United States Patent 7,625,699 (GENETIC POLYMORPHISMS ASSOCIATED WITH CORONARY STENOSIS, METHODS OF DETECTION AND USES THEREOF) - sequence listing, part 6

SEQ ID NO: 12289 - DNA, 663098 bp, Homo sapiens
  misc_feature (1)...(663098): n = A,T,C or G, or insertion/deletion polymorphism (see Tables 1-2)
acagaaggatccaggggaaaggggagagaaagcatggctcattgcaagagtgcaagggtgtcagaatggcttagagctgagggatttgggaatagggagatctgaggctagaggggctggcagggacagatgatgggggctcttgtagggagggtctagcagggagcttggattttactctgtaggccataggggaaagtccggggaagacagaggagctgtgaaatcaggtgagtgttttaaaaagatagctggtggcagagaggaagatgcattgaatagggcaagagcagagatgggcacttgttactcagttgttgtaagtaacctgaaacatagccattgtggactctggttagaatctgggaggtgtctaggaggcagaatctggagggctcagtgatggcttgatgtggggactgggcaagatgggagtccaggataaataggtttctggctcaggatctgggtggatgtggaaactgttccctgaattggggagctgagcagagaggcaggctggggtggagaactagaagtggataagcccaggtctgagcaggctgtggtggaaggggtggggtggggctcctatgagacatctgaggagagagaatgccagatacaatacagaccctgggacttgggagaaaagaggtttccatcctagagttgcccatccaccagcagggacaaataagaaagccagcaattatggagagactgttgagtcagaagagaggtctatttccaccccacacccttccttggtaccctgtgagtgctgcagatttacacactgtgtcctccctccctgagstggcccactctgtgctttcttcctagaaagtgctggttctcacctgccctttcccataggctgagctaggagcccttcttatttccatcacatgctatatctcttctggagtaatcaatcatgctttgctgtttaacgctgttctcaataaactctcaaccccctgaggacaggggccatgggaatgtcttattcttctttatatttgtttcctcaacacctagcacagactctgacatgcagctcagtgtggcatgaacaaatgaatgaaagagtaagtgaagagtaagtgaatgactacacaagatactatgcaaaaaatgagcaagcctgcataaaagtattgctagctgctgtaacaaactccaatatttcaatggcttaacaccctgttttgtcactggcatgaactctttttccttatacacaaatgaagaattttcaccaagaatgtcagaatttggtgaccacagcatgtggtagcactagaggaatggcctaggctgtgggccccttctcacttctccctcctggtttcagaagcccacagcctcaccttggtgtggtctgggctttttcctcatgaagcccctctgtcgccactccttgggcagcagatcactgccacctctatggtgatagcctcgcccttgggagatactcgctttggcctgatcatgctcatgattttaaaattgtgccccatttgggatcctaagcttttcctctgagcccatctttgtcctgtagcccttctctgcagccctgcctgccccttggcctctatttctgccctcgcattgctagaatctcccatttgctctctctctctctctctctctctctctctctctctctctcagcttcagaaggctttttgatcttttcctgggtcagaatgaaaatttcagggcatcaagtctacagctcctccttgaatgaggcagagttctccagagcatcaggccttgtattctttctaaatcaaactctgattttatctggatattaggcttatcttggctagtcactagactgcattgggcttttttgcaatgtgatattgtaaagacacctcaacccacgactgcctgttgctcacagggagaatgagaggggcaggcagggagccagcacttggggctgggctgagacccacactctcctaggctagatgcgggtaggctgttatgtctttgactcctgcctctccattgccctgcagatgtttccagggtccccatctctgcctttgcccccatgtttcctggctcagactattgcagtagtcttctaagtggtaccctttcctttcttaccctttcctcacagagaagttagagtatatgtcaggccacatcacttggcgtctctttcccagaaatgaaaacctacctttcatattcagagctgtctacttttcactaaaggagccatgctatacacagaaaataaatgtaaacagatatctctttacatatattttctgactgtcaagcatctctctcctccctccatctgaaaagtcatctcctcctgttatagaatgaattgtgtgcccccccacccaaattcataggttgaagtccgaacccctagtacttcaggatgtgaccttatttggaggtagagtctttaaaaagtcagttaagtcaaaatgaggtcattgggttgggccttaatccagtatgactggtgtcctgattagaagtttggacacagatatgtaccatgggaacacatgtgaggacacagggagaagaaggcagccatctacaagccagagagagaagcctcagagggaaccaactgtgtcgacctcttgatcttggacttccagcctccagaattgtgaggcaatacatttctgttttttaagccacagggtctatggtactttgttgtggcagcagtcctagcaaattaatacaccttctatttctcactggctaagaataaaatgcaaactcctcgccatcccctaatagaccctatgtgatctgccccactccctatctcccattgcttacctggatccagccccatcctcctcctcctggccccctttcctttttacagccttgcctgtgctcactataccaaaagctctttccccaactttgcatggctgccttgcttaattctattattatattaattaattaattaattaattcatagacagatagtctggctctgtcacccaggctggagtgcagtggtgtgatcatggctcactgcagccttgaacagctgggctcaaatgatcctctggctttagcctcctgagcatcttgcttaattttagatcccatcttccaccgttgccatctcagagaggccttctcagaccatctccttaaagcacatccccatattgtttctcctagcaccataaactttccttttgtagcatccttaattagtaactttatgtgtatttgtatacatattttctgccttcatcaagtcagggactgtgcactaggtgtatattcattgtctagcacagcacccaggcacataatgatgctcaataaatatttgttgagtaaatgaatcttcatcttttcaaggtctttatccatgtctcaggttccagaccaaatcctactttccttcttaaattagccttctgatcccccaagtccaggaaaagctcactgtcttgacatgcctctcggtagcatgccggttcttcagtcatggtgattatcgctgtctgacggtatcagttacgtgtgggtttccacctctggcctgcatcctcccaaagcaggaccacacactgtgcatctctgcagggcccagagcacagcctcgctcagggcccccgagcacaggaggcgctcagtgaaagcacgtggacccaaatagatcagagagcaggaatggcggaggatgtgagtaactgggccttttgcagggataaaataggtgccctgccctccacagcccccagggagaaggatgacaaacgctccttttgcccgggaaagttctgggggtaaatctcatctgcccgttgcagccacagagcaaagttctggagctgagaagagggtaagagaaagcccattggmctgcagccccagaattacagagcagcccagactctcttctgcccagctgtgggctgcacaggaggcctgggcatctctgccagttcctttctctggaggagaaccccgcctccaagagaggggtaaagtcggagcttagaagccaggagcccacccccaggcaagcccagctaacagcccccaaggccaccaccaccactcactgctggcgtagtcagtcccttcctcctctccagggctggtgggaaggctgagccctctctttcgggggctgagtctggacaatgggaagggagaagccccctcctcactgcccmgggaacataaagcaggcctttcactgaggagttctggctgcttcggttggttcttggcacccagcaaggcggcgtcgggaggggcgggcatacaagcgtgttgggggtggggaccaggcccgcgattctgaggagattcgcccgcccagggccaccgggctggctccccagctgtgggatgagctcatgcagggaaaccggaacaacttggggtggggggagggaggaagagtggcatctaggaggctgcgaaagcgtggctctggggaggaagtttttcatggggagtagggacaagcctccactcctccagccctgcccccgccccccaattcatatcgtcaactccacagcccctcttcacacccttccttggatggaaattcctggccacgctgacagccggccaacctgggtcgccagccacccccagcctggctcgccatccctacagtccctctccacacccttccccggaaattctcaggccccaccgcccgccggccactgcccccttggccacacagatgccaacgctccgttttggccaaatcaggctgccctaagcccggagcacagcttctctggggtgtgtcggcaaagggggcgggggtgcccatcgcaggtgcctttccactgcacgcgccagcaggagcctcctctctggaccttgcccctcccagtttcctccagcctccccccatgaagcgtctcttccctctcgccgagagtttggcgtagacagcgaaggagccatcgtgactggcggagaagcctggagtagacgagacagagacggcgaccgagtcgggtgggggatggggtggggaccgacactaagcccttggggcctagaggcagccgctactggggagaggtggggagcagctcacgtccttgggaagaactctcttggtttggggccttggctgggaggaggaaggggagaggaagaagtaggatccgattatttaaatttggggataaattgtactagtaactcttgcaccgtccttccaccaacctcactccccacccccaactcgcgtgcacacagggaccgcctctgccaccctgagatttttgtcttagggtaggagtgggaccgcactgggtcaaatgaaccggttcccccccctccccaccccacacacaacccccctccaccgccctccaattcttaaccctgcctctgtctacgcacacacgcccctctcctgggatggggtaggaggctattgtgaatgaggctcataagcatcgcccccggccctagatggcaagttcaaagccaccacccaagatcagctggtaagagccaagacttggggaacgcgtccttctttggttaccttttcccagacaggattccaatttccaaacgtggaagaggtgtgcgtgtatgtgcctgtgtgtgtgagtgcgtgtgtctctgtcactgtgtgtgtgtgtgtgtgtttgtgtgtgtgtgtgtggagaggggggtgtattaatgggtgatgttataaatgaaaacaggaggactgaacttaaaagaaactggtcaattgcaaaacaracacggataaacaaccctttagatgtaatttgtggtttatctggaggtggaggtggcgctgaagaggaacccccgccccccaatattttatccttagctgcgcctccacccccagcatttggagcggcggagaagcggctccggagtgattaatccggggataattcaccccctcccgccccccggcgcgaaccccgcgaagcgggattggagcgagtcatttccgagagcgcagcgcgcctctccccggccgggcggacacttggttcattccagccgcagaagctcagggctcccgcgtaccgggattttttccgagcagaaaaaagctccagagctctcctgacctcctttctcctcggcggcgagcggagcctctccctcggcgctgccggccgcgccatgccgcgctcgcggggacgggagctggggcgctgcggctgccccgcggggagggctcgcggcgaaaccgggatttcggcgcttgtgccgggcgccgggagccgctggggccgcccgccgccgccaacgccgccgcctctgctgctgttgctgggctgtgggttgctcagcgtctcggccgccgcgggtgagtccagccgcgccgaggagccagcggccgccgcgcgccccacccgagccccgagcccacccatcctcgacccggtcccagtccctccccccgcctctatccctgcctgaatctcccaccctcccagttgcctactctcattctcatccctgcctccgtctcccaccccaccctcagccacgtcctcacctccaccctcaccctcactgctgccccaaccccagccgcaacttggacggatgcggccggtgtgggggcctgggagacagacatccccgcccggggttgcggggcacctggtctgtggcttcagtttctccagcctcccagcccccacggtgctaggctttttcccgataaactttccrggagccctactcccccggctcctgattctgccaggcacgctggtcctgggggctggagaggaaccgtgcgccccctccccatttctgcgtctgcaaggtctgcccttccctgcccccgcccattttctccaattgaaaccggtgccccctctggaaccgactgcagactgcggccgccatccccctcctcaaatgctacccctccctcggcgctcggagctaggagggggttcaggtggacgcgtgcccacggtgggggtcccgcgcattccttgcaggagggtgcaggtgggggctggagggtgttgagggatgggaaggagggggtgggggttgtagcccgaggcgggggagggagtgccgccgccaggcttcgcgctgccacattcccctcggtgctcactccgcgccaaagtgccctttcccgcgccctgctgcagccgagcgcctcggctgcggcagcggcagcggcggcgcgggcggcgggaccagctcccgacgaccgagtccgggaaggggcagatctagcgggtgcggagagtcccggaacttcgcgggtgtctggctgcagcttgcagcgcgcgggggaggtacgcgaaccttcgagggaacccggtcccctgtggaggctactggccgcgactggtgccctcccgctttacccacagcacccctccgaagctcagttctagctacaagctagaaagttccgtgtgcccgggtggagacgggtccaaaccgggatgcctggaaccgcattttcatttagcccgcgaggctgacacccactgggggagaaaccgaaacacctgctggccaggcctagacctagggcaccttcgacctggagccgtgttttcttttttgtttttgtttttgttttgttttgttttgttttgaaaccaccgattgaacctctgaaggcttggcctggaccaccccagttccccttcttgggaaagtgcgcctctcctctggcaggtcagtgagtggcgagctctctggcccactctggccttcagcgtcttgtgagtctgtcctcgcagaccgtgtcgcccaccgcttaaccgcggcatgttggggttcttggtcagggagggcgccccgagccagctctggctctctcattcctagctgaygggactttcttaggttctgctaagagtcatagccaccgacacccagagaggggcgcccgcggtgcgcgcgcctgggagctctggcctctcgcacacccacacccactgggaggctgtgcataccgacgctgctggtcacccagacttgccacatggrcggtgggggaatcgctgctacctcccgccaggcctcccggacgtacgttgaggcgaggccggtctctggcttagctgattggagaatgtctcggcatcggactgaattgtttttctggctagatttgtccctgccccttgggcatatcctgcccctaggggagagaaaaaggccgactcaccggcgcttgcmccgctcagcggtgctggaatcctgccctatagagatccatttgctcgcagctccttgctcagtagagaagttgcggggagggggccttgtgttcatggcttggggtagttcctctccggcaggccctgctctggcttgcaagcttccagtacatttcttttcttttcttctctttctttttaaattttttttaagacggagttttgctcttctcgcccaggctggagtgcaatggcgcggtctcagctcactgcaacctccgcctccygggttcaagcgattctcctgcctcagtcttccgagtagctgggattacaggcgaccgtcaccacgcccggttaatttttgtatttttaggagagatggggtttcaccatgttggccaggctggtctcragctcctgacttcaggtgatccgcctgcctctgcctcccaaagtgctgggcttacagatgtgagccaccgcgcccagcccagtacatttctttttaagcctttcccgcctttagatgggctgtttggccttgcaggcagcagagatttggaaatggacttggtgacagaagatcggcaggatttggtacattagaaggggaaacacattcattttgtgttcagttcacactgttgaatttaaaagatgctcaggactgaaccgtctcccttcctcggctcagtgatcactggataaatgaataaaatrgtttgaaaaaggggagtctcctcacccacccataccttctcccctcaacccctttagtccttgtcctgccttgcactccccctycccctccccaccccagcctccctggagacttcccaccaattacctgctgtccctatcaatcatcctcccttttttttttttttttttttgagagggagtttcactcttttgttgtccaggctggagtgcaatggcgcaatctcggcttgctgcaacctctgcctcccgggttcaagtgattctcctgcctcagcctcctgagtagctgtgattacaggcgcatgccaccatgcccagctaattttgtatttttaatagagaaggggggtttctccatgttggtcaggctggtctcgaactcctgacctcatgatctgcccaccttgccctcccaaagtgctgggattacaggcgtgatccaccgcacctggccaccctcccttcttaaaacacatttccctttgacctgtgaacaggctcatctttaccacaaaacaagccaagaagccttcttggccctattgacctatctaagccactgccccatctctttttgtcttttagtcacttctcttcaaaggggtcttcatgtcagttttctctactacccgtcactccttacttcarcctctgtctccaggatgacactggaacactctagaagagagcaccaatgaccacctcaattgccaaatacattgtactttatctttattttcttttatctctctgtggctgtggccactttggatgaatttctcttccttgggcttctgggacactatgttttactgatttttctcctatctcttgcgtgttccttctcagtctctaatactaacacttattcccctccctgaagtatagtgtcctgcagcatttaattctttgtamtttttcccattccttttcaccactctctgggtgagctcatccttgcccaaccctttcactaccacactctgaagcttccagacagatctcttctgccaagacatctctcctgaaattcatctattggcttcctggtccatgggaattctgggtctaggtaacccatrtatccagctgatccttggacatcttcacttagatatttcccttccagagcaatcttaytagcttctttcttaagcctcccgtatttcctttgtgagctggtggttcctgtagcctcccagttatggagcccagaaacctttggattatcctcaactccttccttatcatatggtcatcaaattctgtcagtttcatatcctcaattattctcgaacctagctactttccttgaggagctctgagcattgaaaaagctatcatgccttccactcccttactaactaatttttaaaaagcaatattaaactataagtagatagtttaagtagatggaattctgacaaagttctgatttttcccgtgccaattayatcatggctttaaaaaaatcaaatgccaaattaaaaaaatttcccctgctttgtatgttgtctgagtgcttgcttttagtcagcctcttgtagactagagcactgactgtactcaatgttctactgtagtacaaactgaattgtattaaaaagcatttatttgtctgccttatatattaaaatgtgagcttactgaaggcagggatggtgctttatttctcttggtatccccatatccagctcaggttctggcatagaattggtgcttgatgtatggctgtttgatcagatgatttttacagttttctttttcttggagagttttccaaggactgataagactaaatcgggggtcaaggaagccagctggtttgcagaggtaataagatgacaaagacatctggtcccctgttcctttccccacaactaagtatcaccgtttggttacagttccctaggttctagaaccaatgcaacaataagcccttggcataccactctcctccaaccctgagccaaggaaaggcgtttcactactcagtcaccagtgtgtgtatgaatttgaatttccatttgcaatcaagctgagggtttatggtttttaaaaaatgagctgactgcagcggagagtgcccaccatatctagggctggtgagtgtgtggctttgttgaaggtgagattagaatcatgcaccagggactggaggaccaaattgcagggtcttggacactgcctggtttgggtttctccggcagagcccagcaggcagcttcagcagcacccccttcaccctcattcatgtgcctgacctgcctgtttcaccctcatcatcacgccagcaggattaagggaacctgattgctccgcagagccttgctggagacccagctgatcttcaggcctctctagggctcagtctccctgctgtaaaaaggacaagtaattcctgagtttttggaaggattagaaaccagagatgcaacgagtccagtgccatacctcatcgaatgtgcctattaaatagaagctggggccaaaggaatcagccaggaagtctatgtgccctcaccatgtccttccccacctaccatgctcagagagctgttctggacacccaggggagttataataacagctcatattcactgagtactcaccggcactgtcttaagcacttggatgtattaactcaatcctctcagcaacccagtgaagcctgcagtattattattcccatttcatagatgaagaaacaggttcagagaggacacataacttatccacgcactaagtaaatagccgagccacagtttggatgcaggcctggctgacgccatatcttttactcataaccttgttgccattcaacttcttggggacccagctggtaccacgtccctggaagcgtctgcccaggctgccttctttggccttgctcttcccactgggctgtcctcatcagttatactgtgctgcttttgaggcctgaatcccacacttctaatcctcaagcagctattgtccattcctttccaccacaagctcctgggkkggggggggggcaggctgtaaagtcattcttggtttctagccccaaacacccatctagatggaactctactgtgggttcttacaactcctcacatttcctttgttgtcagagtcatcaggacatattggaatttcttgcttagtgaggtggttatctgtctcatttccctaaaggactgtgaactgaggcagggcagtgtagagcacatagtggacactcagtaagtgtgctgatgagacagtcagagctgatgagacaatcagaggcaggttgtttggagcccagggctccctttcctttagaccaccctgttgggcattcccaagggcagctgggggctgggaagactggaaacgggttaaggggcatcttcaagtaggaggcagccccaggcccatctgcacaataataatagctctcctttaccgagtgctggttaaatgctttgtagacattaccatttaattatcactgtaatattgtatttgaagatactgaggctcagaaagtaagcagctgggccaaggctgtagagcaggtaggtaaagaaggcgggattwaacctcaagtctacctgaccctagggcccatctttttggaaagcccttgttacagtgctgggcccattgttaccattcaatacatgttagatactattactattactacaactacggtctacttgctttcagcaccagcctcttagaaatataagagaaacaattcatacactctgccactctctggcaccactatacccagtggggggagtcttttctctttgctcctctggctgaaagcacacaccttagaacctggtcccctcactcaacccatcaacccagctcagtgcccttcatccaggagggtagggagggagaaccctctacctcgagaatgcactgcattgccctccctggatttatctccttgggtggcatatggccttgcacccctcctctccatctgctgcagtgtcgtgagagcttccccaacaacaggggaacatcggggtgaacctgcaaatagaggattatttcagagtctttatgcttacaaagactctgtctcagggttcactcgctttgagaagggcttggttttcccttggacccacagaaagcaaagagtgggctatgcaacgtgggagtttctctacttgaaaatgatggcgtggctctcagagctcttttcttactcttgtaagttaagagaaacaaaggaaactcatatttatttttcccctggactctagagagctcaatctcctggactgtcttttcatactcctcttctaaaaatgagattctttatcttcttttcttctctcccacccaaacacacacttagttcttagagctttgggagaaggtgagacccctttggccttctcaggtagcttaatgtcacatgaaagatagtcatgacccactatacatccacaaatgtgaactttagccaaacagcagatgagagggaaggagatggagtggaacatgatggggtgggattggagaaacagcctaatttgaggtagactgagctcaagtaggaaggtgtaagttgggtaggatcaaaggtgggttgggatgtgttggcacaggatagatagagtgagacaggtgatggaatggaatgggataggattgagtgagatgtgatgtcggggatgggatcgagagggtggggtgtgcagtattcaggggattgactgggatggggggtgaggtggggagggaatgtgttagaagacactggggtgggatgggataagatggggtgggtggagttggggtcgagtagaatggaacaattgggatatgatggaggggaggtgagatgtattgtggtagaatggcatgagatagaggtgagtcagatttattgggatggtttgggttggttgagttggaacaagagactgggagataagatggggttattatataaccaattgaataggcaccaactgagtggacatgaggaaatgggaagtgagggagggcactggaaataccttgacccgcctcacattgttgtagcatcttcatcttcctgaccaggactttgtgaacgttggtcagtttctttctcacctgaattgtgaaatttccagcagacataaagtctccattagcctttggtcccataaagcatgaatcctaaaatgctggaggctcccttttcctgccataagggatcattcttcagggagaccctgggagtcccatgtggccaccaccaggaaaccatccgaaaaatatgcytggcacaaaccaggaaccccagggcagctcctatcaagtccaccatcagagaaagacattgtgcctaccctagagctagcacagtggctccactcacagaaaggaaagccgaggatggagtaggggtttacctccatggccccctctgctgggcgagtctctctcctagagactctcttactttccacctgtttgtgtttgtattgttggaaaattttaaactgaatttgtctttcaagggatgtcagtcccacccttgaaaaatcattattataaggaacttttatgatgctaaaaataatgtatgtatagttaaattactgmgagcaccaaattactctgagaaatttacttgagaatctcctgtgccatctagaacagaaaataagggcttatattgcaacacaaatagccttcctacctgctaatgtctaatttataccaattaagtgcaattataatccataaacctcaaaaaattatgtgtccatcttcaaggttttcaaatagaaaacagaataagttctattattaagtasgtacatctatttattgattgaaagtaagtgagtgtgacggatgtaactgtaaagggaaaaagcagagactttgaaatttgagatacaagtatattatgagagaatgtgcagacattttgtgcagaatgattgatggccctttctgagatgagcaagtgtggtagagtcgactcaggcctcgggaggtttgtcttcaggttgctgcctgaccccaaccctttccctaccccagcctcaatctgtctacctaccaaccttcattgcttcctccattgccatttcaggaatggagagagttcagtgattgggtgrgacttggtgatggtgtgtggacttggcagtaagaargagatgacagtttaatggtttattttcaattaatgctaaaatgttcctagcacgaaaacagacatctcaatgttggcatcccctcctgccagggacctatgtggccctatcctcctggccttatcatatgtgcattcctagaagggctgactcatagcagatcctcagccaggagaaaggccttgtttggcctaggagtcaggaattcagccttccaggcttggctatgcccctaaccacctatgtgaacagaagccaatcgtttcatcttcctaggcctctattttcacacctataaaatggggataataatacacagtgtgtctatgcaatgatggacttggaagctctttaaaaaagaagcgtccaaagagaagccagagctattagaataagaccaaaaaagtttctagtttaagcccatccagtgggagatcctgcccagggctcgggctgcttggctttccagggatggggagctcacgacctctgcagacagcttgccaggctatttttcaggtctcaggggtgagaaggagggtgggcttgctgagcttcttggccttgatccattcttaccctccagtggcctgtgggactgctcctgaaaactcaaaagggaagaaacaagccatctccatccagagcccatcagacatcctggtcacagccttttccccaaccaccacccacccctgggcagcagcactgtgagttcagtctcggagagttgactgcttgggcttcactctcactaacacattcgtccagggtaccagatctgaatgaggcctttaactatagcaagaggaaaattccctgcattcgagaacctctgggactcacatctcctacgatattttgttctaaggaacatggaaagaagacagtgttacagggacagttttcctgagttacgtggaaggcacagttgacgttttctgttttctgcaccccaccaagtctcaggtgggtaacatttgaattaatcctaccctcagtccattagcactttatgatcacctctctgtgcaaaacttctctcttatttacaaagtttgcctcccttcatccccaatcctgaagctaagctatcccaatcccaataagtactcattctgatgtgtttgatatatgtcttcaaatatgcatggatccaggcagggcgcggtggctcacgcctgtaatcccagcgctttgggaggctgaggcaggcagatcacgaggtcaggagtttgagaccagcctgatcaaaatggcaaaaccccgtctctactaaaaatacaaaaattagccaggcgtggtggtgtgcacctgtaatcccagcttcttaggaggctgaggcaggagaatcgcttgaacctgggaggtggagtttgcagtgagccgagattgcatcactgcactccagcctgggtgatagaacaagactccatctcaaaaaaaaaaaaaaaaaagcctggatccttataaaatgtgtagggttgtttgtatgtatatgtattttttatttctataaatgatattgaagtctaaatttcatctggtttcttactttatttactcaactccatattttgcatatctcaccatgctcattgagtgtacctagtcagtggtttctaactgcttcattgcattatgagttatacatccatcacgttttacgtatctgttcccctgaggatagccatctagcttatcagcaactcccccttactccaccactaaaagttctgaagaacatccttgtacattcccatttgggaccctgtgtgagaatagttctggactatatgatggaagatttggtccctgggttagtgtgttaatttttcatgttctgccatgatgtttttcagagcaccatggaaatggtgtgccaggtcacatttccactaagagtgcccaagagtttctgtcttcccacgtcctcatgagtacctaatattagccacctgtccaattttgccatttttaggagtgtaaagtgccatctcgttgtattaatttacacttctctgattactagcaagtctgttaagtctagtaagcttgttagctgtttgaacttyttttcttctgaattacctatttatattctttgcccatttaaaaattggatctcttgccttagaratcttccggttgatttgtagaagttttgtttatagtctaggtgttgccctttgttaattttagaagttgcagatagcttcttctagtctttaatccatctatttggcatatggcagctttcgttggacagaaatgcttccttttgatatagtcagatccatcagtgtttttggggaggtagaaattgagataggagggcactgatgagctagagagcatggtggggtcccatgggcccactcccttgcagggctggctctctgtatagagggctctgaggagttctagaaccttcctgtccatccatcctgggcccccacatcctacaggaggtttctggctcaaggccctgtgtttcccgaaggccccagttaaagtacaatttaatggatggatgctatacctagagaatgggcaggattactccttsarcaggcagttattgagtgcctctgtgcgcctgagctctcagcagcactggggacatgggcaagtttcagtgctgagtgtacataagagaggcagctacacacaggctcasagcagcattattcacaacagccaaatggcggaagcaacccatgtgtccatgtgcagatgagtggataaacaaaatgtggtatatccatatgataatctttcagctttaaaaagcaaggaaattctgacacctgctacagcatggctgaaccttgaggacatcatgctaagtgaaagaaaccagttacaggccaggtgcgctggctcacacctataatcccagcactttgggaggcctaggcaggtggatcgcctcaggccaggagttcaagaccagcctggccaacatggtgtaactctgtctctactaaaaatacaaaaatcagccgggcacgttggtgcgcacctgtagtcccagctactcgggaggctgggtcacaagaatcacttgaacccaggaggtggaggctgcagtgagccgagatcgcrccactgcattccaccyggggtgacagagcgagagtctgtctccaaaaaaaaattaaaaagaaaggagccagttacaaaagggcaaataaatacctaccatatgctttcactgatgtgtgaggtatttagcacaggcaaattcatagagacagaaaatagaatggtggttgccaggggctggggagggagagatggggagttaatcatttaatgggcactgactttcagttttgcaagatggagagagatctgtggatggatggtgggtgatgttagctcaacagtgtgaatggacttaatgccactacattatatacttctaagtggttcagattgcacacttatgttatatgtattttaccacaatttttataaaagaagagggacaactctttagacacaagggatcaaggaaagctcccagagaaggatgttcaagccgagacctgcaggatcaacaggagtgagcaggtgaagaggggagcaggaaatggcttgcgacagtgcaggttcatctgcatgggctcctggttgagtgagagtgggttgttccaggtctggaagaaggtttgctcaccaaagaagggcattgaggaggctggaggrtttggagaagggggatggctggctggcttggcyggcagccacaggtctctgaaaaaacacaatgagggtagggtgctactggcaaaggcaggccttggtgagggtgcctggagccccacatcagcaaattggggctgaggggatcctttttcttccacaagtcctctacctggtgccctggcctcccagggagggtaaacagctgagtgaacagtcaaaagtacatgaaacccattccatgaatcatggatcataagttatggttctgttcatcatgcctccatgagaacatcacaaaacttccatctagaaaggaaataggccaagtgtggtggcttgtgcctctcatcccagcagtttggaaggccraggtgggaggattgcttgaggccaggagtttgagaccagcctaagtgacaaaaagtgaggcctcttctgtataaaaataaataaataaataattagctgggtatagtggcatgtgcctgtagtcctagctactcgagaggctgaggccgggggatggcttgagcccaggacttggaggctgcagtgagctatgattgtgccactacactccagcctgggtgacagaattagaagaccctgtttctcttaaaaatgtgactgaaagaaaggaagagagaaggggggggagggagggagggaggaaggaagcaagggagtgagggaggaaagaagaaataaaagaaaaatagaaagtctacctacttgggctgagtcagcaagtcctttccaggtgctgtctgtggggagacctgctatcttctaccttgtccaggccatgtgtgcctgtcaaccttttgttccttccgcctctctcctttcctctcccttctctgccaatctcctccacttatgtcttttcctttcttttcctgtccatccccttccctagtcctgctacttcccaagaaaccaggattccctctcattgtaagtcatcctcctccccatcctcagccttgccatctgtgagagcctcttcctgacctttsaccttgctgcctccaccctcaccccagccaggaccctcccctccgtggccttttctttaaccaggcttcaaccccatacctctgtcatcaaggtggctttttaaggcctttagctgctcccgtctgcctaggagcattgggactggctcatggaacactcactgagtacctagtgcagtggycctgggttgggggtcatggacacaaataccttttaaaaccaagttccttcccccagggacagttataagctactaaaggccaaaggagctccaagcacagcagagggggagaggggaagaaggaagacttcattcagaaggtgccagcaggctcttcaaaagtgagcagggattcggttgaaggagagcaatttgcaggtagaatatcttcgagggagcagctagacaaagacttaaagcagcaggctgtgcttgggagatgtcaagtttgcatccccygccccccctttatcagcatcatagtcttccttgtggaagctgtcccttagtttttatttttatcttttttataggcagagtcttgatctgtcacccaggctggagtgcagtggtatgatcatgtctcaatgtaacctcgacctcatgggctcaagtgatcctcctgcttcagcctcctgagtagctggggctataggcacatgccaccacccttggctatttttttttctaaacttttttgtagaaatgggggtcttgctmtgttgcccgggctagtcttgcactcctgacctcaagtaatcttcccccttcagcctcccaaagggccaggattacaagcgtgagctgcagtccctggttggctgtcccttgttgaacactcaggccctatgcttagtgagagctgctcattcctcccttaccccttacaaaactcctaagaattctgtcattttgcagttgaggaaactgaggtttaaggaaattaaattacttgctaagaccacacaagtagggagggggagagcctggatttaaacctagtctrattctagagcccataggcttaaccactgtacaggtttcccagttaaaaatgtagattctggccaggtgcagtggctcacrtctgtaatcccagcactctgagagactaaggtgggagacttgcttgaggccagtagttcaagrccaacctgggcagcatagtaataccctgtctctacaaaaaataaaaatattagctgggtgtggtggcggcacacgcctgtagtcccagcaagtcaggaggctgaggcaagaggattgcttgagcccaggaggtcaaggctgcagtgagccatgattgcaccactgcactctagcctgggtcacagagcaagaccctgtctcaaaaaaaaamaaaaaaaaaaraaagaagaaaaatgtagatttccaggtcttcctctgattttctgaatcagaggatctgagagcagggtgcagggatctgcgtctttaatgagttcttcctgctyaccttctgatgaccctggtcttaaccccactcaggaatgactagaagaagggctcaggtcctgggtgtctttgagcaaaggctctgcctccacaagtcagcccacacctgggctacctttgcagcaccgccttcccctccctctgtccctcctttacaattagccctggtgctggtgccataaggacatgttcccagggagtgcagcagcccagaggttgtcaccaggctgaccagatttgtgttgatgagattaggcagccccctggaagagcctgggaaggcaccagccccaaaggcacgcattagcattcctaaactgcttaatacacttcacaaaagggctgttggtgagggttggcctgacagcttggagctcctgaatcactaagtctttcctccagccctggatttgttaggtgagaaatcaggacactcaggggagtcttatcctcaacttcttccgtgtactaattcccattattctggatttaatactctctgaagggcagacacacagcaytgaaatgccgttttcttcgggcctgtwggtggggggcagctggcatttcaggatgaggcattgcaggcaggctgaggtgaggccagccagccgggagatgaggaagctacagagggtggggctgaggaggccagggtccagccttcactttctccctggctggaacaggacctcggacccagggyggggagcaggcagggtagaaggaccctagctcagtgaaggggtatttagagagtctgtggtcccagtgaggacccaaggggctcagcagggaaactgaggcaaatggccagttatgcaaatagggctgtgaaggtaggaagcacagtaacactgggaggcccagagatggcattcattcatttattcagccattcctggggtttcattcattccttgggtttgaggaagtaaagtagggactagtaaataaatgctcggggagggcaaagstttcatgaccagatgagtgtgggaaacactagacccttggcttctgaggtgtggttcaaggccttgccaggaagcttkttagaaatggagcctcttggaccccatccgccacctactgcacctaaattttaacaagatccccaggtcaattcctgtgcctgtgagagtctgagaagcactaggcggtgcattctctgagcacagactttagaataaggccgaccccagcaaaccttcgtcctagttcattcttggcctcagttttcacattagtaaaatggggcaaaaatcctgacttcaaagtcatgcttgtaaaggtccatgcttgcagagtgcctggctcagagcatgcagctctcctgcccctttgtcctgatgagtctgtgcccccactgaaggagggggtttggcccttttgttcactgctgtgtccgcagatgtagcacagtacctgcagcatggtggatgctcaataaatattgtgaatgaatgaatgaatgaatgaattacacgtcaagtggttgtcagatcaaactgaacatgctggagactgctttcgggagcagcaaagatgcaattttccttttgttttctgttgctgcaccaaattacrgcagatttttcagagtgaaggattgctgagagactgggcaaggggccggtggaggtttttgatgcrgagcaatgagatagttgctctgtgtctgcctgtgtttcaggaaaattctgttattactgaaatctttggtttgaaagccactgttagaactaaatattttgggaaatgttagccattaacaccttagtaagaatgagccgattagtccagaaagtaggatcaggtaggtggcaagggggtagacttctatggatctggaccctcccagtgtccctgggcctcaacgagattttgaacctagaagttcatcttacccaatgctgtgcctctctttactcttgctccagcccttgtgggcccctccctctcaactcagtccctagagtgtcctgcctctggctttcgaccactctggaccacaggctctgtcctggggccattctcatctctgtggcagcctcacccgctcactctcttgaacaaccttgtgtcctacttcatagaaaagttgacactaaaggaaacagctgcgtgagccttgctgctgaatttgtgcagggaagcgctgaggacaccataccctgtgttacgcagggacgtcactgccataattggcatccctgtgccccatttctctaactcctccctcccctctgtttccctcccattagcccatgcacacactttctttgtgtcttaataatacactaaaaaacagcccctccctgactctgcacccacttttggctgtcaccccgtctctctcctttcctccccagccatacttcctgagatggtgtctgccaattcatttctcagcacctgttacctggcttacaccctcctcactccgggggaggtgctccagcctagggcaccacatgacttcctgtttactaaatccaagcatctctgccggctcctagaccttccacagtctggccacagccaagcttcctgaccttctgaccatcctcctccctcccctccccctcttcagcgtctgacactgcccatcactccttcccacttaacatttgctttaatattggagcttccagcatttgccttgaccttctctttttattctttatttctttatttttttatttttttattttttgagatggagtgtcgctctgtcacccaggctggagtgcagtggcacgatctcggctcactgcaagctctgcctcccgggttcatgccattctcctgcctcagcctcccgagtagctgggactacasgcgcctgccaccatgcccagctaatttttttgtatttttagtagagatggggtttcaccatgttagccaggatggtcttgatctcttgatctcatgatccgcccgcctcggcctcccaaagtgstgggattacaggcatgagccaccgcgccaggccttatcctttatttcattcgctcctatggctttcatgccactgtccaaatgctgagactctccatacttaggtctctaatgaagaccttgctcctgaactccagaaccgcataactccccactccacacactgaagtcttcattcctgctgtcacctatatgactctctcccacccccagaaactttactctcccaaacttttgtggcccacctctatgaattgcttcatgcatcttcacagtcatgcatcttcctaagccagaaacctgggactcatcctggaattccacccctctctgctccctttcactaaccacatcttatggattttacttctcaaatcattctcaagcatttttctgcatctttgcttggcttggaactcaccccttttctcctgaacagttggaacatagcactcttacaactgcagtggcagggctatggcctcccacatctgtcctagcttcttccaataggtggttcctgcttcagtcagacaaagggagtgactttactctttagaatggaagaggagggacaagacaaakgtcaatgagaagttggtacctcttgaagaactggcaaagagtttgaagcttttgggttaagastggctttggaaggtgcttaaactgatatgccactaacacctgctccctgctggggctctgatgagtagggtaaagacctagaataatggtcaaagggaaaagtactgattcatttattaatagccaggcgtgtgcctgatacccctcaggrcacaggtcctgagctgggctctggtggtacattcctgtaatcctggtgactcgggaggctgaggtgggagattcacttgagcccaggagtgatcatgccatcgcactccagcctgggtgacagagtgagaccctgactctaaacaaacacaaattactggtctttggtgtatcatgttgaagaacatggcttggcctgttgaggctgaatggagctttccacctcctttcaccatgaatctaaatcttgagaatggagcactcaggacatctgcagagttagggctaggattgtgcctctcgagaagcctcagtgtccactttcccagccagctcttggcacgagaatgatgggggkcttgttctactcatcagtttcaggtagaacaggcgtctggtcccttggaagccctccctagcctgggcagaaaggaggtccccctctcctctgtgtgctgagactgccatggggaggggaaaagactcctaaatgcctccccgttcctcgacacaacctaactttgttatggcgcgggatgttctcccgttctctgagttcctcccaagagtcttgtgtttcaaggcactgtttctaccaggctgcactcattaagaaggacatggattcatttccccatttctatttctgtgttttcaggtctgctggtacagatcagctctccccagatcccacctaccctacaaaaattacactgggagatgctgccaaggggcagggaggaggttcattagcattctcagctgcattcagagccacccctccaggcagcaagagggcaaagccatggccgagtgaggaggtgccactcaaagaagcaggcatgcagccctcctgcctttctgctgtcctggtacagaacctcagcccctcccaacttcttatggcctcgactttcctttatcccccatatgtggtctgagttgaggccatgagctatacactttcctaacttgggtggttctgttctttggccctgggaaaaggcatcttcttaggacctcattcttattcactttgtctaagattgaggctaccctcattcatcccccaaatgcacctcatttcactttcctctttcaaagaagcaggcagccttgccaaggggctaaagtttctcatgcagtcaagcggaggggttggggaaccaccatcccttaattggcaagcctctggtgtcccccaagggccacagctcggtctcaccgatcagagtggacaaagggcagtgtgacctcactgattgggaatagttccagcccaaagcagacacttggcatttatttggcctgtgcattttgatcgcggttaaatgcagtttctgttaggctctttgaaatattgaaaatagctcacaaactctcattactgcctttgaagagccacaggggtctgggaaccccaggcagggaatgccgttcttgtccaatttctcctctacaccctcaacaccccctcccttacttcccctctcaagtttggaatgaactgcctaaaaaacacaagaggagtcacatggagagatcaaaatgtcagcttcattaccttaccgataacgctgattggaagacrtggctttggatatgtggcaaaattgtcttgttaatacatcactcttgaattgaagaagttacccactcattcaccagcaaaggaaacagcctcaggcttccctcacaggagcaaggcttgctgggtaagttaagggggtgcaaggtgggttggggctgagctaagtatgccaagttatttccccacaaatgccctttggacaagtcactcttcctccaaggtagggagagagttaagggtcagagagagactggaaaaatgtgtgccactggtacttggtcctctggagcatggactgggaattcattcccctctgtggagacaagagtaggatgaacatgttctctcctaacactgcatggtgaatctggacctgagctggttggcaccgcctgcagctggaggtaactgggacaggcargacctgtcccacccmatcaagaggaatggtaggagccccacccaccttggactcagctgtagmtaccagacagccttggaggtttctcaaagctgttatccagactgagaggagatgttgactaagacattgatcatctggcccgcttatctctgtggcatatttaaataagaaaataaattgttaatttttctctacccttcattgtcccctggaagagtaaatggagaatatatttcaactaggtggattgttaggaaatgrgacaatggtttaaaatgcatcagctctggagtcagacctgattctccttggttaactccttgatagaaactgatgtcagattagggccgggcatcacacatttgctttgcagacaaggggccaaaattgacttgaataatagrcccaaggcaagaggagcaggctggagatgacagagacagttactagtataaagcagtagcaacaccaagacttttcccctccttccttccttctttttttctcccatctgtgtatatgtttaaccaagttgtgttgagctaccaccttgtgccagataccatgctgggttctgggatatagagtttgatgacatgcatgggatctgtcctttggcccacatccccctaagctttcagtctttctaatatatcacctgcagagtggacagataattacacagataatttaaaagcaatgtggtgagcatcacaataaagtttaacayggggcaaggagaggggttatgggagcacacaggaaggtcaggagtctagccagcgcctatcagggatgacttcctgaaggaggcaatgttaaactgagacctggaggtctaggggrcagttagtgtagaaaagactgagaagagtcaatcgcaagtttttcacctggtaaagctattattgttaatggcctgggaggctgctgctctgggtggacaggcactgggacccgtgaggtgccagtctcattctgactctgattatgttgaacacgttgctgtacccaggcactgtgctagatttttatatgattatcatattcagtgggctccagaccccactgaaggtaggtagtataatgattctcattttatagacatagtctgagatttggtggaataagatgacttgcccaaagatcacacagcaggtaaaggatggagctgggactgttgttaccacataacagcatccacatgcggtttcttaatcatgtttttacagctgtttccacacagcacacartgtcrcagccctagatagagtccagcagtggcacaaatcacaaaccatttcaataataatagcactgataatatcatcttcatgtatggagtccctaccatgagcctctgtgccaagcattttgtatacaccatctaatataaaccttaaaacaggtccgtaagagagatggcattattatccccatcttgcagaggggcagaycgaggttcaatcatgttaagtaatgtcacaaaaagtcacacatggttggtaaatgttggagttacatccagggctgcatgactccaaagcccatgctgctgagtggaacactatttcattcctgatacaatttcatgcaagaagatggagagagggggccattctcttcttccatcaccccctgccactttccaggccttcgttttctcatctctataaaggagacagccttctgcctgccttgaacagagatggtgacgggatcaccagggttttgcaaaggccaattccgctgggcttgtaaggtgcttgcagctgaatttcaggacttgcgtctcctggggcaccaggtggcttctgaaaggagactgagggggcagagaagagccgatcttgggccttggctccaaggacaagttgtctgatttgatcctgcagaccgttcatctctggatgagtgtacccccatttgctcgtagttattagatgtgtaaagataacctatttggagactgagggggccgccaggacaggatgacccatctcttccccaaaggccgtggcagcaaaagaatggctcagagaagctgcttagggacacttcatgactcacacatgcagcaaacatgtatggggtgggccctgtacagtgtcacaaagagggaagacagcatccctgccttaaggagctcacatttctatgagggaggcacatcagagcagtcaccgtgcaacgtggtgcccagaaacctggtggtcacccttgatacctctttctccctttccttctctccccacatcaagccatgagcaaatcctgttggctccaccttcaaaataaatccaggatcccagcccctggtgccacccacatcacacccaagggtccgagccatcttcttcttttgcctggacccttccctggtttccctccttgcattctcgcctatttccattttcctccaacctggcagctggagagctttgaacatggttaggcagatcattcattcccctggcatcattcagaaataagtcaaggtctttccatgtgctcacccctcattttcttcctgacctcatccccctaagacttgctcctgcttactctgctccggccagtggcttctctgctgttcctcagacacactgggtgttggggcatgcatgcaaatagatttggggctctccatcccctgggtagccacaaggcccagccatcacttcaataaattcttgttccaacgtcacctccttggagaggtttcctcaaccccctcatccacagtaatcccttccttcgcttaccctgctctggcttccttcatagttcttagaaccacccaacataggatrtatgcattttgaaacatttactgacttctcaagcaaatcccatgagatcaaggagcttgtctatcttgttctctgtggtatgcccaactcctagaacagtgtcttccacatagtaggggcttgatgaatatttatgggatgttgaatgaatgaatacagagggagaaccaagacatgaaaacccagtagatggagttaataactccagtgtatgggggtgggtggggggtatgggtaggttcactgttgggtgatgtgacatttgagatgggacttaaaaggtggagcaggtagttttcaggggaggaaaggagtgggaygtatcccaggaagagcctccaaacctcaaaaggccctatattcacargaggaaatgagaagttctgtgtgttcgagtgttccttgtgtgtgtgtggtggctggggctgcaggaagtgaggctggagggggacaggttgtagaggaggggaaaggctgttcagtgggaagtgattatgagcctggtctctggagctagcccagctgggttcaaatcccagccccacgtgaaaaacttataagtcaccctgggaggagggtatgaaatctttgcttaggacctcagagaaaagtgttgttctctgttctatattytcagaggcatagattggagattgggagagacccaggcttaaatcctgtccctgcttggtactagcctgtgtaaggggcatagtaatctctttaggcctcagttcyccatctctaaaacaggaacagtagtgcctcattcacaaaacctttgtaacaatgcagtgagatgatatacatgatgcatttacctaggcctggcctggtactccctcgtggttgccaaggtgatgggacctgctaaacacagtgggatccgaggcattgggagaacacttgccttgaagctcttggtgaggctgcaggtgttctctagacatttgccaggccttgcttgcaagtggcggtgcctttgctcggagagccagaatttcagcctgctgtccccttcaagctcacagagggccatgctttcttctgccgctgggtttttttttgtttgtttgtttgttttktttttttgcatatgccgattcctctgtctggagtattatcttcccctttcactgcattaaccatggctcaagtttcacttcctcagagaaggccccctgcccccrcagtctaaatcattctcatagaattgtgtgtcttgcccttggataacttatctcagttgatcatgatacattgatcaaagccattaatttattattatcaagcttgctgtctagactggaagcttcaggaggtcagggactttgcctggctttgcttattatcctacctctggaccatggatggtccctggcaaatagtaggccattagttaatatgaagaatgatttagggaccatggaaatgacatgcacaactctagtaaaacattgcctttgcctgttccttcccacacaagactggcaggacaggggagccactttacccatgaatctcacagctttaggagggatgccagtttgtctttttaatttataacaacaacaacaatgaataagatgtactcagtgctccagccgctgtgctaagtactctgtagacattattccttcacttaatggaaacatcattattactgagagaaaagaaagatgctgagaagtttgtataatgtggtactattttaaggaaacaaacaatggcaaacccctactgtatatgtaaatgtgtatatgtgggtatgtcagtttatgtttgtgactctgtctgctttctgtagcttataacataattaccacaaaaatctgaagcctataacaaaattgccacaaactttctgttgcttataatagaataaccacaaaattctaaagaacaaaattacctgaagacggataatttataaagaaaaggaatttatctcttacaattctggaggctgagaagtccaaggtcgaggggctgcatctggtgagggccttcttgctagtggggactctctgcagagtcccatggtggcacagggcatcacatggtgaggggggctgagtgtgccagtccaggaggtctctcttcttcttcttacaaagccaccacttccactcccatgataacccattaatccattaacccattaccccgttaatctatgaatggattaatcacccctgagagcagaggccctcaccttttaaaggccctgcctctcaatactgccactttggggattaagtttcagcacaagttttggatgggacaaacattcaaatggtagtagtatgcatgtggttttataagaaaacatagagatttgggaaaataaaaactagacttcaatatgggttgcctaggagtgagtgttggttagtgggtcatggggttaggtgaggatggggggtgatggagaggaagtcgaatatgaaaaggaaaaataaaaataaaatttcactgaaatcccaatatgatacacaagaagatcatatttatgcattcatgcaaggttatatatgaatgtgtatgtaaaaatatataaaaattgtttcaaaaaaaggagtatatgctggcaagggtgcagtgtgatgggcacttcaataaactgcctgtaggggtgtaaattgttacaaacttgctggaaagcaacttggcactatattatcaacagcctttaaaatattcatatatttggactcgatatttcatttcaaagaatttaccctaaagaaataatcagacatgtagtcaaccatttatgtagaagatgcatagcattacttacaaaagagggaaaaagtgaaaatgaaataagtggccaaccgtaagagagaagttaagctgttacatcaraatcttaattgaagtctcttgacagtcctgtagatatggttactcttaccacctccgttttacagatggagaaaacagaggctcagggaggtgaaggaggttggctgcagtaacacagcaagtggtgtagcaggatttgaacttctacatatttgcaaacatatgagattccttaccttagtgacaagcttgtgatcaaggtaaacatctgtcattcaaatccctctcctggaggaaatcgtacagttccaaagtacaatgtacatgcctcaaacccttaaaaccttgatctgggacctgcttaaccatagtatgtggagggaccccccagaaggatcataaaagggacttcactttcttttaaataaatwgaaagcttgtttagccagcacctgacatagacttaccacttagtaaatactacaacttatgattcacatgattgtgttttcttggttagagaatcagttcagaaaatgggatgttttcttgcttatcattctggtttcccctacttggtttagcttggaaattgtcctcttaatagcagcttgttggagtggcaaggctgaagctttagagtcagactggggtttgaattctgatactgcttctcagcagctgtgtgattttagacaaattacttaacctctgtgaacgcagtttctcctctgagcccctttacctaactcagagaattgcagggaagatgaaattaggtgtcaaatagaaagcacttgacaagtccctgtcttgtattaggtgtctattacatgttaggttccttgccttcccaattggaaagcacagtcttcagtcgaagcactggattgtgagttgctttagccaggttgggccaggttgggccaggctggaacaggctatacactgggccaggagcgctggtgtcatggctagggcttcaccccaggctagagttcaaaggcagragggtgaaggagggaagggagcatagttagctgggcccagaatggacactggaggttacagggtagttttgagcctgatgtgtttactcttactggtagctagaagtcccagctggtcagagaccagcgggggaatctgggcatgagaggaagagaagggatataagtgtggaaaaagacttgctgttaagagtgctcaaagatgttctggtgaaaagagcttagtgggccttgttgaaaaagtaataaggtttcagtcactttttttttcttatactcactgggccttgcttgcygcagtctctttgcctccagagagataagtaagtctaggytatgrggtgggatgaagaggtgcaattgctgaatggatgggtggacggatggatgggatggatagagatagtgggtgatggaagaatggataggtggatgggatggattgctagagagcattgatgggtatttgggatcaatgaataagtggatggggtattagatggggggatggataaatgcatggatgactaggatggaaggatgtgtttgattgatgagtgggtaaagtggaagaatagatgggctagatgggatcaatggatggaatggatgagtraatggaaagatgagtggaagggtgaatgyatggatggcaggattggcttgatagagattatagcaatgaaatgagatggctgaatgaaacaaatgatggaatggacagcaagtagattcatgggatgagtagacatatagacagatgaatgtacaagaggaaasacccatggttggtagatggaaggatgattgaataatagatggatcggagttttcataatttattgtttaagcaaactcatttggggattggctggacaaaaaatggtaataaaggctgaactggataattttattaaaggcatcatgggaattgacaagcgaatgatgcagagaggagtccaggctcctatcccaaggaagtttctctaacaagtgccgttaatgaaaaatcatgatatgtcaggcctgtaaccccagcacagaccatgttcacatagctctgtgaaagactgtgtctgttctcatgcacaaacactgtcttcatgatctctgatctgcaaatatgggatacgtccacactggcgttcacactcacatgtaatatttaatagataacacttgttcacactttttttggaaccaaaagaaactcaatggctaacatccacagcacattcaactgagtgggctgaacccacaggaaggaaaatcaagtggcttaggggttgccttgtttaatggatgtgaggttttttcttagttaaataagtaatttattttgaaagtcaccagttcagtgaaatagtttttaagttttctttactagagcaacctgtgtgactgaagataaagtatagaccagatctctgagtttctcaggcagggcctggatagtcttcaggatgcagttacccaaatgacctaatttttctccccttccagccatgcctctctctcctgcttgctccttctcttccctttaagtttaattagttataactactttttaattactatagaagtaatacatgctcagggcaaaaattcgaatkgcatagaagagcatatggtgaaaaaagcccttctccccactgcagagcccagtcccacttatcaacagtttcttctgaattacttcagaaattttcaaaacatgtaagaaaatgtaaatggaacacaaattatatttcacaaaaatgggatcattgtagatmtatcatatacattaytctgtaacatgcttttttctcttagaaatgtctcttatacctctttctgggtaggtgtacatagatttatctcattcctcttagtggctacatgatatttcataagttactgtaaattagtcaatcagttcttttttttttttttttttttttttgagayggagtcttrctttgttgccaggctggagtgcagtggcgtgatctctgctcacggcaacctccgcctcccgggtttaagcgattctcctgccttagcctcccgagtagctgggactacaggcacgtgccaccacaccagctastttttgtatttttagtagagatggggtttcaccatgttggtcaagatggtctcgatctgttgacctcatgatccacccgcctcggcctcccaaagtgctgggattacaggagtcaatcagttctttattatttaggctttttctagttttgggctaccccaaacaatatcacaacaaaataattgtgtgtgtgtgtgtgtgtgtgtgtgtgtgtgtgtgtgwgatttcaacatgagggcagatgtctatagaatggatttgttgcctcaaaggatatatgcatttgataaacttgccaatttgcattaatttaaayactgccaatagtatttgaaagttctttgtaacgctacattttcgagtacatcagaatcacctggagatcttgttaaamtacagattgcttggcccaggagtttctgattcagtgaatctgtgatcaaataggtctgcagtagagtagatttgggatgagatctgagtatttgaatttctaacaagttctccggtgatgctgatgtgctggtcaaggaaccactgctccatcctttcccaacaactttttaaaaacttgcgaatctgatggaaatcagaaaagtagctcattattgcgttcctttaattataactgaaactaagcatcttttcatgtttcycagttgtctgtatctcttctcctgaaaactatctgtttatgcaccttgcttgttttctatggcattgtttctatttttcttactgatttataagaactctttgcatataaaagacactggctctttaatctgtagtagcatggcaaatcttttttgcartttggacctgtgtttacactctgtggtatctttattttattttttgcatagagagattctacatatttatgcacttaaatttgtcagtgttttggcttctggttttgtgtcatacttagagaaagacctttttccctttaagattatatacaatttaacaatgaatgtgtcttgatgctttcttttataataatttctaatctaaaatagggcagcaaatgttactatggtaatgtagtgactacttatttggawatgaaaatatgaagttttcacatttctgaattaacctaaagggatatttgcggcctctttatcccctaggcctgtcagagagaaaagaaactcccatttcatggctttcccctctccagactattactrtaatgggttgagatttaaagaagagtttgaagatctagggcaaagagtgttggctgttgtcaggcaaacagatgtttctaatgtgatggaggcaccaagagaaccatggagaccacaagcatgaggcatcacagcacacaaatgctccctcctatttctgcctgtttggctgccagagctgctcagtatttttttttttttttttttttttttgagacagagtctyactctgtcacccaggctggagtgtagtggtgcaatctctgcctccccggttcaagcgattctcctgcctcagcctcctgagtagctgggactattggcacacactaccacacccggctaatttttgtatttttagtagagacgggatttcaccatgttggccaggatggtctcaatctcctgacctcgtgatccgcccacctcggcctcccaaagtgctgggattacaggtgtgagtcaccatayccagcctgcccgagttttatattcacactccctacccttgggcatgctctctttgactaagtagcaagatgtactatgggaaaggaacacaagggatgggaaagtgtgaaacatagccttttgcacaacctgtaactatgggctaactgattttttttttcttttggacagagtcttgctctatcacccaagctggagtgcagtggtgcaatattggctcactgcaacctccacctcctgagttcaaatgattctcctgcctcagactccagagtagcaggaattactggcacccaccaccacgcctggctaatttttgtatttttagtagagacagggttttgccatgttgaccaggctggtctcgaactcctgacctcaggtgacccacccacctgagcctcccagagtgctgggattacaggcgtgagctactacacccggcctgggctgactgaattaatggaaccatcattattttgcaaggcttgcttttctattattcagacaacttcaagtgcagagttcagtgctagatactgggatgatatcattcacaagccactgtactggcttgggaggaactggcagtctagtggacagctagatacagaaacaagtggtattgcaaaagagggagagaggtggtaatagaaggtgctagactttacaaggacaggaactatgccttatctgtcattctgtcctaggacgaagcatgaggcctgacactgaggtgcccaaccaatgtttggtgattgaatgaattaatttgaaagctgtattagtcaaggttcaccagagaaatagaaccaaaaaaaaaaaaaaggtgtgtgtgtgtgtttgtgtgtgtgtataaaatttattatgagaattggctcatgcaattatgaaggctgaaaagccccacaatctgccacctgtaagctgcagacccaggaaaactgatggtgtaattcagtctgagtctgaaggcctgaggaaagggatgtgggatagtgggggtgaaccctggtgtaagtcccagagtgtgaaagccytaaaattaggagctctgatatcttatggcaggggaatatcccagctcaaggagagagaatttgcctcttctctgtctatttcttctttcggggacctcaatgaattggatgaggcccacccacattggtgagggttgatctgttttatttagtctccygattccaatgctaatattttcctgaacaccttcacaaacacatccagaaataatgttttcccagctatctgggcatcctttagcccagtcaagttgacacataaagttaactatcacaggaacagaggggagggagcaagtaactacacctgggggaggtcccagaggaggggatatttgggtcttaatcagaagaagaggggtgatagagaagtgggtaacaagcaagatggttctcggtgggtgccacctgttacccaccagggcctgggatgaattccacaatgtcacatggtaagagtgaatcggsgctttattaggggaagggaaagctgactaagggtcagcaggacgaggtgccacaggtctcccattctcccttatgtccatggaggggtgtgctggggccatgatattctgcctgacatccatcccgagtctgttccagaggcgagtcctccctctctcttgctcttcctccttacaggtcaagtgtgtgagtcacctcatcagtgaagggacatgcaagctgcttgggtgtgtgctgtttttaggaattgtctataaggttagctgtcccatacttgggggaatttgtggcccatgagaggttggaatccctcttgtctcttgggaagctgaatttggatgcccctggccccagctagctcatgatttaggcaaccccgagtgagcgctcagaagtattttcaggggatcctgacccttgcattgcagtgggaaagggtgtgtgggctgagaggtgagcttgtgcaaagacagagctgtgccactggatgggaggcagaagaaccccctgactggagactctggcctgggctcatttgaaaacaagaaggaaattttatgcctgatcaggaatgagtaacttggtgatggtggcctcagggatccccactctgtgctgcctcagagagaggcctgggcctggaggctgtggatgggtgtcagcatgagtctgtggcttcaacctgatctccacttcctgcagttcctgatggtgagtaagcccccctcaagctaggtccctggagtggagttggggaagaaggtgcaggatgccaagattgatatgacaccagggccaagtcagcaggcagggtctggtctacacactctcctagagagtgcaagacagggacatccccaggcaggctggcctgtgtaagtaacttgcaagatatatttccctgtttgcttattgaaaagaaaaattaagacccccccctctcctgcacctcccaatagagcagacagaactttgactttgggtcaggtataattcattcttgtctagtactttcactattggctggctctgccaacctctcttcacctcagtgtcctcatctgtaaagtggggttataatagcccctgcctcatgggatagtcaggaaggagaaatgagagcatgcacttgcagggacctagtgcatggcaggtacttaataatgtttaacaaaaatgaagcattgcttggtgaggtgggaggtggagaaacaagagcagggaagggtacggaatgctaggcagaaaggaacaggtaccacattgaatgcaagcatttattgaacacctactatatgctctatctggtggggagatacataaaggagaatcagatgccatatttttttcttgattcctggataggatggtctcggtttgtcctttaaaccaggaagcaagctgtggatgtgcggagatggggacctgggacgggtttctgggaaggaggcccttgaaaacgggctccaagagttggaaaatggatgctatagtcaggagtcatcagagaagaaagacatcctgagagaggagcctaaggatgggtggagggcagggaaggcattgagcgcagggctgagcagggtgagtctttaaagccttctctgtctctccctgggacaatcgatccctggctggtccacctgcttcccctgttctcacctgtggttccttcttcacacagcagctggagaaatcctaaaacatgcagatctgattcggtcacccctcccactgcatacacacagttgaaaccatcccgatttgatctggccttgactgccagtctacccacgcttcccctcccaccactcctgcaygcttctccataccccaggtgtacttgcctttttgcttttactggaaaacaacaaacttttttttttttttttttttttgcctccagacatttcttcctgctgtttttttctgcctggaatgctctctctcccatcttcaaacagttcgctcttaccctgcagatacctgctcagggatggcactgtcagaggtgaccacagtagatgaaggactacatcaccttcttcatagctctgatcatgctcattatatgatctactgttgtttacttgtttactgtctgtctcccccactagacaacaagctgcatgaggatgactacagggactctryacccccagtgccacacacagcacttgataaatatttatcarttgcatgaatgaaaggcacagggtggagtggaagggagagaatgagtggtaattaatgtttcttgagctccccagggcctggagtctcatgttcataatcttatttaattttcccagcatgcctgtgagggaggtattattaatattatgctttccttatagatgagggagctgagactcagagagggtgagcagggcgccccaggtcacacagccagcaagtggcagaagggactgtgaattcagttttgtctgactctgcaggccaggcttgttccttcctgcagtgctgccggatgctctgtgtgtgcagggagcactgagccagtcagagcggcggaggccctggcacatgtgcatgtctgcagtagagggcagtggtgaggatgcaatcccagctatcgtgggctattttattttattttatttatttatttttttgagacagagtcttgctctatcgcctaggctggagtacagtggcgcaatctcggctcactgcaagctccgcctcccgggttcatgccattctcctgcctcagcctcctgagtagctgggactacaggcgcccgccaccatgcccggctaatttttttttatttttagtagagatggggtttcaccgtgttagccaggatggtcacgatctcctgacctcgtgatctgcctgcctcagcctcccaaagtgctgggattacaggcgtgagccacygcgcccagcctatcatgggctcttttaaattcctccctatttacacatatccttccatgtattgtaactgatacatgtaagcacatgtgcacacacacacgcttctacacacaacatgtgttcacatacacagtttcacaagacaggtacactgctttaccactcacaaacacaacatcaggtggaagggacacccagacctttacacagattcttccagaagggcactgataccctagtggagggagggggtggcagcgggacccatggagcctccatccaggatgggagggtgggcatgcagccacgtactaaagagctgtatgcatgagaaccgtgtgtgcaaaatgtatatgtgtgtgtgtgkgggggggggtacacatgtatgtagtggacgtggacgtctgtttctgtagctgttgatgtgtgtgtgcacaggtgtgaattctgcatgccaggacttgggcagttgtgagcatcttgcttagcctgggttccagctcccagctctccagccccaagggtgggtcaggctttgaccttgaacctcccccatccctagtcactgtccttctgagctggcagagtttagggacgacgcccctcctgactacacttcaggctctgtgtggagtggctttcctgggaacaaaagccggtctactcactccccgatgacccaggatatgagtctgcacttgacaaccatgcctggtaacagccagggctcaacaaggccgrcagctgcacagagcctgccaggctgtgtgggtccttcagggaggcgggggcctggtgctctgtgctcagcaagacaggtctatgcctctgcctgaacttcaggcttctttgaacacccaggtcttctcttttggtggagctgccaccacttcgacaacgtgctggcttggagccctcactgtctgtctgtgctttctcagggaggaggaaggttaggagacacaccctcagacccgagcgcagcatcccttcctgcgggtacagtctttgaaggacatgggattcccacaaattctaccaagagtcaccactgagttgagccggagaggttttccgcctcagtctctgcactcagtccttcaggtgctctggggaggagcctcrgaagcttccagtgctgggggctaagtggagcaggcaggggtcagctgcctgggttttgcttggagagaagccctcaaaaaggtccagattgagctcagagtccagagggaatgtgggaggraggacacccctggtcttgggtgtggagcagaactgaggtcagggcgtcggtgaggccgattgctgagaaggtggaggaagaggccacttcccacaaggaagaaatcaagaactgcagccaaggggcaaatggaggtcttgctggcctgagaagagggtgggacgatgggtgtggtggtgcccagccatgcaaggtcccttcaaatgctggagaccccgagactctcaacaactcctctcagagcagcccctttccttggttaccaaggccggccagtctccactgtgcatcccttgaaccactgtcccactaggaccctcagtctctacacgctccagccctgggtcagtcctgcaactcagctctgggcctgccacctggactatgaatcctgctgccactgcgaactcacatctctaacctacgcccagcaccccttaactatctttctatcggccacctggtcagcttcctgtcctaatcctaagagtggccattccaaggcacaaatccctggttccatcacaggatgactaccctggtacctcactgagaacaggcagaccatcagaatggacttccacatcctcctcctacctgtggttacctgcttctgcagccactcctcctcccctcactcctggaggaagaggtggggtctctcccacagtccccagttcccagagcccaggacccctttcttccatctgtcttctttgtgatatgccccttctctcccctctaccctcccattttatttttcttctccactgacttcactccttgaatttaaaacaggttcaaaatagaaggtagaagctttttgggccctgaactcctctctggctgccgccctgttctttgccatttaaagctaagttcctcaaatagtccatactcagtctctggttcttccacttagctcccatggggacctggggggtcggatgccgctgacggagcctttgttgtgaagctgtgcgtggcttcttggtgtctcactctgggtcatgccctcgttgccttccgctatcccyatctggtctctctgttcctgtctgcctcttkcctgtgtctctgtcacttttccgtctctctgtttctttttctgtcctcttgcatctccctggcttgcggtctcactctctatctgccgttgtgtctctttttctatctgcccatctctcttactgcctgttcttttctttgagtccctgattttctctgctctgtctttctttctacctggctgtctctgtgggtcctgtctctgtgtccctattccctcccctgcccgtctctctccccatctatgtctctctctctccccatctatgtctctctctctccccgagtctctccttgcctccgtttccttcctcctggccacaaggacagcctgccttgctagctgtgatgcccctgacagcgagaatcagtgttctttcccactccactccctcctgcagtgtctcccagccctccccatctccctcgtctgggtgtctaactgctgctacaagggagcgagggcacaggactcttagaaatcccaaagggtgtagattttgaagcaaaatgggagcacagcaccttttgtgtcccacacataatacttgggggatgggcagtggctgcaggctrggccccccatgaaatgcttcagctgtgccacctcccataaccgtggccttagaggatcacagagcctgtgctcrtgggcaaggatccttgggttctgcctagccccattacagggaggtagtttagttcaggtctcaaccagcagcaggaggtatgtgctaggtgggctcagccagagtccagggctgtggggaagagctcggctttattttctagggaatggattgggagctgccggaagtgccttaggttgagctccccggaggcagacctgagacaaggattaagtgtaagtagtttaaattggaggtggtccaagaaataccagttgaggaatggtaagggagagtcatcagtaaagggtttgtctccaacccagctactgctgtgggcaactggagtgggtctggatgagggcatgggtggaacggactcttggccttcccatgccctgcagtgatgtctgttggattttctttggagctgaagaagtgaggctggggcttcacaaccctctcccttctgaatatcactaggatgtcaggtcatggatggtgtcactgaacagacccccactgggtcctggagatctccccctcaaaagccctcccggggcctgaactggagcagcatgtctggctcttctggggcctggcatgatggcctcacctaaagaaattccttccagaagacagtggggctgggggagagtccacctctgtgtggatctgtggagcacctccagttagtgtaattacattcttcctgctgacagttcccaccatggtctcaattggatgtgacattcttattaaataacttcagtaactagtaataataacacagtccttacttcctgacctaaattgcttgatgctattttggtgagcaaccacggtgctgcagggcttctgcagaacggcctgccaaattgctgccaacacacacacacacacrcacacacacacacacacacacacacacagccaaggttgatgggaagtgtgcttgcaccatctgtgcacggcctacctgtgtgtgccctggagcacatgtgagcgccatacctgccgtccaaatgaaggagccccatatgcctgatggcagggcaagtttccctggccaagggctaaccttcccagcctggttgttgcacaaaatggagatttgacttccaaagtacctcttatgccatgtccttccctctctacctgcctcagcttctgtgcatttatatctgtcttcccctgtctctgaagtttccttccctcccttttccacttgtgaaattttattcatcttttaagacccaatgcagatgttacctctgccaggaagccatccctgattccactatagagggatttgtcactccctgagttggcctyctttatttggtctggcctggctctattctaattacrttagctggatatatgatggtcaagggcagggactgggtcataatcatttctgatgattgacacactcattcccattgtaagactccctgagtgtttactgaatcgaagtcatggaagtagacatagatttatggggagggggcattgatggaaactgagattttctggtggtgggtttctccacagagatgaaatgcttgcaatgcccctagttggtctttgtttttattttccatctttacaaaaaaatgtgagatgttcactcttgcagaacaaatagaactgtgacttttgtttcacaatttatrtggctgattttgtctgcttttgacagttctgttgtgttcctgacagttacaatttggtttctctctgggaccttggratgataagttgggatgccaacctcgcattgatccactgggggagcacagaccccttcttgtttctccccatgctgtgcttatgaatgggaagttctgagcaagccmatgagaagacaaatggggagaaaacaaggcaacatgaaagtgtgcaagtgtgcaccaggaggcagggtgtcacctggatcatctgacccaggtgactagccgatggcatgagcagtggacccttgggtttctccagaccctatccccatatctgtccagtctcccagaagacaagtgtaaatggactcctctgcactcctatgcccttccctttctcctagtccacccaccagcctgtggcatgtcccccaaattttatgtgagttccaagcagacataaattcaaaatggttgaattttctctggatcctcagcwcacagaacaagcctcactggcaggaagcatcaatatatgtgtgctgagtgcatgatggatggatgaatgaatgaatgaatgaatggataaatggtgccatcttctaaagcttataatttccttccttggcctaagcatggaatttctgttttggatttgaatcccaggaccatgacttactagctgagtgattttggaagattattttgcctttgaggaactggattccatcttcaaaaccaacagcagaatccaagcctgcytgggttattgtcaatgtcaagcacataagggactgtacagtgtagtggttaaacccatgggttctggacctaagctgcctgtgttcacaaccttactctactacttcctagttgtatgaccttggacaacttacttggtctcttactgtttagggaaaagctctcttaagccatgttgttgtttttttttyctgctctcacacagccaccaccaacacaacaacaatcatcaatacagaggaagacttctgtgaccaaaagtgtgggttttttttctccacacattaagcagtggacaccagccaggcatcctccaattcaactcctaccctatctacctgatgatagagtcacatcccatgggttgggggctcagttcccgagactcccccccgcttcagacaccagtcacatgtccaaacctccagaacttctgaccaattggcttcaagttggggttcccacaacccccccycctttaagtttgattaattggctggagtagctcacagaagtcagggaaacacatacgtttaccagtttgttataaaggatatacaaaggatacagatgaacgttagatgaagaggtgtgtagggcaaggtgtagggggaggggcttggagcttccatgccctycctgggcacacaaacctccaggaatctccacgtgttccgctctctggaagctctctggaccccgtcctcttgggtttttagggaagcttcattacgtaggcatgattaattaagccattggccattggtgatcaacttaaccttcagcccctgtccctttcccggaggttcaggagtggagctgttaagtcccaaccctctaatcctgccttattctttccagtgatcagccccactttgaacctatcacacaaaagaaagacagcacttgggagatcccaaggattttaggagttaggaactacaggaactacagacaaaaatagcaccacttaacctcaggctgctcattacatatggggatgaccttagcacctacctgccaggactcttgggagaatttcatgaggcaaagcacttaaagcagggccttcacctagcaagtgcccaggacatatatgacagggtgtcttgcccgagttgccattgagatgggattaggaaggcatttggggatcaggctatcctccctctagtgggcctctctgtcccctggtaagatgcccttcacctctcaaagaactttcaggatgactggccccagccctgatttgcatgggtgtaggaatttcatgagaaagaacttgaatcctgagcacagatggggtatggaaataggtggacctgtgtaataggtgggaggaggctctatgaaaattaaaactctgggggagataaagtaacaccagagaggaaataggtagacctttataatgggtgggaggaggttctatgaaaattaaaacactgagggagataaattagcaccagagaggaaattcacccactttgcatgaggaagaggattagtggagtgggctggacagggagggccctgctgcttgagggtaagaaaagacagaggttctggatacagcaggaggctactcttggacgcagcccatcccattttgtcccctgcagatcccggacctcggtgcctggaggagagggtagcttggtaaagatgaaaaaggtgccccaaaggctcagctgtgggtctcccttctcctgcacggtttctcagccttgggcattttgggctggacactgttctggagcactgtcctgtgcatcatgggaagtttagcagcctcttcagaatccacccaccagctgccagtagcggccccctactctgagttgtgataattaaaaatgtctccagacgttgccagatatccccgggaacaaaatcgcccccaaatttagaaccgttgttctgctagactggaagaggatattttcctaccagctggaaagagagatgaaaagtggaagtcaggaggtagaaaaaaaaaaaaaaaccagaaaaattccttccagctgcctgagagtgttaactaaccctattgtatatccaagatcaaggcgtgcctgtgttcacctatggctctcagcagacgctcagcagcaatagtgaagtctcagcagtcctgaggttgtggagaaaggggacaacagctggaaagaaggcctacagggtccaaaacaatggcttccattagagttagcgaccttggaagagcccctggagtgctggttctcaacctcggccataccatagccagggtcccactcccagagggctaattttaattaattyaatttaattgggacactgtgattttacaaagcttcccaggtgccacatggttgagaaccagccactataagcaagaatttatatcagtatcacctggaagcttattagaaatgcaggttttcaagccccacccagacctactaaatgccaaggtgatttgtatgcacattaaagtttgagaagcactgacccactgacctaggatataaaaagtgggaacaatgaagactttttattctaacaggtagagtctcttgattcagtaacagctacaccaaactggcaagacctagtggtcatagcctccatcttttgcttaagcagaagagacccgggacagggactgtatagtagatggatcttcctcatccttsgtacttctcaagctgatctggctgcccccacaagcccaatgaaaagacatctgtccttcctagtctgttacatgtcttcctccctctcctcttttctatcttccccaagtagatggaagaacataggagaaaaccccagacttcagctgccctttggctctcctaacctccacattcgctcattcattcaacaactattcattgtgcacctcatgtaggcacacactcttcttgattctgaggattcagtaatacacaagaaagaaagaaattcctgtcttctgggagtctgcatgtctggttattcaaagaaaataaacaaatacgttagtaaatatgtaatatgttgggtggtaagagctcctaaaaaaaataaagcagagaatgggtggttggaaatgcctcgctgggcatatggcaggagggggaccatgttttattttcttctaatggaaagatatgaaactaaagttaccaggccaggtgtggtgcctcacgcctgtaatcccagcactttgggaggctgaggtgggcagatcrcctgagatcaggagtttgaaaccagcctggccaacatggtgaaacaccgtctcttctaaaaatacaaaaattagccgggcatggtggcaggcacctgtaatcccagctacttgggaggctgaggcaggagaatcgcttgaacctgggaggcggagagtgcagtgagccgagattgcgccattgtactccagcctgggcaacaagagcaaaactcaatctcaraaaaagaaattacagttaccaattaattgttgtcctactatacacctcatattgctctgtataaatcttacacaaactcccatgcccctcgtttcttcactgtagtaaggaacacataatataaaatttactgtcttaaccactaactatacagcacagtagtgttaactatatgtgccttattgtgcacatagaactctagaactttttcattctgcaaaactgcaacaacrctacacccattgagcaacaactctcctttcccccagcccatgacaatcaccatcttaatttctgtttctgagagtctattttaartatctcatataaatggaatcatgcagtaatatctttttgtgacttatttataggtttaatgacttatttattgttggtttattgcacttcatataatgtcttcaaggttcattcatgttgtagcatatgaaaagatttccttccttttttaaaggtggagtaatattcaattgtatgtatgtaccacatactctttatccattcatccatgtaggtacatttaggttgtttctacctcttgtccattgtgaataattgctgcaatgaacattggtatacaaatatctcttagagatcctgttttcaatttcttttggatatagacccagaaataggttgttgaatcagatggtaattctatttttatatttttgaggatcttccatgctgttttttatagcagctgtaccattttacactcccaccaacaatgcacaaggattccagtttctgcacatcctcaccaacacttgccattttctgttttgtggatggtggctattgtaacaggtgtgaggtgatatctcatggtggcttaaatttcatttccctaatggttagtaatgttgaacataatttcatatgtttgtcagccatttgtctatcttctttggggaaatgtctattaaagtcctttgctcattttaaaatcagattattcattcagttattgttgagttagaggagttctctgtatattctgtatagccactcaccagataatatggtttgcaaatattttctcccatttcttaggttgcctttccattctgttgactatttcctttgctgcacagaagttcttaagtttgatgtagtttcgtttgtctatttttgcttttgttgcctgtgcttgtgttgtcatatccaagaaatctttgccaaatccaatgtcataaagctttccttttatgttttcttctaggaattttatagtttcaggtcttgcttttagatcttattccattttgagttaatttttatatatggtatatggtaagggtccaactttattcttctgcatgtagatatccagttttcccaacaacatttgttaaagaggccattctttccccattttgtaggtttgacacccttgtcaaagaccatttgacaatatatttatttctgaggtttctattctgtttcactggtctatttgtctttctttagtccartgctatactgttttgattactgtagctttgcaatgtgttttgaaattaggaagtgtggggccttcagctttgtttttctttctcagatttgttttggctatttggggtcctttragattccatataaatattagaatggctttttctatttctgcaaaatgtgccattggggttttgatagggattgcatcgaayctgaagatcactttgggaaaatatgagcattttaacaacattaagtcttccaactcatggacatggaatgtctttccatttatttgtgttttctttaatatctgtaagcaatgttctatagttttcagttcacaagtcttttgcctcctcagtaaagcgtatttctaagtattttattccttttgatgccattgtaaatgaaagacaagatgaggagaaagataaaaaacaaaacaaatctcctttttagattgttcattgttcatgtatagaaatgcaacttatttttgtgtgttgattttatatccagcaactttgctgaaattgtttattagttctaacagttttgtatgtacgtgtggaatccttagggttttccacatacaagatcaggttgtctgcaaacagaaataatgttagtttggatgacttttgtttctttcccttgtcctctggcaaggacttccagtattataccgaatagactggtgagagagagcatgcataccttgttcctgatcttagagggaaagctttcagtttttcaccattcagcataatgttagctatgggccttttatatatggtctttactatattgaggtaatttctttctattcctagtttgtygagtgtttcttcttttttattttgagacagagtctcactctgtcgactgggctaaagtgcaatggcatgatcttggctcactgcaaccttcgcctcctgggttcaagtgattctcttgcctcagcctcccaagtagctgggattacaggtgcctgccaccatgcccagctaatttatttttatttttagtagagatggggtttcaccaagttgattaggctggtcttgaactcctgacctcaggtgatccacctgcctcagcttcccaaagtgctggaatttcaggcatgagccaccaccacgcctggctgagtgttttttcttttaatcatgaaagggtgctgaatttttcaaatgctttttctgcattgagatgatcatgtggttaacatgggatattatattgatggattttcatatgctgaacaaaatttttgcatttcaaacataaattccatttggtcwtgctgtacaatccttttaatatattgttgaatttcatttgctagtattttgttgaggatttttgcacctgtattcatcaggtatattggtctgtagtttttgtttgtttgttttcttttttttttgtagtatctttgattttggtattagggtaatgctaggctcataaaattattttggaagtgttctgtcctcttcaattttgggggaaagtttaaaaagcattgatgttagttctcctttaaatgtttagtagaattatccagtgaatccatgtggtcctgggcttttctttgtagataggttttttattactgattcaatctcctcactagctctaattctgtttagagtttttatttcttcatgattcagtcttggtaggttatatgtttctagaaatgtatcaatttcttctaggttatccaatttgttggcatacaattgttcattgtagtcttttataatcctttttacttatgtgtcatcaattgtaggtcttgtctttcatttctgatttttatttgagcttctctatttttctaagctagtctaactaagaaaaaaatcaactcttaattttgtttatttttccccattttaaaaattatttatttcctttgtttttgctctaatctttatgattttgttccttttgataactctaggtttagtttgttctttctctagttcttttacatgtaaagttaggttattgatttgagatcattcttttttttaaygcatgtgcaatgtgctgctgtaaacttctgtcttagtaacacttgctgcatcctgtaagtttttggcatgctttatctttattttcattcgtctcaagatattttctaattcccctgtgattttttctttgacccattggttcttcaagagtatggtgtttaattttcatatatttatgaatttccagttttccttttgctgctgctttttagttctattcctttatagttggaaaatgtaactggtatgattttaatcttcttgaatttgttaagacttattttatggcctagcatgtgatctgtcttgaagaatgtttcatacgcacttgagaagaatgtatattctgttgttgggtagggtattctagatatgtctatttggtccaattggtctatagtcttgttcaggttttctgtttccttactgattttctgtttgattaattatccattattgaaagtggggtatggaaatctctcttccttatcatgttactgtctatttttctctttaattctgtcaatgtttgcttcatatatctgggtgctcttctgttaggtacatatatgtttataattgttatatcttccttgttgaattgacccttttttcattatacaatgtcttctttgtctcytgtgacagtttttgatttaatgtatattttttctaatataattatataatcaccttgctgtctttggttaccatttgcatgaaaaatctttttctattctatcacttttagcctattgcatggaatatctttgtccgttcttttacttttcatttatgtatgtccttatgtctaaaacgagtctcttgtagacagcatatagttagatcttgtttttataagtcagtttaactactttatgtcttttgattgctgagtttaatccatttacatcgaaagtaattactgatagaggacttactattaccattttcttattgttttctgtgtgccttatagttactttgttccttttttcctctcttgctacattcctttgtgttttgttgattgtttttgtagtgacattctttgatttcttatattctttggtgcatcttctatagttatttgctttgtggctacaatggggattacataaaatattttataattataataatatgtcttagactgatmataagcctcagttgcatataaaaacttcacgctattacaccttctttctccctacacactttgtattagcaatatcacgaatttcaccttttacaattttgtattcattatacttatatttttatactttcatcttttaagttttatactagaattaaaatgatttaggcatcactattatagtattacaagattctatttgtctatatatttatttttactagagagttatatatttttgtatgctttcatgttgctgtctggtgtgtcctttaattataattttcataaggcagatctaatggcgatgaactccctcaccttgtttacctgggaaggtctttatttctccttcattttgaaggacaatcttgctagataaaggattcttggttggcatggtttctttttcctttcagtactttgaatatatcacctctttggcctctgggcttgtaatgtttatgctgagaaatctgctgataatcttatgagarctcttttgtaggtgatgagtcatgtttccttgctgctttcaagattctttccttccttgtctttaactttttcttgtctcaatattgacttctttggggtcattgtagttggagtcttttaagcttctttactttggattttgattttcttctttagatttaggaagttttcagccgttatttttttcaaataagctttctgttcctttttttctcttttctccttctaagactttcataacacacatattggtctattttatggggtcctctaagttccttaggctttattcacttttgttcattcttttttctatttgttcctctgacttaataatytcaaatgacctgtttttgagttcactgattcttttttctgcttaagtctgttattgaacccctccagtaaaattttaaattcagttattatagtcttcagctctagaatttctgtttgatcttgtattatagtttctaactttttgttgatattgtcattttgttcatgcatcattttcctgattttatttagtttgtctatttgtgtcctcttgtagcacattgagcttcttaaagacaatgattttgaattctttgtcaaataattaatagatctccatttctttagaattggtttctgaagatttattatgtacaccacccttcctttttttttgagacagggtctcatcctgtttcccaggctggaatggagtggtgtgataatagctcattgtaacctcaacttctgggcctaagtgatcctcctgcttcagcctcctgagtagctaggactataggtgtaccactatgcccagctaattaaaaaaaattgtttttagagatgggggtcttgctatcttgcccaggttggtctggaacacctggcctcaaattatccttctgcttcggcctcccaaagcactgggatgacaggtatgaaccactgtgctcagcctattttcttcctttagttgagccatgttgccttgtttttcgttttttttttttaagtgtgctttgttatttttttagtgatttctgcatttgaaaaacaacaacaacaacaacaacaacaaaggagttctcccagtctttacagagtagttttacacaagggaaagtcttcagcagctagaggttctgggggctttccttgggatatatattctctgagcttgcatgtgtactttcttaattaaagaggtttactgggtcttgtttgtttttccttcaagggyttgtaatttcttgctccctctggtgtctgattatggtactcaggttctctggtgttgcaaaaagccagtgaactgtcttttgttctccatggcccccaggcattgaaagtatgctggttccccatcagcactctggtttctgtcaggtgagacagaaaccggtccctctgcagcccactgaaaagtgggaacactgaatgtatgctatgctcttctctttcctttccaagggggaagctgcaagttgaactttttccttcagtctcactgaactgtgacagttgggagaagggtttttatggttgacatgaaacaatttttcttatgcatttcaatatggtggcttttcactttgagcttgcctggggtactgtaacttcttaactggtttctagagttctcataaaggcttttttggactgtgtattgttgttaagtcagtgtttctrtggggcagaatgtctggggcttcctattctgccatctagctgatgtcactcccaagcccctggcacctcctccaggcacctttcccccactgcccctcagcagaagccacaggactgtaagggccatgagggggcgccagggatttacaattataaaggtcttgttgggccataataaagtcyctcycagctaacargtgaccayggggcatgtgatggtcttgctttgttcacccatgtgcgtcttgcatattattcatgctatggatgaacatgtgctcctagccatttcaaggttagacatgttttgagaggatgttgcatmtgtgacaactgtcaggagtcacaggtcctgggtcgctgctctgccacccatgtgtgacacctctggctctctcaactcatgcgttttaagacccacactttctcttggagggcatggggagataaatacctcttgatcctaagaattcagttgggaagtgtcacaaggagggtatgaggaagctcagagacacaaccatttccaaacccaagttaagaagtctgagccatgagtgactcagccaggagtagagcttagctcacaatggtggggttgaagctgggtcctaccttcccatccatgtccttctttttctcctttctcccgtccaagtactaacaaggccygaacctgcttagcttccgagatcagacaagatcaggcacgttcagggtggtatggccgtagatctctttttctcctttctataaattccttgctttcctatattacacacccacacaccagctgcccctcagccatgagcattgtcagggaagggtcagactgtcttttaggaggccctagtaaaaatccattgaattggcttgaatccttttctttctatatccccatgctactcccaagcctgtgaatttcttgccagaaatctctagcattggactaactagattctagaggcctatatagattttactctttatagattatcttattggaaggcacattcattcattcattcaacatatacttttgatttttctcaaggctgcccatatgacccagaaattcatgccccagtctctggcatggtgacaaagcatagtatgcccacaggagaagaaggctagtattggaagtatttctggaggctttgaagggtctccaggacattcattcacataactctgcagagcagtccactgggaaaccctttgagttacctcatggctggagtgcctatagatagagctgtctgctgcagtgtggaggcggttggacagcaggtagttatataggctggggctgcagctgacaagactggggaakcccagggtgagcaaaggccattaagggcagaactgggcatctggggaaatggccatggcaatgtcttctaaacagaagtctgaggtcactgggctgggttctgaacccagtgtctccacatgcccagcctgatcatgtttttcaccttggtttgcatgtgtatgggcaaggggcaacaataagcttgttagggtttccttttatagagactgtaagaggaagtacatttctctactactccctgacacaatttttagattatctgtccacccactcagatatatttttccctcagttcattcaaactgcgagagagaaagagagagaaagagagagagagagagagagagagagagagagagagaatttgaaagaatttattgaaataaggttcctttcagccaagactgccacctctgtccttcctctgggggcagggagacagagacagggctgtaatggagtcgtgtctagttgagaaaagcttcttagctctggtcagctcttttaggccttcatgctgtgtctggcatatgaccagcccaaatctttttctctctccctcccttcctgtttcataccagtgaggtggtagagcctatattttaagatctcagtctcaggagtcagagaatcctgtgtttgaaccccagctttgccagatgttattgtatgtgtgagcttgggcaagctacttaccctgatccccatttgttaaatgggatgaagaataatacctgcttctttgggatattggaaggtttaacagaaataacgcaaggaccaaagtcatgattgtgtggggcacacacagtcagtgcctgataaatgatggctgaaattccttcaacttcctgcttactgacacatgcatcctgtggcagccctgtgctggatcctcaatgatatagtggtaaaaaaggcagaccatgctctgtgtccccaaggaactcagtctggtggggagatggttatggaagtcatgggcaagtggcattcaggatccttccttcccagattttcattgtgggctgggtttctgggtctgtgtgctaccagacagagccacaccaactggtttggtttcctaggcctttagggagttgggtccatatgaattgtacttttgtaaaagcactggattgtagtttgttcattcattcaaccaatattaactgagtgctgactatgtgccagttactgttctaggcacttgggacgcatcagtgagtaaaacaaaggcctttctcttgtgaagtaaatattctagcaggaggaaataaacaataaacagtaagtacaatatataagtaaattacatagggtgctacagagtgatacatgctattgaaataagaaaacatagagcaggtaagggagattggaggtgccagcgatggaagtagggggttagttaatattttatttcattttattttattttttaacttttattttagattcaggggtacatgtgcaagtttgttatatagtcaacccatgtcatgggggtttgttgtacagattattttgtcacctagatattaagcctagtacctaatagttattttttggatcctctccctcctcccgttctccaccctcaggtagtccctcgtgtatgttgctcgcctctttgtgtccatgtgtttgcctctttgtgtccatgtgttcttatcacttagctcccacttataagtaagaatatgtggtatttggttttctattcctgtgttggtttgctaaggataatgacttctagcttaagatggagatcttaatatatatgcttcattcatgttcctgcaagagacatgatcttggktttttttttatggctggatagcattccatggtgtatatgtaccatattttctttatccagcctactatcgatggacatttaggttgattccatgtttttgctcttgtgaatagtgcttcaatgaacataaaaacgtgtgtctttatggtagaatgatttatgttcctttgtgtatatacccagtaatgggattgctgggttgaatgatagttctgtttctaggtttttgaggaatcaccaaactgctttctacaatggttgaactaatttacactctcaccaacagtgtataagcattctcttttctccaccaccttgccagcatctgttatttttttactttttaatagtagccattctgggtgctgtaagatggtatctcattgtgattttgatttgcatttctctaatgatcaatgatattgagctttttttatatgcttgttagtctcatatatgtctttttttttttttttttttttgagacagagtctcgttctgtcacccaggctggagtgcagtggcgccatctcggttcactgcaacctccgcctcctgggttcacccgattctcctgcctcagcctcccgagtagctgggattacaggcgcacaccaccaygcccggctaattttttgtgtatttttagtagagacggggtttcactatgttggccagactggtcttgaactcctgacctcgtgatccgcccgccttggcctcccaaagtgctgagattacaggcatgagccaccgtgcctggctcatatatgtcttcttttggaaagtgtctgttcatgtcctttgcccactttttaatggagttgtttatttttttcttgtaaatttgtttaagttccttacagatgctgaatattagacctttgtcagatgcatagtttgcagatattttctccccttctttaggttgtctgtttactctgttgatagtttcttttgctgtgcagaagctctaaaagacttaaatgtaaaaccaaaaactgtaaaaactctgggggacaacgtaggcaataccattctggattggcaaaagtttcatgatgaagatgccaaatgtccattgaatgatgagcccctgctggcatctagactggtctgagctgagccagggccatactgaccccatcactaatttgcttgagcagagggagctgatttgagctctcccttttgataggaacaactttcaaatcaccatcagtgctcatacaattcaaamgtgtagttgggggcatcaaaacacaaaaccctttcctttataygtaaaatgagcaacacgtctgctgaagattgggaaagcaaagtgaaattgcagatgacctttgaatgccttaatttaaagaatgatctggattgatcttgccctggatctgctgccactgtcttcatgagtgaaccttctggattcccartagatgtccagtctgaagctgtcagaggaatgagggggttgggctgctatggagaaacaagaggatgcatccaacagctsgtgaccacatgtcatgccctccttgatgctggccctcatgctttctgatttcaagtcttaccacccctcatctctagagagttagcctcccacctgtcctcctctgtgtcattggctactgaagaataagtgccaggaacatctcgggagtacaccttgcaaggattgccctccctatcccaggactcctgtgtcaaatcacctctactgtggttccgtctggcccaaggcaggaagacagagtctcgggcactcaggattctgaatggagctgcagtgctctctcttctaccttcacccctttccctcttcagcctctttccctctttctatcccttcattcctttatctcaccaattctctttgttactttcttatcattgtagttcctttttcttctggtgcagaaattatgggagaggttggacaggcatccccattggcttaggagcagaagaaacagcctcccctgaggacatttacggttccggaccatggacagggctactcttgctccagtcaggcaccaacaactcacttgggctagctgcatcagagcatctctgtgaatgtggtcttgagaacctcattccatagatagaggggcaggggccataagtgactaagggacttgaccataccccttgctagcaagtggcaaggcagagttaagaacccaggctttctgattccatggcactatgttagggttttgggtttttttttctctctctctcattagggttttgttttctttttctctctctcatttttaaaattaattttcaaatatgtctcacataagggcacagggcttgaagttgcctattttctttaggratgaggccagttccaccagataaaacaggagccatgtgtttttaatggataaagaaacaaatgaaaagaaaaaagaaagacaccgttgamaagcagacaaattaatccatttacttgacaaatattaatggagtgtctatgaaatgccaagccttgtgttgggatttaacagtgagtcaggcgtggtcctgccctcatgagattctcatggtgagagaaacagcagcataggcttggtttcacatattttgacaattcactcctatttcccgagttattatgattctttttcttctgggaagttcaatgtgctcaggcgtccccatgtggtcccctttctgccactgtgctgaacctcaccatagtggactcattccccaaatgtcaggcaatgggacagaagcctaggagttctaactgacatgactgacacttgaggaaagggctacctaaggtgaagttctttgctgtatgagagtgctgtagaaaggagtttagcttactacattggccatccttcatccatccacccacccacctatccatccatcatctatgatagagtagtggttaagaagacaggatgtggcaccagattgcctggggttgattcctatttccatttttatcagctgtctgaccttgggcagattacttaaccttcctagacctcagtttccttacctatgaaatggggagagtaatagtacctatctcatatggttgtgaggatggaatgaattattatatgtacagtgcgtaagacagtacttggcacagaaaaaatgtttaataatatattattattattataccgtaagctccatgagggcaggaagcactcactgggacacagtgggtgcttaatactattttcaaaataagtaaatgaatgaatcaagcatttgctaagccctcaactttcatgagtctgttcctgtgcttagccattgtcccgtggaccaaagccatagctcaggcatcttctcagctggggagaactcaatggtagttccttgttttcactctgaaagacccagacaggagtagaatcagcctggcagaggcccctggccccagagatacctggccctttctcttgctgctgatccagggctgtggcataataagaatcagtaaagcagagatgcttctgctagtccaggattccctgtcaaaataataaacaacccttgactagtgttggcttaggatgatggaaaatgaactgcatctgtatcaccatgcagggaaaatcatgtttggtccgcaatggtggcttctgtgttaaacatgtccaggagaatcagaaagcctggagttagaattaggaagctgagtggcatgggattattcccacgaagcaattgaatatggtacagggacaggcttgctgcttcaccccacctgccatgcattgttttgtgcctttgttgcatgcatccccagcttgagaggaaaaaggagacccgttttgtatccaggtccctgaggcacagcaactgtgctaagctcttttcaataaatcccaggctctgacccctggtgctgggtgcagagtggaaccagaactatagctttgagagtatgtcctgagatgatgtgwgtgaaatatttgcagcctggcagagggaagggtggtagggttgagagcctgggttttgcttttgtacagatctgggtttgaatctcagcttttccattgctacttgtttgaccttgaacatgttttaaaccttgaagagccttagtttctttacctgtaatatgatgagggtggggctgtaacagccatttcaaaagggtcattgcaaatgttagagagataatgttagtgaaccacagaaatgttggccccttctcagacttgcatgaaagcaccagtccttctaggtttgtctgtgctcctttctgttcccctaagattgaacagcatggtttccctgaaccacttgtcacgtggagatggctagtaagatgggccatgtctgtctcctacaatccactgtgaactccttgagggcatggaccatattatatgcaatctgcccctcccatctcccccaactccctactgcccattaacacccccacctatamaccctggaactaagccatccattccccagatttgctgactgaaagactgaatttgtcttggacctctggggttcttgatagaatccatggggtccctaacttggatgaggacaattgcattattttcactaatctcctactgaaacagcatttctaccaatcatgaagataggcaacaaacacggaagtggtattagcagtacctgtgaatttgtcactggtaagatcacagatatttccatagaacattacagttgttacaattatcttgaagtagcatttatgcttcaractacaatatgtatcaggcccactgctagatcttattaataatgcattaataaaggagcacttwttagtgtatgatcgattttcagtatattttaaaaactatatttcartctagctgatttcctttgcaattctatgtattttgttttacatattttaagacaccatttgagrtggtgtcacgaggctccaaggagggcatggcacgacaaagatggaggacttcaggtcatggrggtccagggataggcttttttggcctgctaatcccctgaaatgaatgaaaacggcagaaggttagcttcctatgtatgtgattctagaaaaagtatttctgactttcattaggaactccaatatggctaagaattagaccagtcgttctcaactagaggtgattttccccctaggggacatttggcaatatctggagarattttggttgtcacattgggaggtgctactggcattcagtgggtagaggtcagggacgctgctaaacatcctatatgtacaggacagcctcccacagtgaagaattatcccacccaaaatgttgatagtgttgaggttgagaaaccctggattagactactgcacattcacagaaatctctccgattgttaagatctgtagtaaaaaaaaatagtgcacatcttcattaaaaacatctgtgataattgtgtcacccagcacttaatgcacgaaatagggagatgggggtagcggagagcgaagagtaactgcctgcagactagaggaggctccttagaggagatgaactgagcctgggacygtgagttagatttgctaggttgagaaggttgcagtggaagggcgtatgaggcaaagggccaagcactgcaggtgacaaattagtggtgtgactsaggcacatgctgtgcaggggagaggggctaaaatgaggctcagtgccagcatccctaatgacctagttcttggtcctttcctaaaggatcattgtagagagccaaagatactgtttgacccctgcctctctcatcagcggacaaggtgcccctgccagaaggcatgcatagtgatgggccagaggctgattgtagacttgaggtgtccagctggtgctccgtgtggcaggtgagacaccttcagcgggcgtgatgatttatccagcatctgcagctccccgctgtgtttcctcttagggcagtttcattaattgcgtggcttcaacaaatccatatccccagtccagattgcactcccaaacaccagtctacagccctaactgccttctggccatctccgtctggatgtcccactggcatctccaactaaatttgtccaaaattgaccttatcagtcaataaatatttgcagaattgaattgaattttcctgccaaacttctcaagagagttatctccttaaaattatcattatttgtagacaacatgattgtgtacctaaaacacccaagggaaccaactgagaaatttttagaattaataagtgttcagaaacctggctggatgtgagatgaatgtataaaaatcaataggttttctgtatatcataaaaaccagttagaaaaaaataatgagaaaaatgacattcactagtgcggcaaaaagtgcataaaatgtctgtgaataacyttaacaagatgtgactgggacttaaagaaaagcatctaatctttactgaaagattaggtggtgtttgctgtgccaggttctgtactgaacatttagcaactcagcagatatcacattaatctgtacaaccatcctagaagtgggtgttaattttaaagatgtcaaaactaaggcttaaagagtttaaataagttgcccacacacaatattaagtggcaaatctgaaatttgaacccaaagcttttgtttccaaaacctatgcttttaacctttccactaagccacttccaaaataaaccataaatacacagataaatgaagttggtgagtattttctgaatattagattagtgcaaaagtaattgtgtgtgtgtgtgtgtgtgtttgccatcattgttaayggcaataaccggaattacctttgcaccaacctaatacaaaagattaattcatttcactcactcattcatttaaaaatgygtactgagtgtctactatgggcaagtactgggctaggtgatggaaataaaattgaagaaaagctcaaggagggtcggacgcagtggctcacacctgtaatcccagcactttgggaggccgaggtgggcgaatcgcaaggtcagatcaagaccatcctggctaacacggtgaaaccccgtctctactaaaaacgtgaaaaattagctgggcgtggtggcgggtgccggtagtcccagctactcaggaggctgaggcaggagaatggcgtgaacccgggaggcggagatagcagtgagccgagatcgcaccactgcactccagcctggttgacagagcgagaatctggctcagaaagaaaaaaaaaaaaaaaaaaaagctcaaggagtttgctggtagagacagccacataaacatatcattatatcaccattgatgaaggcaatgacattcatcatgaatgataaacaaggagtggacgaatacttgatggtgtcttgagggttcccagaaggctttctggagaaggtaatgagtttgaaaatgcctggagttagccgagtgaaggaacaatccaagcacagaatgctaggtgggcaattaatattcatttattcattcattcaaccaacaactattctgtgagcatctattatgtaccaggttcaggtctgcgagctagagatagagcagagaaaaaaatggtgccccactctcatggagattgtattttactggggagggygcatcagaaaattaacaagaggaaaatatatggcagaggtgctaagtgctatcaacaaataaagcaggcaccaggaacacctggcttgagaagcaggtctgaattgtacttagggtagtctccaaggaggttatatttgactagacaccggaaataagtaagggtcccatggctactggggaaacattttctgggctgaagtcttggcaaatgcaaaggtccagcatggccggattacagggatatggccggattacagggatatggttggatcacagggatatggccggattacagggatatggctggatcacagggatatggttggatcacagggatgaggggacaagagataggagaagaggtggacaggcatctgggtacccattcatttaaagctttgaggactatggtgaggactttggcttttatgttgagtgagatgagaagccaaccaatctttagttgagagaagtctttctcagtgtgaacaagggaaaaatattaccaagaaaaaagagataaatgtgactgcctatagaaagtgaacattttggccaggtgcggtggctcacgcctgtaatcccagcactttgggaggccgaggcgggtggatcatgaggtcaggaaatcgagaccatcttggctaacacagtgaaaccccgtctctactaaaagtaaaaaaaattagccgggcgtggtggcgggcacctgtagtcccagctaatcgggaggctgaggcaggagaatggcattaacctgggaagcggagcttgcagtgagctgagatggggccactgcactccagtctgggtgacagagcaagactctgtctcaaaaaaaaaaaagtgaacattttaatctacatgggaaatctaaacaaaacaaaaagcacacaaccaggtagaaaacaatatttgcaacaaatatgacaaaagattaaaattctgactctataaagagttagtacaaattaacaagaaaaatagtaagacctaatagaagatttaagtatataacatttagaaacttcagtatgtcaaacatgataaaattaaaaggccaaacaactacaaaacacatatatagcacatgcgatgcataaaggattaatatattacacatatataaaatagataagtaggtaagaaatgagggaaaaaaataccacaatgaaaaatgagctgaggatttgatcagctagttccaaaaagaagaaattaaaattattagaaaaagtgaaaaagatgttgaatctgagtcataaaacatcactaagtaaaatgagatcacattttttgcacctaataagcaggcaaaaagtttccaaataagacaatacacaaggttggcaaaggtgctgtgagataggtattcctagacataactattgagagtttaatgggtgcacatttcctagaaaggatattgttaacccagagccaaagcctcagaaatgttcataccatttgacccagtcatctgctatttggaagtctgtcctggggaaatcatccaaatcatccaaaacaaatgaatgagcaatgacttgaggagtctagttctctgagattgttctggagcctgatgggggtagctgcattgaccagaaactcaaagcatgggtgaaagaaggcagaccatcctggctagagagaaatgcaaggtgccgtcaaaatggaggtcagtagcagcattcccatctacagggcagaacatcagtcactagaagtgaagaacgggtagactttttcttgaaagaaattcaacgtttcatgggcatgaaaggacaaagccattctggcatgagctcccattccattcacatttcaatctggagtggctgctctgggttataacttcttcaacttactaacatacattggtttcagggaggtttccaaatgagtcaggcttctaaccctttctagccatccctgagagaggtcagccagcctaatgtggacagtaccttacccgaccccacctgaaaccaaagctggaggcagttactgtataggggaacatttattctgggactctggccgtggaaaggcattttccactgcattgaccagcatcctatcaccagatctaactaagggtccaggtcttatttacaatggaacaaaaaatccagaagcaatttaaatgtttgacaataggagaatggctaactaaattctagtataaccatacactgaaacgttgtgcatccatttaaaatgctgtttatgaacagattcagtatcttagggaatgctcacgttataatgtttactgaattgttacaaaagaaaaccgagaaatgacctgaatggccatcaacaggggagtggttgaataaattgagatacatccatggcatggaatattacacattcatataaaaaataagttagatctgtatctactgacctggaacgtgtccccggtgtattgttaagtgagaaagcaagttgcagaaaaatgagctaaactacagttttattttttaaatgaaataatcaaaattctcccagaatgtgtctgtgtggtttgcatgagagagaagaaggtgagggagggacacatacctggctgttaacttcggtaattttggattgggtggggaggagggagactgcatatatatttttttatacttgcattgcgtatgtgcatatctatgcatattacaagtccacattgcctttttaaattgaagattgaagaataacttacwgaaaaagtagcacacaaaattatacatatggtgttatctcaccagtgtgaaatatgcatggaaaaaaatctcagaaaaatgaaaatattaacagcagttgcctctggaaggaagagattataatcagttttctctttttaaatcttgcctgtatttttcagtttctacaatgtagaagttattgtttagaatacaatggccttccaccttctcatcagccaatcttgcctattacaatctgccctctttccaccttgccatcctcccacctgcctttgctgaaattgatctatccattcagcaaatacttattgaattctaggcactagggatgcagcagggaccaggtcaaggctccagctctcagcattgcttccagagggactatttagacaccagacagagtgacctcattcaagaccctcatcttagtctttctgtgctgttcaccacattgagtcaacctctcccacatggaactgccctctggatcctctccgactattctacctgttccctgctctgtcaccttttctgtccccttacatgggagatgttcccagaggctctgttctgaactccttcacttctttctctatagcagaagatgccattcacacccagattcttaatcagaatctcctgtccttggcaggtctgagccaaggcagaggtctgggatgctggagatggtggtgaatgttgatatttcattggttgtccacaacacgaatcggggaggcccttaagatgtggcccctgtggcatctatacttcagaaccactctgtgtacccctctagcatggtattgtctaatgacataytttgatttacttgtttctagtctatgatccaggtccccatggcttatcacagggtctatcctagaggaatgaatgaatgaaggaaggaattaatggcatgatgcagtgacattaccaggcaggttttagggacaggagcaaagtaaatctggtacctgtaccagtgagggaaagttcaaggaagtgtactcagggcttctctgaaagttgtggagttagaggctttatttcattatcactgtggttggctatttttctggcttctgggccatttatgtcttcttttgtgaactaatttgttcagatcctgtccaattattactaatagtacttttccccctaagtattagtaatagttctttctatattcaccatattacttttctcctaacatttttgtatgctttctgatattctgttgttgacatatgcatacttttaatatcaatcttgtagtatcctccacagctattatgctaaaaaatcacggtcagataattacctaggttttcttctcattattttatgactttatttttttaccatgtaactctttgctccatctggaagttatttttgtatatggtgcgattcgaggagataacttaattcttttcccaaacagtttattagttgatccagcaaaagtctttttcttttctcaattttttttaatattgcctgatacatatttccatttttatgtgcattaaagatattcatgcaataccatttcatgtcctacctgtttactcctggaccacccccacactattttcataagtgtcatttatgatgctgtttagtatcttgtgraatgagactgctaaatttactatcttctctaaamaatgcattgtgacaatctatttttctttttttttctttttatttatttatttatttatttatttttttattattatactttaagttttagggtacatgtgcacattgtgcaggttagttacatacgtatacatgtgccatgctggtgtgctgcacccactaactcgtcatctagcattaggtatatctcccaatgctatccctcccccctccccccaccccacaacagtccccagaatgtgatgttccccttcctgtgtccatgtgatctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccacaataaacatacgtgtgcatgcgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtcaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaagaagggatccactttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtggtatagtttgaagtcaggtagtgtgatgcctccagctttgttcttttggcttaggattgacttggcgatgcgggctcttttttggtttcatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataggaatgcttgtgatttttgcacattgattttgtatcctgagactttgctgaagttgcttatcagcttaaggagattttgggctgagacaatggggttttctagatatacaatcatgtcgtctgcaaagagggacaatttgacttcctcttttcctaattgaataccctttatttccttctcctgcctaattgccctggccagagcttccaacgctatgttgaataggagtggtgagagagggcatccctgtcttgtgccagttttcaaagggaatgcttccagtttttgcccattcagtatgatattggctgtgggtttgtcatagatagctcttattattttgaaatatgtcccatcaatacctaatttattgaaagtttttagcatgaagggttgttgaattttgtcaaaggccttttctgcatctattgagatagtcatgtggtttttgtctttggctctgtttatatgctggattacatttattgatttgcgtatattgaaccagccttgcatcccagggatgaagcccacttgatcatggtggataatctttttgatgtgctgctggattcggtttgccagtattttattgaggatttttgcatcaatgttcatcaaggatattggtctaaaagtctcttttttggttgtgtctctgcccagctttggtatcagaatgatgctggcctcataaaatgagttagggaggattccttctttttctattgattggaatagtttcagaaggaatggtaccagttcctccttgtacctctggtagaattcggctgtgaatccatctggtcctggactctttttggttggtaagctattgattattgccacaatttcagctcctgttattggtctattcagagattcaacttcttcctggtttagtcttgggagagtgtatgtgtccaggaatttatccatttcttctagattttctagtttatttgcgtagaggtgtttgtagtattctctgatggtagtttgcatttctgtgggatcagtggtgatatcccctttatcattttttattgcgtctatttgactcttctctctttttttctttattagtcttgctagcggtctatctattttgttgatcctttcaaaaaaccagctcctggattcattaattttttgaagggttttttgtgtctctatttccttcagttctgctctgatttcagttatttcttgctttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttgctgcagagctgagttcaattcctgggtatccttgttgactttctgtctcgttgatctgtctaatgttgacagtggggtgttaaagtctcccattattaatgtgtgggagtctaagtctccttgtaggccactcaggacttgctttatgaatctgggtgctcctgtattgggtgcatatatgtttaggatagttagctcttcttgttgaattgatccctttaccatcatgtaatggccttctttgtctcttttgatctttgttggtttaaagtctgttttatcagagactaggattgcaacccctgcctttttttgttttccattttcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatagtgttatgtgtgaatttgatcctgtcatgatgatgttagctggttattttgctcgttagttgatgcagtttcttcctagtctcgatggtcgttacattttggcatgattttgcagtggctgctaccggttgttcctttccatgtttagcacttccttcaggagctcttttagggcaggcctggtggtgacaaaatctctcagcatttgcttgtctgtaaagtattttatttctccttcacttatgaagcttagtttggctggatatgaaattctgggttgaaaattctttcctttaagaatgttgaatattggcccccactctcttctggcttgtagggtttctgccgagagatctgctgttagtctgatggacttccctttgagggtaacctgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaaattctccgggataatatcctgcagagtgttttccaacttggttccattctccccatcactttcagatacaccaatcggacgtagatttggtcttttcacatagtcccatatttcttgaaggctttgctcatttctttttattcttttttctctaaacttcccttctcacttcatttcattcatttcatcttccattgctgataccctttcttccagttgatcgcatcggctcctgaggcttctgcattcttcatgtagttctcgagccttggttttcagctccatcagctcctttaagcacttctctgtattggttattctagttatacattcttctaaatttttttcaaagttttcaactcctttgcctttggtttgaatgtcctcctgtagctcagagtaatttgatcgtctgaagccttcttctctcagctcgtcaaagtcattctccgtccagctttgttccgttgctggtgaggagctgcgttcctttggaggaggagaggcgctctgctttttagagtttccagtttttctgttctgttttttccccatctttgtggttttatctacttttggtctttgatgatggcgatgtacagatgggtttttgttgtgaatgtcctttctgtttgttagttttccttctaacagacaggatcctcagctgcaggtctgttggagtaccctgcagtgtgaggtgtcagtgtgcccctgctggggggtgcctcccagttaggctgctcgggggtcaggggtcagggacccacttgaggaggcagtctgccagttctcagatctccagctgcgtactgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagctttccggctgctttgtttacctaagcaagcctgggcaatggtgggcgcccctcccccagcctcgctgctgccttgcagtttgatctcagactgctgtgctagcaatcagcgagactccgtggggtaggaccctccgagccaggtgcgggatataatctcgtggtgcgccgttttttaagcccgtcggaaaagcgcagtattcgggtgggagtgacccgattctccaggtgccgtccgtcacccctttctttgattaggaaagggaactccctgcccccttgcacgtcccgagtgaggcaatgcctcgccctgcttcggctcgtgcacggtgcgcgcacccactgacctgcgcccactgtctggctctccctagtgagatgaacctggtacctcagatggaaatgcagaaatcacccctcttctgcctcgctcacgctgggagctgtggacgggagctgttcctattcggccatcttggctcctccccccgacaatctatttttccagttaaacttaggtatcattttaccaaacttaaaacgggtcattgggcttttcatccgaattgcattaaacttataaattaacttttctgtaacttgtcaagaggttaatatcataaattaacctttctgtatccactcaagattatgctatgtctctccagttattcaaattttttatccctctgtaaaagtcattttcatatcgtgcctgcacacttcttgttaagtttatatgtactatatgcattttgtagttaccataaacaagatcttttttctttatatttttatctgtcattgacatataggaatgttactgatttttgtatattattttgcatttggctagtttattaaaatttcatattatctataatagctttataatgaattctcctgggttttctaggtatattaatgtatcatctacaaaccataattttgcttcctcttttctcatttctttttcttgtgtcacatgggttaactcttccaataagccgtgaaatcccagaggtgatggtggcacctctgtcttgttcccaatcttaatcaggtgtttcaccttaagtacaatgtagagtattgttctaaaattgaagctttatcatagtaaggaaatattctttttcctagttttgaatgcttattttaatcagggttacatgcctaattttatgaaatgcctgtttaggatttattcagaagaccttaacatttttttttctcatttaatgggatacttcgtgttaagagatttcttaatattaaagtcctttagagattaactgtcctttgtcagttaatccctaaaatgggctttaaaaaaattagtgtcgagtcaatttatcagcatcatggtgaagaaaatggattcgaagtggaatacttatgtttgaatcccacctttgtgtaacagtgacttgggccccattacttaatttctttctgccttagttcttcgtctgtaaaatggagatgatagtaatagtatctaccgtatagggctgttgtgaggattagacaaatcaatataggtaaagtttttaggagagtgtctagccaaacactaagtaaatacaaacaaaatattaaattattgagaatttaccatgtacctaatactgagcttgggacatggattcaaagatgggcaaactcacatgtggtgtctgctctcatgaagcattcagcctggtgagaagacagatacttgtgaaacaatcacttggaagcatggagatttacttttataataagtaccaccaaggagaagttacggtgtcatgacactgtgtagtagtgggcttgacctgaccaaggaaggacactaggctgagatctgaaagatgggtatgctaagagtgttgtaggcagagagaaccgcgcaaaggtcctgtggctctgcagtgcaagagtgtggcagatacaaaggacagaaacaggcaggatttggctggaaagctggtggatatgaagctgggaggtcactaagggccaggccatgtggaaagccttgtatactttaattttccttattgaagagcaaggaggagccattgaatgtttggggcatttgggaggttggcatgacctcaccaccttctgcgtgcagtgtgaagaacagattggcaaggaccagagcaaatgtggctgaccagttaggagttaatacggcagtttaggaatgagcttggtgtagggtggggacagacggagatagagatagagtggtagattagccatggggttgtgaagaagaggaagcttctaggtgagccttacttagataaagagatggaggcatgattccattcactgagttggggggtaggcaacagaagaggagagagtgggtggggggacatcgagagcatcccaaaggggtgatgggcctggcccacagagggatggctggcctggatcatgacgttgtgagtaaccaatgcacaagtgggaagtcccccaaatcggagagaggagcagaggccttggcacggagactgaaaggaggcagagaaagagcaggagcaggaaaggagtatggtattgtgggaggaagctcagggcattgctgctcaaagtgtggtcccacagagggcatcatcacatcaccagggagcatggtgggaaggcagtccctccagctccaccccggtgtcgatctgaatctccatttgagacagattccccaggtgatgcgtgtgcacagtgaggtctgagatgctctggcccggaggagtgtttctgaaaggagggtgagcaagagcagtcagaggcactgagcagtaaattaacaagaaaacggaaaaatagccactgagcccatgggtagtagatctgtttgggtggatcaatgggaccagaaggcagaattgacagggttggagagtgagtgggaagtaaggaaatggagacagaaagtatagacagattgtgttttctataaatttagctgtgaaggagagagagacaaggctggagggagacgaggagtggggtagggaatttttttcttaacgatagagtcttgagcacatttaaaatgagaagatactagtggagaggaaatgactgaacacacgttagaaagaaacaggaacgtatactgttcttgaagagtagggaagagtcgagactcttggcaagagtccatttagatggaggaagaggtagctcctctgtagcaggaatgaagacagcatgggataggctagaagggtttggaattgggaagacaagggaatccttaggaatggcttttattttctatggagagtgagggagaggaattagctgagagccaggaggttgcagacaatggagaaggtttgaaattgtggttctgacattccatgttgtagaggggaagtctgagttcagcctggtattggtggctgtgtagttcagattctcaaagccttaattttctactgcatagagttgttgtaagccttgattaaatgatacacaatgtatcacctggtcagtacacagcgcacagcaagccgacaatcaacgttagtcaccctttgtacctccctcggtgccaagtacagggctggctcatgggaagcacttggaaaagtgggttcatgatttgctaacacattgctcctgactctctagaagcttctaggagttattctggctattctgaactgctccatttctctttcccaggccagaactgcacgttccaactgcacggtcccaatgggacagttgagagcccagggttcccatatggctaccccaattacgccaactgcacgtggaccatcaccgcggaagagcagcacagaatccagcttgtgttccagtcctttgccctggaagaggactttgatgtcctgtcggtgtttgatggtccaccccagccagagaatctgcgtacgaggtaccatgctgcccaccttccctgtagcaaacagctgggctatgagccaagctcactaggaggaagatctttctcgagtgaaaagtttatggtcatcaacaaagaccactgttttcatgatgtcctccctcaacccctctggttttccaattcatgtctcttgcttagaggtttccggttgggaggattgatgagtaggacatttgggaagactagagagaaaacacaagagggttctagacaaattcagctctttcttttgaaactgatttttcatgcacagggtgtattatttgtacacacagaaatataagttggaaccaacagatatgggtgttgaaggctgatagtgatgcagtgaatatgtcttgcgtcacagtatttgaaaccatcaatacttttctggactttgctttgcatttccaaggccttggttgtggatgtagactctggaatttgggggagttctcaccctcttaacccccatccctgtgatggaagagatccccatggagagagtaaratggcttcctgtacccctgagctgactcccaaggggaagagcttacaggagggagatgggaggaaggcttccaacctctgcagaaagggcagacttttctggggcaaaggtgaagaccccagggtcaaaactctctaggtgacccggaggccagccagggtctgtcacaagccttgtccaggtcaggtcagcgtggcttcccggctctacaggaagccaaagggttaatggcttacaagccaagccctggggagccggaggtgctaattgcttctaatgacatgatgcactaatgagtggttcccagccaaatgcttaacctcaaagctttgtttaagatgcatctcagcccttggcctccaagctcctgcagcagggtcacacacacatttactgcacagtcttcagccctcttctctttcccctctgggcagaagtgagtctgggaagcctgcagcagaggcgggggggcatctggggccccctgcaccccttctgcagcttctcccagaaaagactgggctaatcatcttcccttgaggttcagcagggttctgtgaaacattggtaaagggctagagtcctcttcaatcattcattccacaaatatttcatgggtacctattatgtcttgacactggcctagatgctggggaatagcagtgagaaaaacaaagccaccgccttcatggaggttacatgctaatggggaggcaggcatggaaatatctaacatgtctggtcctatgaagacaaagcacacagggtaagaaagtgatggcaggagtgctggctttattattattattattattattattattattattattattattatactttaagttctgggatacttgtgcagaacatgcaggtttgttacataggtatacatgtgccgtggtggttttctgcactcatcaacccatcatctacattacgtatttctcctaatatccctcccctagcccccaaccccctgacaggccccggtgtgtgatgttcccctccctttgtccatgtgttctcattgttcaactcccacttatgagtgagaacatgcagtgtttggttttctgttcctgtgttagtttgctgaggatgatggtttccagcttcatccatgtccctgcaaaggacattaactcatccttttttatggctgtgattgctggtttttatagggtggtcagggatggtctttcccaggggaaaragagctatgagcagagagctgaatcatggaatatcatgtatggtgtggtatcccatgtaggtatctagggaaagcttctaggctaagggcacaggaaatgtaaagggtacagggccaccgtttggaggatggtcttgctgtggcasagcccactttggccaagccagtcatgttgactaggaagacctgcagttttggaatcctcattctagatcatcccaggtgttgtttttatgctctgctagtttgaattcctctcacaagcaaaggagggtatgcaggaggtcagtggttagaggctagagcagagccagtgggtaggagttctggaagggaaaaagtgaggctgggaggtggcagaaggtggtagatcctgcagggcctcataggccatgcagggactttggccttgatcctgaggcacaggaaacccttggagggttctgagcagaaaagggacctgctgtgacaggcctttgccatcgtggggaaaatggagtgaaaggggtgaggctggaggctgctgttcagggcagagaagaaggaggcttgggtctcctggaagtggggacatgatgagaagtggccagctctgtgctgtattccaaacacagagtggacaggatttgttgttgcattgggtgtgggctatgggagaaaggagatgaggatgattccagtctccttggccttaatgattatggaaagaagtagctgtttcctgagatggggacagcaacaggaggagctggaagttaagattcagtttggccctataaaattttagatgtctattagatatccaggtggagaaggcayttaacgtgcacttgaatatgtggtttttgagttcaaggccgtcagggctagagatacaaaattgggagactaggactggatggtgcctaaaacgtaagactggatgtggtcacaagggagccagtcttctccatcagattttgagctcatgtgacaccatctatggggcacctgtgtagacttttgatgaatgttgaatgcatgtttgaaagatagaaagtcaggtcaaaccaatggggcactgattgaggtatggacagctagaggcaaattctccaattctgcctgctggagttatttaagcttgtcctgctcttaaggcagagtccccacatgtgtggtcgagtctttgttttctgacacttggttttctttctttytttttttttttttttccaggaaacttaagatttyatttgcataagccacagtaattaagaaattcaatttggttttgaaatggagattgacatacagaaacacaaccccatacacacattctcacacagtctgtgggaagtgtttccagagcagtcttgtttgtggtatttgttgtgtggtcctagtggggaagaagtaaagagtctttgttcacctcagacaaatttataaactaactgaccaagagatggactttgtttacaagtctgtttataaataaaatgacgttctaatttttattaaataataggcagttaagcagcagtaaaaataagtataccagaattaaacaaagaaaggggttcatatctcactttcaaatggtcagctcttttccccctaaacctcaaaaaatcttctgtctcctctcaccatcttgttttagaattgactaccaactattgcaggaaattgaactgtttttgacctacatttgtgatgagtctgccataatgtaattctgattgtgctgtcaaagaaaaccacatattccccccaccaaaagaaaataattatgtataatgcaaacgtgattatcattgttagtgtggaagggtacaatttatttatttattattattattattattattattgtacttttaagttttagggtacatgtgcacaacgtgcaggtttgttacatatgtatgcatgtgccatgttggtgtgctgcacccattaactcgtcatttagcattaggtatatctcccaatgctatccctcccccctaaccccaccccacaacagtccctggtgtgtgatggtccccttcctgtgtccaagtgttgtcattgttcaattcccacctatgagtgagaacatgcggtgtttggttttttgtccttgtgatagtttgctgagaatgatggtttccagcttcatccatgtccctacaaaggacatgaactcatcattttttatggctacatagtattccatggtgtatttgtgccacattttcttaatccagtctatcattgttggacatttgggttggttccaagtctttgctattatgaatagtgctgcaataaacatatgtgtacatgtgtctttacagcagcatgatttataatcctttgggcatatacccagtaacgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatggtgagcattttttcatgtgtcttttggctgcataaatgtcttcttttgagaagtgtctgttcatgtccttcgcccactttttgatggggttgtttgtttttttcttgtcaatttgtttgagttcatcgtagattctggatattagccctttgtcagatgagtaggttgcaaaatttttctcccattctgtaggttgctgttcactctgatggtggtttcttttgctgtgcagaagctctttagtttaattagatcccatttgtcaattttggcttttgttaccattgcttttggtgttagacacttgggttttctgactctgagaggaagtatggaagactcagcagagactggtctggcctgtgttctagcatggaagggtgggagtttccatgacctggagaagtggttctggcagggaaggcttcctcttgtccttaggatgcagaagaatcagatgtgtccccagccacggcacagcattcctggccaaccagccatgaggatgaggctctggggttgaaccttcattgggttttccctgcttgtgctcctgatctctgtcatctttatgatctgcttattctaattcatttcacacgggcttagcaaaggggaagggctagaaggagaccactgcctttttttttttgattgatgatgacaacaatagccacagcaacagctaatatttattgagtctttaatgtgtatcaggcattgttctacatgctttactagtgaggctggagagcagtggtgcaatctcagctcactgcaatctctgtctcctggactcaagcacttcccccacttcagccccaaaagtagctgggactacaggcatgagcccccacgcctggctaatttttgcactctttctgtagagacagggtttcaccatgttgcccaggccggtctcaaactcctgagcttaagtgatccactttgcctccatctyccaaagtgctaggattacagatatgagcctccatgcccggtctactagtgtgtcatttaagtcttaaaacagtttatggttaagtgttactattaagcctattttaatgaaactgtagcaaacttagttatgtcacttgcccaagctcagatcatttttaagtagggccagaactttatcccagggataaataatatttcagtggactgagaagttgaattaggaaaaatgaacctaattttgattttgagaaatctattgaatgttccactcataattaatttacaacaatgaacaaaataagggaaaaaatcatcacttaaaasacagatatatagggttgaacagagagtgacaaagagcgagagctagaagattctttggrggcccctctttcctacatctcagcctctctggttctatcagatgagtcctagcagcattttccatgctgcacttttttgtgtgtgtgatctaaccacacattcttcatcaaataccacctcacttctctgctccctttgccagacaattctccaaagagctgcctatgttttctatctctgcttccttgatttctttttttttttttttaatttttttagtatttattgatcattcttgggtgtttctcggagagggggatttggcagggtcataggacaatagtggagagaaggtcagcagataaacatgtgaacaaaggtctctggttttcctaggcagaggaccctgcggccttccgcagtgtttgtgtccctgggtacttgagattagggagtggtggtgactcttaacgagcatgctgccttcaagcatctgtttaacaaagcacatcttgcaccgcccttaatccatttaaccctgagtggacacagcacatgtttcagagagcacggggttgggggtaaggttatagattaacagcatcccaaggcagaagaatttttcttagtacagaacaaaatggagtctcctatgtctacttctttatacacagacacactaacaatctgatctctcttttccccacatttcccccttttctatttgacaaaaccgccatcgtcatcatggcccgttctcaatgagctgttgggtacacctcccagacggggtggtggacgggcagaggggcccccccaccccccagaygtggcggccaggcagaggtgccccccacctcccagacagggtggctgccgggcgtgggcgcccctcacctctcagatggggcggctgccaggcgggggcgccccccacctcccagacggggcggctgctgggcggggtcgccccccacctcccagacggggcggctgctgggcggaggggctcctcacttcccagacggggcggccgggcrgaggggctcctcacttctcagacggggcagccgggcagaggygctcctcagttcccagacggggtcgcggccgggcagaggcgctcctcacttcccagacggggtggcggccgggtagagacgctcctcacctcccagacggggcggccgggcagaggtgctcctcacatcccagacggggcrgccgggcagaggcgctccccacatcccagatgatgggcggccaggcagaaacgctcctcacttcctagacgggatgacggccgggaagaggcgctcctcacttcccagactgggcggctgggcagaggggctcctcacatcccagacgatgggcrgccagttagagacgctcctcacttcctagacggggtggcggccgggaagagacgctcctcacttcccagactgggyggctgggcagaggggctcctcacatcccagacgatgggcagccagttagagacgctcctcacttcctagacggggtggcggccrtgcagaggcggcaatgtcagcactttgggaggccaaggcaggcggctgggaggtggaggttgtagcgagctgagatcaggccactgcactccagcctgggcaacattgagcactgagtgagcgaggcacctcgggaggccgaggcgggcagatcactcgaggtcaggagctggagaccagcccggccaacacggcgaaaccccgtctccaccaaaaaatacaaaaaccagtcaggcgtggcggcgcgcgcctgcgatcccaggcactcggcaggccgaggcaggagaatcaggcagggaggttgcagtgagccgagatcacggcagtacaatccagcctcggcaacagagagagaccatggaaagcgggagacgaagaagagggagcgggagggggagggggagggggaaggagagggacgaccactgccttttattgacctggaaccagaggagctcacacctcggaggatgataggaggggaaatgaccttagaggacagtccaagtaacattggaagatgctgtccttgatactggaatggtgctactctgggggtgtggagaggcagcagcaagcatgcttggtggggacccttgggtctttgtgaatttttttttaatgttcttgcatgatttttaatctactgagatttccttcttattcatgaatcatttttgtgtgtgtgttagtccagggaatcaccaataaaatcacccattttattgagagtgtcaagtctattatcctaaggttgtacactgttttcccactcaacctttctttctccatggtgtctgggtcacatccctttctcacatctgctcctgtgcatttctttctttctttctttctttctttctttccactcagttagtcttgccagaagtttgcctattttattggtctttttaaagttccartgctagggtgatccattttattctcttttatctaaattattgatttctgcttttatctttatctattcttttctctcactttccttaggctaatattgttcttttgccaattttgtaaattaaattagttttattatttcttgtttgataataaaaacattaagagacattttcccctaagtatagctttgaccacattccataaatttttatggctagttgttattttagaaagagtttctaattgcaattttgttctttctttgactctagggttttccccttaaattttgaagtaatatttgtttatactttagaaattattatctagctttatttcattatgattagattatgatttctactttggagaatttgttgacttgtttccctctgtataagatcattttttgtcagtattctatgaagaaagatattctgtgtatgaaaggtgaaaaaattatgttattaatatcattcagtttttctaatttcatatctattgcctaactgatatttgcggataggcaatatattgctctcacattcttactatagtttatatcagttcctccttttattcctaagtttttattttatatactgtgatcctatactcttcagcacattcatattttcaaacattagatcttcagagtgaattttgtatatgtatatatatatttccaatatgaaaattgtagttattccctattctctcctttttttttttttttgctttacattctactttgtaccaatattacactctttttttctttcagatatgcattgattgggtccatttttgccaatttctctatttttaatatatctatattattgttttaggaatagttcttagcacaatatacacagtagttaaatttttaaaaaatcctggctaagagtcactatcctttaacaggaaaatttagttcactcatattttttggtaacaactgatatgtttgctcttctattatacttaatgctttctattacttttaagcgtccttactgttacttccttttatctgtcttctagtgcaagttgtctttgttttttctgtgatttttattctattagtgcttaaagttgcttctttagaacatgttttaagctgtatttttctgtcaacatcctgcctagctagcttttgtcttaggtaggtcttactgactctatcttgtagaattttcttcgtgtttgtagcatgtaggtatctatctgtattccttggtttccaaagttaatgtagatattccatctctttatatactttagatcattttcatgagaatttagggggtcaggcaaggcagagtttaacatgttatcgttcctcttcatcttgacatggaaattttttaaataaaagttttattctttttgatgctattgtgaatgggttttttaaaaaatttgtttttggactagccattgttagtatatagaaatacaattgatttttgtaaattgatcttgtatcttgtgaccttgctgaatttgttagttcagttcgtttatatctgtgaataaaagttttaattcttcctttccaatcgggataccccttatttctttttttccctgattgtgctgtctagaacctccagtataatattgaatagaaatggtcagagtggctagccttgacttattcctgatgttaggggaaaaacatttcgtcttttagcattragtatgatgttatctgtaggttttttgtggatacccttctaataaaaatttttaagcagaggattttggcatgatttggtggcagtgtggaaaatgcactggggtggagggcagactggcgaccgtggggcaaggaaagagacagcagtagtctggactaaagcaatgaagggtaaagatggcatggatgtgtatgatgctatgggaaagagttatccccagagttagtagtggatgtatagggacagtggactgggagtaagaaaaagaaaggaatggargatgactccgcagtgtctgccttggaaacagaaaacaaaccaaatcagtctgcagtgaatttcagtctccagtgaaatgtgttcttggggcctaccaggatatttgctgcactgacatttttcttcacttgtctggtagatagagcaggtaggtcacctcctgtctcagtgttttcctgtgagacagaagggtgcagtggggacagacctagatttatacctagctaggctctacatttattaatgctatgacctcatacaaggtttggtttctctgagcctcatctataaaatggaggtgacatttacccgccttacagggttgttgtatgtgagccaccagctatagrtgcttacgtggtccggaaacattgtttacgtcctttcctgcccttctgttcttaggactcagtaactcagacctttccagagagttctagtgcctgtgatgacacttcatctgtggccaactcatcagacattttagactgggaatttcaggtgtggtagaaagacactgaaggagtcactgagctcaggaacagtcattaattgtgcatgtatgtatcatgtgtatgtatgtaatgtgtacgtatcatggcattactgatcccatgatagcctcctctcctctcccttcccacacagacagtggggccagaccaccaagaggcctgcagcagatttttctctgcctgcatcacctgggggatttccatgtttattgtctaaaacttaatgagctgggcacagtggcatccacctgtagtcccagctactactcgggaggctgaggcaagaggattgtttgaacctgggaattcaagactagcacgggcaacacagtaaaacctagtctctgaaaaataaaaataaaaaaaaayttcatgagtacaagttttgcaattactgctttcactacattttaaaaaattattttattttagattcggaggttacatgtgctggttctttacatggatacattgcacaatggaggggtttgggcttctagttgtatccatcacccaaatagtgagcactgtacacaataggcagtttttcaaccctcactgcctcccaaactcctcccttttggagtctcctcacagcattttttttttttttttttttttttttttgagatggagtcttgctgtgtggcccaggctggagtgcagtggcacaatctcagctcactgcaagctccgcctcccgggttcacaccattctcttgcctcagcctcccgagtagctgggactacaggcgcccgccaccacgcccaactaattttttgtattttttaatagagacggggtttcactgtgttagccaggatggtctcgatctcttgacctcatgattcgcccgcctcggcctcccaaagtgtcctcactgcttttttttttttttttttttttgaracggagttccgctctttagcccaggccggattgcagtggcacaatcttggctcagtgcaagctccgcctcccaggttcacgccattctcctgcctcagcctcccgagtagctgggactacaggcgcccgccaccgcgcccggctaattttttgtatttttagtagagacggggattcaccgtgttagccaagatggtctcgatctcctgaccttgtgatccaccctcctcggcctcccaaagtgctgggattacaggcgtgacctcactgcatttttaaggcatctctcttctcttctctccaacactctggtcttctttctttatggatgcgttccaacaaaaggctgaaacgttacctccctaccccaatcctagccccctttaacctcacctttctccagctgcttgctcctggattgtgttgtgagaaatgaactttcctcctattagattctaagctccttaaggctgggagtcatgggagtcaagccttctatatatatatatatatatatatatatattttttttttttttttttttgctttgctgtaacagagccatacagtggaatatacaccagtcttgccagtagatgacatgagtttgctctccagctcctccctagctgcatagcattggcaagtcactttcactgatatccacagtatgctaattgataaacggggtgtatcaagatctaccttataggttagttgatcaagattaaattaaaacagtatgtaaactgctttaattatgatgagatagaaacaaaaggaatactcctacatttataggaaaaattagaaagcactatttagcaaaaagacaaaataatttgtgaatcatgagrtagagcagtggttctcaactgaaggcagttttgtcccccaggggacatttggccacatctggagaaatttgtggttgtcccaactgcaagtggagaggtgctgatgacatctactaggttgaggccagggattctgctaaacatcatcccacaatgcacagcacagctgtctacagtaaataattatctgtccccaaatgccagtaaagctgaggttgaaaaaccgtgaggtggattgatttgagaggttcatacctttagcataagacatacctgggttttactcctctttctatgtctgtgaacttgggcaagtgagtcaacccattcaagcctcagtttccttctcagcaaaatgggaacttctcactgatgctatgtactggcagcttcacctggcatcattgatgagaaggtgccaatagacacactgcgcacagcttgttctatatgcagatgctattcatctcccartgactccctttctctaccaggagttcatagccatctccttgaaagcatctcacatttcatctggagctattcacaagcaaccacatcccagggtgccagaaggcagcgtctggctgcttcaaattaaatttacaatagaagctgatcagattcttctcataatggatcagggtggggaacgggagtaggagctggtcctgaaggccgggagcctgtaggagtttggaaattagcaagaaaagaacaaagagccttccagataatgcagtgtcagccctgcctggatgaattactgaaacaatccccacgtctctgcttttgcacaattagatggcctctccgtgctggcagacatcctattgcattgcagtttaatgtggaatgaagttttctaatgggacacgagcaaacataatctatgaagacgctgctaataaactgcatcccgtatattggagggtttatagggtgctggtgatgactgcaccagttaagcacagmtaagcatctcttaatttagacatttgggctcaagttatgggaaacactacaactcgttccctcaattattggaaatacacattctgtcatcagcctaaggtgcaatgtagttttagtcatttggagctagttgcagatttcactcaactggcgtcagacacctgttttggaagttgtaaaaatccacaaatttgccagatttactgtcttcttatgaatatgtatcacagcagaggcccccaaaggacctgttttttggattccttaaaaggtgtgccttgcacatcaatagggacgtccttgaagggtctgctctccagaatgcctctgggaatgtgctcttgtgggcagaaggaggctgggaggacccatggggatgagggaaaagtctttgttcaggattgaaacagagaggggacactggaaaggagaacaaaggaatgaggacactgaacggctattatgttccagccaccatgctggacacttgtgttcatgctctcatggtaatttattctacatttattgaatgcctaacaggaatgccaggtatcrgagacacaacagttaacaagacagcttctgccttcaaggaacttaacgatatctttagggagacagttaaataatcagggtataagtgctatgactggggaacctgacctcgccttgggggagatctttgtggatgctcatctggaggcttgggatgaaccccctccatctgccccttgcttagttgtcccttactcattcctcaagtaactcagttgtcccttccttgcccaggacaccctttcctcacaacctggtcaaaccctcctgtgatacctgctcagattaccatgcattcaccctttgtggttttacacrcgygtgtgtgtgtgtgtgtgtgtcttcttcatttatgcccatctaccccacaaggctgtaaactccttgatgacaagaactctttctcttttacttttcattgtagctctccagggcctaacagagagtctggcttatagcagatgctaaacaaatacttatggagtgaatgaatcaatgctctctggaggaagagatccctaatagagtgtggaaggagggatgagagtgtttcgagccaagaaatagtatgtgcataggtctaggcaaaagtgagagaaaggtgaggtgcagaatgacaatgggtaggttcattttggctggtgtatagtgggaaggtggagcagtggcccgggccagctccaccagggaccctgtatgccctgctgaggagctcgatacatttctaagaaagatggttcacaatgaaaggttttaaatagacattgttcacattatctaataattcaacaacacctttaggaggtgggtagtattaattctctttgcagaagttaagcaagcatgtaaggcccctaagctgccaaatagctgatatagtttggctctgtatccctgcccaaatctcgtgttggattgtaatctccaatgtgggaggtggggcctggtgggtagtaattggatcatagggcggatttctcatgaatggttatcaccatcctcttggtgctgtcctgacgttagtgagtgagttctcatgagatctggttatttaagtgtggggcacctgccccatctctgttgctcctgcttttgccatgtgatgtgcttattccccctttgccttatgccgtgattgtaagtttcctgaggcctccccaggagccaggcaaatgccagcatcatgcttcctgtgcagccagtgggactgtgagccaattaaacctctttcctttataaattgtcccatctcaggtatttctttacagcaatgcaagaatggactaacatagtggctaaagaggggtgggccaggggtctcctagagccagaaacaaggctttcccccactataccaaaatgccttttcattgctttggatttatttgcattcattcattcaatttccttttaaaaatccattcctttttcctttttaagcagtttctctaaaatagtaaatgtaataggtattttctgctttaagaaggtcagcagtgtatagagtgagaaaaatgcagctgcctcctttcccaggcccttgtcccagcctcactccctrgaggtaaccgctgttaacagtttggtgtgtgtccaatttctttttaaataaggattcattaaactgcccatgaggcttattgggacatccatcagacctttaaaaattgttctgatgaattaagtgtaaactaattagaaacatggattcaattacccttgaaacacacaagggtttaataattaataggaagtgggtttgaggccaaaggcattatggattttatcaaacccctaacatcagaaaagtaaatatgtttgattcaccctaaatgctggcaaatttgccatccggaggcaaacctgttggtaggagctgtgtagttaatcaggaaagttagctgtggttaataaggaggcagaggaagaggggtgcagaagacaaaacccgctgatcattgctgggcagggcttcttgggacagggaagtggcctgttttgtggggttactgcagtctgcttccttcacaatccaaagcaggctttggagtgggaggctggatacctgggaccctggtatctgcttgatatccaagttcacacaggtcagcaccacctgaccagcaccgaagggggttatggaaggggaggagtggggtctgccagggatgaggctctggaaaccaaytgcagtgaccccatggggcagccatgtgctccatccctaatgccaaagggagggtctgggcagacgtggtgggggaggggttggcagcaggtgatacacaaagccaggtgggcagcagtgtcggggtcctgagcaatctctccactcacagtaggaccctgtggttcaaggtcaaaatcaatatttgtggcaaagcctcaccttgctcattcaccaagtctgctgtttaatagcagccaaaatttaacaccccctggagccagagtctcagtccaaaaggctgtgctgcctgcatcacttctcacaattggtcctgcctgcagtatcatgagatattggtcaaagacgcaacattcccctagagcagacttggccacctctagatcctcatcggcccctctcttccaagtggctgctgacagcactgttgctgagataggaagtttcccccttctatatcctcagctcttactccctgaacttctggggccacagaatttgctcttcaagggaccctggtgtctgcagggtggaggcaggtttggacttgtcattctagtcttccctctgtttctttttcagcagacacggtacccaaataaacacttcccaagtattgagtccctcattctcttggaattaaagtaaatctaaaactaaatcaattctcgacttttaagtgacaaaagagccaaattattgtacccttaagtgggtctactgccacaactacccataaacagtgaggccagccttttgctactgcatcaatttctactctgtcacaagatgtggtgccaagagccagaccaggggcatggagagctgggttctgtcccagcttggccactggtttgcttgtgatcttcactaagtcctattccttctcagggccatctgcgttttcctgacttacaatatgaggatttaaatctagaggaactccaaagcttcttccagctctgaaattgtgtgattgaatgatgctggagatgcatatagaaggactataaaatatccctgagcttctgggattctttctactctacgtaggtactgctcttggctgtttcagcaattccagcagttgtctttggcgaacagtttattttccaatggcacgttaagcagtgtggcagagaaggctaattgcccaccatcaatcttgctccttttccacagtgtaggtgttagtgggaagcagctgcctagctagggacaatattttcctaggcccccttgcatctagatggagccatatgacttagtggaaggtagatggaaatgatgtgtgcctcttccaggtctgggcagaaagcctcctctgcaatcctctctttctatctttccctgggacaggagatgagagaagcctagatgcctggatgactgcatggagcagaacccacctcstcccctatctgctgctgattgattgaattttacataagtgagaaataaacttttatgtaaacttagacctcacgtattactgcaccagttgccccaggagctgcagctgactgggtttgcctagatgacatggtaaagacactgtagacagtatagactactagcctggctgttgaattcatggaagcagtttctgaccacgtgatgcccctagcatcttgcagactggcaatgcagcatcttcaatcctgcctggaggagcagatgttttcacgaagtttatagtggctagctcctctgcacctggcagtctttcactgtgccagttcagtctctcgcatcatcactgccacctttgtccttccataagcaatggctgccttattaagtctcataaggaaggaagcgtgaacaattgactccaccttccaatttgattattttaacccaaagggctcttaactagggatctaggggcttttgtgatgccctggcaagctggtagagctgcatacaacttctccctcctccaaagttccacagctacatatcaaagacaaggcaaatcttaaacttacgtaaaccctacaaagtaaagaggaacggggacgcatcttggctctgatagtttagctggatttcagttataagaggaattcctcaccatccagagataaagaaatctggacaataaagaagctttctagttctgcaagaagccttgcagtagtggatattttcaaacctgccttggtctgcaagggtgggggtgggggaatgcagacacaaagagttcttgcagacagaggcagatttgtatccactaccgcaaagctccacccatgtaagtgcccagtgttactcctctcaattccgtttgattgttgtggcttctcaggcgcattatgttattgacttctcccaacaatccaattgaagtgtcatattcatcccattttgcagaggagaaagctgagcttcagaatggctcataagccctatgctaagaaggtgtggctgagttcttagcattttctccctgctctgagccagtgccctccagccacaggagcctgtggagggcgggagaaaggccttgggcaacagtcagccagaaaaaggacccatctaccctaaaggacagagatagatgagaggaaacctaccagagacgggattctacagtcctgtctccttccatgtttggaatttgcctgcacttaggcaagaagtaaaggaagagggaatggctgtcttttctccactgcactcttcctccagtgtaagttaggtgaaggcctcaaagtggcaaattatttgtagaaccccaaaggagtgggcttcttctattttggagtatgtagaagagtaaagattttctttaattagatagtgccggatagatttaattaaagcttcaaacctgcaattttctttgtttgattgatcagttggtgctgattgcctggagtaattatgaagggggaggtggagttttcaaagtctgatggtgataagaagcagactgagtcaacccgtggatacttggttgtcagagtcattctgaaaagatttaaattgcacaaatgtttgttggctggtcaaatgaaaaataaggtatctaaatcacacttttgtctaaatcatgctcctggtggatgtgcttctgcagaaaaggtcccctttcccctcctttctccaaatctaatcacacctctgagaccaggcagtattctgttatttttgtctttcttttatgaaataattgaagcacattgttgggagtgtctcataatggccttctaaaatttctagagcttactggagggtcaggagagaaagagcatcttatagtctccatgtgaatttagggaattcagaaagagctttaaagtcaggcactcctggggttgaatcctgcctttaccatttactacctctttgactttggacaagtacccttgaactgctttttcctcatcagcaatgcaaaagagttgtgaagattctttgagctgatgtatgcaagccaagcacccacggttagcctgtgatgggttcttactggatttctgtctctttcccttcctgtgctctgttgctttgctgaggtcaccaccataaaagttccatgaactcacgggaccagagctgtcttgttcaccactgcagacagagacctcagcacactgctttgtacatggggggtctcagcaaattcttgcccartgaatgaataaatagttgaataccctgtatatttaggcctccctaaaagtagatgacaccagtacagagtaaaagaaggggttccaaagagttgccacatttatgaggccctggggggtgcaagatgaacaatgtcatgcaggctgccatgtgaaagcattggtggagaaactgttctctttttcctctgaactggtcaaaccatctttattagtccatttttcatgctgctgataaagacatacctaagactgggcaatttacaaaagaaagaggtttaatggacttacagttccacatggctgaggaggcctcacaataatggcagacggcaaggaggagcaagtcacatcttacatggatggcagcaggcaaagagcaagcttgtgcaagggaactccccttttaactatcagatctcacaagactcattcactattatgagaacagcaggggaaagacctgcccccatgattcaattacctcccactgggttcctaccccaacacgtgggaattcaagatgagattttggtggggacacagccaaaccattaccaacatcttggggaactgagttcagttctcagttacacactggaatgggaagctaatgattgtcaagactgctgcagcataaaaaatgtttaagttaaaaaataacaaaacaggctacagaattatctgtttattatgtacattaccatgtaagcatgtatacacaggtgaataagactagaaggaaatatagcaacatgctaataataacatgggtatgaggatggcttgattatgaataattttttaatcttttgtattgaaaagttttttgcaacatagttacattgtttttataataagaatgcatgttttgattaatgtaagattaaatgtaaaagaaaagagaaaagtttaagtatatcccttgctacccatacccaaagagggacattgacaaactcaagtgggaccacgggagaatgaccaggatgaggaaggactttatgttgcaagatggatcttgaggacttcaggctgttcacttgaaggaaggagactcttaggggaaatgacgactgttgtcaaaagctgacataagatggtggcactcaggctgtgaaatgtacattccagggraacaaacttcaagtcatttctaacacttgtgtctgtctagaactgagggtccctgtctcaggaagcaccagtgcagaagttggggcttctagggaagcacctctctgggctacagacatgccatctgcacagtggggctgtagctctctgtcagtcattctttacctggggatgtgcctccccaatcctgacttcctggagtcatggagagtggttcttgcatcacatattgtaagtgggagccagaagggaggtacgtgtgcagtttgaaaaagcatcttcagartgacctttactttgacttgtttttattcattttattttgaattttaaaccacattgaagaaggaggcagtcattttatgtgaatcttcatagggggtccctgattttaaaaggttgacaaactgctctggaaaggggcttctcaaactttcacacacatgcaaatcagctgggaatttgtgaatgtgcacaatcagattcagtctgagatgcatttccaaggagctcacaggtgatgctggtgctactggctcatggactagtcaggataatccctgaggctcttcctggcagcccctggggctcctggctccctagaatggcagaatattggtttcttatgtacaagccgttggcccatcctttgtagagtttgttgaatggagagtaaccatgtaagaatgcaccccccacctaatccaggcagcacataagaactgccttcagtagcaatagaactaagcattccttgctcagatttacatcttttgtacatgtttaaatctgtgcccatgtctgtttatcatttgcaaataatgctctgttgtcttaatcctacttttatggctaatgatgtgtgtttcattctcaagtgtagaactggagtaaatatatatttctcaatagttttccctctaatcactacccagagctgtgagtcattgggataactcatgtatgagggagcttgtatctggagtccatccctcaatgcgagccttctctggctgcctgttacagccctggtgcgggcattcatcctcgcctgtgccttccctgcaggctgagggaggcaccacaactttctccatgaatctgcgagggcatgacaggcttgccaataccatcgatcctgtccccttccaagcagaattgcttcactatcatttccaggaatttgtgatgtttctaatttgatgattgagtgtcgctctccaccattcctgctcagctgcagatagtgctgtctgtcctgcagaccccaagcccatcctgactgtggagaagccccatctttcccagagagcggcacaggactgagcattctaggaccaggacactcagatgcctactgtgctgcagtgtacccaaccccctggctggtccacatcctgctgcgtccaagcccgccagacccctgcctccctaggctagggcaagactccacctgcctctcttgagcccacttgtctctgcagctggactcagaccctgacttctaactccaygtcagagccagcccccagggccttagcagctcccaagacttgcagctcgagcttcatggcatcccccctctactaggctggtttctgagccccaaactttgattatttcccctcttcctttctctgcccattatttctgctgactttgttggtgtttcaagatgcaaaggatcagggaacgctgagggagaggaaattccgagggaaaggaaattccaaggcagagagggggatgcaggagggaatgagcaacgagtagggtgggatgaatcaactgcaggctttggaacagcgcttcctgatcataaaaattagcacttatacagtatttgtatatgcagtgtatatattagtatgtgtgctgtgtgtatgtgtctgcataaaaaacactcgtacatataacacatccttgcacccagcactcttctcagcttgaaatgctacatctcactgagtgttctcagcagccctatggggaatgtattatcattagccccatattacaaatagcaactgaactgaaggaagggagggaggaagtgtcttcctacggtcacacagctggctgatccaggtggtcagacttcagagttgaccattatgtcttgaccattctgtaatactgtctcaagttcctaattgggcagggtggagatatggatccctctgaacttctgatgacagccagggactctctcccataatatacacacattgaactaaaattttgcatttaatttctatgggtggactcacaaactacttgaaactcatctttgagccccagggtaacaactcatgatttagaggttgtgcatatagrtggcaataatgataataggaatttaaactatttttgagcatttactgtgtcctgggtacagtgctaaaggctttccatgaattaccttgcttacaacatttccataacatttccattcacccgcattgcacagataagaaaattgaggtttatagaggtcaagtcattgtctcaagctcaagcagctagtaagcaccagagatgaactaaaacccagctctgctggttccaaagtcagtgctctgtgcactgtgcagccggccctgcttagggctggtggtacccttgtagacataggcctgagggagagaaggggcagttttggggatggtttagaatgtgtgcttctggactgttttactgcctgaacctttggagatttggaccccagcccatgcctgatggagtctgcagtttggcataatgaattctgtgcatacccaacaattcggccctatctttgagagcaraaaggcagagtggggcgaagaaggaaagtgttggtgcacccaaaggcagagctggacatgggagagaagaagaagtctgtttcaagctgtctgtaagacactctcagagttaagagaccatcatgaggtggggttgggggaggggagmaaaggaaggcctaggggaaagaagagctttcaggaagcctccttgatatggtttggctctgtgtctccacccaaatttcatcttgaattatactcccataattcccacatattgtgggagaaacctggtgggaggtaatttgaatcataggggtggtttcccttatatcattcttgttgtagtgaataagtctcacgagatctgatggttttatccgagttttccgcttttgcatcttcctcatttttctcttgttgccaccatgtaagaagtgcctttcgcctcctgccatgaytctgaggcctcccccgccatgtggaactgtaagtccaattaaacctctttttcttcccagtctcgggtatgtctttatcagcagcatgaaaatggactaatacagtaaactggtaccagtagagtgaagtgttgctgaaaagatacccgaaaatgtggaagcaactttggaacagtaagaggttgaaataatttggagggctcagaagaagacaagaaaatctgtgaaagtttgaaactttggaacctcctagaggtttgttgaacggctttgaaatgctgacagtgatatgaacagtagggtccagactgagatggtctcggatggagaggaggaacttgttggaaactggagcagaggtgactcttgttatgttttagtaaagagactggtgacattttgcccccgccctagagacttgtggaactttgaacttgagagagatgatttagggtatctggcagaagaaatttccaagcagcaaagcattcaagaggtgacttgagtgctgttaaaaacattccatttcaaaagggaaacagagtataaaagttcagaaaatttgcagcctgatgatgcagtagaaaagaaaaacccattttttgaggagaaattcaaactggctgcaaaaatttgcataagtaacaaggaaccaaatgttaatcccaaagacaatggaaaaatgtctytaggccatgtcagagaccttcacagcggcacctcccattacagccccagaggcccgggaggaatacgtggttttgtgggctgggcccaggatccccatgctgtgtgcagcctagggacttggtgccctgtgtcccagccactccagccatggctgaaaggggccaacatagggctcatgctgtggcttcagagggtggaagccccaagccttggcagcttccatgtggtgttgagtctgctggtgtgcagaagtcaagaattgaggtttggtaacctcatttcagatgtatccaaatgcctggatgcccaggcaaaagtttgctgtacgggcggggccctcatggagaacctctgctagggcagtgcagaagggaaatgtgggatcggagcacccatcggagctccatctagtggagctgtgagaagagggccaccatcttccagaccccagaatggtagatccaccaacagcttgcagtgtgtgcctggaaaagcagcactcaatgccagcccatgaaagcagcccagagtggggctataccctgcaaagccacaggccggagctgcccaagactatgggaatctacctcttgcatcagcatgacctggatgtgagacatggagtcaaaggagatgattttggagctttaaaatttgactgccccatctggatttcggacttgcatgggccctgtaacccttttgttttggccaatttctcccatttggaatggctgtatttacccaatacctgtaccgccatgtagctaggaaataactagcttgctttttgattttacaggctcataggcagaaaggacttgccttgtctcagatgagactttggactgtggactttcgtgttaatgctgaactgagttaagactttgggggactgttgggaaggcatgattggttttgaaatacgaggacatgagatttggaggggccagggttggaatgatatggtttggctgtgtccccaccccaatctcaacttgaattgtactcccataattcctacatgctgtgggaaggatcaggtgggaggtaatttgaatcacgggggcggtttcccccatactgttcttgtggtagtgaataagtctcatgagatctgatggttttatcggggtttccgcttttgcatcttcctcacttttatcttgttgccrccatgtaagaagtgcctttcacctcccaccatgattctgaggcctccctagacatgtggaactgtaagtccaattaaacctctttttcttcccagtctcgggtatgtctttatcagcagtgtgaaaacggactaatacactcctcttgcccrtaagggtttggccataggtttctatagccagttctgttgctttgcttctccagggactgtcagttgtggcatcagagagcagagtctcaaacaccagcagaagcaagggtgtggctggaggcctttcagcagaacaggccaaagaagagccaggttcagccacagatgttggaggctccccctggccatcctgtcctcccttgcctggctgtcccaccctcgggatggaccctcaccttgggatctcttgctcatggtcttgcccccggagcccctccctctgccctcttcaccaccttccctgtcctccatgtccttcctgtaccccctgtcttcactgccagctcgaatgcatgtcctgaaacatggccacagcgggacttcctggcttgtctgttttaaggcatccacattaaagtgactgtcagaaggtataagctactcttttgctaccagtcgtgtgtaccatggacacccctgatggatgtcaatgacatgtgttacttggtaataaaaatagttgaaggcttaagggtttatttttaggctgggtccaaatgctacctcagaatgcctctgcagagtctcagagggcctggtgggtgcttgtctggttttgctttgagctattgccagcacctgggtcccagcaaggtcaagggctgtggtaaaatgtgctcttgctgattttatattcaccaagttcataaagaacttaagagtccaaagagccacatgtatcctgctggactccccatcagaggggaagccagcacactcatgacattggggtcttagcccatcctgatgacctgatctggggatcccatacacagatcccatacacagatatggagaggcttgaagcaattaccctagctgagctgacccaaccattgcctcatttggaaaaggaagataatgctttcaacctctagggccatgtgcatagacggcaataatggtgtcaggttataaggcctccaggaggttttgtaggatccagcacggaagcctgtgcctttgtgtgtgatgatggggatgcattgcagtcacgatgagctatggtgcccagcaatctctttcactcatctgagtaataatattgataatattaatggctactattattgagcacttactatgtaccaggcactgctctaagcactttgcatatattaacccttttaagtcttacaagaactctgtgaaataggtgttgccattctgcagatgaggagctgaggctcagggagattgagtaactcataagtggtggtgctgggatttgagcccatgagtcaggtagttgagcccctgagccccactcagaacacagatagcagagaagcagtgagtggtggccctgggtgctagagaggagccaggggcatggtcttccatggtgaggcagcctyggtgccctgtgtcccagccgctccagccgttgcgaaacggggccaatccaaagtctggatcagccaaggatggacagccatcagagcacagtctgccttgtggtcagagtgagatgtggcacacaagggcctggcacagagcctggcacactgtccagcykgcttctcaccatggcaccctcgatattcaggactatggagtttctttgttgtaaggagaggtcctccaccttgtaggatatttagcagcaacygtggcctgccagtagcccccctctccccattgcagagaagaaaaatgttctcagacattggccaatgtcccaggcagggttggrgtggagcaagcttgctgcaggggttgggaagtgcgagcttccctttgtgccaaagactcttccacggctacggattatggtctcttatgcaatagctgtctccagtcgtgacagaaagccaacttttctgacccaggggatacaggtgggtggggcctttgtgcatctcaaccaccaggcagaagcatggctaggggaggaacagggaccacgaagatgaggcctggctgagaggggactggacagtgactgctttccaagccttcacagcctttttatccttttccattaaagggattcatgacattttggttactccatttctgcaaagaatcaattgaaaagatcaaaaatatggcatctggagaatttaaaattagattcttacaaaatacaaagtagaagagagaagaaaaaaaaaaaaaaggaaacagggaaccccatgacttgcacaaatcctgcatttgttgcctgggagctgagcaatcctggctctagatgagaaggaattccaggatgcctgggggcgaggtacgctggggagggcaaggcagcctcagagctccccscaggctgccgcagttgcctgtcctcccccaggggccctgcatcctccgcctcccggtctttctccttcccatcctttgatatatatgttttcagtatataaatacattctaattatagaaaacttggaaaatgaagactgtcataaagaagaatttttaaaagtcagctgtcatgttggcacccagaaagaaccactgataacacaccctcacacacttatgcattgattttacccaaactgaatcctactgtctgttccttagctgcctgcagtcatgtttcagagcctcctttgcctgcagatcctcttcttaggatgttcattcccctgacccaggggactgttcttggctggtcctccttttcctctgtggcatccactcctgttgacctttcccattcctggccctcatcctcagctcctggcaccctgtgccttcctggcattcttctttccctctcttctagaggtcacaaatgtgatgaaatccaaggagccaatcgcagccatggctgtggcttctgtcaggccagaggtgaccctatgatgacctgatggtccagcagggtgggggtgaaagggacatttgaatgaacacagatgagatgggaccagccaggcaagagtccaagggagtggtggttgacagggattcagcccagagggatctgggcaggggaattaggaaagcaagagttacccaccaggatccagggtgtgctacagtactgacaatgtcgacttttactgcttgtgttcattcrttcattcattcattcattcattcacgtattcattccccacatagttactgagcacctgttaggggccagccactgagggagaccatataatatgttaattatactgggccatgtggtcactctgcagggttgaacaggcatygcaaaaacagtgggggaacaaaatacacagattcccatctctcccaaacttagcctctagtaagggagattagtaaataaactaggaaacagacagaatgattacagatttgataagcttctgaaggaaagaaatagggtgctagaattgacatggcctggggaacctacttgggtggcttgagtattcaggaaggacccagttagaatgagggggctgagggaagagggtgtcagatggaggcacatctagcaaaaagctgtgagccaggaaggtggtggccttttgaggcacagaagaagggcccatgggtctcgctccacccctctcagcccttggggtgtagcttttgytggtcactggaagcaccttgacttctgatgatactgatagctccatccttttgcatgtgtagcagtgaccttagggtcataatgtcaccaaatacttgagctgtgacttggggaacccttgagcctagcaggaccttggggatattattgtcattgctcacttacttgtgtcctgccatgacccctcatgcttctgtcctatgagacatagcaagtggcccagtctctagatttgcaaatggggaccagggctgggtttctttgcctaggacattcactgaccgccacctaagaagcagcaggtcctaaagtttggtttagacaagggccccacccaaggttcaaggctagttgagatctaaaaatatagcatccatggcttccagcttgtaaaacggcttcatgtctggcaggtggtagagcaatcatgtaattcagggctggggtgtggggagcagggtccaggcttctggggaccagggctgaccagccctaataaagtagggcgaacagtgctgaaggccaggtgtgcggtttcaaccagggtgggcagcccagtgggcactcagaccctcagagctgacactcactccaaacccagatccccagacaacaggcataggtggtgattccagctctaaaccctgccttctccctgtctcgtctgccttggtagatatagacttcctctgctactgtgggcccttcacatattccattctgatgccacagccttgcacgctgtagctcaacaacttccctctccttggggtaggtcttggtttatttatcttcataaattttgtttgatagctataggaatgtagaggatttgtttttatatcatcatcatcatcatcatcatttcaagcccttgctctaggtcaggcatcatgctaagtgccttccctatagcaccccattgaatcatcacaaagatcatctggggtaggtactgtcatctccattttgcaggtgtggaaacaaggatgagagaggggaagtgacctgcccggggtgacacagcaagtaaatggcagagctggagtctgaagtgcacccgtgctctacccagctcctatgtgatgcaggagcctgggaccctgtttctcccagctcacaagccatccttggcaaatggagttgtcactcccactacagctgtgctcatcctgtcccaactaggtgactatgactggctttccctcgtcccacgcccctactcccaggctagttctctctgctttcaggccaggagaagccaagcctgccagaaacagctctggccagtgtcactgccagcccagagcgtgcctcacctcctcaccccaacccccagcttgcctgccagtgctcagatgtgtggtgctataaaaagccaagtagtaatatgcaaattgccctgattatttatggccaagttagtaaataagccagagagacaaggtgggtagttgtttttatgatctctgcagtccttgcaggaaaatctacagtaggcagagtctgggtgggcagagctggagcccatggtttaacaaacacagcctaattatcaggcactggggacaaacaagcgagggggcttgtggaagggagtaacgggaagcggtggccaagaggcggaggcaaggggctggaggactgagtctggcagctggaccctctctgcccacctctctctggctcagcctttgagctgcctgccgggagggggcggggactgagacaccaatcagtgtaaggtgctgtagtgttgctaggaggggaggggtcctgacagtttgccagggcatcgcctccaccaggagcctcccactctaaagctgcaggaaacagcatagaaacagcgagaggctcagggcttaggggtctaggagaagggaaaagggaagcttcctgccagccatcagcctatgctgaggttggcgtggcatcctgggtgggcacctgaattagttttcagcgctgttgcatatctgtgattccagcccttggaaggttgtggtcaggatggaatcaagcagagagaccagggcagaggctgtggtgctcaagggacttgaggagatcaagactccaagcagccacagggcacagtcagcagtgctgctaggctttcgctcccactctctgctcaggtgtcactgggagtggaggggagacgcagcagatccagtagatgccacatccatagttcattggttggagctaatgaccccaggagcaaccagcaacccaaaaggagggagttagtgtattgataccccagcctcttcttcctgtaataggatgactctgagttgcgtattctatgctcactcccagtgttccccaatgggatttagctcaattgactcccagtggcaccttatatgaccaggtcccctttctcagctgccttctcttttctgtttcatatcccctcccctcacwgtgctcttagggtcaactcccaaataagctcacttgtagccaaatccttaacacaggtcttgttttagtggaaatccaacccaggtgatatagctaaacaggtgctgaacattttgatagaaataattgtaatagctatgagcacttattctgtgctaagtaccattcaaaacattttgcctgtattaagttattgaaacctctcaacactctgtaaggtagataccattgttaaccgtacatttgatgaaggggaaaatggagcacagacatgttaaagaacttacccaaggtcacacagctgagccaggatgcaaaacaaagcactactagctttagagactattttcctaattattatactaaattgcaggcctttcagatattccccaaagacctcttcattccaggccttatgcttagcattgggatccagagatgaagcagacataggccctgaccttggagaactcagtcttgaggcagaaacatgaaggaaatagacaagccagtgcagcatagagggatgtgtccagagctgggagagattagaggcagagcaccaggaatcagggaaggtgttcctgaggagatatcacttgaacacaagtcttaaagaagaaatgggagttgggagatagcaggggataaatggagtaggaagaatagtccaggcaggggaacagtggtgtaaaggagctgaagcgagtgtaccacggtgatattcagggaattgcatgccattctatatggctggtgtggtattgtgaaatatacatttggtctttgtctcttgtcctgacatacggctgctgaaatccttggaatctccaaagtgatacacatsttatgaatgctaatgggttgactgttggcttgccatccctaaatatcttcaagaccggggttggttactgggaagaccaagccatgattaaagagttgggattttcagtgtcaacccgcaaactctggaggagagaggggctgaaggttgagttgatcaccactggcctatgatttaattaatcatgcctatgtaatgaagattctataaaaactcagaaagactgggctcaaggagcttccagatagcagaacacayggaggttcctggagactgatatgctcaaagaggatgtggaaactccatgcctcttcctccataccttggcctctccatctcttcatctggtgttcattggtatcctttgtaatattctttataataaaccagtaaatgtaagtatttccctgagtcctatgagccacattagcaaattaatcaaatctgggggagggggtcctgggaatcttgctttacagccagttggtcagaagtaaaggtaaaacaaccagggtcttgtgattggcatctgyggtgggaggcagtcttgtgagactgagccctcaacctacgggacctgatgctaacttcaggtagataatcagagttgaattgcactggaggacatccagcctgcatccactgcagaaatgattgcttgtttggtttgtggggaaccccatcccacctccatttggttacagaagtattctgtgttgattgtcgtagagtgagagcagaggaaaaacagtttgtttttctacagctgaaaagttgggagtagactggctatttgcttgtttattgttattgttgtttggggagagagtggatgactgctgggagaagcagcagaggccagattacaaagggtcttgtcaccatgccagggggaggcagagctacccaggggctccaactatgtttacagtgttttatttcctgtgtgggtgttgtatatacaggtgcttattatattattcttcatccttgtgtctctaaaagattcttatttttgaaaatgacttagaaaaaataaaagcatttaggaggtaaacaaacccaaagaatagactggaatcatcacctctccttacagagacgtagttctgggaaggtgccctaaagtctcaagcttttttcacaccagctcacacgataagagacaatcaccagctccaataatgtttgacagtggcctggttggaaaccactttttttwaaagagacagagtctcgctctgtcgcccagcctagagtgcagtggcgcgatctcggctcactgcaagctccgcctcccgggttcacgccattctccttcctcagcctcccgagtagctgggactataggcacctgccaccacgcccggctaattattattattattttttattttttggtattttagtagagacaggatttcaccgtgttagccaggatggtctcgatctcctgacctcgtgatctgcccacctcggcctcccaaagttcagggattacaggcatgagccaccgcaccyggccagaaaccacttttatagtttggatctcagacccaaggacaaaagttcactcatgcctgtctttagtgcaagttctctagattaagcctgaagaaactttttggattctggtcttaattattatctaggacattcctgctggcttcgtactagtcataaattgatcagtatgccatctctgttcccagagaagatattaaaaattacagggcaaatgcaatgtagtatcctggattggatctcggaagagaagaaggacatttgtggaaaaacaggcaaaatccagataaagtctacagcttagttaatagtaaaatacctatgttatctcttagtcttgacaaatgcgccatggttatgtaagctgttgacatttaggaatagttggataaagagtatataggaactttctgtgccatttttgcagcttttatataaatctgaaattatttcaaaattgggagtctatttacaaattcaggtgggctgggcagggctaaggatttagctctgccgcaggctgctagagccctattcccagttgacaactgtgtacagttgttgagccagtaatcaatgggtcttattgtgataaagtctagctcatctttccctttcttgtgcatttataagtgccttgttgaagctagtgcattccatatctgttgtattttcctgctttcccacccagtaactcttttcaaaaggaaataaagatgataatagtgcactttgcagagaaactcaacttgatcaaaagatttgccggaggatgcctggaaatagcatgtttcttactacattttaagaaattcatctactaaagttgcatgttcatatgccttttcagactctgaagcaatgcggacttgttttcctgaggaaacaaagggagaaagagggattctagggtagtagagcaccgcaatcataatggacctgtattgaaactacacacaccattacatattaaccttccttggagctttcttgtgtccactttgctaggagggacccaagaaggtggactaaagaagagccagtcacccatggaagcatcccattctgacttcgagatctggtgacctttcagtctttcccagacaggctacacggcaaactgtcctccacttacatcattctaattgtccctgctgattaatgaggtcacttacggtatcaattattatcctatcaagagaatgaatatgagactgaaacaaatgcccatgaacttgcttattctattaaaaaataaagtaatgagagatgattgatggtgtgtgccccaagagaaggcgtgggaagggatggacagtagagagaggtagaaatgagcatgttctgattaggggttaaaagaggcttttgtttaaaagtagttcgccattgaccctcttccttccaaagccacttattgagagagctgtccaaactccttgtctcacatgcttccttcccatcaccagcttgctctttgtcccccagtttcagccttgccactgacactgctctcgagcaggtcaccaccactgtcctcattgccaaatccacggaccctcttagtcgtctcttaccaagcccctcaaaagcgcttgctgccaatgacctaattcttctcgaaacacttataccaccaattcctcattcattcattcaatctcgtgtatatttactgagcatccactgtgtaccaggcactgagccagggactgagcatactagagtaagcatgatggacacagtccttcttgttctaaatggagtttgcattcagatagaggaagataggcaattaacaagtacacacatataaatgagctgtgttagtctgggttctccagagaaatagaacctataggatactcaatagatcctataggatactctctctcctctttctctttcttacacacacacacacacacacacacacacacacacagttgtcccataggggattgatttctcgaccccccccccatggatataaaaatctgcagatgcttaagtcccttatttaaaatggtgtagtaattgcatataacctcccatatcctcccatatccyttaaatcatctctagattactgacaatacctaacacartgcaaacactatgtagtaattgtactgcgttgttttaaaatttttattatttttattaatattatttattatttaatattttcaatgcatggttggttgactctgcagatggggaacgctactgtgtgtatgtgtgatgtgtgtgtgtgtgtgtgtgtgtgtgtatacatatgctttattataaggaattggctcacatggttgtgaagactgagatctgcagttggcaagctggagacccaggaaagctgataatgtaagtttcagtctgagttcccatcagaagacgagagaagaccaatacccccggttgaagacagtcagagagagtaccttctcccttactcagatttttgttctatttaggcccttaatggattggataacccccacccccattagtgagggcagtctactgattcaaatgttaatctcacccagaacctccctcacagacacacccagaataatgtttaaccaaatatctgggcatcctgtgccctgtaaagttggcacctgatattaaccatcacaaatccaccccttgtcaactctgcactatatacatcttaaaacacacttaactgccaaataaagacaataacaaacttacaattttgcctaatatgacatgactatcctgcattaacccctcaccagaggaggagacaaaatcttggaatggtgtttactcttcctgatatcctgcaacttaaatactatggtgtaaaagtaacaatacttaaataccataacataaagttattatatcttatgctatatgaaaaaggaaaaagaaaacaaatacatattacttaatatatatgtatgtgtgtatatttatatatttatatttacgtatatttatatacacacatgaatagatatatccttatatacacatgcaaacactcataacaaaataaagagggatactcataacaatgacagtctttatttctgtaactggctatgtggtcacagctggtatttataactaactctttcactacccattctgtattccctttgtcttcagcaagcatcacagctgatcatggttctttaccacgtggggtgacctaaacttaaagtgcctgagccattaatagtcctgcctggattgagttgttctggtttttcattgatcttaatcataggccatgataatactaagagataacctaarggatcttctttattccagacataatcttccttacctccattgtgtagtagcagtcccatttctgtttggtagtgagaatcaatcaccctggctagcatagttactcttttctttgcctgttgattcagaggtatgaggagtgcaaagtgcccgggtagcagtcttaactttcagcacagtaggatcattgttgtgacacctggaactaagacctctgggctagcatagcatatgctagcctctggacttgcatagcatatgctagcctctgggctagcatagcattaattttcagctcagtaggatcattgttgtgacacctggtgggagcattcctccctttggaactaagacctctgggctagcatagcataaggtcatagaacaggaaggaaacactttgtcagttggtcactagaggtaatagtaagtggagctactcctatttccatcccttgatttctagacttgtgaatcctggctatgggagaaagaacactatatatgcatgctgattcagagcatatacagccttctggagaaccttgtcccagcgctgcaaggtattgccacctagctggcattgtaattgagtcttgaaaaggccatttcattgttctacctagccagctgcttcagattggagggttcacatggtaggaccagtgaatcccatgagcatgagcccactgccacacttctttggctataaagtgagtttattggtcagaagcagcacattgtggaataccatgacagtggattaggcactatgtaagtccaaggatggtagttttggcagaagcactgcatacagggaaagcaaatccatatccaaaataagtgtctgtttcagtaagaacaaaacacttctccttctacaatggaagcagtccagtgttatctaactgccaccagggtagttggcttatcatgccagggaagggtaccattttgggaaccccrcttctggtaccaaaatctgttttggtctctttgggctgccatcagaaaatactcgtagactgggtggcttaaacagtagaaatttattttctaactgtcctgaaggctaaaatgcaagatcagggtgccagaatggcctgattctggtgagaggtttcatcctggcttgcagatagctgcattctcactgcatcttcacattgcagacagggtcggcaagagaggcagagaaaggggtcttttcttataagggcactaatctcatgttggaagtcccatccttatgacctcatctaatcctaactacctcccgaagatcccacctccaaataccaattcaacatataaactttgggagttcacactcagtccattacctaagccatccaggtagtggtaattgttatgagaaaaataaagcagagcaactggcagagtatgacaaggcrcaatcaatggaacctttttgggaagtgatacctcacttgttttcacatgtcagtcccttaaagcttgccactgtcttcagggtttcatgttttcttctgtggcacctcactctatacacttggattggatcttaggggtgagcaagtccctgttttacagtatgtcactaaaagtgattcaaaagatggcatctggggttggggggcaaaacccagttccaaattccagctgacagttatcctaagggtccaggcagaaaagcagaattcagggataaggcagcagttcagaatccagggtcatctaccgtaatatgaatggtgctcctgaaagatgtgcaacatagtggccctgaaaaatcctagaagctgcagcagagttagaggttcacaacagacactgggaagtaaggcytgagaaagtccctgaaccacctgcaaaaactctccagtgaccaaactctcttactgcctctgtggctcctccctctcttgtctacagatgaggcccacaggtaaagcctctttgctattaactgcaaatatcgatggtttggatgtaattcaggttgaccctccactgttcacaacgtgtgacttgggcttgggtaatcacgtttcacacttcacagctgtgggctcagcctaccctgcagtcccagcctgagcaaaaaccctggagcccctcttactgagaagggtctctccacatttccttctggagaaggaaccatggttctggagaccatggttctggaagctcctgtttctcctagttccctggagtatgggaaacagtgggcatagtgtcctggtgcctgaccctcccttccaagtgggccarcaagcatttctgtccagttcacaaagacagggcctgatattctcccacttcatggccaacaccttctggtggtggctatgcagcagctgataataatatgtttagtattaacctgtgcacaggtgctgcctgtagcacactgcaaagcgctgtctttaaatggagacctaatctttcaaaccaggtgcggtgctcaaaaccagctctggcggccaacaggaagggcattgtggtacagagcaggtaaggagaagacccccattctttctgtccatcttctccatcctcttgcaggcatgttcagcatcttttgccttcttagaattctcagaggctccacctgctccttccccaggttggcctgagcagctgtccgagggggtaggtgggcacaaagccctcaggatgcagaatctgctgaccattcactgatatttttataattgttgtttgtgtctctctggcacacaaggaacaaatcctagcctggcaccatctgagggcctgggtaaatctcagctgttccatcaaacctcctggggtggtccaaactttaagggctgccttgacagagagcagtttccattcctaaatgggtgatgtcactaagcctgatttaggggaggtagatatggaaggcagcacctgtgcacgggttaataacaaacatcatcattattatcagctgctgcatagccactgccagaaggcattggccacgaagtgggaggcaggcttctggaacatgacgacctctcttcctcaaagcttccttccccatttccawccttgccaacctcctgacacgtggtgctggatacttcagtctctgtcatggaagaccaagttggctcaggggttttcaggcttctgtggaagtaaatgaagtctgcatctgctagaaggctgagcagcctccagaaaaatcccctctcttggggagactggtaattaagcagtcatggcaaacaagtggaggaggaacatctggttgtatccatttgttctcctgtcattagttggggaacaattttataaattacacgtaaagtgggttttgtctttcctctgcttgtgccatcctctttgagatgacctccgtatcctaccacagcccgccatgccctttggatgattggctaacaatttatctttttagatcagctcaggctggtgcatcaagttccctggatgcatccttatcactgcacttactatattgcattataattgtgtcttcagtaattacctcctatggtgtatctggtgctgttctcaatactggggttagataagtgaactaagtggatagaaatccctgccctcgtggaattcacacactggtgggaaaaggtagacgtaataaataaggagtgatcaaatatataggaagtcagattatgataagtgttaggagaaaatgcaggacaaggggaatcaggaaatgggacaggaggggaggagggttgcaattttaagtagaatagttatcaaagcctcggtgtaaagggtatgtgaacaaagacctgcagaagatgaaggaacaagccatacacatctgggggaagagatgaggtagctggaggaaactgagagaagagcaggtgcaaaggccctgaggcagaacttgccaggtgtgttttaggaacagcaagcggccgttatggttagagtgagtgagcagggggaggtagttggtgataaggagggtggtgatggagtgggagcgggtagtggcagcagaggattccctagggcctttagaccattatgaagactttggcttttatcccaaatcgagtgggatgcttttggaagggtttcaagcagagaagtgacatgatctgacttaagatgatcacagaagctgctgtgttaaagaggatctgtaggtggactaggaggaaagtaggaagactggttaggaggttactgcagtaattgaggcaagagatggaggtgtcctgttccaggatggtagtaatgaaggtgatgagaactggctggatttctagataaattaatgtaaatgcctccgtttgagggtaaatccctcgagagtgagtccacgtcttaggcatttttatcctgagaaccaagcatagtacatagcgtttaatagggcatacaattaatatttgttgaatgaatgattgatgagaaaaatttgtaattgttaccggtgggaataagccagccttaatctcttttgtgaacctatcagatcatagagacaaatcatgggtaacatctatttagtttctcaactgatgtcgtaaataaagctattcatgcatgtactgaaccaagaagtgtggggtacgctggatccaactgtatttgtctattattcaggactttccaaagcttttcatacagtaatgcaaaggttcccaaagtttcttaggtgccattagtgtctcagtaatgtttccacggtgctccatgggtaaaagaaatacctattagctccacttattaagtagttaggtccaaataactgaataagtatttataccccaacaactctgtatctgtttgaagataatataaattgaaagaaaaacatttttgtttcatccttaaataattgttaaataacaattgattgctaatggtatgtgtttccttgttggtcattgcaaagattctcaaaccttggactcagattggacactaccacctgcatatcctgttccacactgattcacacatggtccctaattcccatcacaccaactaccaaagctttgcaaagatatgatgtcatctaacggaaggtagctttacactgaaattgtgaaccaccttgagctaatagtttgtgtgtccagcagatattaagtgccactatttcctttgaaagttaaaaatagtccttggttacccttgtaaactcactgcaatgccctggggcaccttggtgcaccgtttgggaaccatggtgcatttcccaaaattacttatttttttcaggcaaacctactaacatcatattggatagtattctgtgcaacatgatttgggaacygttggggtagagcacatcaagagggctccctgctgcagaaggagacgctgcagtccaatgggaaacacccctgagttttgatggagcgagtgtgcttagaggatttgcattctgaacgtagtgcttctcccctatttttagacctcagcaggtgggtctgctgtgactccagatcttgcttctaaagagagtccacatcctagaaagtgtactgtatatggggatttggaggtctagctttgctcccatccagtcatacttaagacaggtatcccagcctccaaaaataaatgcacatgtgcagctgaaagcagaggtttgcagagccagtagatgttttctggagaggcagggacattctagacaagatcctttggacataagttgggttttttcagcagatatctagctaatgcaagattgccctcttaaatgggagtttattacaaggatctccagatcttgagacagcacaagaataatctctttagacttcctctcattctgggtttcagggtgttgaagactgagagtgtcagtggtctcatagctaatgtagctacagcctcagctccatgatctaccttctctgggcatatcctttcccagagagatttccacagaaccccagcccacaagatgctttaagaataaaggagtctatgatgtatatatagaaaggcacaaaaagcctagattttccacatttcccagttttagaagctcttgatgaaatgcaaaggggaattaccagtgaaaacctgtgtttgtaggggtgtgtgtgtgtgtgtgtgtgtgtgtgtgtgtrtgtatggtgtgtgattatgactaatgtccatcaattacctgcaaattactagatgatgcctgtaatgatagttctgtttttagcttaatggtttatgtatctaactagtggctgctgtctggagtagggctgctggcaaatcaaaacactatttgccaagcctgtcagtgtgacaaacgttgcttacatttactcttttattcccaaggtcaattggtatgtcttttttcatatcactgtttgatgtgctaacagccttaaatgagaaccattcaataaaggcccaatttgctatattactatttattcctaggtaattctatattagtttggctctttaagattgcaaagaagagacatgcatagatcaccctcggaagtggaggcttatcacatggttctccagatctcggggcagcacagaaccacatctcagacctttggtcactctgggtttcagaactttcaagatagggagtgtcagcagcctcatggctgacatagcaacagcctcatgattgttgtagcaacagcctcagcttcataataacctgcattctctgggcctattgtttcccagagagggttccacagaaccccagcccacaggatgctttaggaataaaaggggctataatataatgggtttgggatctgttacataatctattccagccttgaaggtttacattgacttagcttgttaaaagtcctcctacgcattttattttttawttgttttctgaaaaatccytgctttatttaacccagcatttcccaattctgtttaaccggtgaacattctagaaacatgctttgaaaaataacctagttttggtactttccagaaaaatctggttgtattaatttgtcagtctctgtgttggggggtctgcatcaccacccgcatgatttattaggactcataggattcagtataaatttgtacccatggctatgatttattatagtgaaaggatacagagcaaagtcagcaaggggaaaaggtgcatcctggggcgatggctgggagaagccaggcacaagcttccaagagttttcttctggcaaagtcacacaggtcgtgcttcaaacccctggcaactaattgtgacaacacatatgaaatattgccaaccaggaaagctcagcagagactcattgcccagggttttcccacagagatgattacctagacccctcttcctgtcacataccaaaattctaggctcccaggtggaaagcaggtgttcagcataaaccataatgtttgtacaaattgtttagacctctcttgaaagtactggaaatggagggaaccctcctgaaatcccggttcccagatgccagacagggattatacttgtaagctggcctttcaaaggatagcagtcaggccttttctgtctgctttctcatagtgaaaccgtcatttattgactctatattgcatctaatatgtactgtgcactagtgatatagtgaaaaggttatagatagtctttgcctccaagagacttaccatcaagaaggaaagacagatatataacaattcagtaagaaaatcgattcatgatcattgggatgaatgttacaaagtagaagtactctattctctgaggacatttatcaaggatccctaaactctttcccagaggaactgatgctgaaagtgagccctgaaaagctaatgcagggttggggggaaggtaaggtggaggccgcctgggtggcaaagggatacatctgggcacagagtcctagggacagcatctgcaaaggccctgagatgggaagagatgtggcaccttcaaggacagtataagaagccagcttatgcctgtaatcccagcacttagggaggctggggcaggtggatcacgaggtcaggagattgagaccatcctggctaatactgtgaaaccctgtctctactaaaaatacaaaaaaattagctgggcgtggtggcgggcacctgtaatcccagcactttgggaggccaaggcgggcagatcacgagttcagaagatcgagaccatcctgactaacatggtcaaactccatctctactgaaaatacaaaaaaaaattagccaggcatggtggtggcctgtaatcctagctactcgggaggctgaggaaggagaatggtgtgaaaccccggaggcagagcttggagagagccgagatcacgccactgcactccagcctgggccacagagcgagactccttctcaaaaaatagaagccagtgtgggtagagggggaaagaccaaaggggagagagccatgagctgaggtagaaagaaaggcaggccaggtcttgcaaggcaaagcctcgggccacgtcacccagagagccatccatctctgtcattcctgatcattatgtccttctagctgatccagatctcttatttcacttgaggcctagggaaccagtcccagcaacactcactcagggacgactcagggctctgcctccatcctcagaaagttatgaaaagtgggggtttatcacatggttctccagattttggggcagcacagagacaatcttaaagagcccaactaatatagaattatccaggaataaatggtaatatagcaaattgggcttttattgaatggttctcatttaaggctgttagcacatcaaacagtgatatgaaaaatgacatgccaatttgaccttgggaataaaagagtaagtgtaagcaacacttgtcacactgacagtcttggcagatagtgttttgatttgccagccgccctactccagacagtttcagaaagttccatgtgcctggaagacatttggacaaagcctaattcttccgtctttccctgtcttctatgtttttctatcaagcaggaatcaagacttacatttactccagtaatggggtcaacccaatgtactaatagactccataattccaggttggagtttgttgagatcagagtttcattatggcctttctcactggttctctgactggcaaaagcaaagccatgtctctgagcttggcccaagattcaaccaggtatgttcctcctcctctctgaggatcagcatctgagacctgttgccactcagtaaatatttgagggattaaaattggattgaacttgagaggtggcacgctcatacctttggcagatgtgaatgccagtgttcttctctgcgtggagcccaagtgtgtctctctggagcctctgtcctgtggtcctttttctttgccaagcatttcatgaggacattggtgtgtcaagcatggccctagggatgtggagacagttcttatcctttgccttgccaactctgttggaccccagactatacgtgcctactgtcttcaactgttcctcaccccacagggtgaggggtcttttagggtctccttgctgcaagcctggcacgtcaaagccaagagaccccagcctgaggaagtgagtagttggtcagcttgagagccttgaagttctcaaacatgggcacaaactcctggagtaagaaaatgagctttcatttccatgggtaggaatttgcagacacttcacttgggtggaagaaatgtcatattcctgcattaaaaacaatttgactttgagtcccatgcataaaggggaagaatttcacttcagccactgttgggattctcccaagcaaggtcttacatagacctggcattccaggaagaccctcaggtctcagtccacactgggcattgttgatgtgctcaaggcctcagtgacacctgaaggcaggaagctcagttgtatccgagccaaattctggtgggggagttcaagtccttctgcttagaatgggagtccttttgtgtacagtccagcacttctgtcccctcttccttatttaaataaataaataaatggcccatttatttatttttgagacagggtctcattctgtcacccaggctggaatgcagtgacatgatcatagctcactgcagcctcaaactcctgggctcaagcaatccttctgcctcagactcctgagtagctgggactacaggcatgcaccaccatgcacaactattcttgaaagtttttggaaaaacaggatctcactatattgaccagggtgatctcgaactcctggcctcaagcgatactcctgcctcggcctctcaaaatgttgggattacaggcacaagctactgcacacagcctaataataccctctttaaaataaaagctcccacccttttatttttcctggaatgattaggaagaagtggaggtgttcgaagcagtctgctttttccttatatctcgcctcatttcatgggtgtgaaggggatttgccatgtcactaagtgttacttagcccaagtctggatgtctctccctcctgttgtctatactgccagcatcagagtcacctaagactctgtgtggctgctcctcgaaacaccaaatagttggccattcattcatttatccattcatttagaaatacacatgcaaggtgagcaacacaaactcagccatggctcttggggtgctttcatctagtcagggagaccttaatgaaaactactyaccccaataaacatctaattaggaattatggttagtgctagtaaagaaaagaaaagaaaagggatgtcagtcaggataggtcaggttatactctgtgtactaatcatggttttttaattgtctgtattttctgatactttgacatcttgggactttgttgacctaaaatagcaaagagctctcccggaagtatgcctttcatrtgcaaactgatgatcccaattgggtagagcacaactaagtcttttattattttttttttaatttaattttttttttgagtcaggatctcacttttttgcccaggctggagcacagtggtacgatcgtgggtcactgcagcttcgaactcctaggctcaagtgatcctcccacttcagcctcctgaatagctgggaccacttaagccccctgagtagctgggaccacaagtttagctgagtaaccaccacactcagacaaatttttgaaaacatttttatagagatgggatttcaccatgttgctcaggctggtcttgaactcctgwgctcaagtgatcctcccaccttggcctcccaaagtgctgggattacaggtgtgagccactrtgcctggcctctacctcttttattgagatctcattgtttatctactatccccctgccctaattacccagggccatacatcrgacagctaagggtggtccacataccctggtgccctctgaaattattcaaactaggcaatcctaaacctgctcagctgcttacctgatcttgcccattccttcttgggaaaaccacaataaaggctcttgcccacatttwcccaggctccttctgccttgtcactgacgctggagcttctgacatgcttgtggccctgcatggcatagtatgccccttcctctaggaaactgtgttatcttttcagcggcagtgtcttctgatctgttggcctcaccatacctgartggtagtaacaaaacctacaagtgaaaacatggtggtagcaaacaaccctcaaattgaaatggcttaactcaccaaaagtttatttcttgctcatgctgcagattcaaaagaggtttgcaggggctctttgcttaggggagttgctcagagaccgtggctgcggaggccaaggatcactgaccttggataaggggaagggaattcagcaaaaggtacacaggctgttcaagcctccctcctggcaacagtgaccttcactgctacccaaatctccctggccaagctggtgtcatggccaggcctgacctccacaggggtgggaggtgctgttccactctgtgtctagaaggaaagctggaaatgcaaggtgaaccataccagtgacttcactgggacctctgagcatgcagaataggctggtctgggatgtcaggaatgcacctttctagaagtaacgttgagacactcgtgataagatttgaatgatgagaaagagttaattagacaaatcccaagggttagaaagtgttctaaatgggagacagtgcgtgcaaagaccctgaagatggggcatggcaaattgaaggaactgaaaccasaggtgtacgaaggaagggagtgggagaaaagcgggggaagagtatttaatcactgacattatttagaacatggatgcatggtgataagaagtgaacttttaaagtccattttattattgatttcaaattccctacaggaaattaatgcccttattgcctgcactttgggctgaccacttcctttgcccttgggatggccttgaccaaagaagactggggggctggagccaggcaggagacagagcagagaatctgtcagggccaagccatgcaggatttgtgaacctcgttagggattctggctttaatcctaagaacagtgggaggctgtggrtagattctgagctgagaaatgaggagtatatggtgtcctggccgtcccattttcaagactctgggttacttttggcaggaaggcaaaaacaaagaaaagacagtggagaaaatgagaagacaataaggctgatgtaaagcagaagatgagtattgttttacacgtttggctatgccacctgtttgcaaaatgctgttctctgtgcattttagagtctgcaaggaggataactcatagcaacaggggactctcacctgccttgccatcattttactgcatttctctgctaagtctggatttcactattgaaggatacctcactcctttcaatatggtatttaatcttgtcagataaaagatgggaaagtctgaaagtttwatttgctcattctgtcatgcaacaccatagctcctcctaactgcggggtcttcagcgtgtctaaaatcgatctcaaagataagtgggtgggggagcgatgattcaggtatccagctggggagattcaatttcccatmccctcccccagccttagctagcgcctttgaggaatcctccctgctggaatttatctaccaaccctgggaaagagcagagcagtggtaaatatctgattagagaaaatgcctagcaagctgcaattccatatattgtaagtgataaaactgtaattgtttgttgacagtgtacattagctattcacagctygcatcaatatagtacygagaaactagggtctaggaatctttaatggcagtgcaaaaatatactggaactaagttggggaataaaatcaacaatttctgcttagtgagaggaatgccattctcagagaggacttcataggagaaggcctggtgaggtttgagcttcctccatgaggctctatgtagttgaaggaaaggatggtccctaggctgagtgtctgggaagggcacccaagggcataattctggtagacatgggtgagagacaagttgcagctgctgtgaattgggcccayctggagatggagacaaccagcgcttgctaggatggggtctggggaaccagatataggtctggccttgctggggacaatttactattttaatccatagggtacaatgggatgatgtcagtctgtcactgaagatacgaatatttcgggggagggaaagggcaactggtgcatgggcaagtcaacaggaagccaaggaataggctaacgggggccctgtggcctgagttctggtactggtagtcagcaaggctgcagtcagtgccgccggtgggggcggggagggtgcaatacaggctggagtggataggaggcggctggagtgaggggcctggaaaagacaaagctcaaagcccaatccagggagactgagtgtaagtctgatctaatggaggactggcgtactgtccaatagcaatataatatgagccatagatataattttttaaaacttwttaaatttaattttttattggtagagggtgttttactggggaaattcacagacagaagcatggtcttgggtagccacaaggcaggtagatctctgcaatgttactccccagacccagggcatatgtaccatagggaaagggtgtatgtgtccagccagacaatgaaaagcagcctctagaacaggcaagggtactgtatgtgtcatagcctgtaacttgtatgataaacatcaagattgacatattcttatgctaggaacagtaaataaaataggaatcaggaggcattctcaagactggagctaatcagaagtcaatatggtagatttgtattcatgaaactttttattttgaaataataatagattcacaggagaggttccatgtacccttctcccagtttcctccaatagttacatcttatgtaactatagcacactctcaaaaccagcacactrccactggtgcaatgtgtgtgtatacttctgtgtcattttatcacatgcagattcccataaccatcactgcaatcaagacacagaatgattccatcacccaaagatctcctcatactacctctttgtggtcatatccatttcccttcctcttacgattcctaatctctagcaagcactaatctgttttccatctctttaattttatcatctctagaatgttatataaattgaatcacatggcatgtgatcttttgagattagctttttttccctacttggcttaatgaccttgaggtccacccaaattgctacatgtattcatagtccattcctttttattgctgagtagtattctgtggtatggatgtactccagtttgtttagtcattcacctattattgtaggacattttggttgtttccagtttgggctattaggaataaagctgctatgaacaattatgcataggtttttgggcctaatggatataagtttccacttctctggagtaaattgctgagttgtatagttatgtggttttttttttcttaaagaaactgccaaactatttaccagagtggctgcatgtttttgcatttctaccagcattgtatgaggaatccagttttcctgtatcatcaccagcattgggtatcgtgactatagtgttttattttagctgttccaatgggtatgtagtaatatttcttcatgttcttaatttgtatttccttaaaggctagtgatgttaaacatcttttcatgtgcttatttgccatgcatatgtcttatttggtgaaatgtctcttgcatgtcttttgcggattttctaactgagttgttgaatccttgcctttttctcaatcttaagggaaaagcattcagtctttcaccatgaagtgtgatgtcagctactgtttttttttttttgtagatgttctttatcaacttcagaaacttaccctctatttgtaggtttctgaatttttttttttcgtttaactacaaacgggtgttgaaatgtgtcaaatactttttctgcattagttgatgtggtcatgtgatttttctacctttaacctgttaatatggtagattacactgattgatttttcaaatgttgaaccagccttgcatctttagacacaaccccacttggttatggtgtaaaaatatttttatatattgctgaattctccttgccaatattttgttaaggtttttgtgtttgtatgcatgtgaaatattgatcttcatttttctttatttgtattgtctttggcttggtaccagagtaatactggcctcataatatgagtttggaaatgtttgttcttcttttctggaagagattagagtagaattggtgttaattcttctttatatgtttggtagaattctctagygaaatcatctaggcctagatatttcttttttgggagttttaaaattactaattcaatytccttaatagttatagggctattcaagtgatctgtttcatattgggaaacttacggtagtttgtgcttttcaagtttgtgcccatttcatttaatgtgtgaaatgcatgtgtgtaatttgtagtatttccttattatcrtgttgttaagtgcaggatctgttttccttagyccttgccaactctagataggtgaaaaatgagtcttggggtttcagttttcacatttttatattaattaggtggatcattaatttgtattgtatcttttgctcttttcytcctgtttaccgttttcttactgatttgtaagaactttttctaggttataaatacraatcctcctcctgtcacatattcgtaacctttcaggttgcacttttctcattatcttttacagttttttgtcacacatacatgcttttaattttcatgtagttattaatcaatattttcctttaaggcctctggggttttatgttgtatccattagcactcaatttcaagagatagaaaaccaagtcaagctagtttaagaaaaaaagaaagtaaagaaagaatgttagcttatgtaactgggcattgaagagataaatctcgctgcatggattaaggatctgaaaaatacatcatcagggttctgtttctcttctcttgccactgctcagcttttatttatatctatctggcgatatcattttctctaaagcagatagtctctgtgtgatgataaaaaggctgctgggagtctcaagcttatattgtagtagtttaaggtccaaaaataaaaggctttcagagtctgtatattatatcccatagaaggactcggaatgactctgcttgggtggtatggtctcttccctcttccccataccctgaatccgtccataaaaatgagggctagtatgtcgcrattgatcatttacctagctctgtggctagtgggtaggtggagtaccatcagaactccatgccatggacagctcccatggaagactgacagggcaaataggtgcaaagagagtcctctgcgtgtcttgcttaggaggcctttccccagcataagatgattaaacaaagtttgtttccttataatatgtatgatttcattattttatgtatacatttttgatgagagagagtatatgaatatggggtgaggtagrgatcttttgctggatgtgtttatatttgaagagaagatgcccttgaaacttatttggttgcctgctgcataatttgataattttttctttgctttttcttgagtctattctgagttaacatgaatcccacaaggttaggatggtgggaagggcaagggcttcatctagcataagggttttcacagtgtctgttaacaaatatctggtttaactcatctgagcccgatactcatgcccttcagtggatatcctgggcatcaagatattgtatagcagtgggaggtatacagcggcacccaggagaaccacggatatttcaarttacctaaaaatggggacaaagttaaaccttgaaattcctcctagattcctacctgggtgtggtaaggcaggctgaggcttagagggggttaaggacaaaggtgtgtaggagactggccacctcactatgacctgtgtgcacaatcaggtccctgtgagggtcaccaggcatggatgcccagcagtggacaaggtctttcctaaatgtattcccaagtgttcagtggtatctttttcccttagaggaatctttaaaaatgattatcttgtgctaaaagcatattatttcaggttcaacaattcctttagcttcacacctgtttccttttattcagttaaattccagaaagaaaatttaaacattttaattttaatagcaygcacagtttgatcccatttgtatgaaattatttcattgaatatgattccatctattgatcccaccatctctttgtatgtcaactgtcaggaataattatttctagattgtgttggttttttattttttgctttctttaaaaactaataggcacttatttctataaaagcagtagacattcctttgaaagaataaagtctatgataagaagcatgctcattcttctacttagagttggctctatttcccttactatgtgaataaatattgtctactggcaattgttagttgtaaactcatggggaattatacccagagcctcacaggacctcagccagaaagagaggagacaggaaaagaaatcagaaaaggagaaaagaggaaacacaaaggaagcaggcaagcctccaggttggggattagaccatggctttggcggagtcacttcctcatgtttctggggcagaagcctgctggttttcatcacctctgctgagaatcactttgtctttgaacaccctctgtgtgcctagatcagcactgtgtatccagcaggcactcaataaatgcttcgtggatgtgtagtttcccaagggggtcattctccctaatccaattctttgtctttcaggctcacaggctttcagctgccagccaccattgttagtgcagccaccaccctctctctgcgcctcatcagcgactatgcagtcagtgcccaaggcttccacgccacctatgaaggtaagtgcctccctcatcggccacaggagccggagatgtgatgtcctaatagccacaagcaggactgcattgctcacagatgcagggaagtgttcttcagacccagagcttgcgcctgtcctgacaaggctggttactaaccagtaactcagttacttaaattgtccctcttggttcccaggaaactgagaattgaaatcaaagctcatgtgcagtagtttatcctgagggcctggtaacatctacttctctgtcccctttaactgggttttgttgtgtttttatttttttaattctgttttatattgggcttcattgtataaggtacctcaggttgtttttgaaaataaaagacatataaaccctaagtaaaagaaataaaataagcaactgaaaacaccatacaatgactgccaagagtcagttttatatcattcagagaagaacaatcgatttttccttaatagcatggattaggggcttttggtttgtgctatgcaaataatttgtacttctctcagtctgtttaaatatggtgttagaattcaaattaacactaatatcttcagattatacactattattattattaactttattatgttcagaaggtggtacttctagatctctgtcatttccctgggaaatttacatctcattaataggtaattatgccactcttggctaagacctgcactgttattttgtgttaagatcattaataggcatattttaagactgttaatgataattaataacagtaatgacataataccctagtaaagcacgccagatatccaaaagctttttttttttttttttttttttgcctttgcctttgtttaagaacttaaagagtaagcgatgctttcttcaatgaagaagctatagcaatacagaaacagacactccctgtcttggccaggggtgtaatgcataaagaggacaagttctgcctccttagcaaaaaaccacccctggtggcagggggtataggggagatggtttgatgctttaacctgagcaactgggggctcctgggaaggcttcagttatttttaactaaaggttgctgagaaggctcctgagaaagttccacctgtcttttgctgagggcttctgacataactctattttaccttaactgagggctcctgacaaagactgacctgtccttaaagtgaggattcctgaaatagcctaatttctttttaaaaaatgatcagatctcagccgggtgtggtggctaacacttgtaatcccagcactttgggaggacgaggcgagtgaatcacttgaggccaggagtttgagaccatcctgggcaacaggamaaaatcccgtctctactgaaaatacaaaaattagccgggcatggtgttacacacctgtaatcccagctacttgggaggctgaggcacaaaaactgcttgaacctgggagatggcactgcactccagcctgggtgacagaatgagactctgtctcaaaaaaaaaaaaaaaagttcctaccaatatcaagcctgtgatttttgtcatcctatttattccttcaacctggccctgaatccaaagtaattctctccaagtttgagcaacaagctcctcactaggagaagcctcttcagaagcttcctaaagtctgtctggccattagctccttccacaataggttggccttggggacattgactgcacttgggacccrgggccaggaaaagggagactgggtcagggacactagaagaggtgccagcaaagatgctgggagtgactgacacatgggggaactggccgggccctaggctctcatggtgccctcatttctcagtcctggtcgatctttgaggccctggcttccctgaggcttgargaaaaaggtgtccctgcccacactgccctgttaggggcacaagcacttctcattaagcagagcagatctgagggcacattcagagtcccgtgaaaacagacactgtcacctggaaatcatgagcagggtctgtagttgggcaacaggaggtctgtaaactccatgacattagagacaaaaattctgagggtgggtrtatctttttctagggagaatatacagcaggcrttagaraactcagatccccctggccaaatctagccagaaggttgtttttgtaaataaagttttattggaacacagccatgcccattcgttgacatgtgtttggtggctgtcttcatrcactacaactgcagagttgagctattgtgacagagaccctatgcaaagccaatgagatacttactttttgaccctttacagaaaaaatttacttacccctggtctgcagctgtattgtccaatacagtagccatcagccacatatggctatttacatttaaattaactaaaattgaatagaatttaaaattcagtttcttagtcacactagccttgtgtcaaatgttcagcaaccacatgtggcttgtctgccatgtagaacagcccagatacagaatatttccatcattgcagaaaattttactggacagagctgagctggagctttcatcggattcacaaagaggccggtgattcaaaagagattgcaaaacattagggataaattagaggccagtggatccctcctcccacctgcctggcacaggtgaggcagtccaggcatgagaatgctcaacattccacagcaagactcacagggcagaaggaacagcctatttcacctcagccacataatgatgtcaggtgtctaagtcattggcactaaggaaataaagccttgtaggcaaggcccctgcaaaggctagaccaatgctaacagattgctgtagccgagcgagtctctatgcagtcacctgttgcagggtttctgcaaactacgcaggatgtgtggctggctgttttgtactgcatggtaaagtgggtcacaggtgtctgtgctaacaaaggagtcagacacccataagccaaggctgtggctatcactgaagctcattaatttgatttgggactgggctatgtggcaattcatgcatctggacaaatgtgagttgcacttacttttggaacacccacagtggatggacaaggatggaaggtgggaggcatgagtagggtcagccacagctgtgagcatacctacctgatatatgccctgggatgtctatcrttgagcttattcaacaggcaactgaatcgggttgaacctgtacctgactcactgggtgaccttgggcagatttttaagctctctgagcctcattgtggggtggaggaggggagattcactagtcaaaaggaatttatgaagatttggctctcagggaaggagctcagcccccttcctccattgcagagtccccttggacatttgtgctgggtggcaagcagggagaatgacagacaggcttcaaagaagaggcccccacttccagcctaggctgcccccagtcaggatggtttccttatattcgctattcatgatgttgttgtgtccgtttcaaaatggcatcagggccctgctcttsgtagctcctcttggctgacatccccaaatgtctgctatcaaagcgagtttgatcctcctccaccctcatccagaatgtgaaaagtatagataaggaactgaactgctgctagggattttggagaaaggtgaagtcaggtgatgagtgtcagcccacggctgctgccgccgcaaggaaaagatcaaaaaggccggtagtcaaaccctgagatgacagaaggtgcttggtttgtaatccccgggggcaagagcgtgggccgcagcagctggacgggagggaaggggatcaacctgtattaagcaccgactgtatgccaggcactttacatacattatctcatttaatcccccaccacaaccctgtggacagacattgctatccatcttacagaagtacatgctgagcctcagggaagttttgtgtgcagcttagggcctgatggccaggaattttaacgtggcttttctgcaaaactctttgagtaaggcagaggctagtgactccatttcacaggcaggtaaactggagataagccagaggcaggggaggatgtgggaacttccaggctggtgtgggtcatccatggaggcaacaagagatgtgttcctgagcttctcagctagggtcaccagataaaatacagggcactcagttaatctgaattttaaattattcaaatttttgaagtgggaataatgtttagtgtaagtataccccaaatatacttattttattttatttatttagttttttgagatagggcctcactttttcctccaggcttcagtccagtggcacgatctcagctcactgcagcctcgacctcctgggttcagcctcctgcctcagsccctgaagtagctgggaccgcagacacgcgccaccacagccggctaatttctttgtatttttggtaaagatagggtttcaccatgtttcccaggctggtctcgaattccagagctggagcgatctgcctgcctcgacctcccaaagtgctaggattacaagcatgagccaccacactgggcctgaaatttaaatataactgagcatcctgcattttcagttgctagaactgacaatcccattttcagcaaagagtctgaaaataggccccaggagccctcgccccacttacctcctcctcctcctcctgactcccatgtctgcccatgtcctgctctgcccatgtagggctgtctgcccaggtctagcctcagttctgccattccaatgaatatacatttagacatctatctgctcacacacatatgcacacaggtgtggatccgtgtgcacttgggattatgctatctgtgcaattctgtaatctggttaatgaagccaacgtttttctgtgttaataaaagtagccctgatttgtctttctaatgaacatcactgaggaagccattgtggtttgcatataccatagttatctaaccagtcatcttctgtggacatttaggtgaagaacatccttgtacatacaatttaagccctcatctaattatcttcttagaataaattcttggaagtgcaattgctgggtcaaagagtatgtagattttccattttatacataattccatcgtgtcttcagaaaggttatacgaacgcacacttctaccaacagtacacaagcaggcctgagcccattcctcccaccttgccagtgttacaagtcagtttcatggattaaaatgggtggaaaatgacatcccatttgttgcgataattggcatctctttgattgtaggtaaggtgaagcacctgtcatcacttactggccatgtactgataattgtataaatcctctctcttggtctctgcctactcttccatgggggtgttagaatttttcttatcttctttgtaagtgctttttgcatattaaggatattaatgtaatgggtttcctttagaggtacagcagttttcatttttatgccactcattttacattttaattttttaatttttcctttatgctatctatttttggtgccatgcttggagaggcttcttctgtgtgaagattagataaatgttcatttaaaggctcaccttattcttttagttttattttactgtttatttttaaatcctcctggaacccagatgtgttgatcttggtttctgtgtctccctttctgtctttggctctctgatgcttgccatgtgtcactccgagttcatggaagcctgcatcttccccactctacccccagtgtgtctctatctgatgtttccagtcttcctgccatttggtcatttttttctcaccctagccccagacttcccaccttccccacacacaactcccaactgttgcatgagattgtttccgattattccagactgatcgccaggtaagcgagcgtgatgggcagatcagaaatgccaatgagggaagagtctctgcaggtttttagtgcttaatcctggttgcacctctgcattttagcagcatggatctcgtgcactctgacacttttgtgaaggagagcccatctctgagtgtcgggtctcagtctgttagatctacttaatactctagctctcaaaacaggtatttctttgtttagctaagtctaactgtgatctggacatctcactatcaaactataggcttccttaaaaatcagacctgttctattccactaatgatctctatgaagaatcttagaaggatgaggtacccttattttcccttattttttgtggactccttggtaaccataaggggaaaggtggcatagtacaagaattaagatctcaggttctgaattcagacacctggaatcaaatcctatcttgccactcacttgctggttgaccttggacaagttatgtcatttcattgagctccagcctctgtgcctataaaatcaggataagaataatacttcttagagctgttgtgaggattaaggaagagaatgcacaagtcacaagatgtgctcagtatgggacctggcaaattgtcagcgcttgataaatgtcagctaattaattaagtcactctcatcctaaccttacttgactgggattatttcaggggatggaaggaatatgtcaacttcatagytcacaatcccagccccaccccagtaccctggctccagagtttgcataaaatccttaatccagctgttcgtggtgtgtctagctttacagccagacggtggctkttggagggaagaagcagagtgttcttcatattcatgagcctctggcactgcttgagcctgtgtccattggatagggatgaagtctcaggttttgtcacttggtggatgggagctaatgaggccaaaccaggaacttagtctgttcatggcctcttctctttgtatcagagatgttggctttagagctaagggtcctagtaagaagtcaaataggccctaggcttttgaggtcatggatttgaaaactgtgacacacacacatacatgcatgtacacgtactcacacaaatasaactcttccataagattcacagggagtttacagatgccctgtggccaccccgatcccctagttcacctaaaaaaacagcccagagaggttgacctcacacattaagttgatggtagagatttcttcgttcattgagctaatatttactgggcacatattgtgtgcagtccttgactttcatccaagcttcattttcattgtcacgatttgtgctctctccctagtctatctcccctcccaaaggrgagcagggagaaagaagacatgctccacttagtgtcacttctggaaaaaaaaagacaaaaccctggtatgcttttgctaccaatggaagatcggtaatatcatctctgtataaggaccacagcgtgttgcaacagggtagacagactcatctgtgagggatggacagatggagccagagctgcccgttttgctgttccaggagacgcaggttaggagcaagcctcagaacacagtgtgcttctgtgatgtttggaggtgggagtagggttggaggtgatcatgccactgtgcacgcagataaattggggtccagagatggaattggaagcaagtacatgggagaaatgggcctttcctggttttgttttttcctgtaattagacctgctgattctctctctcggcctcagcctctcagacaatttcctcattccaaaagagttccccaattctgggacatgatgcagacatctcaaaattgggctaatggaagccatttgatcacatatatatagatagacatacactgaatatgcaatttgcagcatttaagccactccaggccagaacagcagaacagcaggccaatgccctcctccagggagggaggtgatagatgtccatttcctccgctcaggagggatggtgtgtgcttcctgagtgaacctgttccatttccgatggctctgccttgggagttggagaacattcattttaatcagtactgtggagtagcaaattaatacatagagacgtgacatttgagacaaattgggcagcacttctcaataagtggagaatcaggatgattttcatatcacgtcctcaataatcccacaaatagttcatcatgcatagtaatattttacccctttggggaagagtattaacatagctttaagatgatattatgccaaactctagtgccatgaccgtcttcctgtcagggtgtcaggagaaacagtgatgaggaggaaggagcattctcacgcagctgcctgcttgcagatacagtgtacctctgcttcacttctctgtccccattcattcattcttcattcattcaacaaatatttactgaacacctgctatatatcagtcccaaagtaggctttgaggatacaagaaagaataagaagtggcccctacattcaaggagctctgaaacctaaaaatgttgggagagaagtaagggcataagcccaggagacaggagatgtggatccaaaccctagctttccctcaggctggctgtgagaccttgggcaagtctcccaacctccctgaaatgatttttttgcaaaacagaaactataatgcccactttaataggttgtaatgaggattaaagagtcagtgcgtgacaagtgcctggcacagagatgctattcaaaaacaaccaattcgtctaccacgtggagaaaattgctctcatgcccggttaggtttctggagatcaagtttgagctctgccatatccccagtgtatgcccttagataaggaactacacctctcagactcctcctatgaaaaatggggtaattttctctccatttcaagaggactgtgagcatgaatgacaaggtctagaaagaatctagggtgacatttggcacatagtaggcactcagtaaaaggaagctaatataacaaggcatggtgggttttatgggagtgaaaaaaacccaattctttcccctgacaaaacctttggtcaaatcttgtggctctccgagggcaagaactatcacttacttttttgttttctctgccaccatgataccttagtctagggcctgccacacagtaggagtcctgcaatggtagctattgcttgcatctcctgacctggatccctactagtctatataaggcttttgtacaacacaaaagtggctactctgagaagaccctgtcctgtgagcatatggctcagtggatagcgtataggctgggttctaatccttatcacccctctgcctgggcatactttcgcagtactcaacttgaacaacttgaaggttttggagctttacttcagaaccgtcctcttgggagtctgtggtcattcactatccaacaaaagattcagagattcattggatgcttgggagcaaagatctcagagagctttcacttgaaaccctttaattgggttaaagggtttagccctttaaatccttcgagtgtggtggcttacacctgtaatcctagtactttgggaggccaaggccagaggatcatttgaggacaggagtttgagaccagcctgggtaacatagcaaaactccatctctacaaaatattaaaaagaaaattagctaggcatggtggtatgyacccgtagccctacctgttcaggaggctcaggcaggaggatcactagagcccagggggttgaggctggagtgagctgtgattgcgccactgcactccagcctgggcaacagaacaagattctgtctcaaacaaacaaaccaaaccaacaacaacaatggaaatccccaaccatttaattgcttccaggatggagtccagactccttacctggccatcaaaacctccggcatgagccctacctccatccccttccagttctcagatgcaccatactctgtcttcccacttgtctttcaaacacactgagtcccctctcctgaaccacctcaccactaccacccaactcttctcttctgttctctgcctaaactaaatccaagaggctgcccctgtgtacaacagccctattctattacctcttggctccctgcacttctccttctatcatgtgcatcactcgtrtattttctgttccttgtttaccttctctactcttgtgtgtgcttctggacaggaagaacgctcaatagagcactgaagtcagagctcagggtctaaaggaagacttgactcccaactcgtccagatagtagccagcatgtgactttgagcaagtcacttaacctcctctgaccccttatcataggaggacaataagaataataaaccctactccatgggattgttgtagggaagaaatggggtaacacatcaagtgctcctaataatgcctggcatagaataaacactcactaagtggatgtgtaagctattaggatcactcttcacagttgtgcctagcccagggtcagacacatagtaggtgctcaataaataccgattaaacaagtgaatggataaatgatcgtcttgccccatgtgaaaggcccaggcaagaaaagagatttaggctcaaggtacctgataccatatttctttgactctaagatgcccccagtcrtaagatccagctttagttgatgtaccattaagaaagaaaaaaatgctgccaattaaagtgtgacatgccattgactataagacacatcctaatttcagagatattaaaatatggaaaagcttgcaccctagaaccgatgaaatatggtaactgcttaattgctcctaaccaccccttagcctcagttgaggtgtacttatcattccaacctgttctctgacccagagctctctgatggtcaggattcctccttttcagcattcaggtggggactctttaccatgtgatcacctgttaatttattctcttggctccaagtctcattacttctcaattttctgcattgaactctatttaacacttattagcacaggtctttagctgataaacacccttttcacgggaagcagcagggtgccccaggcttgaccctgcctcccataaccgtgctcaaggcaggggggcccagagacccccaaacatggctagctcaggaccactgccagcccactcccagcccctcccaggatggatcccttggtaccgaagaaccactgggtggggacctggatgtgatttctcccgtgtggatagaaggggagagggttgtccttcaactgctgctctggtagggaccgtagctggacatgcatatctgtctccttcctgtgcccttgggtcaggtgaccctgttggagcttcctccactgaccccagccctagaggtttaggggatgcatgcctttctgccacctcttccttggggtgacttatttcccaacccatgagcccagcatcagtggggagagaacacttccaaacagaagtgtcaaattgaatatttcagtcccacctcttgccattaatgaataactcaggagtgattaaccactgttttggattattctttctaccttttccttcattaatgtgaataactgagagttgaacccactgatatttcattttaacagcaggagagaaaagcacttaccgcattaggtaggagattctgatttggagatttggcggtggacagatggcatccctgtccttcccctgtggatgccgttacatgataggagttgtttcacagtcctttatcctcatacaagctgcagggtccatagcccagggcctctgagatgaagacaacaaaggaactggcacttgtcgagcaccttcgacatgctcagcaatgcaggggtgggggctttatagacaacaaccgacacataaccacctcgtgagcaaggccttaggatccccattttacagataaggaagttgaggcctagagaggtgagttaccttgcctgaggtgaaccaggacctraaggtcatgcacaatttaaaaatcagtctggttccaaagcccacactctccaccgtgttcctgctgaaaataagccctgcacagttctccaggcctgccccactcgcctacccctaccccacagcaggagaggcctgggagagtcrggtgggccagcagcatgacgctggggcatctccttgagcctgtggtccccagccctggccttgctcagggcgttgttgctgcctgagacccgtctcatggacagtggctttgcttcccagctctgtcatccttccttccagctctccgcttcctgttatccctcaagacctttatccagctatatttgcagagtaaacagactgggcttggtaatgaattacttgaccaggagctaatcttgggaagtggaggggacagggcaggtgaaacacatttgagcctcagggcctccatacattctgttccccttgcctgtacccagtggccccaaagccctctccctggttccattcagctctgtgctcatgtgtcttcttattgagaagccttttctgaccacactgtatataacacagcacctgttacccatcactccctakcacctcctgacatatgctatgactgtttatttatttgcttattgtccttctctgcaagaatgtgagcttcctggggtcaggagctttgtgttgttttgcattactattgttctgtgctgattcctcagctcctaggacaggtcctgtcacatgttaggtactcagtaaatatttggtgaatgaatggaatcaaagaccagaagaaagagcaaaggcatttgagcaactgcaagaagggcagttgtggagtatgagggcaggggtgtggccggagctgaactggcttgagggacagggaatagctcatgtaggacctaggaggccacaggaaggagttcgggccttactcacaagaaggggaccatcgctgaagggtcttaggcagggaagyggctcmgtgagatttatgctttakagacattggggagagcaggggcagactgcggggaaggaaaccagtcacaggaggcaaagcagggaccactgtcgagcatagaatgtttctgaaccttcaccagcactgaggatggtgccaggacaaggggagaccaagcccagggctcactccctacattgcctttatggatggacatttacactgctggaatagaaggaatgccctctacgtggagcagcttagccttcacaattgcttacacagttgtttgtgatatttctgtctgttctgctgacattcagatgtgactgtaactgattgaacaagctcacctgaagagtcttgctgaatagatgaatgttcaagtgctggggtctccagttgtgagtgatgtgggtggagccctagagatcatactgggaaattatgcagaggagtcagggcagggagacatagcaaatgcattgggtgatgatgatcgtcaggatgataatgaaagctagcattgctggggctcttaccaggtgccaggcactcttctaagtgccttacattttaacatttaattctyaagyagtcctttgaggtaggccctattattatctccattttacagatgaggcactgaaagttaagtaacttgcttgaggtcacacagctagtaagaggtaaagtgtgggtttgaatccagacagtttgacttcagtctacaaaaaggaataaaataatttcacatagttgcgactattggatccaaattaaatattccactataatagggagcagtgtcaagctttgtactttaaaaaatctaacaaaaggaaaagattagtgatcagactatattcaaatgtaaaagttctgcacaataaaaatcatgtaaaatgggaagagaaacaactgacttgaataatattctaccaaatgtggcaacaaagggttaacctctgcattgtataatgaacccatacaaagtggtaagaaaggtatcaaggagttcacaccagaggaaatagagtcagcaaataaatacatagcagcactacctggtcctgatagttatcagtgtaatgtcaattaagacaatgaaatggcactttatccctattaarttaggctgaagaacttcggtgggtatgatgcagtgctggagtggtggcaaagacacagacacactcrcacatggctggtgctgatgtaaattagtcctttggaaatccagcttgacagtatgtatcaagagtcataaaatgctcatgtcatttgacccagtaattcccctcctgggaatatatcctaaggaaataattcaacagaagaagaaagttatatgcatgaaagtgttgatttcagcattatttataatgatgaaaaattggaaactgtaaaaatgtccaacagtaggggcatggccaggcaaattatggtagatctacctaatagatttatgcagtcatttaaaagtataatagcattatttggcaatacagaaagatgtttatgatattattttcygtgaaaaaaccagaatgcaaaatggattcttcatatttattacaaacatgtaaagtaggtcttatatgaacagggactggatggaaataaaaaaagaaacagttgacgtgggcaggcagtgagatgtgggtgaatttttttttaagttcctctttatggctactcaagtgttgtttgtgtgataaatagcaaatgggagaaaaaccaaaatcagagtaaactaacactcaaaccaacatcagtgaagtcctggcttgtgtgaaagctatgtggaggtgtcagttggctatgaacataacatgaatcaaatgtcacatggctctattaatggaaatatagactctggatcttggagggtggatgcattcagaagaaggaaattcatgtaataaagcattgatcagtagcaaggtgttttgttttgttttacggagataaggccttactctgtcacccaggctggagtgctatagtgtgatcatggctcactgtagccttgacctcctgggtttaagtaatcctcctgcctcagactactgagtagctggaactacaggtgtgcaccactatactcggctaaatttctgtagagatggtatcttgctatgttgctcaggctggtctcaaacacctgggctcaaatgatccttccatctcagcctcccaaaatgctgggattacaggcatgagccactgtgcctggccacaagatgtttttgagggtcatggattgtatctctagcacaagacccaaaactaagtaggtatttgggagaaattaatgagacaagtaactatgaaacaaagaatagttaaggagaagatctggaagtgacaagagagtttctctcacagaagacaaataaggattcgttctgcattgctgcagggagtagaacaatgtccaatggaaagatgttaaaagtaggtgaatttcagccaagaatcaagaagttgttttatatagctttaattaccctaaattggagtaggctgccttgtgatgtaatgagttcctcatttctggaggtgatcaagcaaggctttgattgatcaagctctgccaaggattctgttaacatactttccaaactggcatatatactggattttatcaaagttgacattctattgactgtaagatgtaccattattttatgcaccactaagaaagaaaamagtgccagttaaacgatcacgtacccttggttgtaatactcattctaatttctgaattgtttatatgtgaaaaaaaactgtgaaatactatatagccctgagggttgcatgatgggagcaccaaagcctacaagctaaatgtggcacgttttctaatcttatcgtaaagcaaatatacatacaatcattctatctgtctatctatctatctatatcaaatagtaaactaaatacatatatttcaaccaaatatatattttaaaaatatgtttctttatgcagtctatcactgatgggcatttgggttggttccaagtctttgctattgtaaatagtgctgcaataaacatacatgtccatgtatctttatagcagaatgatttataatcctttgggtatatactcagtaatgggattgctgggtcaaatggtgtttctggttctagatccttgaggaatcgccacactgtcttccacatatacaccatggaatactatgcagccrtgaaaaagaatgagttcatgtccttagcagggacatggatgaagctggaatccatcatcctcagcaaactaacagaggaacagaaaaccaacaccgcatgttctcactcataagtgggagttgaacagtgacaatacatggacacagggaggcaaacatcacactctagggcctattrggggtggggggaaagggaagggagagcattaggacaaatacctaatgcatgaggggcttaaaacctagatgacgggttgataggtgcagcaaaccaccatggcacatgtatacctgtgtaacaaacctgcacattcagaacatgtatcccagaacttaaagtaaaatttaaaaacrtatatgtttctctataaataaaatgataaactataaatcttaactaaatatatgtatataaataaaatattcatgcacataaactaaatacacacatmcacacacacacacacacacacacacacacagagcaaggagtccagtgtaaatgggcatctttcaaaagatagaggaggagatttcagagatatccttctggtggctggccatactttcttgagccccatgtcccaggtgcatgcacccacattcttttcctgctgaagatttattcgtgtgagaagcttggctgaactgcataggggcttgctctagatgctttctaaaatccatgacaaatctaggagtcgctaatccaatggatctataatactttaaatcagcaactccttatccactcattccattgactttgattccaaagtgctttctaatccctagtattggtctaggccctgcctctcagatgccatgaacaataagactgcagggatccaggcctgtggccctcctgttgtaccagagctccagcatctctggaacccctacagccctttgtgatccaggaatctgcagagtgcctgggaagggatgggtgctttacccaggcattagctttccccaggcccaagtaagcctagacccagtgccatggtggctcctcatgcctytcacctagctagtctcccacccacttctggaggcagggaagagaaaggacactgctgggacaataggataagcctacactttggaatcatagagttcttgggttaatctaccactcactgtggaatgctctgtaatatctctgaggctcagttttctcaactgtaaaataggggtatgagcataatgagataacagcagagctcacatacagccatgcccagtgaggtcgagtgtgcttcccctccaagatcccattttgccctgggaaggaaaagaattttcagcaggaaaagaatgtgggtacatgcacctgggttctgggggctccagctagtatggtcatgggacacttctcctaaagcttctgtgtccgtctcaaatgaggggtaagatacaggaggacttccttcttttcttgagaaatatgcctggaagactgtagttttagcagctccacccttcataagccagggagaatacatattttctttcctgtgctgcacacccagctgtcttggggaaaagcacagaccctgcttagaggcacacatggactggttggcttctggctgaggcttcttggtacagagagtatctttgtttctcattgtccaaccaagaacaaacaggaggaaatgtcctcaaacactataaaggttatgcaaacctaggtgttttgttgttgctgttgttcatctacccatccatccattcatatgccttgaatacctcttctgaacaaggcctggaaaaacccacatgggtagcaccagcccttgcccttgggcaatcatggtctagtggaggagacagataaaaaatcagacaactgtgacaactgctggagagctgagcgcttaggrcacagtggtcgcttgcctaggctccaggaaaagatcacactagagcractgtggattccacaccatggcctactggggaattcccaggctctgagccagcagcacttctgacctctcaaggtgagagttcccctggcatatctggagaacagagatgcaaccagtgctcctggagcagagtgagggagacgagtggtaggaagagataaagttggagacaagggaccaggtcacacacagcctttacattatgggaagaacttggcttctactgagtttatcaggrcccatgggcaggttctgagcagaagctgacctggtctgacctagctttaaccagctgctgtgctgagaatatgctgaaggagtgcagagtgggaacagggagactggcccggagtctaatgcagcaatgcaggtgagaagccagggggcgctctgggtgagagccgcaacggtgaaggcggagagaagtgggcatcttccagacagtttgaaggtggagctaatagaactggctggcagattagaagtgggtgctggagaggagccaaggttagctcccagggtttggggggatcaacgggcmgtatggagctgcccttaactgaggtggcaaagcccataggaagagcaggtttggggtgcggagatcaggagctcagttcagactgttaggtgtgagaagcctgccaggaatatgggaggaactggtgggtaggcagctggatggagagaacctatctgcccatgtaagttggagcatccttagcrtgtagattgtattgaaagccatgaggtcagatgagatgacctcgcaagggagcagagacagaaaagagggattctctttactccccaaggctgcctttgcctgtggtattcagagagtgccctttgcccctttttttccccaggtgtggacctggaaaacagttatgtctgtttctggttcttgcagcagttgtagtgtcagctccttccagaggtctaagaaggggcagatcaggctgyagagagctgggaaccaagaacagtaccgcccctggcaaaggagacctagcccctgccccraagggcttcccagctccctacttatctccctgaagcaggtgcccagctcccagcaggagctcagcacatgttggctgagtggagggatktggggtctcaggagagytggtgggttctaccccgcggtcctgagagaagcaagaaggactgtgttgtcaagaggatgcccctctgagggagagaggcaggtcgtgtgtgtgcatgggtgccagggagcagatggcagcgcagacaaaggctcgcccatggcacagagcacagaagctcatctctgcctggcaggcacctattgcccagggaacgatggattgaaaactccataatggcacgatgatgactgataatacttgaaaggaaactgcaacgtctgctttcaaagcagccctccccggaaggctgaactgccctcagctcccatctcagtgcctttgtcgatggccataacgctcagccagcttgctagcgttcacacctagagaacaattaatcaatctgtggcttgggcttagtgttgggcttcttcctaaaggctaatcgttggttcacaaaaaggaagctttgctggcccattgcagatgggaaccccaggaaaacaaaatgcagacaagcctggagaggcaaatgtatcccctttgtgcccaggccctggmagctatgttgaaggaagctgtatgggacttggttatatttcactggctttgtttatgtgactgtgtgtgtttgaaggataatcttttattcattcaacatatatttattgtgtacttactactgtgtgccaggcataatttgaaattctaggctcagagcagtgaataaaacagataaaaattctctgtccttatggagcttacattctagtatatggagcagataatagacaagctacatgatgaaatcctgtctttaataaaattacaaacattagccgggcgtggtggtgcatgcctgtagtcacagctactcaggaggttgaggcaggagaatcacttgaacctgggaggcagaggtcgcagcgagccaagatcacgccattgyactccagcctgggtgacaaagcaagactctcaaaaaagaaaaaaaaaatagacaagttaaaagagaaaattgtgtagtatrtacatgttgatgtgcaaagcaaattaagaaacagaggaggataagacggatctggggtggagggatgaccattttagatgggcagtttgggaagaccttgagaaggtggtatttgtgtgaakaggtgaaagaggtgaaggactgaagcctgggagaagagtgtcccggcagcgggaagagcaagggcaaggctctgaggtgggcctgatctgctggaggagcaaggagtcctgggtggctcgtggggatgggtggggagagaggcatagatggtggaatcggagaggctgtggggccacaagacagttcctgatagacttaaaactggaagaaaactgtgaaccattcagcccaaattcccagtttttcagatgaggaaacggcttctagccactcaaagcgatgtttatagtctcactgtcagtagcagaccyggttctatcactcaggtgccttgatgtccaaattactccttttcatttaactcatctcgtcactcagaacgtgcttatgggttaccagaggctgggaagggttgtgagtggggagggaggaggggaggatgattaatgggtwgaaaaaatcattatcatgaataagacctactatttgataccccaacagggtaactatagtcaataatcatttaatttatgctttaaaataactgaaacagtataattggattgtttgtaacacaaaggatacatgcctgaggggatggataccccattcttcatgatgtgattatcacccattgcatgcctgtatcaaaacatctcatgtaccccatgaatatatacacctatgtactcaacaaaaattaaaaattaaaaaaaagaatacacttataggcttttcactcactattggacatgagctataaacaaaactggtggagaggccccgggaactagggtggggaaagaatggactctcttaggcacgtgctcatagcctctcttcgtttctgtttcccatcttgatggaaacactgcaacgtttacctcacctcagagcaaatggaaatgggactcctttgccagtttaccaaactgatttcyggacttttgtcagttttgatagcagtccaccccaacccacctttatatgtagaagttattagaaagagttattagactggggctcagcctctggtgggaaaaagaagggaagcatgtagtaatctgatcaggaattactagcacagtgccaggcagtggggattcactcatgagcacaggcagcctctccctgagacctcctggagcccccagcccagcttggggctagaccagtagtcaaaacacagtgaccaaggctgtgaaggggttgacacgggaccatgggagtgaaatggaagggcatccaagccagacttaaggtgaatgggttagggaaggcctcctagaggaagtaaagacctaaaggatgaaaagaaggtggctaggccttcccaaggcagaaggaagctcaaaaacaaatcactggccaggcgcggtggctcatgcctctaatcccagcactctgggaggccgaggcgggcagatcacgaggtcaggagatcgagaccatccttcaccgaggctaacacggtgaaacctcgtctctactaaaaatacaaaaaattagcctagcgtggtggcaggcgcctgtagtcccagctactcaggaggctgaggcaggagaatggcgtgaacctgggaggcggagcttgcagtgagccgagatcgtgccactgcactccaacctgggttacagagcgagactccgtcacaaaaaaaaagaaaaaaaagaaaaaaaaaatcaagagagtcagtgtggcaggccctgctgacgatcaacctggattcgggtccagctccattggttacaccctttgtgacctcgggccagtcactgaacctctctaagcctcagcttccatgtttataaaatgagactaacaatagaacttaccttacagagttactgttaaaaggacataacaggagaatgcaggtaaactatgtggcacattttaaatgctcgtagatgatggattatccttataatccagtatggtagagggttgtggatgataactcccttacaggccctgcttcctggaggtggcaccactgtggctgagtcttacaggaagagggtcagtgaactaagggaaggatgaagaagtggagaggaagggattccagacagaaagaggaaagactgagcaaagactggaggccaaggcccacatagagtggtggaaagctgcatgtgattcagtctctgggaatartatcagaaggcaaggaaggctctacagcagacagacctgtatgaatattaaggatctgaacattgtcctgtagacaatggagagccactgaagggctcttagaagcaaggaggtgacacaattagacatttcaaaagatcactctggctgctgaagggagaatggattgcaaggatgcaagactggaggctgggagcccacttaggaaaacattgccttggtccagataagagatgatgagacgtgagctaggataatggccatgggaatgggatgtaggggagagactagggttgagtcacataggagtgaaatcagcaggagttaatattttattaaatgtgggggagtgggggtaggaggaagcaataaggcaaaggaatgtgcagaatgtccaagaagtcagcagtttttggaaagaaactcctgatggatttaggagttaagcgctactatatgctagttaaccctccaggagggtgtgagatcactcagggagaggcagtttcagtggggagggcagtggttagygagggagtcttgggagagacccagggcaggcagaggaagaggcttacatggagggaccatcactgaggtcccaggagagctgggagtagattgagcagatattggggtcagaggctccaggagtggtgtcagcagggtaaaggcccagaaagatcagggcggcacagtgtctcctggcttcagctctcagatgctaccctggagtatgcagagttcactgtggaaggcccttccacctycccccacccccgaccctcaattcagggggctgaggcaagaattggaggtgagcaagtagagaagggtgtctggtcacctcttataggacattaaaatgataaggggagacgtggggccagctggggttctgggtttgtttggctttgtttttctcataggagagacaagggtgagtttaaaaaccaatggagcttgctggaaaaaagagaaaaggatcactaagtcctgagagagaaagggtcctgagaaggaggaagagccccttattctctgcagctggctccaagtggttaaggatgggtgagtttgtgtggtatgttgtgtgttgtgttgtgtgtgtgtcagagggtggatggggtaggcaaagtggatggggtaggcaaagaaagctggggagctcacaccaaaatatcctcaatttcttccataacaggctgaggtgagaagggttgtgaagatgtcaaatcaacattcattcattcattcagcaaatagttatggtgcacccactgtatgcaaagcacttgagaggcactgggaatatagtcatgaacaacacacaccctgtcctcatggaacttacagcctagtaggggaagagatgttaaacaagcaaccacacagataaatacaaagctattaatgaataaatkaatatcgtaagacttcacttatattcctacaaagctccaactttattagaagctgcccatctgtgtgtttaggtgagaaagagtttttgaacgtgaayctattgttctccttagttctgttgaacagaacagcatcatgatagagccctgaggcagaaaactagagaccaccttcagatgggcgcaagtctactgacttaacctacatctttttattagtactcagacctagcagttctttgtattgactcacagaagcttctgcccatccacagtactttgtatgagaagaaacaacatggtacaactaaaagagttgggatttggggttggaaaacccgatgttaaagtcccagccatgctgctcactagggggacaagatgaatgagacatttaacctttcaggaccttcatttcttcctgcattaaaataggctgaatcctgacacctgctctgccttcttcacagggtactttggaaggtgaaatgaaggaacctgtggggagatgggtggtaaacgtaaagtatggagcacgtctgtggttttatttttcacctgtgcccacttggagttggagccagtgacagatgagtgcagagaattgacagcaaatttcagaattctgatttggttttgcgcactccataaagcataattatttgttggtttaagtgagatctccaggctttttcaaakagtcaaacaatttatactcaaactgcattttgacagccagccttggatatgctcatcttttttcaagaccacatgtcttgcttttacagattgtgttacatgttcatggaagaaaatgggagacattcacaagagcacaaagaagaaaattaaaatcaactattatcacaccccctagatataaccacaattaatatgtaatttattcttccaggcatatatgtgcatattagtgcataaaattcgaaatatatatatttatgctatttatattgctataattattcagccaatcccctgtgtttaaatttagattgtttctactcttcccctttgacagataatgctgtcgtgaaacattcctatacataaatcattgggatgcatctgattatttccttagaataaatctataagggcatggccatttcaaagagttttggtatgtggcttcaaattgctttccagggagatttatgttcttatcagtaatgcatacccatttcttcactccctccccaacactgaatattaacaattttaaaccaattagtttaaaattggatgggtaaaaggtggttcaacaacaggggtcagaggaggccaatcttgagggattgcccatatcccaacagctgtaggactcttagcagaactcctgtttctcagaagcttgttgttccatggccagggtctggcctgcttcccatccacagaggaccgagtaagtgctccttgtatgctttccccagagtgggcacttccatgaggctgaggtcacttccatgaggctgaggtcaggcgtgatgctcaggggtgtctgagtcctggagacagagagggagcttcaggtcgaggcgggccagtcctctgcttatcatcttggatgcaattctggacttcgacttaaataaaggtccttttttaggttccaccagaagtgggcaccaggatgctctggtcattcacagggcatgcctctttccagactagatgcagaatctccagaggcagtgagctagcattctgccccgggagagaacattttttatggctagatgggagcgtgtcacagtttccatgcctgagagagtctggcagtggaatccctgggggacactcaccttcctcaccagcacttgcatactccttgggggcctttactgtcttggacctggggaaccttggggtagttacgactccacactggacatggctggtggcttataggggatgagaaggcagagagcatgaacttcctgagcctagtacccaagaatgaactgtggckcatttgcttattcatcccaccttgcattgtgctagttattagrtggaaaaaaaatgaagataaacaggaccaagtcttttggtgacttgtaggagctcacaagtaagacagacaaacctgtcaaccagcaattgcaaaacaatgaagtgtttgataarccctagaataatttctttctgaggctctggaaacccaggctactcacctatctttatctgttatttatactctagagaagttcctctggaaacagtgtggaggtgaacggtggtgagagggtcaggtaatgagatctggggtgggatggggtggaataggagcagttgatctattggcggctctaggttgaagctcctggaataatagaagcaggtgtaggtggggtmttggggacacagaattctccaggtgcaacgtacagcatccccatccyctaggcaagatattaatctctgagttaaggactaagggaccctgatgaggtctgggaggactgtctcaaaggttctctagactgaggcaccttggctttgtatttggctgggattcaggatggagtgagtgatgaaccaagatgggctggagttctaagagggccaagtatatactgatagaaggatatggtagtgagggcaaatggactttgtcttgtattgccaatatcagtcaattggttgtggttgacaaaaaccatgtgttcagaccacatctagattcactgagaagagggcagagatcaattagtgatgtctgcatggggrtggatgagcaaaatagtggcacatgtgctatttgtgtcatttctgacctcaggcatcacagagcatattgctggatggcagagaggatagcatcataacagtgtgcatgattgatgcttatacctgggaagcaggctgcataggctctgctagaatacaaatctgaggtatcagaggagtaggagccatccatggaagaaagactcttgagctcagcagtgtcccaaaccttggtgaccagaatctgacaaggttccagtgctaggagacctatagcatgagtcaaggaaactgaggcagaaactcagtcatagacactataccaaaccggtgagtgcaaggaaggttcaagcttgatgggctcctcttgactcataatattgggcctgtggccacatggctaatttggactccaccttctaatgatgtccttgccctagtcaggaccacattcaaggcctgggcgtggtagagcctgcagtagccatatgggttacacctaatcataaataaatcacagattggttctacaaaggggaagtggaggattcctggcaagtgagatattaggagcatttaaaagttctcttttctctccccacctaatcctctcccatagcctaagcactgtctgtattttcactatcacagatgcacccataaaatgcctaagccagaaatgagcacatgacccgtcattgcccaggaagtaggtctttcactctccctctgcctcttggccaaggcagagagggtctccctagctgaatgtgcttgggtttrggagctcttcctattactctgggaagatttctctctctcgtatctaattagctttcttattgagaggtcactttctttaaatgggaactctgttcatgggtttcccatgtcagcatgaagagccactgatggaaagtggtgggggattctacagctgctgagccatccatgcccattgtcttcaggggtaattgtygaatgacccmcaggtcagggctcagcccagcccagaaaggattgagaagaggtaattgctgaggaagaaggagagcgagtgaggattggcaagtccagagccagatggggaacactctcagaacaacrtcaagctcctacatgtaggagagagttggaaataatagattaggtggaattaagatgctatttgaccaggccataggaatacttggaccctacctcaggccatctcgttctaaaaagccccctagggagatttcatatrtyctcaattgcaagatgtactccctcccctcctacaccctaaccaatagtttaaccttttggaaatcaaaacaaatcttactatcaacaaatgcagtttatgctgtgtttttctttctctctttttcccaaaaagccctaattaaattgacgacacatgttattattgatggcgtgcttgaatcaagaaaatatagtatatgtacaaagaatggcgctggcaaaaaacaaaaacaaacaaacaaaaaaaaaccttgattactaggtaaagctgtggctccaaatgctctagcaagctggctagatgccaatgagaatgtctttagcctacttccatgatttttctgtatgagagaaggcctactcaaataaattttaacacgaaagggaatctattggcttaagttccagggaaatccaaagggtggcgggtgtggcctcaggaacagctggatccagtgtcactgggacctcattcatctctcagtcctgttttttctcttttatgtggcaacaagatggcttctgggagctttggattcacatgatcctagagaaagagagagattatatttccccagacatctgcagatctaaagtcatggaagaagtgtttttggctgtactcaggttgtgtgccacacctcaagagaaatcccagcggactaagggatggggtgtcatattggctggtctcctggggctagagggcaggtaggcattgtgatttgattgagagtctgcacagagccacatgggatgggggcagggcagttctccaatgggaagagaaatgctggacaaataaaagcaacagctgtccactcttggatcagcctgaaaggcctcggaccaagacttcttccatstaaagctcaatctgagacttgacttttaccacttctgtttgaggaaaggccagtctagactagaccattggaatgacagaggacaaggagaggaagaggcagggtgtggtgcctggatggtgcagtagagtccctccagggtgttggcctctggacatgtccccaccaaggggatatgagaagaagcaaaacagccagagaggcttagagcaacctaatccatgccagcaaagaaggaagaagccagagagagactgcatcctcctgtgaagataatgcatgggaatgcttagcccattgcctggcacccagcgtccaatcaataaatggtagctattattattacccattagggatcatccctcagcgcctgcagtctgggcatgatggatgcaggctgtgcttgtgtaatggggattatttattagtcaccttgtaaaaagcaatgacagaaaggcgcaaaactatgttaccacagagggatcttatctcatggaaatcaaaagcttctctgtttttccactaagaaacaagagcacttgttctcagagattaatccaattccactgtaaagacctcaaggggaaggaggagatgtaattcaaacagatttcagcactgcttttgggataatactcctccagctcctaagtacctgggacttgggcatggatgggagggagggaggggaatgggagttggagaaggaaggagggagttggtgtgaagaggcaggagagtacccttggagctcgcttagaccttgcctggccttctctactggttcagggcaaagccccagaggtactgtttatgcaaataggttgctatccaatgagggagcctgacccactttgaccactccctgcagctgcacctgctttcggcttcctctcctggcccactgcagatccagggctcattttacaaaacttgggcccattacccattgccatttaattacaaatactgtttgcaaaccactttaaattttttttttaatttatcttttccattaacagatgtagcaagagtatatttatgtggcaatgcttatacaacaattcagagtggccactaaatccccatgtgtgggcttaggccttttgttaattatttgtttcacaacaactctgcctgaaaacaatcagcaatggctccccaaaraacatgggaaaatttaaaatttatgtggttaataggaggcagcatacaaatcacttctaattagcatgcaacgagactttgtggccaccctgaatattaacattgattaagcacttaagtcgccccaacccctcataataatttttttgcatataccccacaactatcctcagaggtagctgttattaactattatgtgcccattttacaggtgagaaactgaggcaccaggagagtaatagtctgggggagtgttgaacccagaacttcagaactaggccctgccattgtcacaagacaaggcctcctggtagaagccacctagtcagcttgtaaacaggaattatgatttaatttttwaaaatgacccatgtctattttaagcattcaagcaatacagtaagaatataaatatgagatattttataatcactactcacaattcaacattccagaagtagagcattgttaaggttttcagggcatcacccttgacatctagctatctagagggataacaaactaatgctaatgctggaaagacagatttttcaagaaaacaaagtgagcttgctacatacccaccattttatttttacttttcaaaattttacttaaattcgacagatggaaaaaaaaacaaaggttgaaggaatcattaaacttcagatcattagacattagctcctcaaatatacctctgaagctaagaccaagttcaaacagcatgttaagaagttgcagtcattattatcctttttattattattatttttgcagcatttattaaccacccctgcattgaagaggaggaggttagcgcatgtatatttgttcttatttccataaactccctttcctggtttaaattctttttaatttggcaagatctataacatttatattccattctgtacaatcctcagggttgtgtaatcttagttccatatttaataggatttaacactcaccaccaattttcttgccatacattttacattccaagtgttgtattttgattgatttcttcatttgccagagtccactgtcakatacttcttacaagaaaggttcatgggtgttgtattccctgaattcatgctcgtgaatgtccacctgttgtctaaatatgtaaatgacaacttcaatgagtatacacctcttaagctgcagttctcctcggagctcgaatggcttgattggaggccaaccagacttatttctctcttgtttagcttggtgtttctgcctagatgtccatatgattcattcttttcccttgaaatgtagtatcttcaccagaatacatctttaaggtgattgctatatataaaatttttggagacctcatgtgctcttttgatcttgaaattcaactttcactatttcagggatgtttttgtcgattatatctttgtatgtttttctctatggatatgttgaatttcttttgtcaatattccctatctgtgatcttccatataatcatgtttatatatttgatcttttccatgtatttatttaattttcccaagtttgcttgccaagttcatgagttgagttttcagatatgtttaattcattcctccttctccttttcctcctcttttctctccctcctcttcctcctcctcctctccctcctctttttcctcctccccttcttcctccttcccctttctccttctcccctccttcctcctcctctttctactccctttcctcctccacctccccttctacctcctctctcttctcttcctgttttagctgttttcagtgtggtacttctttttctttcccagctcatctttcatggttttygcttatcttacaatttttcttttaggtccttgaaacttttctttgaattcctttttaaaaactctgcaatttctttgagattagacaacagtggttttctgaattcatcttgcttcctttgacaattccctctgaggtctatgtgttccatagccttttactttattcatttcttcctttcttattttgtttgtttattttgtaatttctatgacacttctctggctagttccctactaattatctctccctttttttgagttggaccaaatatttgccaaagaatagtgtgcagaactctggggcctgggaaaggggattatgaaccgagcggttctgcattgccggtatggttttgtggtccatttgtcctctcaccagatccggcatttctctttgctctgtgccaaagctgctgcgtgtggtggtttggggatggatgtctcatttgtccactgccttactctgcagcctctctaggacagagacagggccgtccatcattcgggtgaaaaggcacatggtctctccttcagtctcctcacattccttcctgcttgaaatgctgaagaggtttccgcgggacactcccatggctggtccacattcccacatcttgtcactttcatcaaaaagtttattgaagtccttttgaggactgagatactttgttttaagaaaatttcgctgaaggtctgaggattactgtgtagactgtcaacacttcttgtttagattcacgtttctcagtatttggcaaatatgcctaatggtttgtggtcaagacccatttccttgtttccctaaagatacagtttctactcctctgtatttttgttcttgttgtcagtggatttcaagagagattaaaaaatgtaaawaccttcactggacatctttaaaaagaaatctcccttttcagtgttgtttaatagttatacagaattccactatgcaaatatagtaacatttactaaaattctctcttgaaggacattaatgctatttccttttcttcttcttttttttgagtataaacaaggctatgatgaatatcttggagtgtrtgtccagttatcctcatcatattttaaagaactggggaaaagccttagagaggttcaaggatttgcccagggccaagaatctagtttctggttaggcatggcagcttatgtatctgtaatcctagcactttgaatgactrtggcaagaggatcacttgggcccaggagtttgagaccagactgggcaatataatgagaccctgtctaccaaaaaaaaaaattagctgggtgaggtggtgcatgcatgcggtcccaactactcaggaggctgaggcaagaggatcccttgagcccaggagttaaaggctgcagtaagtgagctatgatctcgctactgcacttcagcctggatgacagaatgagaccctatctcaaaaaaatagcaaaataaaaaaaaatttttaaaaagtatctagttaccatacacctggatgcaagctcaaccttgagacatccgtttcaaagctgtccagcctgccacagccctgcctctytgttcatctcagggaagacccttcccactgcccgtcctctccaattttattgcctcctcctctggcattgcagtcttgtagatttagcccctattctcaaagggattaactgtaagaggatttctatgcagcttttctcctggattcacacaaaaggacttagataagtcttggcttatggggccttaatgggctgttaggggaaagtggaacatctggggccactcaaaccagaaggaggcatcagagaggctggccatacctggggaggaccttccaaagcctcttcttcaatgtccttattaaggacagaatccgggagcctgggctgtttatgcaacccagatatttagacttcctaagttgaggatmractctytgggggcatccacacatcaactacaaataattaagtatctaacaggtagccagagccagcttcatagatatctgacctatgcagtcatacagggccctgctcagggaagaaccctgagcttggtttaatgctcttctgttgacctcttgaaattaataatcatattttaaccaggggccctgccttttcattgtgtactagatgctgattacgtagctggtcctccatgtaccagacacaacaccaggctctttcacctgtgccagctgaggctgccacagggagaagcagagaactggatctgagggctgcyaggctaggagtctacagatctgcaggctgcagtctgagcagcgttgcgtgagaaaagcagcaaagttaacgaagctgggcagacagaaggacacctggacaaggtgactgtcctctgggcctatagccacaactggtcctactacagactggtcattttgcatgtacgtgagctggagatcttagtctgttttctgttgtttataacagagtacctgaaactgggaaatttatttaaaaaggaatggaggctgagttatggaggctgagaaatccaaggactaggggccacatctgatgagggcttttttgctggtggggactctgcagagtccagaggagatgcagggcaccatccagcacagagcaagagacctgagcattctaatgtgctagctgaggtctctcttaattttcttrtaaagccaccagttcctttcccatgcttgcctattaatccattaacccattagcccattaatccgtgaatggattaatccattcatgaggacagagcctcatgacctaatcgccttttgaaggccacacctctcaatactgccacattggggattaaatttcaacatgaattgtaaaggcaacaaatattcaaaatcataacagggtccttggtctgcacctcaggggcagaggagatgcccatcctatcttgctggactgcaccctgatgacagaggcttcgagaaaagaaggcattccttagattgccactacatttttctcccakcactagtcacattactgaagcaaaggagcccagttccagtaaatatgcagacagatcctygcatttcatcctagctaactgtggtgggaagatggcctccttctttctcccctccaactctctctttctctcttttctttcttctgttttattagctgcacacaaaaaaaagatttttattactcaaatgagctctcagcacgtttgttaatatactcctaatgggttttaagacctaaaagcaacagcatgggtcaccgtttgcctgctcagcaagaatttgcctggtgggagggtgggactgagagaggggaggaagacagggaacaggagctacctctgttggccaggcccaccatgcaaatgagctgggatgcrgtcccaacatattaaatggatcagagcagcttctcattcacatgtgcaaattagattaatcagaccagatgcagaaagaggagaataataatgccgttactaaggacacgcaggcacccgcagggacccgcaggagacatacctggactgagaatcatatttggacaccgagtcatgacctggcttctctcactgagccattccactggggccaaatctgccacatgatcccagcctctgcagctctccaagtccttcctgttgggcccagcctgcccaggcagcttccaaggcatcgatgagcagggaaaccgactctcgtttcttcatagcccctttggtgcctaggtctgagccctgcagagaggctgggtgtcagagtgattcagtgtggcctgagggttgagaacacaaaacccagtatgtgatgaactgacatggtccttacccattgtatgaccttgagaaagtgacttgaacttcagtttctgcatgtgcagaataattctctcaaaggattattctgcaggttaaatgagataatatgtgcaaagaactgtgccagatgcaataaatattatctattattgtctttcttcttccggtcccttttttctcctttctgcttaccttcctgcctttctctctgctttcccctctccctccctccccttcctcttcctcccgcccttttctccttcctttcctcccttccttcctttttcttttctgcttcgtagaatcggttccagttttctataagttgattcatagaactgattccatgatttatctaatttgatcttccaggagaggcacacaagtccagagatggtggtgtcctttggatgccccagctgcctgcctagaggggtggccccttgagtgagcaaccctttccttccagtccatgcaagctcctgggtctccttcctcagggcttggctcagtcctcttgtctgcccagctctcagtagcttcaggatgagtaggacttgctgccaagacattctgtttgttccctgcgtgttgtgccctgacagctgatatatgcagaatccacacacctgtgccaaggctggtaggcaaagaggttttcgtggaaaagccagggcggagggattcaaagcttgaccgagtatggcttgtcatcatcctctgacactttttcatccctctccgagttttattttggtggacactgtgtgtccaggattggggcagaaggaaagtgtggcagatccagccagagggcrtggtgattgcatattgctctgattaccagtgaggttgcgcatcttttcatgtttattggccatttatatttcctttgctgtgaattttctgtccatatcctttgcccattttcataggtcatttgaatttcttttccttttttcagtaatttgcaggaggtctgaataatattaggacatttgttctttgtttgttgtgtctattgtgcaaattttcttttagttggctgcttgtccctaccttgtcaattgtatttcccacaaagtgacctcagcgaggggtgcatcagcaccagggtgtgcacatcagtaaagayagttggagtcacacctgggaataatatccatcaggtgcatatcaacagaaaaatctagatgaaccactgctcccggttactgaatatgaacacaactggactttggaattttaaaagtgttgcttttcctattcgcgataagtccatttctttcctgggtgaaaagagagcagagatatggtaaactctcatagctctgctgtagctggaagctgaatttgaacaaactcatgagggggtggttcagaagtggggactggtgagatagctgccatgtttttctgtctcctgagagctgagcaggatctcagacctttggaggaatcgaagttttgcacaagccctgggtcttgacccagaggccggttgcagagaccatatcccagaagcaggaggccagactggcttttgatcctagattgctgggctggtaacaagtggagtccaaaaagacaaggtccgatgtcccagagcttagccctgaagccactaggccctgttgaatcatctacttggcagcctctgatggtgacagtgtmgtagtcctgcagctgagggcttaacttgggtgagtccaactttggtaaagccaaagaccccaygtgcatatacaactgggacttgtcattttgtgagaagcgaagacagcagagtcgtccaagtgtggacttcgttggagtcttgctggatccacttgtggataatttacactcttggagaacctttcttctctttctcttcatcactggaaacatttgcaaagaacccattgggttcaggactgatgagagctcatggaaaacacttcttttttttttttttcttttcttttttttgagacggagtcttgctctgtcgccaggctggagtgcggtggggcgatcttggctcactgcaacatctgacttcctggttcaagcgattcttctgcctcagtctcctgagtagctgagattacagacatgcaccaccacacccagctaatttttgtatttttagtagagatggggtttcactgtgttggccaggctggtatcgatctcctgacctcgtgatccacccaactcggcctcccaaagtgctgggattacagacatgagccaccgtgcccggtggaaatactgcttagctacgtaaaccaactgatctatgaatgaggccaatgagattagattcctgggcccatcagtgtttgagaagtagaagtgggtttagggaagtggttctagggtgaagggcattttaactaagaactaactaaattccttttttttaagatgaatatttatggaatatctaccatgtgctgggtactgagttgrgctctggaaatataatgaaaaacaaaaataagtacaatccttcctttcatggatcttaaaggagagagtaggagacagacattaatcaaggagcccctaaacatatgtaaaagacaactgtgaaaacggccatccatggtgctgtgagcrtgggattgggagagctggcctagtgggaggcagtggtcactcagctagctctggaggaagaggggactcatcagggggaagacaggccttcccagctcaatgaaatttgcctgcctgtcactcattctcccttcttcctctcgctcacctaccccactcccataacccaaagcatacccsctggatccaatggattattatgtcctatttattctacctctgaaaaatccctcaaatttaaccacccttttcagatctccctactggctctgcctcaattatctttttatctctcccctagattcctttaagggtatcctcactgttatattgccctccagtgtctcccttcactaattcacacatcctggagtcaaacaattgtctccacccatgggcaaaagccttcttaacagaacgtgacctttttcatttaacccattcacatttagaggtggttataagctagacacattggacttactagaaagaaagggctagatttattggaaggggtagcctttgagccgtacaaagaagaatggatatggagataaggtgcgggcaggggaggccactgcaaacaagcaaaagagtggtggtaaatatttccaagggggtctaggagagtgagttttgagagaaagcaactgggtggggcagccaggagggggacttccaaggaagtgtttccttaatgtgataggaatagatagaaactagatagtatagagttatgaattatgagagacataggcaaaggaatgcatttctctttcaatattattggtcatgagagcaaagcaagatggtggctggaggtagaagtagcaaaggaaaaaagaagtgacgagagagagagggagaggctggctgagggtgtagaagtgtggacttgctgatagagaagggcccaggagacacagagtgggcagaggcggctgagatggggtcgagaacacaagtccgaggactcccaaagagagaagcccttcttgagagaaaaggcaagtggaaatcagtggcattagtggaatgagatggacagaagcaaggtgagggagggagccagtgtgacctgttgtggttctgtaaaccaagtttttaaataataaaaataaatgttaatagtatattttgctataaaattttcagacaatgcaaactacaaactgagggtcccccttcaccagccctctcctgccttcccctctcagaggtttatagggttcatggattgatgcgtaaccttccaggttcttttctatacattcacagcactgtaaatrtatctagatagagatatatacatagacacagacatatacatatatagagacacatacatgtgcacacaatacacatatacatatgcagacacagtcatacttttttacataagtgggacaatacaagatgtactattctgaaacttgctttttttcatgtcatatgtctttagagctctttctctattcatattcattcttcctggtggatctatggatctctgtgccatgagttatctaacttttttttttttttttttgagatggagtctcactctgtcgcccaggctggagtgcagtggcacgatcacggctcactgcaagctctgcctcccgggttcacaccattctcctgcctcagcctcctgagcagccagaaccacaggcgcccaccaccacgcccggctaatttttttttttatttttatttttagtagagacagggtttcaccatgctagccaggatggtctcgatctcctgacctcgtgatctgcccacctcagcctcccaaagtgctgggattacaggcgtagccacctcacctggccgagtcctgtaccttcaattggaacatctgggaacctgattccaggtggctcctgatacacagcccttgaatgtttagggttccagagaacactgaaaccttttagtttaccgctgtacatcctacatgaacttgaaagtgtgggctatataaattggtgaataatcattgccacataaatatactcttgctacatctgttaatggaaaagataaattaaaaaaaaaatttaaagtggtttgcaaacagtatttgtaattaaatggcaatgggtaatgggcccaagttttgtaaaatgagccctggatctgcagtgggccaggagaggaagccgaaagcaggtgcagctgcagggagtggtcaaagtgggtcaggctccctcattggatagcaacctatttgcataaacagtacctctggggctttgccctgaaccagtagagaaggccaggcaaggtctaagcgagctccaagggtactctcctgcctcttcacaccaactccctccttccttctccaactcccattcccctccctccctcccatccatgcccaagtcccaggtacttaggagctggaggagtattatcccaaaagcagtgctgaaatctgtttgaattacatctcctccttccccttgaggtctttacagtggaattggattaatctctgnnnnnnnnnnnnnnnnnnnntgggtgcattgcttgagcccaggagttcaagaacagcctgggcaacatggcaaaacctcatctctactaaaaatacaaagaagtagaagggcatggtgagcctggtgaacatggtggcgcacgcctatagtcccagctacccaggaggctgaggtgggaggtcgaggcttcagtgrgccgtactgtcatgagtaccatcatcaatgcacttttatgagcttatatacgaatgtctgtcagatggaaagtgaggagtggaatttttgcatcaaagactatgtgggctgtaattttgttattgtgagactgtcttctccaaagcttgtttacactcccactaaccacctgggttgattcccctaccctctcccaacattagattttatcaggctttttcatttctgccaatctgattgtcaaataatgctatctcattgttttgatttgcattttcctgattagcaacacggtgcctcttttcatatacttatcctccatttgtgtttgtgatttttttttcaagtggattacctgttcatatctcctgcccattttttttctgttgggtatttgctttttttttattgacttggaccacttaatatattcttggtatcactgtgttgtccattatatatgttatggctgtcttttcctactctgtaatttgtattttaagtttgttttgaggcctattttattgagtcagagacagatagcttaaatgacttgcccaaggtccctctgcctagagctgttttctgactccccgtggtgtttcaccagatccagtattcctctgcagaacagcaagaccgtgtcttcctttggctccctttcagggggattttttaattgcatgcactcctggagtaagctgactttgatcctgttgcaaagctggctgaggcagggaaacctatgactatggctgttgctgggttctactccacctgttccatttctcttctcaatttcgatggaagaatttccaagattttctagcccacactttcaagttcatgtaggatgtacagcggtaaactaaaaggtttcagtgttctctggaaccctaaagattcaaggactgtgtatcaggagccacctggaatcaggttgccagatgttccaattggaartacaggacacagccatrggaggtggctgatgcctgtaatcccagcactttgggaggctgaggcaggaggattgcttgaggccaggagttycatgccagctgggaaaacatagcaagaccctgtctctacaaaaaatgaaaaatatcarccagacatggtggggagtgcctgtagtcctagctacttgggaggatcgcttaagcccaggagttctaggctgcagtgatctaagattatgcctctgtactccagtctgggcaacagacagaggccctgtctctaaaaaagaggaaaaaaaaaaaaacccaaaacacccagttaagtttgattttcacataaataacaaacactattttaccataaatatgtcccatacratattctattataagtatgacccatgcaatatttacttacactaaaacattattcatttttatccaaaatcagatttagctgggattgtatattttatctggcaaccctaatctggaggagacaggaaagggtaggaggyaactgggtgagctcagtaggctcacccctggcctcaacctaaggctggcactgtttaaatgtcttagatttttagatttaagaatgtaaggtacgaagagatcaagtgacttggcagagctgaagtttggatcaagataggtctgatagaagagcccattgtttttcccaagtcccttgartttggggtgactgattctcctcttcatagcctctccccagggtgtggaagagacagccccagagcagcaaagagtgtgaggagataggcctatcagaaccgggctttccaygtgcagaaagtgtggggtgaggggagagtaatgtgtttcgtgcaacactctcatcaccttaaatggggtgaatcctcattaattccaattaaataactgtttaattggttctaactccatttccaggagtgagctcacagcccatgaatagatctttggacttctgactactacatatcttacattactactacatcctatcactttttttgatacctagtctaaatttttttttgaaatggaatttcactcttgtcgtccaggctggagtgcagtggcacgatctcagctcactgcaacatccgcctcccaggttcaggtgattctcctgcctcagcctcctgagtagttgagattacaggcgcaggccaccatgccaggctaattttttgtatttgtagtagagatggggtttcgccatgttggccaggctggtctcgaatgccggacctcaggtgatctgccagcctcagcctcccaaagtcttttttaaatcactcttattgatatgtaattaatatacartaaaatacaccattttggagtgtacagtttggtgcgttttcacaagttcatgcatccatctagctaccaccacaatcaagacataaacatctccatcrcccccaaaagtttctttgtgccggttcttagtcattctcctcccatccctgaccgcaggtaactgatctgctttctgtcacgtcagattagatttgtctttcctagagtttcacatagcaaaatcgtacagtgtaatcatacaatatatactcttgtgtctgacttttttcagtataacagtgatgagattagttcatgtgttgtcatgtgtatcaggagttcattcattttttttactgctgaaaactattcagttttattaatataccataatttctttatccatccaaatatccttttggtgaaagtttgggtcattggtttggggtcattataagtaaacctgctgtgaatgaacattgaaatataagtctttgtgtgattatatgtttcatttcctctgggtaaattcttaggaatgaaattactaggttgtgtggtaagtgtatgtttacataaaatactgctcaactgttttccaaagtagttataccattttgcattcccatcagccatgtatggtggacatgcccttgctgaaacttggtatctttattcttttacattgtaaccattctaatgggtatgtggtggtatctcattgtggttttaattttcatttccctgatggctaatgaggataaacattttttcacctgtttattgaccatttggaaatcatctattcaagtttctgcccatttttaaattgaattatttgtcttattagtgagttataagattacatatatatgtgtgttttatttctatataattcatatatattaatatactataatttgtttatgcatccawatatatatatatatatatatatatatatatrtatatatatggagagagagagagatttttacctgtcccaaagccatgaaggttttctcttgttttcttctggaagtgttatagwtctagcttgtatatacactcagttgtatgattccttttgtgttaatatttgtgtatggggtgaagtgagagttgaggttcattttttccctgtgtgaatattcagttgttctagcatcattggttgaaaaggctattagcagatcgtattttgaataagatgccgatacaacatgattgattccctatcagcatcccctccttgtcttagtattttttttttccatcaacaagtatttgttgagtttctgtgacwtgtcaggtgttgttttaattgctgggcatcagtcctgaataaagtggaacaagtccctgctctcatggagaccgtggcttagccacaggagacaacaacttaacccaaaataataatagtagacctggccctagaaagataactaaaatagggttaggaaacagagagtggcaggacattccagaatgaaacagagagggcaacatttctaagaagacagcgtttgagcagagacctgcagggtgggggatgtgagggcctggctctctgcagatgggctgttaaggggacagactgattgccagagcctcccattcccagcccagcttctcagacactcccttaggggtctacagttgtgacaagggccctctgcagagctcatgtgccatcacatgtcactcgggtctcctccatgtcctggctactccagccactgctcacaaagctgcatctgacagcagggagtgactttcgcagatttcactccttcattcatttctttaattaaaaggtatgtattaagcccagtaagtgtgcttggcactgcgctagactctggggagacagagatgaacaaatgaatggacctgagttacggcttcagcaggagccagctcaagaaaagtcttaaatgcacttggtacatgaagtgtttgctctgcagacaggagagctccatgaatggctaaagctactggatttgggggagtgaggaatgggagacaaggagagtttatcctaggagactgttgcaataggtcgggtgagatatgatgcaggtgtgaattaaagcagtggagatgtgggggctgggagaaagaatgttggatgatccaggtttctaacttgaacacaggggcatggtggtgctactgattttaggggacacaggaggaagagcaggtctggaataggtgagtgcatgggtaaagtgatgaagagtctgtttggaggcacggcaagggtgaggtgctcctggtagaaatgtctaggacttaatttcacttgaaggtctgaagctcatgaaggagatctgggtgggaggtcaagccttgcaatttatccacagaggaattataattgacagcagagatggaagagatgctcctgggaggtatctaaacaaatacttgctctgtgtcagacttttgcctggcgtgctactaaatgtttaatatactggttaggacattgagttctgatgcccaactccctgggttaaaactttagcagtagcacttgcgagcagggtgaccttgggcaagtcaactcaactctatattcctctgctaaatgttgatagtaataaatttaccttctggggtattatgcggattaaattatctggtatgtgtatagcacatagaatagtgtaataccatgtgattggtaaatgttagttgatcctaatatcctttaacatacctatagcatagggggtatcattacttgttttatagataagggaattgtccaaggttatggaattaggtagtggaagaacaaggacttgaatgcaggcctgtgtgtctccagagtctaccattcaaggctgtcttctactgggggataaaggtctgtgcattcattggctacttgatgaacttagcccctctgggcagaggggttccaatgcctggctaagcccycatccctgctgtgccatcggccatggctagtatcttctacctgcaacctggagccagcagaccctgcagcccctcctgcaagccttacacacacacacgagaaggatgctgcctttctcacctcctccagatgcttgcacctactgtgccacattgcaatcaggggctgcatgtccgtgccttggtcccagaacagaggaggaaaggagccctggagtccatgctgacagagrtctgtttaccttcatgcccagtgccctgagttacgctccaggtgtcccatttggagaagagaagctagtcaggagccctgtctgagagactgtggcagcttggggttgaagccaggagagcagacttggaaggactttaagctattagcaaatacagcacagacagaggccagaagttctgagaggaactgggattagggaacagtctgagtcatggcctggcagggaagcatgaaggcagccagctctggggagggcactgagaacaagcaggcccaggctggatgcctggctctacctactcgctctgtcacaagatttcatgcttctctgagcctcagtttcttcagctgtaaaatgggcatggcaaggatacatcccttctaggggcaatgtgaggactccttgctatgccaaggatgttacgtgttagcttcccttcccttcccctgcctacccaaggagggaggatttcctgcagaaggcaagctttcagcagcgctggagaggtacagaaagacatggattgagagagtagaggtaggagggtgttgctgcaagggcctgagccttgtatccccagaagccggagctgagtggaaagcttcaaggtgaagggattattgggcataaatatgtaaagaggaaaggaactggctgctgtcattctagtaatcctggctgctgccagctctgcggcaggcattgggctggactggggtggtgccaaggtgaatgaggtgccacctctgccctcaaggagctccctgggttggggcagtcagacttattaatggagcatctccatccagggtgctaactgatgctcaggggttggacaagggaaacagctcagagcagagagtgactgctccttccaccagaacatgagtcgctgtgccctggcagcctgcgagtggactgaggccccatgcattcctctaagggtggggcgatcaaagagattccaggcctccgctctatagactggaggcttgaaagggagcacaggtttgtaccagcaggactaagcttggcagtgcaccaaggaccttgacctccagccagggaaaacaaaggcacaagatctactggggagcagggactttcacatacattatcctacttaacctccttaaagtattgagtgtcccttttttatccaaagccaagagaggttaaacaacttacctagagacacacagtgagcaagtggcagcaccaggattcacactcgggtacgtttcgactccactggcttgatctttcctacaagcaccctccaagccagccccatgccttcccaacagatggaccacttccacctctctgccaagccctgcagacgtggctacgtcctgccttcctccagaggagcctgggcagcctcagggcctggcccaccgcagtccctcctgtcctccccagctgccaaaccactaattagtgtgcctggcattgttcctcacagtttccctctcactctcgcctcccctagaaagcctagctcccagctaaatttagctgtgactacttcccagggaggggtggggtggatggggaaggaaggctaagtcctgagttttgagtctccatagtgaaagggagacagccmagggctccmtccctccaggacagcttcccctccatcgacctgctggtgaagccttgargctgtggcattgcgttactgcacacacttggcttgaatatgatggattctgaggtccatgtacgatagcaatgggaaccgttaacgccacacgtctgccttcatcaaagctgccttgttttctttgagaggttttataataagcaatcattacccatttgtgcaatacttttatattaacatcacctcttttatacactggggttctggggttctgtgtgagatttccttccttccttcctkcctgcctgcctgcctgcctgccttccttccttccttccttccttsctccttccctccttccctccctcccttctccctttccctttcctttcctttttcttttgacagggtctcactctgtcacccaagcttgaatgcagtggaaaaatctcagctcactgcagccttcaacttctggacccaagggatcctctcacctcaacctcccgagtagttgggactaaagatgcatgccaccgtatctgggtaatgtttttactttttgtaaagacagagtctcgctatgttgcccaggctggtctggaactcctgcaatccttcttcctccacctcccaaagcgcaggcgtgagccactgcacccagaccaagatttcttttgggagggatttgttttcttaaaaagcaagtttggaaaccagagcttcacacttgagtgtcttgctgctttgagtgtgatctgagaagcagctgcatgggcaccccctgagagcttgttagaaatgcagaactcagcccccaccccacaccgagtgaaatagaacctgttkyactttcaagatccacaagtgatctctacactgttgaagaagcactgccttagtctaaatcaggatcactgaggagcttgtcaaaatgcagattccctggcttcctccatgagattctgactcaggagtaagggaaggcccaagctatgtccattttgtcctttttttttttggtggggggagacagagtctcgctctgtcacccaggctggagtgcagtggcgcgatctcggctccctgcaagctccgcctccagggttcacgccattctcctgcctcagcctccygagtagctgggactacaggcatgcgccaccacgcctagctaattttttgtatttttagtagagacagggtttcaccatgttggtcaggctggtcttkaactcctgaccttaggtgatccacctgccttggcctcccttggtgctgggattccaggcatgagccactgcacccggcctatgtccatttttcataacacccctggttatggtgcaagtctttcgtctgccctgagatgttaatgttcactctcggctaacagcttcagggaggcaggctgcccaatacatgcacagaaacaagcttcctcaaaacgtctttctctcctttacagagatcctgtcctctgatgtccctgacctcagaggtagtaggatgggtgatgggctggggagaaagcatgcctgtgacctgcagcttcacaagttctcactttagccttgaccaccgagacatccttctgctacagggagagatagactaagacagcagacgttctgtgagaaccaggtctgtccccaagaagaggaagtcttgcagattacagaccagatctgcaaatattcctgcagactctttgaaattactttctacataaccagtctccaaggatttgatgtcagttctttcctcccttcttgcccgctagaacttcccacagggaaaaatgttcccaagtagagagatgccccaagataggtggcaaggaggggagaggcaggtgattagacctgctgcattgcccacatccttgagcatgaggccataaataagttcttggcatctgctaagtgctcaaaaaataatcatcggatatttttttaaaaagccatctcccacctggattgttgcactgccttctaagcagctccctgcctccagtctccctctgcagagggcccttgtcataactgtagacccctaagggagtgtctgagaagctgggctggcaatgggaggctctggcaatcaggctcttcctgtaacagcccatctgtagacagctgggtccccactcccctgatcctgcaggtctctgctcacaccctgccttcttagaagtgttgccctcctcatctcactcccctttaattcatccttcttgggctcctagccctgccatcccttgttctgagtccctcaagactcccttggactcctagggtctggtccaaatgtcttggatgtacaaagccttcacgagctgggttctgcctaccccttcacccacatctttgccagccctccctgtgccctgtgctccaccaaggccacagtagatccagcgccttgagggtgccatgcccttgcggtcatctctgcctgtgcacctgctgctccctctgccagggatatcctttcctccaccaactggcaggtctcctataacctattccaggagtctcttcacaggtccgtcattcattcagtcattcaacatgaattgagtgagttcctaccatgtgccacatactaagctagagtctggggacgtacagtgcctgtgatagattcatcaactcatttaaaatactcccagtccaagaagcttcaggataacctctctcctcccttccacagtttgctaatgaggaaactgaagcacggtgtggttaaatggctttctcaaggacaaactactagaaggtagagggtcaggactggagcacagagtctggcttcagagcccagggcttgggcactgtggcactgtgccactgtgcagcccctttgcaaaggtctgtttctcaatgtctcctgtgatcttgctcctccttcctcccgccctggttctcctctgttgctcccagctcagaggatggaacgtctgttcatccagtagccccccaagaaaactggtagtcattttggccactgatctctccatcacccacttctgtttgccttctgaatgtttctgacatctgtccactttccacttttcttcaccrtcctgtcacccactagcctgaggttccatcttgtctcacctggacagctatggtagctctaaattgccttctctgccttcacccatgccctcggcacaaatcagcagacttacagccactctgatcagggcacccagtgtgacttccacaggcctcccatactgccctctctgccctttctcagccctccctctgaagcatctgcacaggggaccccttccacctgggggtgcttcttaycctgcagccccatcccagcagaacctcactgtgcccattcctcagctctcagctccagactcattgtcccaggggttctcctctgatggcctgtccagcccaaatgcctttgcttccctcatgggccagtctggctctatgattacatacttggcagtgtcattgctgtatgagcacctgtctccttcatgagactgaaagctccaggagagtggcaacatatctagttctggtctctactgtatactcagtgcgtggcccagggccagatatagagtaggacggaaatacgtgatgaacaaatgaaggggttgttatgacgatcaaatgagaaagtataggtaaaagtactcaaaacagcccctagcacaagtcagatactcaattataagctactagtaatgagtcttgttgttagaaccaatcttgagcaagccttacctgatgcccaaagggggatgaaaattgcaaataacgaggatggcaactgcacacagctggaagggactatacagagctgagggtggaagctgcaaacagctgagaargtgcttatgaacagctggggctgtgactgcacactcctgaggataaggcctgcaaataagtgggragtgagtgcaaatagctggaatgttgaactgcaaacaaccgggagtaaggactgcaaaacaaccagagcagaggctgcatctggggagcagaagagcttcggagcactcacatcacccactgcctctgcaatactgggtccctgcactttctcctctctcccaacagaagtgtgcccaagagaccccaggggtatctctcacgggcccacaaataagactggttcgcctggtctattctgaagtaacttttccctcccctcccatgctccaccatgttactttctctcagttcttcagataggcttgtatcctcccactacctgacctttgcacatgccaggccctccttctggaagttccccaccccatccttcagatctgagttccaataccactttatcagagagacaagatcagattatccttctccattttccttcgtttcatcatcttcagtgagaacaatgattagcatttgcatatacttgttgggctttctgatgactgcctaccacccctactagactctaatcttctagagagcagggacttagcacctagtccacggtctgacacgtagtaggtgctcataaatatgagatggatggaaggatgaatggaggaactggagcaatggttgagtggacagagagttcctcaaaggcacaagcgaagaaaataaaacaactgtcttaattgagtgcytactgtgtacctggccctggaacaagtcatccctttcttgttagtgcttgggatgtatatgaatgaatcattctttgtctctccagggagtcagaagatcttgattctttccttcattcagccagtgtttcactgtgagacctgacctactaggaaacctgttaggaaaagacaaaatattcctgccagtgctttgcactgacagctacccttcctgcaacctacctcagataacagcaaggaaggagccagtggtcctgaggctccagtttacccatttatgagagagggatttgggttctaagatgatccctaaggaccatgccaggtgggatagtctgagtctgtgaaacttctcaggaggttccttatatctttattttgtaactggccaggttccagagtcccagccccagataagagtygagggttctggccactggtgcccactgccttggccaggaaagggtccacagtgaaggctctcccctggttccaggacacttgttctatctaccaagttgcctacaagaatctcagatctctaaagcgggcacagaacccagacttacacagacacagaaacccactaaaacccccaaaaataacaatagtcaatctttataaagcactggctagatgcctggcattgctctaaactgaagctcagagaggttaaagaacttgcccaaggtcacacagctagtaagtcagagctgggctttggacccaggcagatgggctctggggtccctgctcttaacccctgcatcatagtctgagacatccagtcacactcaccaccagacacacaggctcacaaaagtacacacacacacataaaacacacacaagcttttccagtgaaggcaacaaaatggctgctgtctcccttctctttcctttcttgtagtgatttaggctctgtgggctaagaactctgcacaaagccagaaagggtctcttgttaccagtctgtttctcaaatggattggcattcacagtcgctctgccagccagtctggacaagaggcttgggaagcactgagcctgtagtgcccttggatactggtacccacagtaggaggaaggggcagggctatttctcagcaggttgacgacgctttggatggtagccgaaatgcctccttcatctctgtcccattaattcaaagatgccataggaaacctgctaggaaaacacaaaataggcttgtctggctctctgcactgacaaccacccctactccaccctgcttcagacacaasgaggaagggaacctgggcagctgtgacggggccaggtcctactgggcacagccaccctgggcatctcactggcaggggatctggcatggggtgggcaaggagaacctcagaaagacagagaagggcaaagtaaaccagcaggtgagacaggagcatgtcagatgggcacacaaagcaacagaaacgtggagttcaagtccaggagcttccagaaaggtatatgtacctgcaatgatgggagggtggagatggctgtggttgatcctgactctgattcttattgactatgtgatgtggctttgggcaagttacttaactctctgtgcgtcagtttcctcttctgtaaaatagagatggcaatagtactcacttcttrgagttgttaagaggatttagtgagataattttgcaaagagcttagtatgatgcctggaatatcatagacatgcaataaatgttagctctcattcctggaaacaatgaggaggatgaagatgcagcggggtcaggagagacagaagggtctgtgccagggctaggtggctcgtaagcatccttgcatcatcccagccactctgagtttctagggttcttaggtacggtgtcctctcctggcctttgcatctgctgttctctccacctagagcactcttccctctcttctctggattaactcttgcgtatccttcaggtgtcaaacttagacctctctctgcccgggaagcccttcctgaccctgaccctgcaggtctggctgaaaagcctcctctcagagytcccacggctgtctatacagctcatcatgatctttctcgccctggagtgggttgcgggtctacctgtctgccctctgtgatgtgtcatgctcagcaccgaatccccagagattcacagagcctggaacacggtgctaaataataagttgggaatgaatgaaataacgacttgtatgttgaataatagaatattgtcccattacacccagctgcttctcaaagacaaaatttgaagcaccagacataatgagatgctcaatgtggtggggccaagagtacaggctctggagtcagacttcctgtgttgtaatctcatctccttccccagtacctgcatgaccttgggaaaattgcttaacctttttcttcctcaagttcctcatccatataatgggaataataaagyctccaccttgctgagttgctgcaaggataaacaacacacttaaagattttagacagggctggcccagawgagctctcagcaagccttagtcctccttagaggtgtgctccacctcacacctgcccttcccacattgtgaatcgtgtcagccccgaccgggacccctgcccgcttctgttgactctttcagtagtttatagaagctgttgcgatttttttctaatttaatgtttatatccttttatgtcctgaccaaaaaacaaatgacccaagaggaaggctggggagaggggacatctgagttgaggcttccagtcccaccactgtagattctgtttcttgggctcttattccacagggtcagcatgtggaagggttgggtcagggaagggcatctcaggcagaggcagcagcaggagcaggagctggcaagagcacagctcagtgctcctgctgcagyaaagkatggggaggtgcagtgaggggttggcaggggattggtcatggggtgtcctgagggtccctggaagttgcttggaatctaggctgcaggcaacagagcaccactgagggctttgagcaggtgagacctaagagagagtgccctgatggaaggatggacagagatttgctgggtaatagggagggtgtctgaacattcatggggttgaatctcctgctcccacagggtcctgttctgccctgatggagggatggacygaggagagtttgmtgggtaatagggagggtatctgaacattcatgaggttgaatctcctgttcccacagggtcctattcttgcccactcacctccctcaccaccaacattcactgggcctgtttgcccatctgcccactccccacccagccctgctgccaggctgggagttctatgggaaggtagtcattcccggccagctgtttacctccagcaccctggacaggatctggctcagagtaggtggaattgtttccctccatcctttcttgctaacttcctacccctctcctcctaacttgaactttcttacctgcttttgtccctctctgcctctttgcttgaataacagcctgtgctgtgaattaatttctgtcctctgtttcccctacaccctcccccatatcccataaactgccacttcttttctggaaaagctctgaactccacgacacttgaagaacctaaagggaaggggtaaagaaccaataccagtcaaacagctttcatatgccaagaactatgctgggaactctatatggattccttcatttaacttttcaaacagcccaaagaggaatgtattagtgtcctaccttataaatgagggtcagagcagttcagagttgcccagtgtcacattgtggcagagccagaggcctcatcaaaagaatggttctctgatggtggaatctcaggcattttgagggggcagcgggaaagatttggaataaggagactcctggaccactcgcatcatgccctggtggtgttgcctccattgcttctgccttgggtcagggattcctgatccacagccctgctctgagctggagtagattcygtgaacctccctgggtcagatggtgctccaggaaggcagagagggcatcccacatcctgctgagatagtgctgcaatggtgggttggagccagcggagaaatgaagccagaggccagatccccggggctaaagttacaccctaggctgggaatccccaggtgggttctgagattttgtttccttatccccaaccacccccttttggatccatcagcctttgtttaaacccattttaccaagtcctcaatcatctgctgcccctgatcctgtgcatgactctggccctggtcacagcccttgggcaagacagatgagctccccttctgtgtctcaccatggcaatggagacctgcagccatccacatcctgagctagctctgaaagtcaaaccagcacattctactcaggtgagacagcaacccgggtcccttggctcagcatcgaagggttgggaatgatcagcaagttgctgttgagaatagagaaatgaaatatgtgaggatataacttttaacttaaaatgcggtgccccctgcatttggatgtcaggagggatcttgagtgacgtttgtggagctgctggggtgagcatgtgaggtcaaatatactcattagccatgcttagaggcaatggtggagggagcgaggaatacactggttccacctgctgggtttctccctatcaagagggaagcagagctcagattcagttcgacatccccaaagcaggcccacagccrtgcacacagagagcatccgcacaggccactggagcgtcagtggagtccaaccaggctgcaccagcttccagatgcccttcacctgctacagaggggaggccctcccctcccccctggtggttcctttcgatggcacctgtgtagcatcatctctgcttggaataaaccaggttttggctgtcaggaatcttattacagaaggaatctgggtggatggccagactttgtgtgagattccctaatcggtggacttgggamatttatgcacttgtgtgtgtgtgtgtgtgtgtgtgtgtacacttgggagagggaggatctgtggatctactgaatgtcttctaaaagggatctattcatttatttaaataataccgtgtattatgtccctgatactgttccaggcactggggatatagcagtgaagaaaagtctgtttgtactctaacccaggagacagaaaataaatacatgactctaaaactgtcaggagcccttgtgattacagtaagtggactccagtctaagtgaggggtacccctggatccactgcaccttgcagaggaggtctgagtgtaggctggatgccctcagaagccaggccctctggtgctgggcatgtaccctggagagtgacacactgattcttcccagccttccttcctacacctagcctggggccagcctcctgaaggaaagggtgggagcttgcccagccaggggcagtctgagcagagctktgtgcagtggaaagtgcctggcttcagagtgttgtgaggtgaactgggtggaggcattaagcatctggcatcatggctgactcagggtggctgttccrtccrtagagtaccctcttcatttgccttattagggacactcaaagatgaaaagtgtgcagtcatctgagtttgctcttgtagaaggggccaggaagctccagtcctaagaaggtcattccttggagatactccttcygttctgtgggacttggaggctttaatgtgcaatgtaggaattggatcctgagatgggccttatctgactttcaagctcatgctcaaacacttgccrgtattctcctgcagtgtgctttgtgtcgagccctgtgctgagatgagtaactctcagcctctgactttgggacactcacagttccatgcaagcaaagcacctctgccactgactagccctgggacatcaagcaggttacttaaatttctctaggtctctgtttgtttcctcatctgtaaaatggggatcgttggagtgccttctgggacttttgcaatatataaagcacttaacacagcattcagtaaaacttgctccttggggacagacagcctgactggctcatgtctgwgtccctagtgcttggcccyatgcctggctcagaggagcatttccagaagaaaggcagaatgagcacgcagtgggaggaatctcctctgtatgctgctgggttatcagtttctggaaccatgtgagatttgtgcgagcccatgtgaccaacagacagttcttcaggctgctataaagcagtckccaacacctgtccctgtgagccgctgcattgtgtatttgagcctttgatataccggggatgtttgccaagggagagaaatgttattggacatttttcgtggctgtaaggattacttcttgatgaaaacacacacaaagaaagacttacaagctgcccttaaggtaggcaaatgaatgatgtgtgtttacagcatccaggccattgctcagggctgtcagctctgcagactccttgcaggggctgcagcagaagaagggaagtggccagcacatccatgtggctgagcagagggcagttctgctcagactgcagcagcccattattctgattcatccrttgaytcttcctacccctctcagtgtgttgacgtctttcctataaagactgaggcttttacctgagctctgccctggtcactccccattccccaaactagaaggcaccttctcctcagtgcatctgcctagagagcctgtccmtgctcaggcaccctgggggctcttccttctcgtgtaggagtcctgtctccccagccagctcttacgtrctaaagggcagggtgcatggccattcctcttaggctccttctaccctcaagtgcattttcctgcactaacaggcaggcaagaaagagaagagaagaatcatctcaccaggtgcacttcaccttctcaatgcagttatcacacccagctaccttgtaccctgacctgggagtcccctggggcaggaagcttttctgattcaacccaggaccccctcagggtctgcaaagcctggggcagtgcatggggtcaatgaatatctgaatgaatgagtgaataatggaacccagctttagcttctatgctgacccttctcccattccatttcagaccccatcwcctgtgcaggaagccccttggcctccctagtgggtagcaatgtcccctctcagctgtctgcactgcctcctcctcygagtctgcttactggcattgagtgttcttcctgctgtcaacacagcttggggacatgccagcgtgctgggcaataggcccagcacatcctaaggcagatagtgtgggcaggggaggatcctagcagggctggattctggcacggccaggcctgggatctggttgaggagagkgttaaagaaagacagggcctgggtctggaggggtggctgggagctgagtcttggggtcagaggctgaggcctacttgcaactgggcaaccttggatggatggcttaccctctctgaacctcagccgtctctcagtctgcaagggagaagcctgaatggagactcatagtcttttagctgtgaaggctcatcctgctgcttcgggtcctgtgcagagccttggagaaacatcagtagatgagtcagttgcgctcgtgcaggtcgtggtctgtgtgttggtttcctatggcctttgtaacaaatctctacaagcatgatggtttaagacagcacagatttattctattacagttccggaggccagaagtccacaatcagactcactgagctacagtcaaggtgttggcagggccgattccttctggaggctctaggggagaatatgtttccttccttttcccagcttcggagaagccacctccttggattatggccccgtcctcccgtcactctgatctcctacttccacggtcacagctcctattactgactccaatcctcctgcccccctcttataaggacacttgtgattacattggacacatcaggataatccaggatgacctccccayctcatccttaacttaatgacatctgtagtctcttttgccatgtaaagcagcatatttccatgttctggaaatcagggcatggacatctttgggtgggggtgaggagtattattaagcctgccacagtgtggttgaatctaaaactatgaatcaattaatcatcaaataaatgaattactatgaactctaatggcaccagccacaaagcagcactgtgctgtcaaagtatcacagggacctggcttagcctcgaggacagcaagggctgggccacattcccctttttcttttctctgttctctcaagccctgttcatcccactgccccctctgctgtccagaagwccccagggagtccgtttctgcagtttcccaccacctactcccgcggtccctgccccagcctggaacatccttaaggggtggctgtcgtgaatgttagcaatgctttcacctcctacgcagcagtcctttgaggactarcttycctagggagtaccagtgatggaaatatcaatattataagtatttgtctcctgggctggaagaagtatcgagctgtgatttagtcagttgtgctgcctctctctaaccacccaaattctcctttgcctctttggaagacttacaggaatagatctcgtcaactctccatggctcccagggcactctgaggaaccaagctgggagggtgaagtcaggtagaatttgggttccttggaggcaccccctctcacccacctcccaaaacaggcacccgcccaacctrccgaaggcacttgaaccartcccacatgaccctcccaagcttgcagagaaggcaaagaagtaatcagctgcttgccactgggctccacggggaaaacccagctctgtcctttcacgaggatgtgactccaagagctgctcggaagctgctggctctgctctcacccacgcacagcacagaaaagacattggaatgtgcctggctttgcacaaaagctgaagcaaccaggatcwggggaaagacctgagcsaggcacgatgtttcccgaggccctgcagatctcccagcctgtgagcagtgtcagggctggacccagtggctgccccaccataaggccggaggaagattggtcrcgggcatgcatttccatgaagccgccacactggctcacccatgcacatgagacacttttgccggcctcagggagtctagaggtcacagctaatgtggcccaggtggggcctcaagggaggacaaaggctggtgttcatctgcagcatgttaatcgtgagtcctgctctctgggaaggtgtccttggccgtgccagaagcgttgaaggagatcctgttaactgctagtgacttcccaccagtcccggcagacaccgcaagggctgccataatgataatgataatggttctagtaatgatcattgctctcatttgctgagtgtttatgttgtgccaggcactgtgctaagctgtttatatgcattaccccaattaatcctcccagcaacctgattgttatcatcctgattttactgatgaggaaactgaggcagagggaattaagcaacaatgcacatggttggttgaggagagaggcagcatgggttacggtaaacagagcacacattcaggggttacacagaattggattcaaatccagagtttgccacttaccagttaagtgacctggaaaatcacctgcctgctctgaggctcagggaagcaggagggagcaagtggacacatatggacataggggcccctccccaggggcccagccctgtccctgcacgcacctggactcaggtaggccctgaaggctggggatgagcctcagaggaagccatctcccttctggggaaggcccgggctgggaaggagagctgccctgttgagtgggcatctgatctttcctgccaggaagggtggggggcaggaatgtgccaggagagcacctgtagtatcatctgctcctgggtgcccaggcctgagctcaggcttgggtgccattggatgtcactttgagatcccacaagctggcctcactttacgggagcagagacaatgggcaagatctggaatgagggtgggattagcgattgcggacacagggattcctgagggagggagaaaaagagggagrggattgagtcttgggcaccatcaccacatggggcctgctattgcctagaggtctggtgtgtaagagctgaaactgttccacctttcttcaccatctgaagcatacacactcactcactcattcattcattcattcattcatctaaggagccagccagcacagtggctttggagtcagatgggactgcctttgaatttctgccttttcttttctttttttttttttttgagatggagttttactcttgttgcccaggctggagtgcaatggcgtgatctcggcttactgcaacctccgmctcccaggttcaagcaattgtcctgcctcagcctcccaagtagctgggattacaggcatgcaccaccacgcccggttgaatctttttttagtagaggtggggtttctccatgttgaggctgatctcaaactcctgacctcaggtgatccgcccrcctggcctcccaaagtgctgagattacaggcgtgagccaccacgcccggctgaatttctgccttttcatggattcttagtgtgatctgaggaaagccacttacaatctgaagcatacacactcactcactcattcattcattcatctaaggagccagccagcacagtggctaagagcacaggctttgcagtcagatgggactgactgaatttctgccttttcattaattcttagtgtgatctcaggaaagtcacttaactctcaaaaccttaactttcacatgtgtaaaatggaaataataatacctaattcacaaggctgcaggtagggtccaatgagatagtattataaatcacttagcatagtgcatggcatctgtaactacgcaataaataatttcaaaatctctatatctatctatctgtctatctatccatccatccatcrcactgtctagtagaaatgtgatctaaacctcaaatgtgagccatgtgtataattttaaatttctagtagccatgttaaaagactgaaaaagaaacaggtgaatcaaatccagtagtatactttaaccccatctgttcaatatattactatttaaaaatgtaaccaatgtaaaatgcaatattttacattgttcctttcacactgtctttgaaattggttgtgtatgttatgcttaaagcacatttcaattcagagcagctgccttgaacagtgtggccattccccaggatttggtccttgttttgttcttctctgaccatgttctttctcctatgatctcactgactcccaccgtttcaatgatcacctctaagtgaacaacgctgggagtgacttacaggacctactcctgggagctagagaacagacaggatgtgtccagawcatgccaagggggacatgtgactgacaaggttgaaggctagcagaggcctgaaaaagtagcatcaaggtggtaaagtcccagaacaagctgggtgtatgagtttcctattgttcccaataaattatcaaaattaccaacgatcacagttatagttaatcacagttataaaattgtcaccaactcagtagcctaaaataacacatgtacattctcagtttctgtgggtcaggattctgggtatggccttgtgggtcctcagtgcagggtttcaaaaggctgctgtcaagtgatggtggggctgcattttcatctggaggmggagttcaattccaagctcattcaggtgtctgacaggtggatgtcaggtggaggccactctgaggttctagaggcagccctttcatcccagaggccaacttcaattccttgccacatggcatctccaacatggacccttccttgatcaagcctgcaagcagatcttatctctaatctgctaagacagagtcttacacaatgtagcataatcataggggtgacatcccatcccctttttcatgttctgttggtgagaggcaaatcacaggcctcactcataccaaaggggatgggaatacaagaagccatgaacaccagatgctagaggattgttgggagtcaccttgggggccatctgccacctggaatttgtaaaamactctaaagatggacagcaagaggttagcgggcttaagactcacccsagctcccatgtgagttctaagttaaggaagcatgagatgcaaagataactcacctaacatgactcaaagaaccagcttgattcatttctagacaggctycccgaagtgtgggactatgacagggccaggctggaaaatgggtcgggcttctcatcttcctcctaaagaggagaccactaggctcatggggcaaggctgaccagtgatagttagccaggggttgaaaatagtcgcrgagatgggcagcttccatgctttagcatctaagaatactcctgcagtgatgggatctcatctgtggtttctgaccgccttgcagaaaaccatgtaaggaagacatggcatccttctgactctctgttaccctagaggatggggctcttcagacaagccctccttccttcatctcaaggtttatcctgccccgtggaggttcttcttcacagactggaggtcagaaagtgcaaataaaactgaagcaaagaatgtgatctgggctcttctcagagacccattgccccgagtgaggccccccaaacctattggccctactctcatcgggaaggccccgtgaggcattccctcccagatggaagccctgacttcctggttacaaagagttaatgtattgtttttcatgatacctctagaacacctgttgggtgaccatcatggacgtttggctgggatttgatgtggggagtgcagagggggacgtggatcactacggagataaagaaatcaatagagatacctttatggtgtagggaaagagggtgtgcacacttgtgcctgggttcacctgtgggtgcaggtgtgctgggcgattaaacaggagtgtacatgcatttgttcacgctggggtgtggatgtctacctgtgtgtgtagagccttgaaattcaagccaggcatatcctgagaacctgacattcccagatcctcaaatatctttatagactaccccccaccccccgctttaaaaaaaaaagtctgtgaagtgtgtacttaagaaaaagtgttttggtgacctcttcagacctttaatgattccataaatatgagatcaaagccatttataaaatattaaaatcaattctccactaaaatatactctcctctacctcaccccacatcattatgaccaacacattcgcatggagtttaactaaagcttctaagactaaatagaatcgtgatgaataataataccacgcccctattaacttctcctgtggcaagggaaaacgtttgcgaaatgtttaaaccttttctcgtacttaaaggtcagctcagcagccacaggactgcctccaccacctggtgctttatggaaatgttgacgtggctcccagctgttgtctaggcgcatttccacagagagtcatgggtttcctgggcatatactcacaacactctcaaccgcctttttagctgtcacaaaagtattcattcccactcaataagcaatttttgccctggctgaagcacttgctgaaatgatttcataaatcatctttttcttgttttcaaacacttgcaaatcagagccaccatcaaactcaacatccactccttaattcacccgcagcttctattttcttgctaaaaaccattacttccttagactccctcgcttacttttcagtttcatcaccaccctgggcagttggctctattttgggaaatgatttttcacaataaaatgaagattcttatcactttacaggagttgccacataagccccaacaacaaaccccctagaacccaagatcctgagaaggtcaacaaggtttcttcactagctgagtgtctccctcacatgccagcctcctggcacatgtgattcccatttaagcctcagcataattgggaattacgtcctggatcaaagatctactttatgtagaccaggccttcaaggatttgcaaccatcagggcagaaaattttcatggttgcttctagggatgggcaggtgagatcaaggttggcctagaattgcagtcaagaaggcttcactgctggtgggctggcagaatctggagtcaagaccagaggctcaaggctggactcyttggattaggaaactccctggaagttcagggagccatgtaggtttcctgtcctgtaagatttgggtcttgcatcatttcttacgggaagtgatctctgacctctcccttgtctccccagagcaggtgagctacttccactaagctcatgccattccacctcgttccttggccactggacttattccctgtgctgtgcttactgctggtttctcccrtctctgcatcctgcattagactgtgattccctgagaagggactctgcctgctcattcattctgttgccagtcatatggcttatggaaaggatgtgcttctaatgtggctatccgcattcagggccagcttcctgggttcacaaactgtgaggtcacacaggtcaccgaggaacctatgcatggtattatgctctgctatgaccatcttgaaattctgaaccattttttgaaaaagaggccctgcattttcatccagcactgtgccctgaaaattaggtagccattcttacctgtatttaataaactggtagacaggaagtatttttagagggttgttgtgcctagatgtctaatatcaatgtagcattagatgagaatcccagaaggcaaggaccccagttatggagcacttcctgatagcacccagcatcaagccraggcacaagggcatccttcaccatcacacttaccccgtggccttggctggagcaacttgaaagtatggagagggtcaccagcacccaagaggacccttcaacaagaacctggagattgtgtgtttatggcactaagtgtggcatgcatttgttctcttgcataatttcagagccagacagtgaaattataaagctaggaatgacaagaatgatgaggccctgcaaatcagggaagacacatcaccataagctctttatcaggccttcmcccaagaggccctctgtggaaagtgggaagcaggagggccttcttcactccacggtcgaggggaagaggatgagtggagagaagaattctaaccccatcctgggtgactttgattcaagctccataaggtttaccaaggggaagcttgatgatttgaggcaacctagagggacagagtcagtccaggtgcctgggccaagcagccctctgcctctgcacctttgaggtgtgaagaagaatagtaaattcctgagtttcctgagtgctttccatgtgctacttgtcacagtgctaaatgcaagttctcatctgatcctcyatagtcttgctagagaggtgttatgagcactaccatttcataaacgaggacacagagcacagagaggtccagtgatgtgtccccagtcactcagctgatagttaaggggagagtcaggatataaagccagatatacctggtgctgaaacctgaactcccagtgctgcagcgccctacccctcaaccatctagggccaggaaggcctcacttctggggtctgggagcaggggctttcatatgatgggaggggttgtgcatccatctgcctggacagatcagaaggagagaagaggcttggggtccccatcctcagaaataaaaacaaaaaagcagaagtcttgttgggagtgggaggatgagtcctaaaattatctcaaaacaagtcagaaacctggaatatacaaaacttaaggcttctagaacctctgcccttgtcctattccagttgcttatttcttcattcatccagcaattacctccaaagagcctaacatgtgccaagcacgttttactggggactaggagtgcagagattcaaagagaattacagatwtggatgagatgctgatcatgtgccaggrgctgatttaagtacattctatgtacttctttcttcacaatagccctgtgaggcaggcactgttattatcatctccatgttatagctgaacacattgagacatagagaggttaagtcccacatctaggaagtggtagagccaggatttgaacccggacagtcttgctgcagcgccttctctccaccactccatggcaccacttcaatctcaaagatcttactgtttagagcagttgttctaatccccaaccccacattagaaccacccaaggatcttttaaaaatctgcaccctcagggagactctcgtacactgtaggtgagaagacaaaatggcacaaccactttggacaaacaccttggcagcttggcagtttcttgaaaagttaaagacacatctgccatctgacacagccattctacttccaggctttactgcaaggaaaattaacacatatgtccacacaaagacttgtacccaaatgtttatagtggttctatttgtaagaacagaaaactagaaataatgcaaatgtccatcaacagatgaatgaataaataaatagtagtatatcccttcagtggaatactatgcagcaataaacaagaaggaactgatacaagcaacagcatggatggatatcaagtgaactatcctgagtggaagaagtcagaccaaaatgagtcctgtatgattacatttatatgaaattctggacattttaaactagttgagagtgagggaaagcagatcagttgttgcctggggagagaggatagagaggagaggagaaagggactgcatggggtgggtccagaggaaaatctcgggaatgattgataccttcattatcctgattgtggtgatggtttaagaggagtatacatactttaaaatgtaacaaagtgtacattttaaatatttgttgttaaaataaagtgtgtacactttaaatatatgccaattataacctcaacaaggctgtaagagagcccatgctgagacctcatccaagaycaaataaatcggaatctttgggagtagaacccagacatctgtattttaaagttcctcagagattccaatgggctgtcaaggtgcagaagagcagatgcagtgaggagactgttgcataagccaggggtaggtattcagattaggtgaggggccccataaggggctttgagaggagaatggtgtggctggggttgcatttaagacactgttgttggatccagggtgaggaagacaggctttagactctcaatcttttgacagcaagatctgcactctcaggcaggtgacacctgctcttcattcttcctttcccttattcattcattcacagatatttactgagggccaactacgtaccagacattgctctaagccctaaggacaagaatgaaggaaacagaaatctcttccttcatgagtttgcattccagagaaaataaacagtgtggttacaggttctgcatgatatgttagatgctatgaataaaaaggaagcagggaatagaggtggggagagatgggtctggatgcaattttaaagaggatctcaccgagcagcagacatttgcrgacacacctgaaggatatgagkgagtcaatcttgctgatttgggggaggaagattattccaggcagagggagctgcaagtacaaaggtccagaggctggagcaagggagggagtagagaggaaggcagggaagaagcaactcacctggggccctgcaggccattggaaggacctggcatttcctctgagtaagaggggaagctgttggggcattggagtagagaagcagtaataaattttttccctcaaggttccttgtaaatcagatgtttgtcaagtgaaycctgcttcaaatcccctatgagaacctgggctgaccttgcttgaaagtggctggattccacagagcatgtgtgtttgcacagatgctgcacatgctttactcaaatgaagtctttctgtggccccctaaacccccaactcttttgggtaagagcaagccccctaagtagcaacatgcccacatatagaactcgctccccctccccagggaccgctttcaggcagacatgctcctcatcattaaaaatggatgaagcctgaacagagggagggaagcatgcaaggaagatgtcaactgtgagtgaggctgctggccctgcagtacgagtcctgggcaaaggagcctgagcatcctctctcttgcccagaccgcatgaatttgctggaatgttttccattccatccatcccaaacagctagtgtaccatttattgagtccttactaggtgccagtgtctgtgacatgtgtttttcacatgatctatctcatttaatcttctcaacatccccaagtcttaataactccctgtattcttccatttgtgttgctataaaggaatatgtgaggctgggcaatttataaggaaaagaggttgatttgattcatggttctgcaggctgtacatgaagcatagtgccagcatctgcttccagtgaggcctcaggaagcttacagtcatgggggaaggtgaagggaagccagcgtgtcccatggcaagagagggagaaagagagaaagggaggggatttcaggctcctttaaacgatcaactgcgtgaactcatggagtgagaactcactcattactgccaggacagcaccaaagccttcatgagagatccacccccatgacccaaacacctctcactaggctcgcattcaaaccatctcactctcatctcactgatgaggcccctgaaggtcagagaggtacagtgtagttctcaaagtcacacagctaaggtggatgcccaggcctatctgattccagaaccgtgcttggaaccacaccatgacattrccactccctcccagatgtcactgagatactggcctcctttgccttccaagcaggacagggcatgcaaggccagaagactcctgtcccagtgagcgcagctcctcagtcttacacaggcctaatgggattttagaggcagaggcaggctgtgagaaagaggtggggtttgggatcaggctggtcttgaactgggggaagcacaggcccttgttaggatgcccagtgacatcagctgcaaagccttcgacacccactgatgcacctgcagggggctctggggcaatggtgagaccaggcagggaggctgccaagccatgagttgtgggtgctcctccttggaaagtgtgactacagctggcaagtaggggattggcaggggagggggctgatgcgctgtagcgcattgatggcctggatttcatataaggcccagtaaaccagaaacaatagagaatggtaggagatggagtcagaaattgtggcctggggttgtctgtgcccacacagggatcaggaaaaggatgggagatgtggcccacttcagaccccacctgccatggacatgcttcctgaatcactgcctcccaataactcactaattccagagtcgccctcaaaccagatatgtccctaatcagtgggcgctttctaaagacatcatatacatagacttctgctaagtactgagactgaaatgcaaaactctcatcccccagagagatcctgttagctgggagaggaggcgtctgattcctgagctcagaaaggttggcaaatgagagtctctgtttccatgggaaatgcgtgcggtgcccctgggcttccatggtgcctggcacaggcttccactgcagcacccccttatctctctgtaattgtttggctgcacatctgtctcccccacaacaccatgagccccttgaaggcaggacctatgtctgatcaatgtccctgtccccgatggctggcccagactgctccacagagttataaaataaattattgaataattaggaagaaactgcttccagagagcatcagggttccaagtcagtggtctgataatgtctgtgtgagcgaatctacctcccgtggattttgtgtgttgaataattgagtgaggtatgccaggggcagagcagatgtgagattgctcaaacctctgacaaatgaaagacagtttccagcacagaggaggtggtctgaggccgagacccatcccatgggggtgggcctctggggattcccaggaggtccacctgaggaagaatatagggtggggcaagaggccagcttgagttggaagacgacagtcagcacagccctggaggcaccagggatggtaagagtgggctgggggcaggagcagggtagggtcctcactgtggaccattgtgacctcctgagacccagagggcttctgtcacgtggggatcaggatttggaaaggggccgaaagtcaagttgccagacaaagctttattcattcattcatttgacctatgcccacgctgctaggatccagcaggaatgcaacaaagccgctgcccttgtagaggttgacttctggtgtggagacagccagggggcaagccaatcaaaaaataatttcagattgggataaatggcatgcagaacaaaarcagggtcagggaaagagagtggtgagctgcattacatgggacagggcagtctgggagggcttcctggaggagctgacccttgaaaagagacctgaaagatgtgaagccaggagtttttgcaaacaccgcaaagggctttgagtttggcaggtgtgaggagccacctgaaggcccctatggaaggagtcaagggcagcaggagggagagggggcagggtgagcaactgtgctgctttgctttgacagaggattttccgggacacgggactttcagtactaaacctggatatgtcccgggcaaactgggactaaattggtcacctagaggtagggcctgaggacagagaggctgctggggcgagaacacgcaggcccacctctgaggtcacagggaggactttgggttttattctacattgaatggaaatggaaggcaaaaactcgtttctgacttaaatatctgtgtgtgtctggcactgtgctgggcagttgataaggatgaggcatacacgatccctgcctttgcggagtttcaggcttttgtgttttctcacattggcaattaagccagcagtgtcacacgtgtcaccacacgccttctctgtggcattttttatctaggctcagaataaacaaagagaagcatccatagtcttcagagcaggcgcctttcctctccacctagatcagcaggttgctatttccagacatcatctcactgtgaccacgagggaagcacatgttatctgatctggaaaattgagcaggggctcacctttactgggcacctgtgtgggaaggtcacaggtcagcagggagtcgagataaataggcagctacaacacagcatggcgagggccttgtgtgggcagaggggtatcatatccacaagcatgaacatctcttaaacactaactgtttcagcttkctttctgctgcataaaaaaaatcaccacrcacatagcagcttaaaccacatttactaccgcacagtttccatgggtcagaagtccaggcatggctgarctaagttctctactaagggtctcacaaagctgtcatccaggggcagctaaggctgaggttttatcagagacctgagggcctctctcaagttcacatgattggtggcagaatggtttccttacagctgtaaaatcaggatggcttccttcttcaaggtcagcagaaaagtctctactgcttcaagtctctaacctctaaaccctcagggcttacctgatttgaccaggctcacccaggagaatttctttttggattaactcaaagtcaactcatcagggacctcagttatgtctgcaaaaaaaaatcccttcacctctgccatataactttacctagtcatgggtgtgacagcccatcatctctacgggtcctattcacacccaaagggaggggattgtggagatgggaccaaggggtgggatgctgaggggcatttcagaattctgcttatcacactaaccatggaagaggtgctttacacttacaaactcatttcattctcagaacaatgctatgtgataggtactatcattgtcctcatttacaagtgaggaaactgaggcagagagggggtaagtaatcaagtcaaggtcccacagccaagaggacccagtgctttggaaaaacacagcctcatggaatgaggatccctgtggcagtcaggaaaaggcgtgggggtgggagcgagcctaccaaagttcgccttgctgtttcataaagcgttgccatggaaaccctgcatgaagcatccctcaaagagctgtttgattattttttcagggtggcatctgcagtcacctagcagcagcaccaacacacacacatgcgtgcgtgcacacacacacacacacacacacacacagtgactgagttaatgggtctagtacaggcacatggcaggagatctggaaggtctattgataaatgaattgcttattggcaggatcagggttctgttcggtgtctctactgcagggaacccagatctgggaacctttcaggtcctgatggtcatggtgctgtcggtcttcagtcactgtgggtccagagagactgtctctcagctgccccttctgtctcctcccactggcttatccttccagctccagccctgcctgcccttcctagaccttctcatgtcagcaatcttagtgtctttggccaacctgggagtgggatargattgtgtagaactcattgacattaagcctgaacacacagacctataaggcatgaaacttgttcactcacagcccctttgatgaattccagctcctttgatgacacagaaagtcctggacacttattgatcttgtcccaaatcttaaagcgaggtctagccttgcagatcaatgaggcaggaggcccagggtaatcattatgatgacaatgatgataataataatgactgccatctagtacaacgtcttgccaggcagcatgcaaagtgctctgtatacatggtttcattgctcatttgtcagttcattcaacaagtatttattgagcaatggctctctgccaggtactgggtctatactaatgaatgagtcagagaggctccctgcttgcatggagcgtaccttctagtagggaagatagacagtaaacaaagsggggaaagacagccagttgtgataagtgtcatgcaaagacttgaaataagacagccttggagagaggacctgtgggcttctgcctctttgatttgtgtggtgaggggaggcctctcgggggaggtgataggtgaatgcaagagccctgaggtaggaacttggtaagcctgaggaccagaaagttgggccacagtggctggagcatggtgaggaaggaatcaagggcaccagcagagactggccacggagactctgcaggtccaggacaggagggtgattcttatttaaagggagatgagaagatttaggggggtgttaagcaggggagagacatgctctaatttgtattttaacagatccctctagctgctgtgtgaagagtggctgtgggggcaagagtggaatcagggagctcagttagacctttggagacaccgggtgaaggagactggggcttgggccayggaggtagcacaggagccaaagaggagtgcttggrttaaggtatgctcagcagggctgactgatggtgtgggtgtgggggtggaacatagagaggattctggaatattcctaagattttggtctgagcaagagggtagatagagattccatcttcagagcaactctaagctgtgatgttttctgcactgcataacttaaaaagcagacacacaatggyctgacacctgctacagcatggatggctctcaaggacattatgcgaagtgaaggatgccagtcacaaaaggataaaaacgatatgattccacttatatgcagtgcttggactagtcaaactcatagagacagaaagtagactggtggttgccagggcctgggaggagggggaaatggagtgttattgcgtagtgggtacagtttcagttttgcaagatgaaaacagttttgtggatggatagtggtgatggttacacaacaatgtgaatattcttttttttttttttaatactttaagttctagggtacatgtgcacaatgtgaatattcttaatgccactaaactacacttaaaaatggttaagatgctacattttatgtatattttactataattaaaaagaacagagccaggatctcatagttggtaaaaggccaagccaggtttgaactcagatctggtgtgttaattgccgcatcaccctgcttccaggaacacaggccccagccttgatgtgagctccctcatggtaccagtgtcgaggtggagatcagcctacatcatgcactggtgtggccaccataggaggacaccaacccccaggtgtggctggtttggcacctgtaagtgggatgtttgaatggagagatgaacaatagaaagtagactgaacgccggcactttattttgtctaatagtgtcagcatatacaaagcaacccratagaaatgatgatgatgatggtgatggtggtgatgatcagggtgacacaaagtcagcttccacacactggcatatcagtgccaagcccttcacacatgacattttatcaatcctcaccacaaccctacaatataggtactttcattattctacatttcattctacagatgagaagactgaggctgagtgactttcgttaagattgcccatgagtaagcgggagtaaaagatcaaaacgtggtctgtctccagagcctgaatgcctttctagtaatgacccgggttaaatgaggaaactaattaagaaggtataacagcactcactcctgagtgttctattttttgggccaacttgaagggacacgcgggtaattatttcctggaataagcatcctctgcacaggccccaggatgctccatgctcagcctcctgcgtggaagctgacaccgcgtttgcttggcgacaagtcacaacaaagctcggcacactcccaccccgccccactcaggcggcgcctcktgggggaaaataagataaaacaaaatcaagctgagctcctaattcacattccatctctggcagctccttgatgatgaataattctggaattggaaatgaggcaggagaaaggcagatggggatccgggcagtgtggcccagcagcccgttctactcgggatcgtcctctcttcctccttgggatggcgagacagggtccacgggtgataaatgaacaccttgacctcctcctccttttaaaagaattattattttcaatcgtggtgaaatacacataacaccactcattatcttaaccatttttaagtgtggagttagttcattggcattaagtacattcacattgttgtataaccatccccgccatccrtctccagaaccttttcattttcccaagctgaaactctgaccctttagtctgtactaactcctcttttccctctcccccagcccctggtaacctctattctgctttctttctcaatgagtttgactactctaggtgtctcatataagtggaatcatacagtatttgttctttttgtgactggctcatttcacttaccatgatgtcctcacagttcatccatgctgtgtagtatgtgtcagaattcccgtcttttgtcaggctgaataacattccgtcgttcggatgtaccatgttttgtttagccattcacccatcatggacactggagttgcttctcccgcttggctgttgtgatagtgctcctatgaacatacctccttctcctttaccggaggctgacttaaccctggctaccctcaattgtataattgtgggtatttggatggccggagttaagtcagtgttccctccccccaccaccaacagaactgccacccccatacccctcacttggcctccactagatcttaccctgggccctacaggtttccatagcaacccagtaccaatcagctgtggaaggcagtcaagtttaggggtttgagtccaggcttgttacttacaaggtttacgacctagggcaagttagttcatttctgyggtcttcgtttcctcatttgtagaaacaagatcatgatagtactatacctacttcgactctcaggggagggggttgaaggagataatactakccctaggtctgtgccaggtgccttgcatggattatctgcctgggtccacatagcaaccctaaggggtagttatattattatcctctttatagatgaagaaactgagtcttggggagggaaaggacttgctcgaggtaccatgatagcatgggggattggagaagggagtgagcatggcagggaaccagaatcactgggcagtggtactgggattctgagcactgggcttgtacccttatccatgggaagtgccctgcaaatgaaggctagtctgataaattttggacatgctcatagctggctcctgagtcaataaaatcaatccgtatctctcagggagcagggtcagcttgaacaggcaaggcccttttctggcagggacattttaagcttggaatggggctgtcaggtgagccatgctgggcaaaagcactaggaatctatgcctgaactcgggggcctgtggctcctttcttcctgggaggagggtccatgtgttttatcttctctcaaaagatccctgactccaaactggtaaagacccacttggattctagcccatggatctcagaaaaagctacagactctataaggactatgagctacagagattgggttctactgcaagcttagagagggcaggttcctgggtcagctgggctgtaggcatcatggaaacgttgcaagttggcacaggttgaggctgcaggacagacagactgtgcgaggattcaggggcatgtgagagaagctggttctggctgtgtagcagagaatgggtaggccayggctctgcaaatttaaattcatttattgctcatgtatctgtcctgggcaggtgtttaatatggtggggagctctactccacctggaaattcagggataaagcctccttccaccttggagacacacatccccttgggtctgatcaacaacatccagccaatgtaggaagaacatgcaggaggctgcatggaggtttttatgggctaagcctggccayggcctgtatcacttttgcccatggtccacctaactgcagggaggtctaggaaaggttgtctagctgtgtgccccaagaagggaagatggaattttggtggagctagactttttttgccacgtgcagccatccagcaaacatttgctggtgcccaatgccttacggaatgtttaaggaacagaagccctgtgacgtgagttcagtaaacatatggctgacaatctcacagaaagctaagttcattgaggttgtcatccatccactcatttatacatccattcattcatagagtcgttgattcaagaaatagtttttgcgtgtctactgtgtgctggccactgtgctatatgctgggatacaaaagtgaaaaaagtcagacaaggtctctgtttgcatggagcttaaatgtttgtgtgtgtgcatgtgtgtgtgtgtgtgtgtgtgtgtgtaaacaacaaaaacaagaaccacataaaatgattactcatgactgtaaatgctctgaaggtataataaagggtggtgaggcagaatagctgaggttggattaaatgtcaggattaaatgtctgaaggtataataaagggtggtgaggcagaatagctgaggttggattaaatgtcagggtaggcttctctgaggaggtgacatttgagttgagtgctgaaaaacgatcatgaatgagcaatgcagaatggaagacagagaacttctgggccagggaatattgtgtaaaggccctggggcagagaagaacttcatgtacttgaagattatccaccatcactactgttattcttattcagacctctacctctttgctctattagttttcctctgcttaataccactggttctgtaactggaccatcaaattcaacagctctgttcagtcctgttctggctttagctatcttggtggcatttcacacattgccagccaagttttcattctcaagatacttggggtcatcacagcctcttggtcagagtttcctaggactcagcccttaactgctcttctccttctctctaccttggctcctgtggcctccccaccatgctgagtgtccatggaggtgtgtacaaagcacactggaccacttggctccacggaggagagggggatgtcttcccagaggtgacatttgaactgagtcttgaaaggttgagaaggatttgccagatgatgaaaatcacaagagtacttcagaggtggggccagcaactgcagaggccaaggggcgtgaaagggcacaaaggagagatcacagaaggagaggtgacgaaggagcaggagtgtgcgtggttgagggtgtggtagggatggaagtagcgggaggaaaacctggacagatggctgagtccagattgtgtaggacattaaatgtcttgctaagaagtagacagtttcttctgccggcatcaaagagtcacaagaagcttaaggatggtgcctgggtttgttttataggcaggtgagtgttggagcgaggattggagaaggaagtgagcctggcagggaacctgaagtggaggacgggcgagggggtaggtgggagaaagccagggaagagattgatttttcttggcagtcaacgatgtaaatggctggcataattgcttgacacagagcctatccttaaaggtcatttggcctcacctcttcttaggggttgcagcccgggatgggctctgatagttttttaaatacaagagcaccttttgtagagtgtaagcataatgagggcagggaggacattcatcatcagatcccagcaaaccaccaaggtgtgaagacaccagttgaatgagttaatgaatgagcagctccagtaagccatgtgcctcttgaacagatgacagaatggagtgcaatgtccctaacatttagacaaattcttgtctcattgctcaagggagggaagagagaaccaggctggcttccgcagcctctctccagccctggagatgtgtgctaacagactggcctgggaaaagagggtggaaggttggagacttggccaatgtcagtcaggaatgactgtgggtcagattgtcagatagaggaccaaggggaaagagaaattggggttctcaggtgtctagaaaaacacccaaggttctggatgatgcccgactcaatgctgtaatcagttaggagctggaattaacagctttctatctttggtgaacaatcaccatggtggaacaatgaggtcaacagcagctcttcagagacatgaagacagacgcatcccaatccttggctgaataggaaggagggagacaagatacccagggacatggcataaggcttcttctatgcatatgacctgtgccccaggacagttgcaggccaggtctagagagtgtggagtgcagctccctctttttcacctggggagatttagggcctggtaacacctaactcccaggccttgagttcctgggcctgtcagtagcctagcctttgctgtaaatgtcatcttgcccaactatgccaaccactggcttctcaaccacgtttccctcaatgcccatcctcaacaggctctcctacctgaatacccacatgccatgtccctgcacatacccacatacccacacatttcatagttatgcagtttacatgcatatatagacacacacatgctcatgtaacaccaacacaccagcatgactatagacacaaactctcctctctctctctctctctctctctctctctctctctgctggaggagaaataaggagagccattgttgctggaacattgggtgtgaggaggagacgggtacgtacagttggagacatgggtggggctagctcatggaggaccttgagtgatattctagagcttgacaccaactgaagcgcttttaggagggaagagccatgatcctactagttgtttagagaatgggttggattggggcaagtctgaagacagaacaatgaggaggctatctccaagtccaagagaagaaactgagatagggtagggcctggtcctggagcctgagcaatggggtgggggcagatatgagagatggaaggaaggtaattcaagagactgggtgtgagaccagatgaggtctcagcttggatggctggctggatgatgggccagtcccagatgcaaggaacccaggggagagatgggtttggggcaagggcaggagagtaatttgggccatgtgcagttggaggcacttctgagattttcacttagagaagcccgaaagtagcaagacttggggtctggagtcaggaggaaggtctgggctgggattttgcacacaggaagttaggagtcactaaccctgggaacaagagcctggaaagcaagcagtgggggcttctgtactcttggccatgtgccacttcttgtctctggaacatccttccttctctgtcaagaccataccaaatgcctcttccaggaaacttctccaaattattccttcccctcatccctgaagttgtgagccactggctggtgagccagggcagcacagggcagctgaggcgaggatcagagaggggacaaggtctgagtccattgatacacagggtctcctcttgcatttcagtttgcagctgggtaggactattcacgaatgattcttattaggctgtacgggaggtctttagaattcaaagcaacagaccgctccctgkmtcaacaagagcagtgtaggtctaagggatgccgcctgcctggcagagccagggtgcatcccatgttctggctcctggggccatctgccctccccagccactgtacccggcttctctctttttcagctccagcctctcccacactgccctggcatcttctcccagggaatccaggggcttatatgtaatcacatcctaaacttattgagcacttcctgtgtgtcagacactgagataagcactttgcctggtttattggacttaatcctctcaacagctctctaagctgggtgcgattattacccccattttattgctgaggaagctgagatgcaggaaggtgaagtagcttactatttaagtaacagtgctggggtttgaccatgaacccagagtacagctccagagtccactctcctaatccatacctgttatacaaccagtaacccacagccaggagaggcacagatggaattcacacccaggtctatgggacaccagagacattttctggaccatgatgccctgtgtctccctgaccctgacagcccttgatccctacctctgaaatcacagactgagccagcagatgcttgaggcgtctctagggtcagatctacctctgcgcctctatccctgcattctgtactgtgtctgggaaaacaggagcttaaacacaagtgtcaggcaggccccatgagtgtgtgatataacactggcttctgagggctgttctggttgtataaagagatacctgtgcaaaagtttattaatccaaagaggctatatggaaatggatcggtatcttgagatggacgtggcttgtacataaacatgagtggtttattcaaatgtgtgggagagtaagtgtgttgtatccattgtcatgtgtgtgaatgtaagagctgtgttcagacgcatcctgaatttgcctgtttttatatatgcatgtttatgtgtatgagaatgtacatgtgtgcatgtctcttgtaaaggggaatatgtaaaggggatgtgaatggatggatttgtgcatgttgagtgtgagtgtgtgttagtatgcctgtgtttctgtgtaagacatttttgggtcttccaattaaggagcttgtccagggcagaaggcagagggtagagtccattctaccacctgcctctatgacttcagaggacctgaacagatggcttccccctgcacagggtcctccatgaagcctttggagaagtagttggactccagagatgagtgaaaattaatggatgaggcaggggctctcctttcctactgttcctgatcctcaaactgcaaaatgttcaccaagtaccatctttggcccagttagggagacctgtaggaaacaaagcctcaaagcagactctgtagccagcaagatagtcttatgactcaccaactcttccttcacttctacagcagctaagaaagaaggtgccaaagtcaggctgactaggtgtacaccccagttcccctggttccatgctgtgtgaatgtgagcaagtgactcaccctctctgcgcctcagtttcctctcctgtccaatgggcacagtatccacctcagtgctattatgagcattaaatgagaaaggattaagtgtgaagtttgtcatagaagtggtccrtaagcgatggtgcttatgctgaaggaggaagtgaggaggatgaggattcacaggacaccctacgggaactcaagtgcaccacacgttgaatccctgtcttttgcagtcgccctgttcaccatcatttgcagaaggtggttgatggtggtcagacgcctcttcctcagttcctctttgggcccctctgtctaactcttcttggaaggagagaggccgtgggtctggagccttgggaacatggtgcttcttccagtaaaatacaagttcagctgtctcttgccttaagagagatggctgtgaggtgtgctggggcttcagggccgtggacggggagccaagtggaggaaataggggctctggagttctgttgtctaagggattagttgatgtgtgggacatcattatgggcatcccaagtaatgcaggtcctcaaggcaatacttccctaccagccagcaggatataggggactaagactcagccttgggcaggggcagcagagcctggcccagagcagggctcccaccctgggggaggttaaggagataacaaggctagttatgcagtctgttaggacagcccyggcaagggatagagtaaccttccaggtgtgcagcctcaccaatagttataaaccccagcctcaaggcaggaccctccagccaggttcagagcctcctcctctttgagctcctttgccaggattggttcagggctgaggccataggagatgacattctatctgcagctggacagggatgtgggccaaacatggcagccctggccataaacctcccaaagcctgagggtcattctgacccagacaaacagaaaacctatcctgctataaaaattgtcaggtggccgggcggggtggctcatgcctataatcccagcactttgggaggctaaggcaggtggatcacttgaggtcaggaattggagaccagcctagctaacayggtaaaaaccccatctctactaaaaatacaaaaaaaaaaaaaaagttagctggacatggtgggtggtgcgcgcctgtaatcccagttactcaggaggctgaggcaggagactcgcttgaacctgggaggtgaaggttgcagtgagccaagattatgccactgcactccaccctgggcgacagagtaagactccgtctcaaaaaaraaaaaraaagttgtcagatgaaaagaaagaaggtatctctttgtcctctttgtcctttcttaacatgctacattcctctggaagtgacaagtttacttcttttgtaagaattgattttaccaccacaagttactagccaatgggtcatagaagaccttaggccaatcctgcccccagaacaaacagttgtttgcatgttccagtgggagacatgtttgtcaagaaaaacattttcacattaacctggaaagttctatgtaaacgtcaagtacccttgctattgttgttttattttcataatgactagtacagaaagtaaagcaactcaggtttatcttattccagaatccaacacctcccaaaatgtgtttcgcagaacaattcagagtttattaggcattactgagagtaaagttccaaagtcagggcagtgattatgtagtcaaatttttggaaattctggattaagcaaggttaagcaggtttctcctgcagaaactctcagataaacttgtgagcactggtttcttcaagagggagggagtttctgttgtattttttaaaattacctgacacactgaatgtttttcttattaagtttatttctcagccagtgtatcatagaacacaccggaaaataattttctaccccactatgcaattaatcaaatttagcctcaaattgcatatttagctattctaagcctaatactaacagtatttagccatgtttcaccatagggtaccacttattttccatgtgtttttctgtctagatatatttgatcatccctgggctagggtgctgtcggggcagatcgggctgagcagggggcagcagggcaggtgctggagaggttcacataggccgcaggatgaaggacctggtgccagcctaatgctcttcctccaagggaccaaggcttgccacagtcttctgaaacaggggcagcacgtgttactggtttggaaaaactgaacttcccttagagagtgacaggagcaggaaggaggcaatgtggctccctgctcccctgcaatcttgctgtatcccaaaccttctcaggtcctaccctaggaggccctgaaacatccccctctgcatccactcttccagctcaatattaaattccttaaaggcagggtctagctcttccccttttcctctgccccatttccccagagaaatggccccaactttttaagaggttgaagtctttgacgcagaagagatacctcttccctctgggtcagggttgcccaaattggcaaattaaaatacaagaaacccagttaaatttgaatttcaaataacaaagtctttttagtataagcatattccaaatatcccaagggatatccttatactgtagaagggtttgtgtttttctgaacttcaaatcgaactgggagtcctatattttacttggcagctctattctggggcctatgatgtttccttcttggtggtgcttctttaaagaatcccaggtggaagagaggaagccatgggttctgtggttaggaagcagcaaggagagttctgttctgacagcctctctgtgrcccctctggtgcaatgatggatgtctttgcagccccagctagtctaggttggaggaaaggggccaaggagagctctgactggatgtgggttgggaatcctctaggcctggcaaggagaggaactctgaagttaccaagagcatggactccacactggggaagcagtgaaacaaacaagggtcttgaatcctgggagatcaagattacaacatggtaaaaggcacagcccttagatcaagcagcttgggttttaaccccagctttgatcccaacctgcattgtagccccgggtaagagttagcccggctgttcctcagtttcctccctgtaaaaaggagacagttgtagtacctccgtccgcataagatgaaatagaagaatgctaagcaatgtgcccagctcatagtaaacactcaagccgtgactattattactttcactactcctactagctgtgtgacccttcggatctctaaattcaactctctctttggtaaaatgaggtcatctttaccaacctaaagattagctataaagactaaaaatgaatcctattttaatggggaagggtggaggctataaatacacaagcccttccctgcagtcagcacaatgcccacctgtccccagggccaaatggtagggaaaaggaaatttgatgtaggtctcaatcttcaagtgccacctgcctgtctcttccagtacctgctagtcacctctgtccagcaccttccctggtgcagcccactcgccccacagtcccttcccatcgttgactcccatcaaaactgagctttcctcacttgcttttatcacaggagttggggggggggcgttcctgagatatgaatcatatgcctcacataagtacataactgaataaacactagttcagggtcagcaaactgtggtctgtgggtcagctggctatttttataactaaagtttggttagaacacatattgcctgtggctgctttcacactgcatggaaaaaatcaggtccctgtgacagagaccatatagcctgcaaggccaaaaaatatttactatctggccctgtatggaaaatgtttgccaattcttacactatttattgcttcktgtgtgtgtgtgtgtgtgtgtgtgtgtgtgtaattctgattaatatataatatatattttattatgtatacatatatatttaattcactcaacacattccggcttcaactaagcactcgcttcctgccagacatgaaatcaaatgctagatatataaagaatacagcactgttcctgcccctcaaggagtccagagatgaaaatagacacctaaagaaacaattacaacaagcaggctcagctcctgtttggaagccagggtgttataagtggatgaatgaatgaattacaatgtacaacaaagtgcaggaattgaagcgcaaggaaacccccacgtaactccttagatgggstccaaaaaaacccaatcatgtaaaatgtgggcttgtgagattgcaacattaacaaaatgaacagagggagcctgcctatttcatgggccaggagattcaggattctaacagccaattgccaatgacattgtgacagtatttatagtcaatcaagatgtgttcttgtgggatcttatgggttatacaagacacttagggtatcaaggagggctttacggaggaggtgacatttaagtgtggctttgatggagtttgccagatgaagaatttgagagaaaaggtagagaggacaagatgagagaaggcagaaaaaacgtcagcaacagtcagatcacaaggatgggggcagcctaggcctaagctttaattcgtactgatggcaacagagaggttcttaaggttttctttttatttcctttttttaaaaattaatctttcraattattatgtattctcatgagagtcacccagaagaccataggttctgtgtttgcctgtgccttggtggtaaggaacttacttttataatgtgggctcctggcagggtcaatagggcatggccatggtgaatttgtcattctagaatgctggctccrgcattgctgaggacaatgcactggagagggcaaggccagcagtgagaagatcagagttgggcacagaagtccagggaagagaccatgagggtcttcaaatgagaaggaagttatagggctagtgtggtttatggaggacaggaaactctaggagagaggccacatttgctgctgtcagaagtaaaaacctaaaaacaagaaaggccctggagattgagcagttaaagctcagagagataaacccagctgggccagtggaataacttacatgaataggttagtgggagttgttctcaatctcagcttttcagtctcctggagcagccgaggctctgtttctcacgttatgattcagcaggtttaggracagggtctaagcatcagtatctttataaaactttccacataaccatgatgctgaaggttgcagaatcacaaacatgagtcgagagaataggcttatggcggagggcttctgcctgacaatggttagggcaaagcccagcagggcggggccctctgactagttgtgggtggcatcctccatctgatgccctggcacctctgcctctatttgattgacaggtagcaggaaatatacaggaccaacctagaggtcagcttgcctggttgtcaccccaaatcctctccctcaggagaatgcatgtgaattccttgtgagaatgtttcaaggtacagtagtcactatggacttcctgtggaatggactgtgcaagaatggcctattgcaggcagaaatgtggaatcccagacagtgatgtgaaaacctgcctctgcccctgcagtgagctacgtggccttggataaatgctccaacatctctggcaactatgcttatctcaacaagtgatgataataatagcacctctctcgataggttgttgggaggattaaataagatcattaagtctctcagtaagcttttatgaagttattattatacatcaggcactgttcttggaactgagaaacagcgttgaacaaaaaagaccaaaaaatgcctgtccttatggagcttacactgtagcaaggtgagactaacaataaacagatggatgtatcaagcaaaaatacatatcatttgtagtatatgaagtatattaactttatatatgacatatataaaatgtataattatatatctcatgtataataaaatataaatatatatcagttgaatggagaggaaatggagacagcaagtatagaaractctttggggatggaaatatatgaaaagcacttgacattaaggatagcacagagtaagtatgctatgaattatgtttaaaaggccaaaccgctaaaaataagggagtcgtaaagattaagtaagctaatatatgatgcagaagtgcctagcacagatctgggactcaaaaaagagtagtttttattcttccctccctgatcctgcccactgcccccagatcacacacatatggacacacgtacacaggcatcaccttctcttctttccatgatgaggattgtgggaagactaaatccttctccctgaattcttcttcccaactagcctaccacttggtatcaatcgtatggccatggagatgaaacaagttacttgatrgaagagaagaaatcaaaacatatggagggtgcttgtccagagagcataaatgactcttcattataataagggaaccaaagtctcaaattaaaaataaaagaaggcatgatgtagcttttgctgcacttcagccacagaggagattcattgtcatrcaatcactgagaatattacgttgattggcaagagtcgggctttgtagaagagacaaaaattccccacagctaatctacaatggaattgttcaatgtcaggcactgctttaataatattgttctgggctgcgttggatgtaaatatccccctcttcatttggtaagcaatcaaagggaagctttatagatgggagagcatgaacggttatagtatctgtgctaaaaaatacacggacattctaaaaaaaaaaatcaaagaacacggtgccttagaaaggattcgctttgtagcttatctccaatctcctatgtctgtccagcaggttgcacattagacacataacaaaagaccacactttaaatgttgcccttgacattattaaaaagtacaggactggcaaatcagactgggaaaaaaatcagactattaaatctggacagtcgggtaatctctcttcatcttattgcagtgcctagaatgatgaaaggagtaagggaactcttgtttattaagcacccactatgtgcttggatgctttgcctctgtcagaagcagtctcacattccagagtgctgaacaatggaggcagaaagaccgaggtcctcaacctagctctgccattttctagttgtttggccttgggcaagcaagtgaatgaagctctctgtgcctgtttttttttcacctgtaaaatgaggatactccatatcccacaagataaagtgcctggtatgtttcaggtcctggactaaaagtaaaataagcttttagtccaggacctgaaacgtactaggcactcaggggtaggtattataagttgaattttaatctgcgcaacagccctgtgatgagttgaattgtgtctccctaaaagctatgttgaagacttaacccccagtacctgtgaatatgacctcatttggaacagggtctttgcagatgattaagttaggatgaggtcattaggatgtgtaccctatccaatatgagtggtgtccttataaaaaagggacattcagacacagaaacaaagcaagagaacaccgtgtgaagacagaggattggaatgacgcatctgcaagccaaggaacaacaaaaattgccagcaaaccaccagaagctaggaagagaaaaggaaggattcacctacaagtttcaaagagatcatggctctgctgacaccttgattttaaacttctagccttcataactgtgagaaaataagtttctgttgttttcagccacctagtttgtggtgctgttacaggagtcctagcaaatgaaaacacccttacaggatgaaaaagtatccccagtttctgaagaattgaaggccagtgagggaaagtttacagctcaagattgcgcagccagatcggggatttgaacccatgtctctctgagcctaaagtctggcctttctccatccactgtgggacctctcaggagtggagcttggcataaaaaagcaggtggggttggaaatgagccccattcattacacccaggtcccaatggaagcatcaggtcagagtggtctgattgtgaacagctcattaagtaaagagcagtgagcktttgagagtgactttttaagaagaatcgacttttatttatagtgatgttccagtcattaatttcgaaggaagaaagcccaaagcagaagcaggttcattaaaaatttgacattagtaatttaattaaattgggtctttgcgtctcattgcggaaaatgacacgttagttctacaccagttctcagctcatttcccctagttggctccctcccctcaccttagcttgcttttttctccaaatgtttacctgacctgcccttcccaccccacactcataagcacacacacatcacagtcattgcctctgctgtaagacacctgcataggattatgggaaacaccaagtgagccagcagcagggcatcatgggaaatgccaagtgaaccagcagcagggactgatcatagaagatgctaaataagccaggagcatgggatctcatgggatacaccaaataagcaagctgcaggggatcatgggaagtaccaagtaagccagtagtgtgggatcatgggaaatgttaagtaagccagcaacagtacaggatcatgggaaacaccaagtaagtcagcagcagatcatgggaagtatcaagtaagccagcagcatgggatcatgggaaatgccaagtaaaccagcagcaggggatcacgggaaacgccaagtaagccaagagcaaaagatgggaagtaccaactaagccagcagcatgggatgatgggaaatgccaagtaagtcagcagcaagggatcatgggaaatgccaagtaagccagcaacatgggattatgggaaatgccaagtaagccagcggcaggagattatgggaaatgccaagtaagccagcagtgtgggatcatgggaaatgccaagtaagccagcagcaggggatcatgggaaatgccaagtaagccagcagtgtgggatcataggaaatgccaagtaagccagcagcagtacaggatcatgggaaacaccaggtaagtcagcagcaggagaccatgggaagtaccaagtaagccaacagcaggggatcatgggaaatgccaagtaagccagcaacatggtatcatgggaaatgccaagtaagccagcaacatgggatcatgggaaatgctaagtaaaccagcaacatgggatcatagggaatgccaagtaaaccagcagcaggggatcatgggaaatgccaaataagccagcagtgtgagatcatgggaaatgccaagtaagccagcaacatgggatcatgggaaatgccaagtaagccagcagcaggggatcatgggaaatgccaagtaagccagcagcagtacaggatcatgggaaacaccaggcaagccagcagcaggggaatatgataaatgctaagtaagccagcagcacaggatcatgggaaatgctaagtaaactagcagtgtgggatcatgggaaatgctaagctgggccaatggacagggcaatagaggtaaatcttttcatctagatcatctcacttggcacaggtaaagaatgggcaaggaagagctcttcagtctttaagattcactctcacaaaaatataagcctctgagggctggccccactgtgccaagcacrgtaagcccacaatgaatttttgttgcatgaaggaattaatacatgaatgagtaactctccaaataactaattaatgaacatgcacatatgtccctacaagtgccaggcactgtgctagtctcccaggatatacctatgaaccagactaggcccacgccctcatggccctgtggcccaatggaatgagaacatttgccattttgtgagcacctactatgttctgggcgttgtgccaggcatgcagcatttatattggtaactccctcaaccgctaaatattattggcctcactcctttctcatttgaagaaactaaggctcagagagttcatgtgactcaaggtcacacagaataagacatgatggcacctggtttcacacccagatcaggctggttccaaagtctaccattaccctctacactgagctgtttcctctcagaggaggaagagaggaagggggagggaataccttttttcagagggttctgagatcatcagagctggtagagggttctggaaggcagatactaacagcaacattggcaggaagagggtattgcaaggactaggggggccatttagagtccaggcctgcccacttccacttccccatcactgccaccccactcttttactccaggctccctcagctcctgggttatctctggcctcagggcctttgcacatgctgtttgctcttttttgcttagctaagtcttactaatctcccagggttctgcagagatgtcacctcctccaggaagtgatctctgacctctcccccagctgggtttggttccctacctgttcctgtcccatcataactcttagtgtgccattaattgtgcacagcacccactgtaccgagggttagattcacttgcgttgtactcactgtacatcaggctctgtcctaagcactttgcatacctgaactggcttaattcttgcaacaattattttgatataaggaaggtgctgttgagctccctatcttacaaatgaggaaactaaagtgcaaaaaggttaaaagacttactcacggtcccacaggtggtaagatttcaggctgggaagtgaactcaagcacggtggcttccaagtctgcacttaccaccatccggctgcatggcctctcagagacagcctcaataagtcattgccaggtggattaatggagaggtacttaaacggtagtctgggcatgactaagacccctactcctcaccccatgggggtatcctagaatgataggaggtgttgacctttaaggcacaggcagttctaactctgggggacaaggcagagggcagggggaagctgggtcagttagaacaggtgactgacttatgggcacagagaatctgtgtcctccctccctccttattgccaggtcatggtgctcttgcaccttccccaagaccatttcctctgcctcatgagagcacacttgcaggtgaccatgattgcttggctctggccacacactgtgcatggtgtttcctggctcccaattttccccctttaaaccagtcaggctgatgagaacccgggttcttgttttcccacttcactgcctattctgcctaatccaaccctttcaactcccctgaacctgcggggccaaagtgcccctctggctgccagggtggatcacacatgaaagaaaggacactggatttaatgagcacctactcttatgccatgccttatgtcccttccatggtatttagtgaggagtgtggagtctgaaatcaggccagccatgcccaagaggttaaagtaatattcctggaattgcatctctagtgatcaggatgaacataattcacatccatggctgcgcattagaaaaggcaagagacctggacatccagttgtaaactcatgtgtgagattttgagtaacccttgtctcttatgagtaacccattcccagggaatctacagccttgagaagcgggcagatcagcagtgggcaatgctgttcacagaagaagaaatgagttccaggaagcccgagtggcctagggagttgctactaggaagcccggtgtcagggctccagcccagctcacggggtacccgtctctttctctgtttctcctcacagttctccccagccacacatgtgggaacccagggaggctgcccaatggcatccagcagggttcaaccttcaacctcggtgacaaggtccgctacagctgcaaccttggcttcttcctggagggccacgccgtgctcacctgccacgctggctctgagaacagcgccacgtgggacttccccctgccttcctgcagaggtaggtggccagcaaggggtctgacagagtggggcagtggctgggaggtgatgctggagcttccagtgacatccagtctcaaagggcaaagctacaccccagcagggaggggggtacccaagtctggacagcacagagggttttcagggtcctcaagtgttctaggggtatttcaacctcacctgacctcctaaccctcaagtgtgcactccctcattttttcccctgtatcaacaaacttatatgtagccagtcttcccttacctctagccctcctgtctcagaagaaacatcatttctcttcctattgcagaccctctctcctcttgtggaagccagatcactttcccaacagctttcgtactgacctcactgtaggaattattcttttctctttcctataaattcagcctctctccctatctaatagtttcttcctttcagcctccaaatatgctcaaaatctctttactccaacaaccccctcccccagaaaaacacctctcttctatgctgtgtcggcctcagcctcccagctaggttgaccaacttgttcatatttgcccaagaccttcccaattttagtcctgaaagttccgcatcctggaaacccactcagtttcaggcaacagagacatttgtcacyctactcccagcctattccttacacaatcttcttttttttttcctttcttcctttcttttttctttcattctttttcttttttctttttttttttttttttaattttatttgagacaggatcttcctctgtcctccgtgctggagtgcagtgacgtaatcatggctcactgcagcctcaaactcctgggatcaagcgatcctcctgcctcagcctctggagttgcagggaccgcaggcatgtgccaccatgcccggctaatttttttttttttttttttttcatggagacagagtctctctatgttgcccaggctggtcttgaactcctgagctcaaatgatcctccggccttggcatcccaaagtgctgagattacaggcataagccaccatacgtggcacacgatcatttttaaaagcttagaaaatacagaagggaataaagaagaaagaaaatttacctgttttaactgtgattttaatgtatgtcctttccatcttcttccaatacgtattgcacatatgcatatattacaaatatgtacataaattgagattatgatgcatgcagacaatttttaaccacctttgaaaaacaatcaatcacatcacactgtaagatttcccatgccatcaacatagcccagcatcttgaaagctccatccagccttgtccctccttttcccttctcatttactcctctgcagactggcctttgccctcaatatttgcatcattttgccaaatcagatgggaattgttttggctcttgtatttcttgacctcttaagaaacctttgcactattgaccactcttttcttctagtaacgctcatctctaaattccatggatcctgaacatccatatatcagtctgggaggaacatttccaggagttgagaagtcattggaataactagctcctcctttagttcaaattttatttttcttttggaggaagattttctgtaattactgtaaaagactagctccagggataagcaactccttcttcctgccacatgcacacactttttgttattgacaccaaggataaaaattacatggcatgtatacctattccccttcttcccaatcccatggcagacataattaattgttcattgcaccctttctgcttgggtccagacacagctgtgaattccctcccaataggcaagccacagccaatcaatctgagttgccacttgacttcacctttgtttacctctcctcaaccaatagaatgggccttggccatgttgagccttcttggtggaccacaagggaactagagttccctttcctgctttcctaagtcccatcttcccaggccccattcctaactcaggaactgcctctttccatgatggacttcaggaattaccaaaccaatcaggtgagaccttggcccctacacaggtgtgtggcctaaccacagcctgaaagctgctgtatctgcccttccttatagcatccttacccaccccctgccttaaggatgttaccgttaacattctgatcttccaaggagggtgtcagagttgtgacacgatgatagaatatgaaatatgatagtaaataaaatcaagtgtctaagttatgaaatataaactgcagttctttttctttttgcagcactataaatrccatgctattttgttcaagataaaaaccagaaacaaatgtaatccaattactggatgcagcgggggtatcactctgcttggggaagtaaaatactcagcaatatccaatgctaatatggtggaaatccactaaccctcctaatatctccaggaatctgtcagctttagcttcctctgaatcttgaactcaatgccctgtctccctacccctgcttctgctctgccaacttaggttgggaactgggtccatttttcttggatcccctacttctccaaaagacaaaatacaagccaacaaacaaaaacatcaacgaaggcgtctgcatgtagttcaggctttatggaaggtgtggcaatgcaaggagcttacatcttagcaatgcaaatgacttaaaatgaaagtatgagcaaccaggagcttcacagtcttttggcccctcctcccgggaagcttctccctggcttctgtcttggcaggctccaggttcccctgtgatgtgcattgtaccctctcttctttctccagcctcttccaccttggtgctgcctgcaccttgagcccatttcagaatttccatcaacttcttaggcacaagagcctggtttcctcttggttttgtcatctccttgcagtctaatgtctcccctcctcctccaagctatttaggtatagggtagtattttcctgaacaaagagaactctcattctataagacactctggggctggatgttaacatatctttttgttaccccaccagccagagataagtgatgaggggcacctcatggaggtcttctacctcttggatgtcttcatgtccaatcaaggctcacaacccagtgtctttgtgtccaggcacagcgggcagcaagggctggcccttccgagggaaggagcagggtggagagataccactcttctrgcattcacaccacacagtaattcatgggcctgggcgggggtggcatgtcttttggtggcacgactctctgaagtcttccaattcttttttcgtcktctgaaatgatgatgattctttccctccttctccttcactgactttccaccctcattccccttaaatactggagggcccagctcggcctcttctctggggatttcttccatctcttggaatttctcatctactgtgttgctgtaattgttactagggggcaactctccaatccccacctccaaccccattctctgtcctgagcttcaggcccctgtggagagtgaactatgctaaagttctcctcagcttgtttcaaacttggcccatgaaaacctcactcttcctgctttccccaaacctgctctttttgttgccttccccagctcagtgaaaagtgtccccaccaacagtggccaagctgaacccctcagggcatcttacattcttgcttttcttgctgttcacatcgcatcatcggcccccatgtccctctgcaccagcctaccccctccacatctctgttgctcttcagatgatggtccaggctctctcgtctctcacttgcctcactgaaggttgaccctctgtaggcaggtgtgccccagttctctcctgctcacaccagcccattcctacctgtactgctagggagaacttgctaaggcacagatctgacaaaactgagtggctcagtcccttagtggctcttcatcactgacggggtctagttcagattccttagcatggagcagaaggctcttccagaaagagccccaccccaatctttccagtctgtctcttagacttattttaagtagcttccactttagccacaccagagaatgctcccttccaaacgccctagggaagccagctgaggatgtcaaatcctgcttctagaagggcttccagccccctgctgcctgaggggtctgagatgtggttctgctcaaaggctgggagagaataaaatgactttccaactctcagaccccctagggcttccccccacccccagtcacctccctaccttcaggttcatctctattataatccccacaagctacaagaatatcctaagaaacatcctcaataatgtcagtgattttataaaagtgatttcccaaactgttcttccttaggaggccaagctaaacaggaacaaagggtacccaccatacacccatcctgtgccaggagtggtggtcatgccagagtgaacaggttcatacttgggaagcattaaaagccttttggcctttcttcctctcgtgtagaactctcaagagctggcatctgcgagtgggtaaacctcatccactgggcagtggtccgtaaatatttgctgaatgaacggctgtctggatgggtctaattcaccatcagaatcatgctagcatacaagcccgaaagggaaattactagcctgggttaccccacctgcccagtagctctgagtgacaatctctttaagtccaaagcttcccggagcagactggaaagccgtgtgtgtctgttttatctaggaaatgtcatgtgcccagctggagggtggacttggtctggggacacagcacagactaggagtgggggaatagggaacagctgggaataggggggagccaggtgtaaggccgacccccaaggaggcccatcccaaagatcctgacccatcaaggcttggtccagctgacagagggaaggagatggggcctgtgaccccccttcactttgtgtcacactgggcacgttttcaaaagcagaggtccctgggaggtgctgagctttgtgtcatctctttgatccacaagagggaagatcatgtggatttcagcaacaggcctctgayttatgagggccattggccctggatcaaagaaggctgcatggggaagtgacggaattcatatgcactggggactgagaggcaggtggtagggagaaagctggccagagcaagaagtgcttagcctctgaggttcaagccaaacacggcaggctgtcaccatacctggggaagacggaatacggtctgcagaagcttggactgcaagcgctgagctgtattccaaattttctggccccaggggaagaaacctgcagaatgtgaaaaagaagcagtggtgtcgggtatggacagtgcatagagtcagactggcctgggttcaaccctaggtaagccagcccctagctgtgtggttgccaggggtgctgctaaacccctctgagttttaaaggtgggacacaagtagcagccttacagggctgattgtgtcctcattttattcacttggctactcaacaactttctcttgagtgcctgttatgagccagccagtcattaattcaattatcatttattgactgcctatacagtgccaaatattgttctagactcagagaattggaatgatgagcaaatctgaccaaattccatgatctcttggagtttacattctagcagccaggaggcagaaaacagatacacacgccaaataaacaggtggtggtaggagctacgaggaagtaaagtcttagccagtgatggggaaggctactttagacggagcagtcaggggaggcctctgtggggaggtggcctctgaaatgagtcctgtgacaaggaggagcctgttgtgtgaagacctggaaaacggcattcctggcaaaagaagcagcaagtgcaaaggccctgaggtgggggaaagtactggacacgctagaggaacagaaaacaagcccctgtggcaaaagtagagtgaggggtgggtggagagggcagggatggggtgaagcaaggtaagaaagcggaggctgaagcgggcagatcgcgagatcaggagtttgagaccagcctgaccaacatggtgaaactccatctctactaaaaatacaaaaattagctggacgtggtgtcacatgcctgtaatcccagctactcaggaggctgagtcaggagaatctcttgaatccgggaggtggaggtttcagtgagctgagatcatgccactgcactccaacctgagtgacagagcaagactctatctcaaaaaaaaaaaaaaaaaaaaaaagtataggcttggttctgagttcaggaggcaaccaggggagagttttaagcagaagtatagtccaatttaacttaatttttttaaaagatcactctggatactagctgagcaagagccacaataagaagatcagttaggaggcagctattatgggcaaccaggctggagttgctgcatcttggtcgagggtggccggagtagaggtggagggacaggcgtagattggggctgtgctttggggatacagccaacagaccttatagatgggttggatggctgatagaataaagggccaaagttgactcctaggcttttcctggagggctggtgggtggggatgccaatgaccaakatggagatgactggcacagagggcaggaagcatgtgccctaaagggaagcaagacagctcactttgtccaggtaacgtttgagacgcctgtgagacatccaaatgggggcattgattctgcagctggaaggagtcctaagctagaaagagatctgggaaaggcataagagggcaacactgtagatagcaaagagggtctgggcactgcatgctggacaccattgtgttgatcaaatttaacaacatggagaaggcactaaacactatgccgggtgcagtgtgcaccttgagtgattctgagcactggggcctcaacagcgaccacagctacccaaggccactctttacgatagggtaactctactgctactgggataactagccttccatcacttttgcaattactgttactataccagaacgtttcacgatatgggctctggaggccagtcacctggattcaaatcctggccttgccacttacacccactggctgagtggcttgggaccagttactcaacctctctatgccccagttttctcatttgtaaatgggaataataatggtacttaactcataagttggcagtgaggttcacattgataaatgctaagcacatagcagagggccttgttcatagttatgactcagtgaggggtatctatcattgtcattctcactgccacagcctcactggccaccatattgagccctaactaagtaccaggtcctgcattacctgttgtaatcctcacaactcccaaggaggttaaggtaatgttatctcctcttacaagtgaggaaactgaggcccagagaggtgcagtgctttacctgtgattacacagcttgagagtggtggagccaggattcagcgcaagtccacgtgcctaacagccatgatcttgaccaccaccctccactgcaggcaaggatggtggcctctggcccacagcaggagactcacaatgatgctgtgatttccagagcttctccagcctgatggttcagggcctgagagcttggcctgcaggtgcaggcatcccctgcatggctccaccagtcagggactggcagtctcttgcggtttccccttgaccttccatgcattcctgaggagagaaacctctgggaaagggcctgaggtcattctgttggacagatgctgcttcagggtgggggctggaaactacttttccatcctatgaagaaagccagacccaaggttcacccacctccacttaagcactggtagctggaccagcacttttgaggcagcacaaaggcccccaggcagaagagaagggagcaggaggaagcgtctcatgcctggaaaaccccatctccagggtctggtgcttccaggagcctgctcctagcccatgtcaggaacaggattatagtgactgaggcccaggaggcagacaaataggtgggtaatggtgtgggcctggagtcacaaggtcttaggttcaaaccctagctccaacatttagtagctatgtgaccacaaggaagtcttaaaaactcactgagcctctgtttcctcatctgtaaaatgtgcacgataatacctatgctctcgagggtttgaagattaaaggggaaaatgcaggtgaagcattttgcacaatgcctggcccataatgaaagctcactaaggagtgtcatgtaatcaaataccatgtcctgtctacattcttcccctcagaaggataccttaggtggctgtaactataggagtctgggagcaatagtgatgttctcagaattggtcatttcttcattttaaggagtgtcattgataaagccaaggataaatgggcagagtccaaagcccccaggaagaggggactgaagaagttgagcaagttctgggggccccagcatgtttaggcacacgaaaccattcaccacaagaaaagggggtgggccgcaactttggggcactcctgccctggtgctctcagtcttgcactggaattggaagatggtggcttctcctttggggcctgttggcatcttcatttccacagaggctgaggggtcctggggaagatgatatgaacagaagccaattccaaggaccccaaatcttctaggcatgcaagatggtaccctagagctggcctgaagtagagaggataatgtcctgttttctccatttcctgcctgaaatttgtcagtcattgtagagttaacagaaatcaaagaggattgagggagagttctctaaaattatggctaattgaagagatttccgtagaacttaaagtcgatcataaataaagtcataaacttggaaaggcaactatcagcataacacacctgcacctgagaatatgcatgacttaatggtggtgcaaaatgcccattgccagagaaggagaaagtgtaaatgaatattttaggactatggtgtcagctgaaggttatattttatgactctggagttgtaaccatgaaatatgatgccttgtctaaagtgggagaaaacctccaaacagcttttgcaggatcttcaatcaaaacaggatgatgcaagggccagggtgtcggatgagcccaagaggcagggatggctaaaatggtaaaggtgccgccttcagaggagactggtagctctggccagaggatctcaagttctcaagtcctcagttctagcacaagtccagaaatcattgcctacagttgggaagtttgaaaatctcgggatggcttaccaaaccactatcaagcagggatgtggaggagactaccatcctggtaccagagacactcaactgaaatcttgactcagccactccctatgtgaccttgggaacattacttaacctctctgagcttcagttttctgttacatttatttgttcagcagatattagtcaagtgcctgctgtatgccaggaaatctgctaggtgctagggacagaacagacatggcctctgttctcatggagtttgctatctacatgttaactaagtaatgatataattgatcaattaattatggaaaatcattaattatggcaaaatatgtggtgctcagaaagtatatgatgggggagggattattctatttctgtaaagatcctcgaggaagcagcacttggatcgggacctaaaggctgagggcgagggggcagtcaggcccaacgagatagggaagaagtttccagaaagagaaaataacactttcaaaggccctggagcaaggcaatgcttagtgaatcggaagagctgggaggaggccagggtggctgcagatagtagggacagagagactggcatgaggcaaggccctgtaaggtccttgtgagtcatcgggtattccactttatcctgagtgacaatgggggttattgatggttccaacagagagagtggtgtaatcaggcccatggtttcccgtattactctggcctctgtgaagaatggacagaggctgcaaagcaacctacagattcaatgtaatctgtatcaaaatacccgtgtcatttttcacagaaatagaaaaaacaatcctaaaattcataaggaacaacaaaaaagcctgaaaagccaaagcaatcttgagcaaaaagaacaaagctggaagcatcattctacctggcttcaaaatatattacaaggctataataaccaaaacaggatggtattagtataaaaacagacacagaccaatgaaacagaatagagagtccagaaataaattcatatacttacagccaactgattttcagcaaaggcaccaagaacatgcattaggggaaggacgcttgcttcaatagtgctgggaaaactggataaccatatgcagaaaaatgaaactaaacacccatctctcaccatatacaaaaatcaacttaaaatgaattagagacctaaacttaagaccccaaactataaaactactggaagaaaacttaggggagttattccaggagattggtctaggcaaagattttatggctaagacctcaaaagcacaggcaacaaaaacacaaatagacaaatgggactatattaaactaaaaagcttctacacagaaaaagaaaccatcaacaaagtgaaaagacgacctgttaaagacgagaaaatatttgcaagctattcatctgagaggggactaatgtccagaatgtacaagtaactcaaacaactcaacagcaaaaaaataataataataacaatcccattaaaaagtgagctaaggacatgaatagacatttttcaaaagaagacattaaaatggcaaacaggtatatgaaaaaatgttcaacatctctgatcatcagggaggtgcaagtcaaaatcacagtgaggtatcattttaccctagttagaatggctattattaaaaaagcaaaaaacaacagatgttggcaaagatatggagaaaagggagctcttatactttgttggtgggaatgtaaattagtacagccattatagaaaacagtatggagatttctcaaaagactaaaaatagaactaccatatgatcaagcaattccactactgagtatttatccaaaggaaaggaaatcaatgtatcaaagggatacctgcaccccatgtttactgaaacacaattcataacagcaaagatatggaatcaacacaagtgcacaccattagataaatgtataaagaaaatatggtatatgtaatatatatgtgtgtatgtggtatacacatacatggtggaatactactcagatgttaaaaaatgaaattagctaggtgcagtggcatgcgcccatagtcccagttacttgggaggctgaggcaagggatctcttgagcccaggagttcaagtccagcctgggcaatgtccagcacaactccatctctattttttttttttagaagagtgaaatcctgtcatctgcaggaacatgggtggaactggaggtcattatgctaagtaaaataaaccaggcagagaaagacaaatatcacctaacactcatacgaggagttaaaaaagtggatctcatagaggttgacagtagaatgattgatagttaccagaggctgggaaggctgtgtgtgtccaggattggaggatgtagggcatgaagagaggttggttaacaggtacaaatacacagttaggtcagtggtccccaaccttttttggcaccaggaaccaatttcatggaagacaatgtttccatggacaggaggtgggggatggtttcaggatgaaactgttccacctcagatcatcaggcattagataacttgctcaacactcacctcctgctgtgcagcccaggttctaacaggtcccggtccatggcctaggggttggggacccctgagttaggtagaaggacgaataaattctaatgttcaatagcagactatggtgactatagttaaaacaacaatgtatatttcaaaatagctaggagagagaacttgaaatgttcccaacacataaaagtgataaactcttgaggtgatggatgccctaaataccctgaatggatcattacacctactgtgttaggcttttcttgtattgctgtagagaaatgcctgagactaggtaatttatcaagaaaagaggtttaattgactcatggttccacaggctgtacaggaggcatggcattggcatctgctcagcttctggggaggcctcagggagcttttactcatggcggaaggtgaagtgggagcaggcacttcacatgaccagagcaagagcaagagagggagtgagggagaggtgccacacaattttaaacaatcagctctcgagatgactcactcactgtcacaaggacagcaccaagccatgaggcatccatccccatgacccacacacctcccaccaggccccacctccagtattggagattacatttcaacgtgagatttgggagggacattcaaactatatcacctactatgcatgtcaaaaaataacacgcataccccataaaaatgtacaaatattttataacaataaattttttaagggagtgctccaagataaagttctcaatgcaaaaaaaaagtatgtgagttgattgatatgctaattagcttgatttagtcattccacaatacatacatatatcaaaacatcacagtgtattccataaggacatacaattattgtcaattaaaaataaaatttaaaaaactgaaaaaccaaaagaatggatgggctggaggaggaaggaggcttggagaccaggagggggcttcatggctgtggttaacttggagtgtgacatggcttggggtacagcaatggcagtgatggcgggggacaggattgacagccacctagatggactgccagctgagtccctggctggatgtgggggtgtgggaggagttgaggatgtcccctgagcctctgccatgaggaagtgggtgaatagtgctgaccctccaagatgggaaagtctggaagaaggctaggcttctgggaggaaaggatgagagtgattttggttgggttgggtttgagagcaatgtggaatatctagttgggtttctaagactggaagtaggcagaaggctctggagtcattgtctttcccccaagacctgcttttcttctggaattctttgttgtccacctggatgtgcaggccagattaaatgagactatgtggaccaagggcctgattggagacttggccacacagagtggctgtgcctgctcctgagccactccctccccctctaatgtttctctttggcccctgcttactttccacctgagtgcccctcccttcccaccttctcttctttcaggtatctttgcttctgcctgctccatacakgtctgttcagtccccagccttctccactcctgtggtgggagcttccctctctgtcctgctgattccctgcctcacagtctctgggatcccaggcccataggtatccccatctgtttattccccaggatctcacactcagcatgggagtggggaagagcagggaggaagggccgtcacttcctgcagagctgcgtctcctctagcgtccctgtctctgctctctccttcaccatccattttctgttggagacttcaccctctcattcctccacagtctgcctcctaaatcccttcctgctgcttctctttcctccctgcctagttgcagctttgatgatgggaaaacctcttctccattctctgtctctgatctccccaccggcaaccttccctggccaccaaaccatatctttcatccattactatgggaccaaatcatctttctaaaataggtctggacttgtacttcctgctgaaaaccctcttctccacacctaccatgactcccctgcacctgcagaggaaagtccaaacacctcggcagtgctgtcaaggccttcccccaagcagcatgcccttccaggccttcttgcctctgagggcctgtttgctctgcctggaacccctctatttcttccccttccagcacactcctgtgcttttttgaaggttcgggctaaatgtccctttcttcaccatgatccctttccccagtacagtcaagactcagccattgtgcccagggcgaagacagttccacctggtgtagtgagggccagtgacaggactgttggggaccagtgggcccggtgcttgctcggaacaatattggcaaatctcccacttgttggctggctcctgtggcttatctccctggtaatgttcatggtgaatttatttacatcagaaggmgacaaactctgcctcagatgtcagacatcatagcctcctgccagagagatactcaaggcagaaatactgtgcaacttgataaaacaaatcaacagcaccactgaactggatttaaagccaagcaaggccaatcttgcctaccttccctcccttcctgctttctggggcctgggaagctgggttgagggtagcaaaggaggaagaggggaggagaacagaacctcagctcctctactcggcaytcaaggaccttcgcagtccagctcttgccttcctgtccagcccagctctgtcatctctgcatgtccctttcagttcagacggtcctgcctaataagtccctaaacatgccacactccccaacttgaactgtccttgctgtttttctgcctaaaacaccctctcccctgaggcctaccaggcaggcaccctcagctgatgtatgctgccagctcagtgttggaaatgaagccagactctgactatgtctcactgttaccacctggtcttagccaccatcacctctcactggattattggggtagcttcaagaggcccccaccttgttcccttgccctctctggtctgctgtctacatggcatcccaagggatcctgttaatacacaaatgacatcatatcatcctcagctcagaaccctccactggcttctcaactcattccgagtaaaagtccacatccttacagcggcctctcaggccctcggaagccctgcctcccctgccactttcctccttcttcctgcattccagccctttgggtctctttttttttttttttttttttttgagacagattgtcgctcttattgccctggctggagtgcaatagcacaatctcggctcactgcaaactctacctcctgggttcaagcgattcttctgccttggcctcccgggtagctgggactacagatgtgcgccaccacrcccagccaacttttttttttttttttgtatttttagtagagacagggtttcatcatgttggccaagctggtattgaactcctgacctcagttgatccgcccacctcggcctcccaaagtgctgggattacaggcatgagccactgcgcccagtccttgggtctcttgatgctcttcaacggtgccaggcctctgcaccctggtgacctttgcatttgctgctctatcttccgtgaatgctcttcccccaggtaaccatgtgwcttcctctctcattccttcaagtcttggctcaaatgtcaacttctcagtggggtcttccctgaccaccctttctgaaatatccacacccccactcccaacaccagatagcccattttcctctgcacttaccagctcatttactatagagttaattatttatcttggagttgtctttatccttctgaccagaatgtaagctctgggaggataggaatttttgttttattcacagctgaatccccagcacctagaacagtggctgacacatagtaggtgctcagttagcatttgttaaatgaatgaatgaataagtgaatgaatatattaacacaaattctgtctcttccataaagcccttcctaactatgtgctatcactgcgccttgagcatccccatcrtaactattctgtgttgccattgctggcttgcctgcccacctcctccctcagaagcatttgaaggcagagaggaaatcaagcttttcacattgtagtgctggccctacccagtatttggcccacagtaggtgctcagttaatgggtataggagggaaaccttcataagcacctactctgggagagtaggtgtatatcttacatttctgcactcatagaaacttagaagttagcattgagaaatgctatgagttggctcatgattctcttgaccctgtaaagaacattagtaagaatagttcagagctgctaaacaagatcacttttatctctagcccagatggctcctatatatctgttaatctgatctcaccrttggaggccccacagacatacccacttctgcgtgtccaaaactgaactcctggttgccttccataccacaaggagctcccttcctgggttttctgcctcaggaaatagcacctttcatccatccagatgcttataccagcaacctggattttatacctcctagttgctgaattctggagattctgcttcctaaatatctctcaaataagtcctctcccaccctccacacgaccttagctcgatctcatccagcctcacctggactgtggtgrytttggtgataccaagagcatcccatgcgcttccctgactcagacctcctttataccatagccagtgttctttctaaaatgcaagtttaatcacatttcttcactgcctttgatccttaagatgaagtagaaggaaaaaggagaatctagcattagcatctacccacatgtcagtcactggctaatgctagttactgtcacattaactatctaattcagttatcacaacagagaagcaaactgagccttaaaaaaaataaatttcccaaagttatgcaggtggctgggaaattgtggagtctaaattcaaatctagaccttccttaccctaaaatccatttcctttccaatgcactcccctgtctccaaatctttttggctcagtgttctctgccatgtgacttctcctacatgccattactatcttatattattcatcttttttaccctgtgatgagtcatctagagctgtttatcttagacatgccttgcacgttcatatgtctctgcttatgaccatttggttccttcttccctgaaatgtccttccccctcttctccatctagtgaactcctactcattcatcaaaacccagctctaatgacacttcctctgttaggcttctcagatggacttgtccaaacaaagtcatttgctgctttatctatgtccacaaactgtgaattgtactcttgggagacagaaggatgtattgcaggtatagcccatggtgagtgctagggcttgaaaaccagactactcatgtaagcctcttctctctgtgcccacagctgatgatgcctgtggtgggaccctgcggggccagagtggcatcatctccagcccccacttcccctcggagtaccataacaatgccgactgcacatggaccatcctggctgagctgggggacaccatcgccctggtgtttattgacttccagctggaggatggttacgactttctggaagtcactgggacagaaggctcctccctctggtaagcacaacatcaccttcctttcctaccctrttctctgcaactgtgaattactgggatgcttgcagtctcctcagtgcctggacctgcagccagaggcctcttagccacttccttatacctactgttagagtcctttcatctcatcctaatgaaaaagcactgcatatttttagagctggggtaatttttatagtgattttgatatctgatttgaaacatgttcttgctgaagatttttatgatgggtcttggttgaataacttgcattaagactaaaaatgttctggtctcaggatgtggacagggtctagtaaaatgattcaaaatattgttccatttctggaagacatatgcatagcatccaaaaagggactagaaccataagtgaccattgctgagactagaacatttttagtcttaattcttcccactccaagggtcctgatacatcagaaaggcattatgtcccagtgtctgaagggtaggacttactttctccctcttgttctggctttgctaaaaaagtgcaggctcttctgtagtgtgcttcatggagagtctcagttgttgatgggttagggaggatatgagttattgaagccatcgttgcttatcccagacttgggcttgcaggatgtgctcaaattgaggatggcttgaggaagtatctggctttctgtttgggtgagaagcatcacaagtggtattgtggcatttggaacactctcttgtattctcattgtggctgtgttatcaggaggacttttgttagcacatgaggagccaatagaaggatatgtccaggtgtacttcaagcaaggatggggcatcgttggagccttagttgctgcatagtgtcaggtgaaggtggggattccacttcctgatgtcaggcaggagtcacggcgttggctaccagggggtgccgcagtgggaatagcgttctggtggaggccctgggtgcggggctgggcccggccaggtctggcggggctgtgctccaggagtggatggacggagggcataggggtgggaggaggtgtcactgaggattctgagcggagcagaaagtgggtgtctgcaagagtcagagaagacagagacgtggcagtcagtgggagtagggaggaggaagatgggaaggagaggagaaaaggaggggaatggggcacgtttattgcacaccttccctgtgccaggtttcatggcggtaggaacaccagttgagtgagacatggttttttaaggagctcattgtctatctatctgttaggtaagaaaatcagacaaacccatggtaggagccaagtgtgactattaaatatttaagagggataaagggggaatggattcttcccaagtataggctcagatttgggaactagcataagcagaaaactcaagtttcctggtgcagtggaaggtgagccgacatgggagtcagaagaccctggtgtcaccatgagcttctcacaggaagctggccaggtcatttcctaccctggtcagagggctgagagaagcacaggtgagtgaggacaacctgctctgtggaggatgacattctataaactagtccaagaggaaaagctggtgattttaagctaggagttgggttgaaggttaaggtgagtcttcactcaactggaatcctgatgatctgcgcagtgtgaagacccttggaccyctgcctcttttgtaaaatacctgtttactgactgtaagtgtaatgcatatgctccttgtagaaaacatggaaaatctacaaaggtatggaaaaattaaaattattacaattttgatgtactcccctttgaccttttttcttggcctagatyaagctagctggctatttatatatatttaatatgaccaaattaggatctaaaaatatctgtagttatatatttttagctaattattgtgtcatgaaatgttttcctgtaccatcacagatgcctccaaaatatacaaggtctgataataatatcatttgttgaccctttactaccaatatgtgccagacaggttataagctctttagagctataatttcatttcatcttcataaaaattatatgaagtaagtagcatagttttcctccttttacagaagaggaaaatgaggcccagagaggttatactacctgcttgagatcacaccggcgagtaaggagcagagctgggattcaaccccaggttaatctgatactaaaggctgtcttccaagccatgacagcatgctattatgacatgcgatatctgtgatgagttttccgggctrtgtagcattcccttgtaagactgtagcatagtttactcatcagacctcttgttaggtggttcccaagttttcacttctataaacaggtgccaagacgaatacccttgccagttccctgtcttccagtcccaaggccttttcgactcacttgtttatccatgggccaaatggtctcctacagcttctgccctccaggtgtgagtctacacgttgtccraacttttggagtgaaacaaatctgaaagagttccttttcctattaagtcactcagtggggaaggaattaagcagaggaaattattaggggagtcactcagaactctttgctataagattacattataattatttacagggttggtgtcaccactgccaggatggatgcatttgttgttctaatttatacttgcatagcaattatggataaacaaacttggagactcaggacgtatgtgtgggaagaatcagctctctcccttgcccctctcctttatggatccctggattcctgtaaaaatttgatgctgctggtttatgagtatactgcttttgtaagcatacattaagatttcaggatgttctcttgcattctgtgccaaggcatagaaaaacaacagatcctgttagcaaagatggatttggacaactgggcacccccttcacctatcaagaagacargaattcctttgagagaaaaaaaaaatccactacctcccttaccagataacaagttcccactgattcagaagggagagtggcatgcaatgtccctgactcagtttccacactcttcccctccccctaaacgggatagcaacaaattagggcttctggactagtaaaatttccaaacaattggagaaacataggattggtcattttttattttgccaagtaaggatgttagaagaaaacctgccaactcctcagaatattattcataaaacaaaggacaattcaaagccaaaactgtggcaggaaataatcaattggaagtgttgtcctgacatcatgaaagataaggtgcggggagcacacataaataacagtatgtgcccatcactggagtggccaacagtatacatgcagcaatcagtgggccagttctccctgttttgctggtcccggtccagcctttgggaatccaacaatacatgttttgaacaggaaaaagctgttactgtggtgagcactgaaccctgtagctctgacatgttgagctattccctagtattttagacttactccccctaaaagttaattgcatttttgtgtgtgtgaccatgagcaaaagctgggcttggactgactgagggttacaacccacagagaagaattggtattacaccctgactacacatacatgtgtgcagccctcacccaacatacacacaamcacacacacacacacacacacacactgccaaatcgtctctgacacatacctttccaagtcactgccaaattcacatcaccaagtcatccctcacccccagaccaccttaagcacatgtacacacctgtccccccttacacacagttccatttccagttcaatgtaggagccagactttctctcactgaccctgctggagtgtgggggtggtgggttttctttctctgctctgctctgacccagtcacttggctctgaccatcatggagctccattcctttccatcacgttctaagaaaacactctcacctttgataagcttcctcatgaagccccaggactttttcaaaggactgggactggggatacagaagacccttttaacaatatggggatgtaggtccctgaaggatatcaggatcacgttatactgagtagaagtgatctccagcccatcacagaactgacctctccattggttgagaaaatcagcaaagtgaagccccctgagaagccactagatccagaatctgtctcctctttcctctgtctcatacccaacactctccatctgagtctctccagaaccatccccagattaaaagagaggagggaaagccagacatcctctcctagamtataggagaggaagtttgtgcagtttctctggaattagatatcgagcctgcaccatggcatcgaactgggaagggggtaggcttgggagtcagcagagacacttgggctcaaaaccagccacctctcagtagttgtgtcatcttaggatatttaccagcttttctgagcctgtttccacatctgaaaaatgggtctcagtataccaacctacaaaacactttgagagggtgaaacgtggcaactgctgcctggctcaccataagtacaatactcctggaatgaggctttgagaggaaaagagtaagatggagcaaccccagcaattcagagcctcgttggccctatttttggtggtcccactgaagccaacatatgagctttccagcccagtggcatctcaccagcagaaaggcacagcctggctgccctgactctatctagcctcaaggggaattgcctggaaactcagataaggttagtgtggggagagtctctgggtgagactggaggatgtccttgcaaaagttagaagaggggacagtgattttgttggaactatcttcccagagctgcacttggcaagcacattatggatagcatcacttctgttcctggatctagccccacactggccagttagctgctttgttaagcagaagagggccggatgcagtgactcacacctgtaatcccaagactttgggaggctgaggtgggtggatcacttgagtctaggagttcaagatgagcctgggcaacatggagacacctgtctctacaaaaaatacaaaaattagacggatgtggtggcacacacctgtagtcgctgctactcaggaggctgaggtgggaggatcacctgagccctggaggtagaggctgcagtgagctgagattgtgccactgtactccagcccgggagacagagtaagaaagactctgtctaaaaagcaaaaagaaaaagaaaagcagaagaggattctaccaattcagctaccactaagagctctgtgcaggactaggaaagcagaggtactccacagtgagtcaggcacagcccctgtactggggtgctcacagagtaggggggcagggaccataagtatggagaaggcattcaggagacaactaccagagatgggaggggcatctctgcttgtgccccctcgctctctctggaccatgtggttggagggttctattgggccttcttctctccttctttcctctacccctccccaaggggcaaattcttcctacaacagggaaggcagacagagtctgacctgcactcagaattgaagccactcttgtcttgggggccagtggaagtgccagcctcaggagtgtgtgtgggggggtgtatgatgcgggggtcgtccaaagctcctttccacccgtgggatttctgtgtagatcctggaacaaacctctgcccctccaatttccttggctgtgactctgtgggttagttttggccagtggttcccagtctctcttccttgccctggccactgtatattgattttctttttttatctatttcactcggatcaccctggatgggctctgcctgcccattctctatgtccccacactcccaggcccagtccccacaaaactgtgtgctaataaactccaccaaacattcaaagtaggaagagaaaggagagcaccttccagggctcagaggaggacactgtcctggggcaggagaccaaggcctcaaggcagaggctgcacttgagacaggtcgagaaggatgcataccattttaatataggagatgaggtggtgggaagcgcattcttctagggcttctgcctagtcctcctggccaaagtgtgggagttccttgatccctgggacacagtccaagaagaaatagtcccagaaattctctaaggaagatgctgtccagcatgcacccaccccggggctctggcatctacctttgagcctaggcatctccctccacctgcagaagaataggatgcctgctctatctgtctggacttcccagatcctggccctgtggccactgggtagactttggctgtttttggaaagagaatttccctgggaagcaggctcaacctactctctaggtccagcaagtaacccttttgagtttcaacattaaatttccttaatttcatmcctccttttcatgtccttagagctttgacggatttgcttcacttcattcccttcattcatttgcttttgtttttgtaggtggcgatacaaaaactgtctactctgcagacgttcactttgaaaattttgctagcaacactctttctcctcttgaatgatcttgctttaattattaggcattttacccatggaatttgagccaactagaaccatttgatctcagtgacgtttaactagatatctcatttaagagccattagatccagatatagttagaatgagaattgcacgccaatggagatttgttaataataactatccacttatttatttattcacatatgctttatcaaaccattggtttagctcattcatgttctttgttacttttcccctatttattttctgtaatcatttattgagactcttctatgaacgaggctctcctaggtgctagagggacaaagccacagtctgggttcctaaggagttatttattccttccacaaatgtttatgtaatagccaagcactgtgctggaccctgaagctcacagtcggggcaaagaggcagaatataattaaatgctttgcaatatcatgtgttaggtgcttttctaagaggtataaagaagttcccctaggaaataaggagaaatgtaatagccaggattctttgggtttaagaaatagaaacccacctccagctaactcacgctacaaagggaatgtgctggcctctttaactgaaaagtccagaacttgacttcaggcagtgctggatcaaggtatgcaaataatgtttctccccatcccaaggctttgctctcttgtgtgttagtttcattctcaggcaggctttcccaagaggtggcaaaggggaccaccctcagctccctataacctacctctcttggcaatcccagcagaaagggagcatatctttcctaatgggtcctacaaaagccctcggataaaccttggtggaccagcctgagtcatgtgcccacccctcaataccagtgtagccaagggatgtcctcattggctggatccagatcatgtgactgtctgccctccccaaaactcaggctgggagtggaagccctggcaagacaaaaactaagactgtccttgaaacaagtcatcaaccttcctgtaagagggcggtgatgctggaagggctcggaaaaattagtcccacaggatgatttttgagttgaactgaggggtaagattttgccattggcatggagccgaaaagagccctggtgcatttggggcattgcaagtcaggtgcagggagcaagagaggaagtgcaggatatgaggcccaaaatgaacacaggaggagcatggaccaggagcaagaaccctgccccttgttcataagccagagaggattccataagctgtggaaagctattaagagactttaagcagggaagtaaaataatcattctgaattttaagtgggttaaacaggaaggcccagaaatcagctataaaactttttttgtgactctgcaggcaagagaatccagccttgaactgaggcagctatgaaggggtagagaggaggaggggctgatgattatcaagttctggctgaatgactatggtggggccatgtattgaagagaggaacacaggagaagaagtgggctggggtggagtggggaatggcaatgcccattggtctctccagcacaaaatgagcaccaatagggaagtcaaggctgcaagaaggaagaagataaggctggatgtgctgggacacagctgcccttggttacgaattcacagtcattgggataagactggtgaaggtggtcagataaaatcaacagctayacctgaaagcttggtgttcaataccctggcaggaccatgagcggtcatcttcacaatgagcaccagcatcgtctttcatagggaaaatctccttcattatggtcactgtcatcttaccatttcatcttcattaccagcatctctccatcatcattcaatcaktcaaacaaactactcaggcccttctcctgcttgacattgaacttggcactgggaatgcaatggtggagaagacaaggcctctgcctttgtggaacttacggtctatttgggggagactgaagttagtaaaatattcaaacataaatgtagaaagtatgmcacatgtcataaaggaaatgaacaggatggggaataacagcagtggggaccctattctaaatctgacctctctgaggagggtaggatttaagctgagacctgacttttgagaaggagccacaggggaagaactcaggtggcagctttccaggcagagggagctgcacatgtaaaggcttatcatctcaatgtcctatttgctcctgaacttcgtacatggaggtagcataggcctggtacctgtcctctgaggtttcctctttgaatgtcaggagcaaggcagagtcaaggtctcaagctagcagagacactcagaaaacagctcagatggtgcatgactaaggatgctgaacccatgttggctgagctggtaagcgaataaggcccattctaaccgagcctcagacctcctgccttcctgtgggcttgtgacgcctttgcttctctctccttccttgacacatcacaactctttaagtcacactaagtaactgtccttttttgatggagcccatgaaattgcatctgctgtatccatcaggagccaagccataaataaccagccctttaaaatctcgtctcctgtatctcttggagttggaaatagcattacaagctctgccgcggagcagtaagaaaagattagtgccttagcatgctgctggcacaaatgtgtccggaggagtgaaggccagggctccagcactctacatggagtatcaatgtgacttccttgcttccactagtgagaacttgctctcaaaaagagaacaaaagtcacagctgggaggagcaggaagtgaactggtgttgtcgcagtgggcacagcggctctgctaaagcttgtgacttggcaaagttctgtgcatgggaagctgaggtcgggcagctggcctgccccccatgggtctgactgcatgcaacaggtttgtactaagtgcctcatctgcgaggcggcctgtgccaggactgtgaagggcaccagagaacaaaatgctgtcctcgacctctcttgaggagctgccagatgcctgatggtgccgctaagacagatggaaggagytgttctgggtcctccagagccccttgttctggcaagacctgtcttctggaatgatgttgcttcattctgaatgttcaaggccccctcctggtctctgttttcatgtttggccatgaatgtttgttccactcactctcagcttaacctacatgttgtttcacgttggtttgcgtctctcctgctactgcaaccacttcccaggttcccaagactgacttaagtcttcagttctatcccttagtctgtacttttttcttttttacttttcttcttttttttttttttttttgagatggagtcttgctctgtcagccaggctggagtgcaatgtcacaatctcgctcactgcagcctccacctcccaggttcaagtgattctcttgtctcggcctcccgaatagctaggactacaggcacatgccaccatgcccagctaatttttgtatttttaggagagatggtgtttcaccatattggtcaggttggtctcaaactcctgacctcaggtgagccaccacgcccagcccagtctgtacttcttttcatcctagtttctctttatccagtggctgatgggtgacatccacagactcaccagagaggcaggattcacacaaaaaactagcaatgacagtccgatgaaatggcaaaatcaccatttcacatatggtgaaactcaacagttcaaattcacatatggtggatctcaacagtttgggtcatttggggagggagaaggcagagtttctttgaacaaaatgaggtggcttcatggacgaggtagatctctagcatccctgggaatttctcacccaagcttcttgaagagtggtctacactggctaccctcaagtcttctctccccattcattccttacctacttcactcccactcttcaaccctccagcctcctcctgaaatcactcacattaagatgatgatcaaagggccgggtgtggtggctctcacctgtaatcccagcaccttgggaggccgaggtgggcggatcacgaggtcaggagatcgagaccatcctggctaacagggtgaaaccccgtctctactaaaaatacaaaaaaaaaaaaaaattagctgggcgtggtggcagacgcctgtggtcccagctactcgggaggctgaggcaggagaatggcgcaaagccaggaggcagagtttgcagtgagccgagttcacgccactgcactccagcctgggcgacagagccagactccgtctcaaaaaaaaaaaaaaaaaaaaagataatcatcaaataaccaaccccacccctaccccattccaaagactaccacttccaattaccaatgccagaaggcgtttttcaggtctcaccttctggacatttctgcattactttacactgtcagtcattttctcctctgggggctctgctttctgcttgcctccatgccactctttctgattcttcttggatctctctggccattccttccgtgtctcctttgatgtccattccttcttgctgtactgctctgctcactccacacatctcccagggtagtcttacctgctctcaagatttcaggtactacctatttcctcccaaatatggctccctagcccagcctacccactgagccagtcaaactgtagagccagctacctgatggacatctccactttgatggaccaccaatatctccaacttaacttgtctcaattttgctcataattgacccataaaatcatcagtctgtgtcctttcctagtttatggtaccattccccacctagttatccagaaatctgggaatatccctatttaatccctctctctcaccagccacattcaattaattgctaagttctcccaatatactgtacctttccatcctttctaccactgcctgaattcagcccatcatcttttcttctttgagggatgtaatagcctccttactgatctcccagcatcttggcactgtccaattcatcctcctcactgctacgagaatggcttaattaaaatgcagatctgacatgctaagccccaggcaaaagctttcaatcatcttctgttgtctacagattaaaattcaatcccttgatagggcacacaaggcccatctggatctaacccttgcctaagtaaccaccccaggctcacatcttgccacttccttttttaaattttattaaccctaaaactcagtggtataacaccacaaagatttccttcttgctcatgttacagatttgtgatggaccagtgggagtggctctgatccacatcatcacacatgtgggtacccaggctcgagggggttgcaccatattctaaccacaccatctgaaatatgtggccttctttaataccatgacagggaaaatgagtggagaatccagcatggctttccaccactctagctcagatatgctatacataatttccaactcatatttcattggccacaaacagtcacacagtccagctttgctgcaagggagccaggaaacggggatgagcagatgagatgcttggtgagccgagttctctgccacacctcatgcttctgtagacaagatgccgtggttcctgtcaaaggccagccctctcctgtactccagagctcatcttcctccaaaatttccctactatatgtatctccttttccttgcattccacaattgttctctctattgagcacttctaacaccataaaggcatgttccaatatctgccacctaaaatcaaaataaaaacagcacccatcaaacccctattactccatcccactcagctaccacggaatggctcagccactgccaattgctgagacagttctttctcagtttctgccctgctttgtcactaaaactgaccttgctaaaattgacagcaacctccaggttgcccattycagtgtcgtttctccatcttcatctgactcagcctcttggcaacacatgacactgatcaccagtccttcttgaactatttccttctcttggctcctatgaaaccatgtagctggttaccctatggccattccttcttagtctgttttgctgtttcttccaacgtccactctctgtccagcctttatgcttggactacccagagggtcctgggactctcctctcttttattctctttcccagctagccccaacaaatcacacatgggctttcaatatcatctagatgccagtggctcttgatttaaattttcagtcctcaagggtcttctgggcttcatgcatattaacaggaatcttaaaatgaacatatcgctgggcacagtggcatgtgcctctagtttcagctacttaggagactgaggtgggaggactgcttgagctcaggagttcaagaccagcttgagcaacatagggagaccctgtctcttaaaaaaaaaaacggaaaaatatatataacataaaacctatcggctggacacggtggctcatgcctgtaatcccagcactttgggaggccgaggcgggcagatgatgaggtcaggagattgagaccatcctggctaacacggtgaaaccccatgtctattaaaaatacaaaatattagctgggtatggtggtgggcgactgtagtcctagctactcaggagaatggcatgaacccaggaggtggagcttgcagtgagatcgtgccactgcactccagcctgggcggcagagcaagactccatctcaaaaaacaaaacaaaacaaaacaaacaaaaaaacctatcattccatttttaggtgtacaacttagtagcattaagcacattggctatttagtggtggataacaccactatctatctctagtaccttttttgccttcccaaatggaactccatgcccattaaagaagaatacccagaatagtcagattcatagrcagaaaatggaacagtagcgacaaggagatgggccgtcatttctttttaaggctgaataatattcccttgtatgtctaaaccacattttgtttatccattgatctgttgatggacatttgggttgtttccatccartttggacttctcatcccctccccactcataatctgttctcttagccttctccacgacctcccacatctgttttcctaagaggaagctgcttctgcccatttggttccgccagcacctttgggctgctcgggggccttgtctccctgcttctacccctctgtaatccattctgcagatggcacctagagtgacttgggtttattaatcaaatcatgtctcccctgtttaaagcctcccaatggcttactatcacatttagaataaaatcctacaagaccctacattgtccagccactgcctacctgtctgacttccctcctatccctcactcacacccattctctgtgctcttcatcctgtccctagggtgggctaagcaggttccctgctygggcttctgcactagctgttcccagggcttaggatcctcctccttcacagtcttcaaatcttccttccaagttaaaaaaacaaaaaacaaaaaccactgtttttttgaaatatagagttcaatgtaaatttcctatctttagaaaagactttcccgtccatgcagcctaaagtaacccttgctgtctatcagaggatcttgttttattttaaacattcatcaatacctgatattttcttgcttacttacgtatttctttttcttctgtgcccttcccctcccctgccattgccagcagaaccgtgacaagcccctaatrtgcatcttggcacttagtaggtatccaaggttggtttgtttggaggagagatctgcttctgccttgccagttacaatgtcctgtggctaattgcaaaggttaacatggagcctctccaccaagtattttaagtaataaccttcctgggggacatttgcaaattagcactgactcttgctgattactcatcctaaactcagtctgattaataattaatcagcaaactgcttggccagagcgggctgatcagtgctagaaaggatcttaaattatgcaagtcacttggccagtctttaaaaaaaaaaaaaagctcagcagtcgacaacagaactggagaggtttgattgcaatgtgagatctctctcagttgtttgttttttcctttttggcttttttttcttttgactaagaaatcaattaggctcaaacttgcaacctcagagagagactgtgtagcacagaaatagaaatgtgttaaatatcactttctttttgtttctttccttccaaagagttttggtctgtgaggcagaggttaaaattagccaatttgctaagcaaatgcctgtctggcacttgatgtcaatttctgcagccacgtcagtttcagctattcactcacttcctctgagctgcagtgccctgtgtctggcaggaaggaggtgagagatttgatgggtactgtctgcttgcccaccctggggttggggtgaaatcaatttgccagcaacctgtcccaccaggagtccatatagtgctctatgtctctggcctacaaaacccagagagacaggaggaaaggcaatcagagggtgatgaacaggcttcccactctcaggagtgaacttggggaccgccagggacccctcttaagccttatctgtagcctccagcctccagagccagtcctgcatgtggctttatctttcttctctagatacctcttctggtcactggagatatggctgagggggatacttagcgaaagctgaggggtttgtggacattaatctccgggccagaaaaaaaggtgcagggataaagggtttagtgcagtccatgcaactcggatcctgattagaaccagcagggtgacaaggtgattccccagaccaaataagtcagcatgcccagggagggacccaggcatcggtgatttttacagctcactgtggattcgtgtgcaccaaagaggagaaacatgatgtgatagagcatgagaggcttttgggaaagagattatgaaggacatcaaagagtgaagtagaaaatgggcttttcaggagttgattgtctttctggaaatagagggacatctctctatgttgtgtcaggcagggtaagggaagaagaggcagccagatggggcggtttccaggagccctgcagtttctgatccatctcagttacacccccaacttttaaaaaaaataccctgtgtttcctttaaaaaatgccctctaggacttatcctgtgtttctcaaactgggttgcactgaccaactccctgcttcagaagacttgcttgaatgctctttggaagaatgcagattcctgagccccacctctgtaaaatcatggattcctgagaatagaactcaactaattcagtatttttaaccattttcctgggtgttctgaaatagatttaagtttaagagttaccctgggcctaaatagaatactttccagagtgataatataaaggaagtagattctgcccattatgaaatgatttgtctttttatgaattgattcattattgaatttctccccagttatgtttgacgtataggtttggttatggcttatgcgtgagtttgggcaagcacatctattccataaaatgaagcacattgactcctagtaaactttatttatttatttcacaaatatttttccttgcctactctgtgccagtttctgtgataagctttgtgattacaatgctgaactaggaagtctcaacctttcaaggagctgctaaagtttagccttgaagtctagtctcacctccttgtctacctggtataagcctgtgcaagggtctccctcctgaaacctttagatgcattgggacctgtgccctccctcagccccacccacactgggcaaccccaggctcctacgacgcactggcacaagccaaacttttctagaatacagagtcctcctcccaacatgaactctttcagagcatggacttggcccatcatctctgaatcctcagggctcagtagagtcctggcacagacaggtgtaaagattttctgacaatttgttgaataaatatagcctctgagatcttagagtctcagcaccttctcacagccaaccgcatctcaccrgcatcaaagggaaaagcatatggcacttggctcacctcgcctggtgtcagagccctttggcaacaggaccaatgtcaagataaataaacaggcaaatattcattgtttgcctctatgattgaattgaggccatcacatgtgtggaatgccatcttgccccattgggtcttcacccccaagtttgagttaggtattggcatacccatcttgcagataaaraaactgagcctcagagacttagcttcctcctcacctacacgtggttctccccagctgggttttcccattttgttccctctgcagatcctaggccagccactccaggatcatttctcacccttaaagtaggctttgatgcaatctgtcctctttgagtctctatctgccttcctcctgccttaatataccttcaacagtataatcactttgagagctaccatgtttcaggcactgtactaaggtttttatatgcatggtctcatttaatgtttacaaaactcttttttttttttttgagatggagttttgcccttgttgcccaggctggagtgcaatggcatgatctcagctcactgcaacctctgcctcccgggttcaagcaattctcctcaccttagcctccccagtagctgggattacaagtgcctgccaccacacctggctaatttatttgtatttttagtagagacaaggtttcaccatgttggccaggctggtcttgaactcctaacctcaggtgatccacctaccatggcctcccaaagtgttgggattacaggcgtgagccattgckcccagccacaaaactcttgtaaaataataatattatcataaagagattaagaaacctgatgtaatatagctagtaagtgtccgagccagaaattggatccccatcatctggactctaaatcctgatctacccctctttctcttctgctcctctgggatctaattcattttctttcctgacaccaaggagggcaccatggagcatagatagcatttggactcaatgttgggttcaaataccaattctgctaccaactaatcgtgtgacctcagttaactttctgaccctctcaaggcctttcatacagttataagaaataattgggcacagaagactttgaacagccccagattcccagcttgtaaatccagcttgtgtccttcttctgccctttcatggttacagcacctggaagggctttcctcccctcctcccctgcccctctcaccctgctcccagagcctcccagcatatgctccgtgcagacagctacacacagcttctttcagaggtttaaggtcctgtgggtcttggcctctgcagttgataagtcagggaggcagcttsaggctgaccgaggcagaggccacagcaagaggttgtcatgtctccttgggccaggcagccctgaggtcccagggccatttggcagtaccctgaagggcacatggggaaagtcggggttgaacaataatggcttttactcttctctcacagcaagtcacttagctttctgaacttcagttgccctagttttataaggcaggtgatgggtcctcaccaccctcactgtaacctgctgggaacatgcagattggtgtacagagacctcctaatttttcacatataaatccaaccccacagattcccttccagtgggatctgcctcctaaggtgatttttctggaactgagagggttttaaggaagaaaatacaattactatgtgtagggtaccaacgacatgccaggagtctacactgatttttcctttgtgcctttaagcaactctgagaacccgagactcagtgaggtcatttacccaaggtcacagagctaggaagttgcagcctgaagccagggccctttgcctcccaacctctgctctttctgcccctctggattttggaggttggaaagagaccttgggtatcctggagagatggccctgggcctatgccattggcttcagcttcttccccctggggctgcttttgggccttgggctgtggttggttgatgtgggctggcttcacagatagccaggctcatcgaggccttggctcccacatcctgccagctccctagatgccagccctggtgagcgtgggacagactgccatcagcgttcccctttcaagagagccctgtcaatgcagataaatggcccgtgtcatttagccacatccgtcacgtccttctcgttgctggtctgtggcctgagttgtccagataacccttttcatttagtgttgtctttatggatgccacagaggtctccgggcaatgacagcccagcctttgcaccraccaggaagagtcacaggcaggcctgcttcctgacttctgtttgctgtctgtttggctctcacaattattggaatctgtcaagctccatcaagtgacatttttcacatgagggcaagtgtccttcaggcctcactctgagctgggaatgacatcctggacgctgacgtggcctccatctttccaccagcggtttccttcacagttgccaagcttccttcagccctggctcaacagtgccctcctaagcttccccctcaatgccctcagtccctctttttgtaattaccctttccccagccccacattcccctggtgccttagcaagtaattaccttcatagggaagttgacaagtctctggcgactcctagccccggctggaaaagattcattattctgtgtctggaaataaccagccccatcagcacaggggctgagataacaccagtgtaaaagttctttattcagggggattaattaggattccttattaaagatccaattaggcaaaagggcatttttatctgtgatagtcagctgctcctatttttctaaagctgtaactcttaagtttttttaaaaaaggaaaaagcagggggttgtgtttttgtctaaaacaattcactctttcattgtcagctatgtcttcatcaggatgtgaaaatagattttctcattcaatttgcagtgctttatctcttcggagtctggcaatgactccacgatatcccttcaacaagaaccgcaactcagatgggctgttggggagtgggatgtttggttatcatgactgcaagagaaatagtaatagcattttttagcaacctgactccatgagctggcaggaaatgccatctctgccatgtaatgtctgtgtgaccttaggcaagtcccttcacctctctgaacctcaatgtcctcctctctcaatctaactccaaggatcaggataagggtttaattggggcaatattacaaagtgactaggaacccagggtcttgactgagaccaccttacacccacactcacaagccatgttgacttctgaaccttggtttcctcatctgcaaaatgggagggaaatacctcctccgtcgggtctctgggagaattgagggagataacatttgtggaaccaccttgcccatggagggcccttgatacatgtttatcaaacctgaatcaactcattttgtatttccctcaaagacgctcagtgaggttccctggagtgagctgttgccgctccccatctcaggtgaattgagctcattttgtccctggtagtgcctgggtgattccacagtacagtgaggctgagactcctggctctgttgtcacccggctgtgtcctcagttgctccccacggaagcagtgctggctgcaggaggggtgacctcttgacctcagtcatgatgtggacatacacagtatgaacccacaggtttttacttgcattgttaaagacagcagcagcagcttgtttaccccaggaaagaaagccctggagaaataaaataatctggcttccagaaagttcaacagaaagtgttttgtccagttgccagattccacagatgaggaaattgagtcccagcatcactcagcaaacatgtggcagagccagggcagaatcgaagctcttcatgtctgatccagatctgtttccaccaccttcaatgtttgctggccacctagcactgagccggcgtttgtagacttcacatgagagggtcacagcagcacctggctccagcaggatctgaatccacataaaccctacttcatgtggtgttcctcacctgtctgcctgtcctggctcctcattgcttgtgcctcagtgcctcagtttaccccatagaggagccactttagcttctggttcatcttctcacctttccacaataytgttttggcctgaataccctcttttacaggcttgccccctgtaaccctgccccctccaccacggcctctgtgaccttaccttctcctaccctccctcttattcccttccccagccacaakggcttccttgctggtccttagatgccacgcgtgctcttcccacctcagggcctttgcacgtgctttcccctctgcttggaatcctctccccctgagatatccacacatctgactccctcccctatttcaggtgccacctttaagatcatatgcacagtgaggccttccccaatcacctatttaaaatggcagatgcctcctcccagtcagtagagtgtctgcccatgtttgctccttctcagccagatcctcacacttcaaagtgtgcctagctcatagggagcctggaagttgggagttcaacccctcttcttggttccagtcctgaaagccctgttgctccacagccatcattctccttcgccagatgaagaaactgaggcacaggtgggtggcatgtgacttgccaaagtcacccagggagttagtgtcacaggagggactgctggggtaatcttaaaacaatggtaaaaatagttgtacttgtggggttatttatatctctctacctggtttgccctgaatcttggtgtgacctcaccaggtgatgtcctcaagcttcaccgaggcctccagtatgtggccatgtgtaagacccatgtcacagaaacaaatggtcctactgcaaaaatgtgctgatggaagagaacacagtctgtgctgagaaccaagaaatcctctccccctcgctactcccctccttaccctcctaccccctctgccaattcccccatcaaataattcctgataatgaagttaggatgattcattggttttctgatgagcatgaattcatcatcaaaatctacatatttcagtcccctgatatgtgctctcatattcctaacctgattaatatgtaaagtgctttatcctgtgacttaacaaaagaaaactcagcttggatttagggacctgcaagcctcccagactctggggttctgggaagcgtggggagatgccactgcttccgtcttggaggagatgacggtatctcatcagggactgggtcaaggtgccagcaggtgctacagttgagaggggagttggttgctcaggaccaggccctgggatgcctgagcactgcggcttcagacccctcatcccataacccagaaagacctggctgcaaagttgtttaatattcacaaccccacaaactcatgggggctgggaacagcctgcatcccatgcctagggacccggatgagatgcggcatccccctctcagcctttctggagggcggccagtgtagcctgccacctttctgccaaggccacttaagccatatccctgcaccaagtccccctgcctctccagagggcgggctcaagctctgcatgaatgcctcaagccgcgcttccccagccaccacccgtggggtggccctgctgctgctaaccttttgtcttacccatgattccctcaatataaggtccagcctcccaaacctctgtcacttcatccaccatacatccccatccgctctactaccaattttggcccacacctccttggactcagaccatttcccagtacccccatgtagggccaatccctgcctctttcacccctgacccacaaacccatacaccctgcaggcattcccaccaggtgctctgtgcctgtatcatgagaagctgtttgcctagagggctctaaggtcagatgtggattcaaasctctgctccgggatttggggaagctatttaacctctctgagcctcggtttctttagctttaaaacaatgctatcaggaataataatttatatttcttagggctgttgtcaatttcaaattagcattaagcagagaatctaacatacaacatgtaggtaacactcaataatgtagcgattattgatattcatcctcatggccactgactgaggtgggcaagaattacttcaatttttctgatgtggaagtggaagctcaaagatgttggggttggatgtggttgacaggagcaaagcagcacctcttctccacagaagtacctggggcatcttgggggaaaaggatttgggaccctgtggaagacaggatacctgagaggagacttgccctgcaggagatggggacccagtcagtgacccggatgccccaacaagacagaggtcccagaagagggctgctcctaggcatattatgtgtctgatgctggagttcttgcccctctggaaccagggtattttccaagtttgggttccccaaaagcaggcctgagacaagggttcaagcacaagtgttctattaggaagcacaggtgacactagcagataagagggacataatacagggaagagacwgtagctaataaagggtggtcataccagctaccacaatgggggtctgggccataatcccacagggacactctaggaaacccaggtctgcagaacccagatcttagaattatcccacccaaggaatgagggagctgaggtatttatacaccaattcctgaaagtcattgaatgagggctgctcctgaggggttattaactccctagcccttccagcctgctgtgcacatgggcaaagtggcctagcattgggggaaaaaagccttcgagcacagggatgcagacactgggagcttgcagtcagctggcccactctgaaagatcgagtattacaggaaggacactggcaccacctgctacaggtgtacgtgtatsaaaaggcagtgttactgacagagctgtaacactgggggcctaggcagctctggagtgagacccagctcactaaaagtgacccttggaaggaccaccttcccttcagccttggggagccactgaaatttgagtgaatccacagaaacctgtggtgtaggcagtggtcctagcaagcaggcacagaaaaaaagaagaatccattatccaggtggccccattaacagtaatccccctgtccctgtcaccactgtcagacaacagctgtagaccccacatcgggatatgtttgatctcctgcccttctagcaggctgcagccagtgagcaagaggactgcctcaaagtccagtatcagccaccccagcatcctggaaaaagscatggctgcctgctagcttggcaattaaccattgagatttggaaaatcagggctatgaaacttactttgtatagccacagaatggtaagttctgtggatttaggtcacacacacactcatacaaaccaattattcactggaatgcaagacagtctgctgtcaacattcaaatatttttggaaagtttgtatgtttctggctgtgctctgagtgaagtcgtgcttatttcacaagttgtaggctgggagatgaagtcacaaagagctcatgcatagctgagcaggaactcccacttggaggctttatttagatgtgccccagcattccctccatcgctctcttgaactgccaggagaagtttcagagctcagcctggggaggaagaaaagggctcagagttcagatacattcttctctatgtaggtgaaagctgctttgtgcttcacttccccatcctttcccctctcctatcctctgcctggaaggcccatgggaagaggccaggatctggactcagataaaccaagttccactgggcaatcttaggcaagtgactaatctttcagtgctcctagctgcaaaatagatagaatagtgccaaaaattgtgcttacgaggtaagtagcacagagcaagtactcaatgatagccactccccctcctttcttataagtaattttagctccctttctgttttaatttctttcccctcctcttccattcagattgtaccaggcagagctgtgacccagatgtttctagtgatgtgggaattggatggatgcaaagcatgatgatccattcacagtcataatcaagcatcatcaatttattatacagatactattatgctaggaaatcccattaatcatttttgataggataacatgaaccctttcaccagacctgtttgctcttgagcctgtctgcatttggtcattcacctcctacgaatgcactcaagttggtgctgagggcccagggatgcccagcctcactttctrcttcaaagtcacccaaccagactcagagggaaagagaaattattttactgaatttgcttacagcaaaaagtaagcagaactttaaaagaatagagagtattagtagcacaatttgcaattgcaaaaataagaaaccaacctaagtgcccatcaaccaatgagtggataaagaaaacgtggtatatgtaccccatggaatactactcagccataaaaaggaatgaaatagtgtcttttgcagcaacttggatggagctggaggccattattctaagaggagtagctcaggagtggaaaaccaaatgccgtatgttctcacttataagtgggagctaagctatgagggtgcaaaggcataagagtgatataatggactttggggacttggaggagaagattgagagggggttgaggggtaaaagactacatattgggtacagtatacactgctcaggtgatgggtggactaaaatctcagaaatcaccactaaagaacatgtccatgtaaccaaaaaccacctgtacacccaaaaactattgaaatgaaaaataaatcaataattttttttaagattaaaatttttaatcctatttttattttcaatttaaaatatccccccatatgaaattaaatatgtctgacatggtgtcctccagtttgccaaaagctaaatgactttaaatgcaaattatattttattgaaaaactcactagtgtatatactatagttgtcacaaatatacatatttgtgacaaaaaataaatttccattttttttttgatggtgtctttagggttttctttttattattattattattattattttactttaagttttagggtacatgtgcacaatgtgcaggttagttacatatgtatacatgcgccatgctagtgtgctgcacccattaactcgtcatttagcattaggtatatctcctaatgctatccctcccccctccccccaccccacaacagtccccagagtgtgatgttccccttcctgtgtccatgtgttctcagtgttcaatttccacctatgagtgagaacatgcagtgtttggttttttgtccttgcgatagtttactgggaatgatgatttccaatttcatccatgtccctacaaaggacatgaactcttcattttttatggctgcatagtattccatggtgtatatgtgccacattttcttaatccactctatcattgttggacacttgggttggttccaagtctttgctattgtgaataatgccgcaataaacatacgtgtgcatgtgtctttatagcagcatgatttttaatcctttgggtatatacccagtaatgagatggctgggtcaaatggtatttctagttctagatccctgaggaatcgccacactgacttccacagtggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaaatgtctgttcatgtccttcgcccactttttgatggggttgttttttttttcttgtaaatttgtttgagttcattgtagattctggatattagccctttgtcagatgagtaggttgcaaaaattttctcccgttttttaggttgctgttcactctgatggtagtttcttttgctgtgcagaagctctttagtttaattagatcccatttgtcaattctggcttttgttgccattgcttttggtgttttagacatgaagtctttgcccatgcctatgtcctgaatgataatgcctaggttttcttctagggtttttatggttttaggtctaacgtttatttaagtctttaatccatcttgaattaatttttgtataaggtgtaaggaagggatccagtttcagctttctgcatatggctagccagttttcccagtaccatttattaaatagggaatcctttccccattgcttgtttttctcaggtttgtcaaaratcagatagttgtagatatgcagcgttatttctgagggctctgttctgttccattgatctatatctctgttttggtaccagtaccatgctgttttggttactgtagccttgtagtatagtttgaagtcaggtagcatgatgcctccagctttgttcttttggcttaggattgacttggcgatgcgggctgaaaaaaagagcccacaaaaaaaaatttaattttaaaagaataggcagggcacggtgtctcatgcctgtaatcccagcactttgggaggccaaggcaggcagatcacaaggtcaggagatcgagaccatcctggctaacatggtgaaaccccgtctctactaaaaatacaaaaaattagccaggcgtggtggcrgacgcctttactcccagctacttgggaggctgaggcaggagaatggtgtgcacccgggaggcggagcttgcagtgagcaacgatcgctccactgcactccagcctgggtgacagagccagactccatctcaaaaaaaaaaaaaaaagaaagaaaaagaatatgtatattcttttatatatatttagatccccacaaaagcagacgagtattatattttttatttccattgtaaacataaagcatggtcattaaagaaaatttagaaaattgagaaaaactgaataaagaaactctatgcatgaacattttgattcatttctttctyttttttttataggtatggctttgtttttaaagagctgtgttcatagagtattgtgtgagtgtgtgtgtatgtgtttaagtatatacccactttttatwatgagtaatttatactctttgtgaaaaattcaaagcatacctgagagtacagaataaaacgttaaagtcgtctatgtgttaaatccctaccctaattccactgtcttccctaagcattattaagttggtctattagcctaggcattacacacacacacgctggcgcatgcacacacacacacacacacacacacacacacaggataggaggtgaaacataaacatattattctacagcttgcttttattctcttaaatgtctacgttaaatatgtttcaatgtcagtatatatatatatgtcagcctcattttttttaacaatttccctaataattgcatttttcactatttcaaataatgttatagttaacatcatcatgartatacctcagtgcacattggagcattaataggatagctttctttaaaatagaatttctgggtcaaagtatacattatttttaaatttagactctgctaaagtgtactccagaaagactgtgccaatttcatgtttccatcaaccatgtataacagtggctatttccctaactcttttccaaattaaagttttgtttttatccatctcagtgggtgaaaaacattcctccaattattagtgtagttagtaatctcttcatatgtccatggtcacttttattttctggattgcctgttcatattctctacccatttttctatcaggtcatgtttgtttttcctattcatttataggagctctttgtatatttttaacatgtattaaaatcaatatatgttgtaaaaaggttttatcaatcagtagcatgtcttttagccttactttgttgtctctcacagcataagttttattttgtgtgtgtgtgttgaaatcagttgatcttggccgggcgcagtggctcacgcctgtaatcccagcactttgggaggctaaggtgggcggatcacaaggtcaggagatggagactgtcctggctaacatggtgaaactccgtctctactaaaaatacaaaacaaaattagccgggcgtggtggcgggcgcctatagtcccagctactagggaggctgaggcaggagaayggcatgtacctgggaggcggagcttgcagtgagccgatattgcgccactgcactccagcctgggcgacagagggagactccatctcaacaacaacaacaacaacaacaacaacaaaaatcagttgatctcctgatttgatcacataaaacttctcagttttgtgtcttggttaggaataccttcctgcttggaaattatagaaatagtcttctctatttattctggaactctcagaatttttatattttacatttagctatttaatctgtgtgaattatatttttgtacgaggtttgagctatagatctagctttattttagttataaatgaataatgaattaactccaaacctgtcctttctgatttgaaatagtcctttcatcataaactgagttcagctctattcatggttctacaactggactttttcttctattttatttctctgttaatctatttctgtgtcataattgtatcatttgaattttgccatagctttgtaataatttttgttttctacccagaaaagacctccttcattattattactttgaaaatatttgttgacaattgttgtgcgtttacttttccagatgaattttagagtaaatttttcagatttcccccaaagaaatttcactgtgactttcgttgaaatttcactgaatttgtagattgatttggagagaattaaaatttttacagtaaatattcctatcctggacgatggtatgcctcttattttccaggccttttttaatgatcttgaataaaattttatagttttcatcacataagtctagtgaatttcttgttaggtttttttcctaggtccttttatagtttttattgttatagtgaatagggccatttgtcactgcattttttttctagttgcttattgctggtaaataagaaagctattgatttctgtacatttcttctgtaaccagccatcttactgaactctctcatcagccctaatagttttaaagttgattattttagattttctagattagacaatcatattagctgcaagtaatgtaattttatttcttctttcccacatggatgctttttttttggcttcttatatgactactgcctccagaattattatattaaagaggagtgataggtttggcagctctagaatttctgaataagagggacttaaaggcaagcatagcttttactaaattctatattacagatcaataaaaacagcaaaattagttctagagttttttctcccattatataacattaagaaattatgtgtttttcttattaagtagtgttattttttaaaaactctggagtgatttggaaggagctgatagaggttggagaggaaagttctctaaatggaaacccagtggttctgtaacaccatcgcttgatgaggctaagtacaattttgtatcctgattattctgcacttataacattagcattttctctgttattataaacccttgacctcaaaatattcattaagtggatatatcacagcttacttaaccattcctctttctgtgaacatttaggctgttcctcgttgtttatgttataaatattgctgcaaggaacatttttgtgtgcaaagctttttttttttctgaatttatgattatttctttaggagcaattcccagaatgaatattttttaagatacttgattcttattgccaaattgttttctaaaagcatttgatcattttacrctgccacagtatgtgaatgtccgaggaaacagaccttttaaaattaaggattataaaatatgtcatagaagaaagagaacggactttggagtcaaagagatgggtttgaattctgattcctccactgaaaaatggtcgtatttaaataaatttaaaaaaaaaaacstctgagtctcagtgtccccctctgtaaaatgtgcagctaattcttcttcagtcatgctgaaggctgagtgagaacaaactagtgatggcactcagcacaaagtagctctaaacaaatgggagtcactttccctttatttggactgttttcagaggttttattttctaaacagctttggagacttcccctgaaaaacatgctgcaattaggaatgacttctgtcccttagccgaggcctgtctgccaaggggaaaccctttcctgcggctggctgctggccccagttgtaagctctgagatctgttatgcagaagaatttcccatcggctgcccactgtgccccacgctgtgtgcaggccacacatgaacctctgctctgtgctggggcagaggaacaagcagcactcagcattcccggtgaaaacagtggctgggggcttccagagaggccatcagcttctcccctgattccctaactggattcttcttttctgacattgcacagagcagggtggttgtcatctgctcccatctcttggttgccaagtcctgccagttctgcctcctaagtatctttccaatttttccctttctctgcaacaccagtacgcccgactttgtttaggtgctctcacacctggaacactgaagcagcctcctgcttgtctccagaatttctccctcctgcccatcctctattctggtccagtgtgacctttctaaaccaaatctggctgtgctgtttccttgctgaaaactctttgatggctcctgtcacccatggaatatagtccagagccttagctcagcatccagtatcctctagctatctgtctctcctaagttgtacattccactcatgcattcttttattcaggagacatttattaagtatcagcgaccataagaattgtattcactaacactttttgcaccctttctaggcactttggggccaggctaagcactcgatatgcataatctgtcttaacccttttaataaccctatgaggctggtattattttcattcccctttgacacatgaggaaattgagcccagaaagttaacctagcctgcccaagatggctcagctaggaagtaatagagccaagactttgtctcccaagcccatgctcttaaccactcaccartcccaatttctttcatatatattaggcctgagaatacctattagactaaactggtggtatctttctccatacacatattttgtaagaaatatgggcacagaattcatactacttaaaaattatagagcttgctgccaaccagacactggcataggaatttggcagattcttctcctaagtgctccagggctgaccacaagattcctgccttgaaccccagatcccagaacccccattcctgcttcctcatgtggtgcccatgcttgggttagttataatttcccaggagggacccctgcgtttctctctggaccagccctatggggtatgtggtgggcactcaataactgcactgaattaaatcggattgaattgaaccaaattgaattcacaggcagatattctccagcagtggctgggwcttaagttcattgttgtcttaatcatcttgtggtagattgcattgcctcctccataagccaggctaagcacttaggtttttgagaatagtgtatcttaaggggtttccattcaagcagggtagctcttctgcataggccactggaaataggtctgagttgtgcgtgttctttgacgtagttttctgatatgtctcggaagtcaaacaatgtgggcttaagaatcacccgtactgcttacactgctgtgtgacctttggcaagctacttaamctctctggtctctggttcttcatctgtctgtcccaacaggatactgtgagaattaaaatgaggaatttaatgtgaactcttactatgcacaatgcatagtaacagaacacagcttttggcaataattataacagttgtttttctttccatgtctctcctgtccatgctgaattggacagtgagctggattgggagcagggacaataaggaaatgacagaggcagaaatcagaaagcatggtcttcagtggggcttggtcagcctagggctctggacaaagggggaattcttagcttctatgcctgggaaagtacctgaaggatatggaaaattgagagaggatgagcctggagagatagatggaggccagatgattcgtattttattctgaaggcaataggaaaccgctggaaggtttacagcaggggagtaacattatcagctttgcatttttgaaagaccaccctggctgctgctggagtacaggatggaaggatggatgcaggcacagacacaaactgctcattgttgcagttgcccaggtgagagatgatgaggcctgaattaacacagacagtattagtggagactgagaggagggagaggtttaacagacttaaaaacagcatcatttggttagcaatgcaattaacctgagggacaaagcgggaggaggaataagatggctgtcagcccttggtttgagtggccagtgtgtgggatggcaggaagtggcaaagggggtgatcatcttaagtttgaggtgcccctggggtgatggcatcttaagtttgaggtgcccctgggatgccagaggtagaaggatgtaaggatctaaagttttggggaggagtaaaggttgaaaatagatgtctgggagccatcagcttaggtgtgaggagagagcttacaackgggacacaacagggaaaaagggaggatgagaggacaagaggacaagcagaataaattagagtattaggacttcctggragcstagactcatccactagagagggtgggcatggagttgattgcgctgacatccagcatgtcagggaaagccctgggaattccactgtgtgtccactgtgtgtctgctatggtcatgggaggccctctagcttcctgcctggcctagagagtccactgaattccagtctgttgcastggcccatgaaccccagccccgccctgcccagctcatcctccttctagggctgaccctctccttctaactccttctaagttatattgaagagccctggtcttcattggccattgccaatctcttccaagtccaaattccataataagagggaaggcttctatctgagagtgggcaaaagaaacatcttgaaagtggggccttgtttcccaattcaaggcatgtgtcccagggatcatatgggtctttgactgtagactccctgagaaggcttggagagttcccatatgtgttaaggccttctaacttcttggctccatggatacttctctgaactaaacaaatgaaagtgtctagatttcacactcacagactataactcggttgattaggagttgatccggaaatctacattttcaatactcaccctaggctatctcgatacaactagtcagagaccaccttggagaaatactgacttaaaaaaaaaaggcaactgtgaggggacctaacatctaacaaccatccacaatttgccctactattgacatttcatttagtccttactaaatgaggtgaggtaaatgtgtcatcatttattctagaggaaatcatctgaggctcggagatatttagcaacttgcccaacyacacacagctggttgctggcagattcaaaattggaagcccrggtcttttttactccgyagcctaagacatataccaatatatcacctactgagaggaaaatggcmcctgtttttgggtagctaaatgtccattctatggaagaaagtttaaataactgggagaaactgaaccaatgggtagttgcaggagtcaaaccttgactcagtgcaaagatctttgtaataaaatggaatagcttccttggggagaccattggaagagtcaaggaggggctggacaaacaccagcctccagctggtgtggtagagagaatttatgaagtaggctggagtacatgactctgaatccctttcaagcctgtgatgagtaagatatggagctttgataacttgattgcctgaatttggtgctcctgttggctctagactgcatccgtagccacgaagggaagaaaaggaggaagagaagggaaggaaagaaggaagaatggaaggaagaaaggaaagggggaagttagctagtaaattcagggtatgaggattgagaaaactatggatcctgaatcttccattctttattgagtaatttcttaactaggaaacaactgagaaagcatgctgtgacctcaaagagataggtacctccatttttctttatggatgattgaagtgtatgcccagtgttgacctctgcagtgaactcatggcattaatggggaatcctccttgaaccaaattttagagaaacaggcaagttttcacatgtgcccttatcactaatgccagcctaatgccctattctacaaaggattaacagtcaatagaaaggtagatatgtttcatttctctttggtctgaacattctcaagtgggaagagtcgtgacataggcagctttagagaaagtatgaaattacaaatgttgtccattgacagcctgtcctttgaagctgtctcattagaccatcagtcttcacctaagtcactttcagtcctccagactcaattacctctggccaccccactcccatctccccactgaagttctgccatagccccgtggataccagtactcacatttgcctccagttctccattcatagctgtttaatcttagacaagtcactgaacctcttagaacttcatgtcctgttggtgggattataaatggcacaacttttttggaaggtaattttcatggtaggaattaaaacgtgaaatgtggataccacttttagggatttataccaaggaactagggaatagtgagaggctggtgcaaaatgatatgtgcaaggatgttcactgcagcattatttattataatggggaaaaggaaacagtatatgtccaatattaatggttccataaactggcacctgtggctgatacaacacatggggattaaaattataatttcagaaactttcgaataaatttgaaaatgcttaatataggatattaagttaaaaaattaatatacaaaactgaatatgtagtttaaatacacagtactaatgcattttattatttatgttcttttgtatttctaagttttataataagcttatattactttctgcacacagaaaaacaagtaaaagttaaaatatattttgaaagctcccaccacctacaggattaggaacaaattttctaacagaagattttataatccgactccatcccaactcagctccttcattttctgtcacttcctccccatcatcttcagttccccacaccattccctcccttgcaccttgctttaactaccccacgctgcttggcattctgtaaacacaccataactatgcatactgccatgctgccatgccttcatgcttcctgctttccctagccaaaacgaccttccccacatttttcaagaactaattcaggcatctccacttcttccttgacagttaattatttcctgcccctttctcctacagaacagtttttatatacttaataattacttatttagtagctgttattctcattttacttttcttcaacatttgtgggaaccccaaggagggaagrctgactgtctcagaggatcaggaaaggattcacagaggagggttgcaggaaaatgaataggagtttgtccactagacagaaagacaataaatgccctgacagaactccagaatgagttcccagcttgtatctatttctctcataactcttttctccctgcgtaatgtgttgcttatgggtacatgtctcttccctaccagcgaggtcattaagagcagaaaatgtgccttgtttgccttgtggtgtttagcacagtgcctgggcatcataaatatatttttgtcccagagcatgaaggtccaaaaataacaatacagtaattacctttctccttgtttcagggtgaatgggggaaaatcatattcttattgtcacttatcactggtttcaagtatgagcccagagatgctgaaaatgctttatattttgctaatttgaaccaaattgaagaagttgtccccttggtaggtcttaagaggatattctgcaaaatttgtactttmtttgagtataagaattgtaccaatatgagctttgcttcccctttaaacagcatgccacaagaatgatgcctttgaaataaatcctgtttgagtaatgtttctcttggactcataaaatctttatggaaatcttttctcatctcatagactatgagaagaaagagagagccaaaaccactgagctgtaagtgaagagcgcagtcttttctcatatgtgggtcacactttaatgtaaatagtttttaaatgcaaatcccataccgactacacattagctcaaaaatcctagctctgtccaagtgctgaatctgtgagttaagatctcttaatctctcattaaagagtaggtggtatggaaatgtatccattcagatagaaagtttgaatgtattaaaagatccagtaatagccatactagggataagaacacaaatgctggcagaaataaaaacagctttatgtcctccctcaaaaagagagagagagagaagcagtaagttggcagagctgagctctcaacccagctatgcaaaggggcactgacttgggagccatacactcattcagcatacatttttggggtgcctggtatataataggcattatacaatgacattaaattagataaatcatcatttttggtctccatgaggtcacaatcagtgtttgctcatccactgactagctgttaactttgagcaatttacttaacctttcaagcttcaggtttttcattttaaaattttggataataggatcttactagattactgtgcagattaaataaggtaatgtttacaaagcactttgcatagaacttaacatattataaactctcaatgagtgttacatattagtatcaggtgtgatgcgctatgctaaattctttatattcatgctctcatttgttctctcatttgctctacacctgtcaccttgagtaggttttaattcaccctttacacggacaagaagaaggaggatcagaagaatgtggtttgctaacttgccaagttcatacagttagtagtgggaacagcattcaaagccagttctttcttcatctaaaaccaatgctcatgattatagtggtggtggttagagcaggaatrggggagagacaccaatgcttgctatcagccacccaatattgtaagacaaaatctcctaccctcatcaggactggcatttttgggaaggcaaagtctaagggaatgaggtggtcacatgactcaggtatttgtgtgactttcaggtcagggacatttgtgggttaatagatatggggaagataaatcccaacccttgggagagtaggcccaaagtccatccatccagaaacagtttcacaaaactgctagcccatgggggagcaagaaatgggaccagagattgaagcagaccaaccagacagatgggccacacttaagtggagtggttaatgatcaaggctgcagggattccagggactaaatccctggctcctgggatcttagtgggaggtggtggggaggacagcagactatttccagaatctactcgacaagtggaaaaggggctcataatgaatttcctgctggagacaattgtcactgggacagggcaggttgaccctgaatatgtgaccaagcaaaggctaagcaaaagctggcaccatagaagccaccaactcacacattccagttggaacctccagccgagagaactctttgattgtgttggtctgcatcctgtggcttagggacagtgggagttctgaactagtgaccacacattgttaccgcggtaagaagaatgtgctttttcttttcgttcaagagcttatgattcagtcctatggattcatataaatagatattctctttgctttactacctgtggcaaataggactacaaagcacaatagcaccctgtccccctccccagggctgtcccataaacagtgggagttatctgagttcccttgattgaaattggaaaggtcatatctcaatagtatctttagggcttgcttttcccatttgtgacaatcttggactgtcctcaggcctccctaaggtgtccttccagctctgaccttccaagggtgtctttcggacacagagagtttggccagccatcaagcaggtaaacagatcaatgagggctgttcactgaattgtgctcctgggcctctactactgctttcagcccttgctgccactgtcagatcaatgcggggagcagatggctgtgctgtgtcacaataatggctcctttgaagagactttgctcagtccttctcctgtaagctagggaggtgaggggcagctgcacccaacacctggcagctcaagggaggcccatgttggcttctaataaaagcagcgggggtgtctggaatggaccacatgtgggtctcccactcacctgtgatgctgtctgtccccgtcagaggggaagtgtggttgctcacatctcatgtacatctagcccatgtggtgctggcctcatcgtctactgaagctgaaggaaagcatgttgtgtccaaaagaaacaaagcaggattttcagcttgtttgcagtaacggcctcacgggatggctcctggcttaggaatcagagaatttgctgaacaaatacatgggcagaaagtgctgaaaagcaactctcagatattacatggtctattccccttctctctgcttggtcccaaatggtcactccagcccctgagtctgcctgaccttcaaatccaggaacccaactcccagtttccacatctcttaattcaaactatcaagagagagaatctgattggctccactcatcagtcgagtgtctccactccttgtccaatcagctgcagctagaaaggggcaagctcagcttgtaccagtatagctgcaggagcccctcccttcagcagcgcaatcctgaaaagagggcaggggcttggcagcaaccctgggcatatcttcgacattaacttaacatctctctcttctctgtggtctctctcagaaagtaatagggaaaagtattcttttcaatttgcccccttgagctacacaaaataatacagactaagggcctggcattcagtgaagagaacttgagagcaatttcggggtgcctttaccactacagtattgtcttgtctgcctttcacagtctgcaaaagggagctctgtaaataccagggattttgtgattattatgaatcctctaagcagctaaatttcccaaattctcagagttgtaatgcctcgggatttagagatataattaagaacagatgagcctcacaaaggttgatggtgaggatctgggattgcatcaagccacagagagaattttgctgtgagttccaggccctcatctcccccagtgcgacaagggggacaagtccagtgggacaaggactggagggggtgatggcacacaggacctctgttaacgagccattgggcccaggaatcctgacctctcattttcccagaacttgtgacacaatctataaacccactcaacaggttaggaagaggcaatgctgagtcagccctgggctgtgcgccatagccatcctgaacagctttctgccattacaggatagaataagaccagccaggtstggcccatttcctctcagcagccatttgccttctgcccacacatcgatcttgccaaaagagggcttgtgctgcagcattgagtcattctcctaccctctttagtttatactcatttttcagggttttctctgactctactacttactgaaaggtgtagaaatactaataaggcaatactatgttttatttgatctatagactgcagcaacctgaatctatattatctgtcatgccaagaatgttttgaccttctaaaaggaaatgaatgctctccggaccagagccaagcaagcagcttagacccattcacaagcaaaagtctggggccttgagagttccagggcattmaatcaccatcagaataagactagggtcttgaagctcatgatctggagcacttagagtggrcaaggagcaatgaccccacagctactatgacacatggtagagtgtgggtgctgcagccaggatgcctgagttctgctacttgatagctgtgtgacctcaagcaagtcgcctaacctctctgtgtctccatcttctcacctgcaagccacaggttataaaggsttgctgtaatagatgagtaaatacatgcgagggacttagaacagtgcctggcgtkcagtaaatactcagggcagcatctgtgtcccaagtggtacgtaagttctttatgccatgtcttctcattctattcccatatgaccctgagaaacagcttttggtgttgccattatacataagaataaagtgaatttctcatgttcgacaaattgcccagggccacatggctagtaagtagcaatgacagattcccaaggtagagatctctgactacaaatcctgtgttctatctcttgaccagttcccctcatggtcaggctggcttcccgtaattacaaactctcccctttagttccctctgttgtctcttgatgctcacttgactttcagggactctggaatctctgctgcttcccagctgtgagacaactaagaccaggcaatctgtctttgcctcaatttctttatttctgtaaactggcatagtaacagggcctgctgagaaggagaacagcagcccctgatggctgcaagctggcctggcactatcagtaaggccttttgctgccgagagctggcctggcacctacacctagaccttggggttctcctgttgaccataaacaatttcactgaatgtcaatgccggacaaaaccactctaggaccctgatagatgaagacaaaaacaagaccatttcaacatcatgaattcagacaaaaacaagaacattattcaaaatacaaagatgacttaacagcccccctccctccacctcttggctgatgtgagtgatggctgcttctttaccaattacaactcttatcttccttcattcctcctgccttgtaaataaaatttatgaagtacccaaccagagaattacacctacctccagtctccaatccagggcaaagctctgcttccttgaaccctcccccaattaactaacacaagcccgaatcctacagtgaattatttcttaccttcttactgagacactgcacagctccctgtggtgtgcattctccctcactgccaccagtcagcaaacccaactttgttcaactacagggaggtccatggtggtcattggccgggggctgacactgcctctagaattatacgtgatgatatctggagaacacttagaaatagggcttagtccatagtaaaygcccaaarcatgtcagtcatgagcatgacatttattataagaaatacccttcctctttggacagagctaaggagcatacatttgctctcactaaccagcccccttcttttctgaagtccatgcagttcccccgccccttatgtttgccctgggcactgaagcattctctttttgcatttcacagatcttcacactgcagacctcaaacctagaaaaatctgttttgcccatgacattggaggctgttgtctgccctgtctctgggatcccaatgaaggacatcctctcagggtatttagacagcatagaggggtgggagtgggggctagatgagcagtggactgatgatcaggccttggcggccctttcccacttcctggcagagtagatactttgcacatggaagttccctcacccacttgccagggctgtgcgggccagaggagcctggccagattcttcatcacaaatgtactcgcagctgcatcagtgagggacagccccagggaccacagagttcttccatgcccactgcygctaattagagataatacattaaaaatacagagccgcatctgttcgttgtaacatgggtatcgaggaatttacgtggtttataatgacagagtgtggggagaggaaaatgctgattctgtctgggagccagaggcacagctgtgggcgaagagctggaggtgtggtttctggtgcccatcaaactctctgggtgctaaccaagccctccctttgagacacccagggatagatccaggtacttatctggaaataccaagctaggtaacatgaccagtcaagcacaaagtggatgtccagatgcccaggaggccttctggcccacatgcaaaatacatgtcccttccacacacaaaatacaaatactctggtatttgcaaagagttcttgagagaagggagacacaggacagaagaaaaaacatgcttctcatgattcaattgttcattttccatcaaacatgaactgagcacctaacctgctgttcaagttgtctgtaaaatggggtgtttaaagtaccgctctcattgaatgtttttcttaagtaaaataattgcattaaatggcttcaaacagtacccaaatcatctaacacaagcccaaatcctgcaatgaattatttcttaccaggtatgatgtaggcattcaataaaagtgtgctattatcattctactccatgtgacgcattgtgttaaattttagagcactgtgatgaataaggcaagatcccttcccttctctaccagttgaggggacaaacagttgctataatgtgctgtgcattgggatggcattgtatgaacttacataagctattatgggaacacacaagggagttggagcatcaaagacagcttcctagaggaagggatacctgacctaagtctgtagaacaggttgaagtctaccagacctaaaaggtaggagagatgagaagtatgtgcaaaggccctggggaggagagagtgtaatgtttctggggaaaatgcagtgtagcccgaccttagggcaggtgcgttaggtgtctgttgctgtgtcacatattactccaaagcttagtggtttgaaacaacatttattagctcatattttctctgtgttaggaatgtaagcgtagcttaattgggttctctggcttagggtttctcataaggcttcaatcaaggtgtccactagggcggcagtcatctcaaagctcaactagaggggaggacaagcttccaagtttcttcacataattgtttgctggattcagttcctcagtgctattgaccagagacagccctcagttcttctccaaagggaagctttcaacccagctgcttcatcagagcaagccagagagtagagccagagagagaggataagacagaagtgacagtcttttataacctgatatgagaagtgacattctatcactttttctgtattctattctttagaagcaaatcactaggtccagcccacacacaaagggaggggactgcacaaggacataccagaagagaaagaaatttagagtcatttctgaagctgcctatcacaatctaccctctggctctccaatgattcttgtcccttccacatgcagaatacatgtcccttccacacacaaaatgcaatcatccttcccaaggtctctaacatctcctcccgtgggagcaccaactgaaagtccaggatctcatcatctaaatcaggtgcaggtgtggatgaggctcttgggtataattccttaagtacaagttctagaatactgttactacagatttggtgatttgaaaagctaaggagataaattatctgccccccatatgcccaacatacaatggcaggttaggtatagaggaatggctataaacactgctactcaaagggaggaaaatgtgaggaacaaaggcgtcactggtccgtaacaattttgaaatccagccaggaaaagactgcaagtttcttggttaggtttcaaagcctggggataattctccatgactcttagctccaccttctaagctcttggttcttccctctgagtaatccttcctttttcatgaaaggaaacctgtgtttaaagctgacttgttttctcagcctgtttcctgctgagaattttaggggtccaatggcctcattttattttgtactgtctctgttcctttctgtcccagctgtgtttcttctcataggttttctcagaaaccttctgggtcttctgtaaattgcactgagattccctctattacacaaaaaaacaaacccacaaatttctttgagaactaaacttttcaacctgagcctcttgaaaagatggccaagggacagccccttggcttcctagagtccctattgtttgatctggaggatctatgaggcctaccctaatctctttaaagggcctttgtatgactgaataataccatgatcttttgatctttctgaagtcttaaccaaaggcccacagtcacacccacagctttatctcagaccaccatttcttgctcaaatgccatttcttaattttagcaccttttgctgacttgggagactgagaattttcaaaactatcaggtcctgtctcactttaacttttttttttctctcttctcacataagcagtaagaagaaattattttcaacactttgcttggacatctccatagctagatcactaagtttattaggtacatattttgctttccatgtaactgcagacaatagtggcactaagctttctaccactacctaacaaggatgtccctyctccatgatatggtttgcatgggtcccccaaatgtcatgtgctggaaagttaatccccaatatggtagtgttgaaaggtggggacttaaagaggtgattggatcatgagaaccctgtcttcatgaatgggttaatccatccatggattaatgggttatcacaagagtgggactggtggctttataagaacaggaagaggccaggcatgatggctcgtgccgtaatcccagcactttgggaggctgaggcaggtggatcaggagttcgagcccagcctggcaaacacggtgaaaccccatctctatgaaaaatacgaaaattagccagatgtggtggcacacacctgtagtcccagctacttgtgaggctgagacaggagaatcacttgaacccaggaggtgagggctgtagtgagccgagatcacgctactacactccagcctgggcaacagagcgagactccatctcaaaaacaaaacaaaagaagagagacctgagcaggcacatcaacatgctcagtcctctctgcagacagtcctcaccaataagaaggctctcaccagatgcagccctttgaccttggactcctcagcctctgtaactggtaactgtcaaataaatttcttttctttacaaattacccagctttagatattctgttacaggcaatagaaaatggacaaagacattctagtttccaataacatgttcatcacttcttttaagcccccaccagctgtatcctcaaagtccagatttctacagtgtcttcaattgtctttgaggcaattgaagatttctctaacaagcttctcagaatacttctcacctctgcccactgcctggttccaaagctatctcacatttttaggtatatgtcatgatactatccttctcttgatgccaaaatctgtactcatcatttcagtttgtaacaaattatctgaagccttagtgccatgaaacacctattagtttctatgggtcaagaatcaggtacagtttagctgagtccgtcacaaggctgcagtaaaggtgtccactggggctgcaggcatctcaaaggggagtgatccacttccaggcttacttacggttattggcagggttcagttccttgcaggctgtttgactgagggcctgagttcctcactgggtgttggccagaagccaccctctgttccttgccacatgagcctctccatagggcagctttcagcatgtcagtttgcttcaagtgagagagaagaggcagagagagcggtcacagcctttcatagcctaacatcagaagtgaaatcctatcactttggccaccaggtctagcccacactcaaagggaggggattacacagagtgtgaatttcaggagttggagatcactgggagccatttcagaaactgcctaccacggtgaatatcagggacagcacaactakcaatgccccagtggcctgattatgccatgtcagactcccataggtgatggacaaccactgaaatatttcaccgttgaaggggagacatagaaatgtcacccagcagcctgaacagagaaagcaytggaaatgcagcactgggtagggagagctgttgcaatgcaactacctcaagggatggcctcataatgaaatgttcattgtgtcactggtaatccaacccagaggtcagggccaacctgaagggtcgtatcccctttgggccctgggccaagctttwtctcctgcttgaagctatcttcttgtgtgctgctcttgcctyttgaacccatcctttagagaccaaggcaggcaaccccattcctagggcactgcttatgcatcagatgccacttaacgatgatgtcccaggcatttcrtttattccctagcacacctaaggggcaggtactgtttgatggaagtgtgacaagtggtcacatgataggacaaaggggcatcaatgcctttgtgacctcatcctggtgacctcaccccatccacagacctgacttcctatcttaaaggcccaggaattggacattttttgccctcaaataattgatattttagtggaagctaaaaccaagattcctatgctgctgtgtggcccggatgccagttgattgttttgcaactgataccaacttctctgttggaatttgagggaaacccaataaataaatatacttattcccctctcaagtgcagaatcaattggcagatgcaagagaaaaacagatgaggatcagcatgtcacctttattactgatgaactgattggagagctgtctgaatatgctctgcagctagggcgatggggagagagagaaagggagagtggggagggctaactgagcatggtctgctcctcctcccaaacccaccagccagatgagccatgcctcctacgcagagtgaatgaggggctacaagaaggagaatttgtctgtggtcctgggaccaggagcatcagtatcacctgggaactttcagaaatgcaaattatagatccaactcccagaaatactaaatcaaactctgggggtaaggcccggcaatctgtgttttaataagccctgcaggtgattctaacacaggcttaaagctgagaaccactggccttttgggagttgttccccacaaggcccaggaagaagtattcccctggaatattttgccacccgtgcccacccatttcctccatttcctgagaaaacatatcccagagataggattcacagttcccacatttggtttttagcttccagctgctccaaggaataccaagtggaggcttctcattatctcccttctttcctaagggaaaaaatgccatggatttggtgtcttctttcttgcaatcctttagaggggcagaggggtaatccccttgttggcacttgatagtctctgaagaccctagaatgatgagtaacacaaagtcagagatggaagcacgtggttctccactactgaaatctctctgtggctctcagttgcacttagatttccacataaaccccttgccaaggccttcacccttccaaacacatctcgcccatttgttcacacctccagttgctccggcctccctctgtccctctaatatgccaagctcgcttctgcaaggacctttgcacttgcttccctgctgcttggaggactcttctcttacaccttggcttgtctggctccttcttgccctttaaatccaaacccaaatgccagctccgcagaaaacttctgaccatccatttcaagtgccctctatcctatctatcatcatttatctcattacccacgtttattttctagtgagtactttaccctatcaaaaactgattcgatatatgtatttgtgktgtttgtttgtttgtttgttaagatggagtctcactctgtcacccaggctggagtgcaatggtgcaatctgggctcgctgcaacctccacctcctgggttcaagcaattctcctgcctcagcctcctgagtagctgagattacaggcacgtgccaccacacctggctaatttttgtatttttagtagacatggggtttcaccatgttgatcaggctggtctcaaattcctgacctcatgaaacacccacctcggcctcccaaagtgctgggattacaggtatgagccaccgcgcctggcctatttgttgtttttttaattgtctgtctctcctcacyggaacgtgagagatgaggaaccttgttgtattcccagcaccagaatagttgctgttatattgcaggcataagatttatgtaaatatctgttgaatgaatgagtaagtaaattaatgactacatgaacacagaaaaacggttgaggagagaaggatcagagttgagtgattcagtcatcaagatggtgatgggcctgccttcctcttctcaaggacaggagcacctgaggccagctgagtgggcctggaatgctggcaccacaccagattgtccatctactttttctctcacccattatcttaggtccaggctcccccaacttctcctcctccttccctccctctctctccattgtcattacattacagtcattagaagccagcagattcagaccctcctattgtctttttcataaaggactgttaatggagttagttttcagcaggggaactgcaaactcttgtcaaaactctgacttggccacccacattcacataattaatcacacaggaaaccagaaaggggtggcatgagagctggggcctagctgtgtgggggccctcttcccagagaggagtgtggtacatcacacagctgctgcccaccaagagcccacatttcaggctggaaacaagacaacccaactggaactactactgggtaatacaaatcaggatctaattagcactggacggtgggaggtggccctccaccttcaagatgttggtaacaagagattggtaacaaaggaamggaaattaaatggggaaggtagaggctggagatagaaacaagattaaagacagtctcttctagaattataaggaagagggcatttattgagtaatgtattctctattgctgtgtaacaaattaccacagacttagtggcttaaaacaaaatacactcatatggtttaaacatttatagttttaaacttacatttatacagtttctgtggggtcaggagtccagtaacagcttagctgtgtgcattgcttcaggccttggtcagccagggccaagttctcatctgctggcttgactgsggaaggattcacctacccacttgtgtggctgctgcartattaagttccttgtggttggtggactgagaacttctgtttctcactggctaatggtctgaggccaccctcagcttctagacatttcccacagttccttgtcattccttgccacatgggcttctcaaacttgaccacttacttcatcaagcagcaaggagaatccctagagcaaagtggctagcaatatatagtattatttatcatcacataatcacagaagtgacatcccatctcctttgccacattctatgggttagaagaaagtcacctgtccagcccacacttaataggaggggattatacaagggtgtgaacaccaagaaaggaggaaaggattatggaacagccaccctagagtatatccgctatattacctattagatttaggactgtgccaaatacttttacatgtattacctcagttaattgctaaaacaacctgtaaggcaggcattatcctccttgcacagataagaacatgaggctcagaggaatgagaacttgccctaagttctgccaacattaaggtggggaccaccatatcatggcatcaagtgaacttgtatgagtgtacaggctggagggccagcacccttatagtaaggagcaagggccccagggaggcagggagrgggcaggaagagcaggagggggatagctctccgtgaggggtgagaccaggaggaaaggattggtatggattacatttcaagaatgaaggaaactgagagcacttatatctgaggatctctattttctcaatgaagcagaaaatgcgggcgtctcctgagaggsaagagaagcagagccaagttggaatagcagctgtggggaatgcggaacgggaattttgccagcatgcctacaaagttgtcaagtggaataaggctgcttccttcatgaagactgcagcacaggcttgctgggtggtccccagtccctcccccattactttctgcattcactttcatcatcttgctttgcagtgctgcaatttatgcccaagtccatctctcctgtcagaaggaaattttttatagggcgggaacttagcagtagtgcgtaatgtgcctccctgtacccagcaaatggcctggcacatgaaaatcctccacaaatgacctgtttgattccagaccctgaatttctaaatcactgtattacctctcatcccctaaaggctcatgcagttctaaaagactgttcaaaaatatgtatttttactgttcagcgcagtagagtagaaagtgtaggtccctctatcatggaataggggtccttagaggtggagttagggagatctgttgcatgtataaactggtgacaaaaaagcagctttgcattttggcccagtatttttgatgtcaagaagtcagaagaaccatttcaaaatattccatttcaatctttattgattggtatggaatgttgcctacagtatattcttgcctgaaaaatctagttaccagacagacacttacagcacaatcccatttgtgtcaaattatagtcaagtaggaaaaaacctaagtcaaaccatstcagggaaaaaatgaaatgtgttgttcatcttcaatgaaaagtttaggagactgttctgatgccacagggattctagcatctcggcctccttcttgggccctatgagatggcaaatggctgtccacattccctggactgcggtgtcccccaggactccttacacaggtccagaggtccaccctgataggaccaacttgggtcacatgcccaccactgagccaatgactgtggccaaggcgatcctgccctcttatccagccttggtcacgaaagggagtcagagtgctatgaacaagaggaagaggagtggaggccacatattatacatctatccactgaaaaacgattgatctggttccccagccccctgctttttttttttttttttggtaaaatctgccccttgcctcctcctgattagggaacacccctgggagttcaccctggccccactgagcgtatctaagtgttgctggaaatcctgggttccctcaggcctgtctcaactcagatgccatatgtttctcctggggcctcaagtgtgagcttgaactctaggccttctagccctggcagtcttcccagtcctgccactgcttagcagagtcagacgtcatgttcctgaacctgacactgagtagggtcctctcacctggatcaccactcagaaccacggtgcttctacctccatgactgctgctactttacacctggaggctcccacccagtggcccaagtcacaccttttgtttactgctgacacttctctcaaagccagcccttccctccctttccctcccctccattcccctcctttcccttcccttcccctctcttcccttcccctccctcctctcctcccttccccttctttcccttcccgtcctctccgttcccctcctcaggatcagtctctcctctaccaagccactccctcctccacaaagcatcagtcacagctactctaatgccacacatgagaccaggaacaggaaatacggttgaatggcattttgttttttcaaactggatccatcagctctgcctgactcttttccctctgcaccggtttctagctgacattcggtrcttcttcctggcattacattgtttacggtagagttcaagttcctcgaagtacttagctctcaggagagccactctttgctcataagggtgcttctccaggtctgtcgctgttgaccacatcttccctgtggccttggccacctgcaccaccgaccagttcgggttctccctcttcagctgagcatagtggtcttggcagaagagtaggaaggatgatggaggccgtctgggtkcctggggatcccgctttctccgtttcttcctcttgccaacataattcatcatttcttcctggtatcgggctttgtcgagtttggccagggcttcatatttggccttttcatgctttgagatggatctccatttttccgaacactttctagagaactctttaaagccaacrtaggtatttggctgctgctccttgaatttgtttctgtaattcagcaaaaagtgaacgtaagaagagacatttgccttaggctttagctggatttcttttcccatgttcgtaagttcaccttttttctggattcagtaacgtggacaggagagactgttgttcccacactccaggagcaatctagaaagtgctgtacttgcagcgaatttttctgtctgcaagagctgtagtcagggctcagccttttcagtgctgatggcattgttgagtcagaggagggaaactgtgacatcatccacaagccagccaatcccagccarcacctgtgggcatttgtgtacaggtgctcgtattggttggttacttgagggtcaatgtttgcctctcatgaaagatgatggttcattcatagtaggctatgaggcagctatgtcccccagaaataattctccttggcttcctggaggcagtgggttttgctgcactttaggggcttaaaatccctaggctgtagtgacaggccatggggtctgccttcctcactatacgattttcaggatgcctcatcatcccttccaaagacaggctgagcataatgaacatggggaggtggatagatccagggctgtcatgataaaatgtgaagtgtttctgtttgccttgaacagtggcagctcatgccatacaaagggtttagtagtaactctaaaagtaatcaggtatgacagctgtgacttggttcctgtcaggacaaagttgtctaatttaaaacctgagcacttgggctatgagttggaactcttcatttctctgaagaaatgtgaggcgaaagaggggggagaaccttgagattttattaattaacactggagttcatgaaaatgaaatggaatttgtagcacatccagaagcctccccactctcatgtgaggggtccccatttcttaggtttagaacacaaagctgtaacagctacactcaaactggccggcttctggcttttggtcaaagtaattgcagatattccactagtctttcaattggagggaagagaaaagatgaaaaagtgtcattctgggggcctttggacactgctaggtacttgcctgtgtggcactgggtttaatatcacttaatggttgatgatagccccaaatttataggactagaaaactgagtttcattaayataaaaagtaacatgttcaaggttgaacagccactcacaggtgagagtgtggattttgacrgctgattgcttgacctaagcctgtgcttcatcctgcctgcacagagctgttgccagggcactgagggtccagatatgtggtctcagcagctgagcyggacaaggaaacttgcctaagactagaccatattttgaatttttccaggttcattcccagggttccaagacttcagtgttcatcttctgtaaaagaaagatggaaactaataagagtctccaatcctgaattcttgcccagctctgctgcaaggtggctggcctacctaagccatccccttcctccctgtgagccaatgatctctcataaattgagcattctggactggccagggaagcccctccagggracaagctgtagttgtgtggcaggatttgggggcctataagatatcaggtgccatcaaggaagtctgggctagtagggggtctcgcaaaggaacggattactctggggacacttctcagcctaggtagcctttttccccctggctctttctcccaaggggccagaggttgactcacacattttttggacatgagcagggctgcctagatgaatgggacacagctcctttctgagatcaaaagatgggacatgaggaagaactttaatgaaagtccacatattcatcagactctgctcaggctcagacacacacacacacacacacacacacacacacacacacacacacacacacagagtagcttatctgtgcctcttaaccttccatccctctcatgataagatccaggaagattaacccacaatagctatcgggaagctagcagatttaagaagaaaaggcagtaaaagggaaaagctatgtcaaccttttggtgttgtcaaagttccaacttggaggatgaagcaggggaagtccttgtttaggggagcttaggaaaggtaaataaatctggcttcctaaatcaatgctgtgtgctgggtatctaagagttgcccttccagatcccctttccagccttctccaacctctcttcaaccttctctggcctgggaagctggtctgtatgagccacatcagaggatcccataccctctgrtttccatctcactttggtcaatggggccctccacaggagatcagagatggaggaaagttaagtcaaggcatttattctcctggatccccaccccagggtcacttggagctggttctgtgtccctggactgaaggtcactggtcctcataaggtgtcctctctaaatgactctctccttccagtacaggcattgccccctttctttatctcctcctgcctagggtggtaaaactctacttttatgagcctctgaggtctctgctactttcccacactctgccctcaccaatcattttaatttgagtggccatctgtttcctgcggggaccctgaccaaagtaccatggttttagcctttcaccatgtaggcatcagtttaatagagaagagtaatgagcttctggagatccaagtgcctggcagtcacacagcctagagcaagcatgcctgcaaggacagtagcatgaccagaccacatgcccgggaagaggtgtccaatattccctagattatgagatgacctccaggcaggagcattggtctagagggccaggtagtaaatatgataggcttggtgaaccacagggtttctgttgcaggtacccagctctgccactatacctcgaaagtaaccatagaaaatacctaaaccaatgagtgtggctatgttccaataaaaccttatttttaaaaaatargctgcaagctgggggtcgtaaatctgccaactcctcgtctacagatgtgagttcagtattttcaaacatcttgattgcagtctgcaataagaaatacattttacatcatgactcgtttacatacatacatacttaatatttatataatgcttaatatgagccagtctctcttctaagcactttatgtacctcattccattcagtcctcataacaagcctatgggagggctatttttatctccatacaaggataagtgaattcagatgaaggtagcaaagcacagagaagatatagagataaaaaatttctacttgtgtgacatactcttattttctactctgttgtagtcacctttactttatgttgttatttaaaatgccacccacagactgacctcatgacccactgatgggtcacactccaagaatggatttgaaaaacactgtccagacaagctgagagggagcttccgcctcrgagactgtgagatcctctttacttggtggcagtaacatgaagtggaaagaacatggccttttaagccagacacatataagttcaaattctagctttgccatttactagctgagtaactttgggcaagtctagctcattacaaccatatctctaaaaagtagtgaggtgataataaagccatgaggattaaacaaattgaaatgataggaataaaaacagatggcactccccctctccagtgtgggctggacttagccacccactactaatgaatagaacatggaaagggacaaatagtaactttacagcggggaaatctggcagacaccactttaaccaagtgatcraagtaagcatcatcaataacaggtcatgttgagatcacagaacccctttctgtgttgccataataacagcatctcaccgccatgatattcttcccaaaaatccatrgccaaggtctatgaaaaaacattagacaaactgaaataaagaacattctaccaaatacctgatcagtacccttcaataatgtcaagattttaaaaaaccagggcaaggctaagaaactgatgcagattkgaagaaaccaagaagacaggacaaatgcaatgagagatgctagactgaatcctgtgacagacaaaaagtgggccactggtggaaatctggggaaatctgaataaaatgtttcatttagttaatagtactgtaccattgctgatttcttagtttttatgcatgacccagggttatgtaagatgccaacattagggaatcggggtgaagggtatacaggacatttctgtatgatctttgcactcttatttcaaaataacatttttttaaagaaaaatctttccagttgatagcaatgtgcagccagggtaaagacaccctgctcttgatccatcatctccrggaatcacagggccagattttaccctcaattacagcagcatatgctcytagcatatctctgtcaaagtatctctcagattttgcagcatgatggaatcacctaagctttccaaaaccctcagtgctcaggccacagcaacaacagcaaacatacctggcataagcatgtgtatgtcaaatgctttgaaacttccttcatccccctcctgccccttcctctgtggagtgggactcactggttgcatttaccctctgaacaaggcatctgcaagtggcagaagaatgcctctccaaagatgctggcgtcctaagccctgaaacctgtgaatttgttccttacttggtaaaagggactttgtagataagattactctaaggatttagagctagggagatgatcctggattatcaggtgggcctgatagaatcacatggcctttgtaagaggaaggcaggagtgtcacagtcagaggagatgtgatgagagaagcagaggatcagaggtggagagagatttgaagatgctacactgctgatattgaagacaagggaaagaggccacaagccaagaaatgcaggtggctactagcagctggaaaaggcaagcaaaaggattgtcccctagtgccaccagaggggctcagtcctccccacaccttgatcttggcctgctgaaacccattttggattctaacctccagaattataacacaataaatttgtgttctttaagcccttaaatgtacagttatttgttaaggcagcaataggaaactagcacagtatctttctcctctggctgctggtctgtaacttttcttctgccattcttaacccctgcttgtgttaatgaagaagacacatttgagggtgaaagttttataccacggcatattcaatttgttgagggaaaagaacatgatatattcaatcctgcacactcttcttcactcgctgactcattaagtcactaattcactaattcacttagcagttaattcactcttacgttctttcagttcattcactcactcatgtactcacacacccatctcaataaatagctgttgagttgctggagcagtgtggctgctgctttgatggccagtgatgaacagtgtttgagggatggatgtgtcccaggaaggagggtggtagtccagggaatcatctgaattcacttggatcgctacatagtaagaaaccagatagggaggccaggccataagcagtcagtccaaggctctttggcactgacctcgtgccaggaactgttaatcaatcagatgtgagcacaatattttaataaaaatgatgatcatactttgggtacatcatctctggaagcctggaagcgtgaaaagagagattaatttatccaaggccacacagcaataagtggcagagccaggcttcgaactcaagcttgtttgaccccttggctcatatgtttagcctctactggtagtctaggaactcccttggctggggctagggtaaggaagcaactgggaaggaacaaggccaagtattgcaggaggagggaagaaggaaggagaaaaagttatctaaatttcaacgtttaaaagattcaggtgagtcttttctaatctgggttgatcctcattctggatagatctagtcaacttatctctaggtcatgggatgttctaagtccaggaggtcaactgacttggatgacccatagaacttcaccagcatctgaagataagcacggagcctgcatctactcccaagggcagaggcttgccaaagccaggcgaagtgtcagcacccagcccaatggactagtgggcaggtgggcaggcagtggtcagatgattagacacagaatgggatcagcctggttgggggatgcctggctacctatgaaaggatacaggacagatctagaacaagaccaactctgggttgataactcacacagtgatctatggatactcctcacaggtctttaaaaacctactcctttatagcatrggagagtggccctgattattcagtccacctacttctctttcatccacagtagacatcttttgttttgtctgcctagsactcctcacttcttttgagcacattccttcttttggagaattgtccscaaactagtcatggggttctagtggaggctacctccttggccccaggaatgggtacattccccagctaaactaatcagaggcctctgatgggctttttctaattagagtcacggagagagattgtcatctctctagtggtgaaggtgagagagtgaatcacagagctactaagggtggtcatggctccagcctcaagcagccgccatttgcagtagagagaatgatgccagcaggcagagcacaacagagatggggcaccgagagagggcctttgtagcatctgagttcttggttctggccatccctggggccagctacaactctactcttcctatggtttagctacaatccatagcagccaatcatttcttctgtaggtggatgtgatctggatttctcccatctgaaagccaaagtataaggcattaatccaggtggacggcagcaagcaatacaagaagagaggaattctcctctcccccatttttgatgctttttgggcacatgctatgtgccaggcaccttttatatgcatcacctcacttaaaccttttaaccactcaatgaagtgggtgctgttattatccttactatatagatggggaaactgaggcctaaagcaggtcagttacttgcccaaagtgagacagtaagtttagagctgatgatacttgaacccaggcagtcttcttctagggcctgcgtgctaagtctctaccccaaattagtttctactcagtaaatattattccctttgcctacgagtctaccttgctgtacagagatatggcagggccaagaattgtagatgtcgtgtcttgaggccttagagggaactttgtgagcgtcactcacaatcgcactatgagatataaactggggaaagaagggctcagagaagtgaagccacctctccaaggtcacatggccagcagacaatgaaggcaggattagaactcagctccatgggactctaggaccacttgctcactagccttagtgtgtgtgagatgtttagcccacccatcctccagctgttgggcagctcactcattcttctggacatcagagctgctgatctctggcagggaccactagctgcctcctaacaggggaagggacatmcatgatgctcaaactcagagtggcagttaagtggcaggcacacactgatgtgggcagctcctcaagaagccatttacaacagtccctctgggtgagaaatagtactaattacaagcagcggaggcttctgcaaggcaagcggtgccaccctctatggcaggaagcaggttccttctccaagtcatgtctgccagtgacaggtggaaagtgggcaaggctgggaaagcaggagccagtgsaggccaggctggggttccccagagaaagagggaagttgatggccaggtgtactggctggtctgggtaccacagagtgccctgtccttctacccctgcactgctctatcaccagagtagatgcaggtgcctcatttccctggagaaaactaagccaggctgctctgcggtctactctgaagggttgggttcaaggcattggtaagatcccaccacctcttctcaaaccccagcaaggcagggggaaaatagttcacatttgtgaggcacctactgtatgccaggcacagacttggacacattatacacatgagcactgctgctcagaggaatcccattgcacagatgaggaaactgaggctcagagaagttacgttgcatgcccatgttcacacaactaggaaacagtagaacgcagattcaaatatagcactgtctggttccgaaggcctggcccttaacccttaacctttttaaacctattgcttctgtgaggaacaagacaggtgatgagccagataggtgtcatctttacttaggcagagactccagtcaggaagaagaagagggttgagtagagttgagtgtgaatatgctgtagtcaccacgctcttgaggcctgcaccctgtttctgggccaagcctgatggggataggctttaacatcctagagcatggaggctgccagtcctcaggactgccttcccggatctcagatctgacatataatagagacttgggctggggacaggggacagccagctaaagcctcagcagctggtcagagtggagactgctcttagattctgtccagtcagactgactcctggaggataaatgtacaaggttcaggacatcatataaaagtaataagggcaagttggggaggcagcaacagaagtggaagaaatgatgctaggacaccatttcccaaatctcccctgggaaagccaagcctgtggggtcttctcctcattaaagtgagtactcagcccttctctccatccaaacctcaaatgggggccatagggacctaccttcctgatagaagttccatcagctcattggcccagcttgggacacatgaccaccaggatccaatcagctgtagcctatgggtcatatgatgtacatggctacccctgtcaggagctgtgggttgagggaaggagactgatcttcaaaggcttctggtcttcataagagagtagaactgcctgatttagacctggagacagtaaaggacggagtgggcaactcagaaaagcagctggggatccacccacaagcctcttcacccagagcttggcatcagcaccagttctgatcttcagacccaaccctgttctgtcacttcagcacgatgggaagatcctctctatagaggcaggaaacaccttacccatcagctctgccagctgagcagctgagctagcaatggaaggaaactgacacaccaagccacccctagaccttcgcaatatgccaccaccccatacacaagacccagcgtgttggtgaggaagccctcatcccggcaacagccaggctccctgttcctcagcactccaagcctcagacatgtgtcctccagagagccgtgcatctggaggaaaaacatttacctgatgtggtttctgtgggttccctggagctaacaattagctgagcaagaaagagttctgataatttgttgagtttattgagttgcttctggggaaaggggaacatttgcccacattgattagcagacctcactgttgctgctttggggataggtcagcatgagaagaatccccaggaaggtaccagcagctgctaagtgaagcaggtagtggggcacagccagagctgaggaactagractggggaagcatgtcttgacaggagtgggcagtgccatgggaaacccgggtgaagcccgcgtggcactggaggccctccctcctattccctggctcacctgctcactgcctctttctctgcttttccccacatgtaacctctgctttcaccagcaggctctcattcattcattcattcggccaatcatcccttcttccactgagtgatatttactgagccctttctttatgtcaagcactctccaaggtaccaaagaaagaaacagctcctgtcttcagggagctcatagttcagcaatgcatggtgagagaagcactatggtggagaaagtgcagggtgcccagaggggacaaaggagaagtaaaccagacctagcaacaaaggacaggtttcctgagccaggggctgatacacctgcacgatgagtaggaagtagctaagaaaagaatggggatggatcaagattgggagagagaatttggcaagaaggtaaattcttaattgttgggaacattcaaaatagatcataattgaccgtttttcaagaatgctgtggttgagactcaaatatagctgggcattagacctagaagacctttgaagtccttctcaaatctcagattttaaggttagctggttcccactctcctgatagcagaggggatgtaattcgatatcccaccactgaaagtaagctactgctgtttgttcatttattcattcattcacaaacatgtccaataaaagtgttcttaacccaccctgcctcccccaaagaagccagctggactacccagcactcccatggcctcagtagatcttcctgactggtgcccatggcacccccagcaactgctgccaacaggcagtctcccacccccaccctcaatgcctgtgcacttctgctcctatcagctgagtcttgcactttccgagattcagttgggtttgttgccaagtctctcagtgccagtcatacttgttattgtaattatgtgatttaaattaaacatcacataaactgatgaaatatgagtgtgaaaggaaatatagttgcatctatggaaactaaattgaatgctttggaatgattccatgaaggagagtctcttaaaagaattgcttactaaatattaggtgtgagtgaatgagacaactgtaccccactgggtaaattacatgaggggagggggatgggacaaagcatccttatcaccttgatgagaatggatgtcaatttctggcacatagtaggtgctcaagaaatatttgttggctggacgatctgtagcaacatttgaaatggtgaatgatgcattgtggttgtagtttatataagacagwcaatgtggagaacaaacccatgatcaaagggaaggccttggtcctgcattaaactgattggcaaataaatgtatgcttaagtgttttacattataatgaaatgttgaagctacatctgtgtccttttttatgattccctacttagaaattaaatttttatttaccaaccaactacatcatctgtgaggcttctatggtaggaattagcaaacttttttttctgtaagaagccagaaaataaatattttgggctttgcaagtcatcrtcttgcacaactccttaactctgtcattgcaatgtggaagcagccacagacaatttgtaaatgaatgaatrggcatggttgcaatctggtaaaaccatatttacaaagacaggcagcaagctatagtttgccaacccctgttctatgaaatgtatttgttctgtgtgccaggcactgtgctgtgcaccagagatactgagacaaaaagaagattttattccagctcccatggagcttgcctgctagttgaagagatggtcaactcaaaagatgagtacaatttggtatgcccaggatcatggcagggccatgtccactgggggcagggagagggagagatagaggaaaggaaatatttagttaggtttataggatcagtgatattttcccaagtagccaggtggggcaacaggaaaagggcattacaggyagagggaatagcatgtgcaaaggtctggagacacgaaagtactagtcgcattccaggatgtacaagccattctgtgtagctggatctcaaagtgtgtgtcattgaagaggaaagacattaaaaagcttggactttattctggagccagtgggttcaaccattgctgctggctttccagcaatgcagggatttgatcaaaattccccacaaagtatggaagatcgatcagaggcagagggcaaatcagaagcccatctctgtagtccaggtgagaaacgatgaggacatgaaatggagaagacttggccacaattggcgataggggtgaaggagagtggggagttgaggatgctgcctgggttgggtgaccaggaggatggtgtagattagggggagcagttgcactaaggagcagaaacgactgggggaaagctttggtttgttcagagcatagtaaccaaccccaaacacatactaggtagccgggaattgaatctttaaaggctggctcagatctttcagagctgtccacacaaccagggtgggcaggcactgctggtaaaaaaaaaagccttgggaggctgaggggcctcttttcaaagataaggcccagcaactcatattcaaaagaaacttccatttgtcccaggcattcactcagttcctggaaaatatataacatcatgggattgtcttggggaaagaatttatcttgacatagcaagtcctaggagtttagctaaaggaaaactgattttggaaagcattttgataagaatgggtgtcaaggctgagtcattaaaggtttgcttcaggaatgagaggtggcttaggtttggcagaggagggatcagcctcaaacaagggccttgggactatttgcccaccactgacaaagacattttcaaaagggtttctctgattgtatcctggtgtcctctccattcatcagggaggaaagcaggtgacaggtgggaagggaagagggcttgggagtggggataaggtggtgaggacctcctatatttcacattctcctaggccagccttggggatggggagggatggtttatacttagtactgggatgcagaagtgcttcaactctgaatcagaccagggccatgcacatagcttacttaacagataatgcccacaggagatgctctgggaggacagaagccagatgctattgatggagaaggaatggaggctgaacagaaaagaaggcattgcagctgaatcgtgtacattacaggcttttcagggactccctatatctagggaaccacagtgggagtggccctcacttgcgagcacagtgccttttacaaaatatgtgcttggtgattgcrtgaatgaatgttctcctgaagatgtcagttttcagggatgctaagatttaaactaagatctcctaacactcctccccctcgacttacaattaggcagcaattccttgcacagtcactgttgtcatcttgatgggggtatctctcagctccccaacatcccgactgcatgagaagcttcttaagaagaaatgcttcccacaaaatctkctctgagctcttcttcatgaagggaatggctcagagctttctgcagaggagctcaaagccacttttctataatcaactacatgcattacagggagtgatttttttttaattctycccaagccagattccattaatgaagccccacttaacagaagtcaatttaccaaaaagaaaaaaaaaattgagtgtaattgcttaaatacattttatgttgtactgcaatagcaattttctgggtgaacttggaattccccaagccccccgtagtgaagttaatgtggacagaaaggtttgaaagggagaatctctctttgtgtttctctcctttaattatgattctaagagggagcaaaattaaagaggatcctgggggaagtcaggaggggggagaagaggaacagaatggaattcagcctaaatgattccactgccttccttcatgcttgcatgtacatgtgagtgtaatgcagtggctgaatgcataggctctggatgggatggctggatttaaatcccacctctgccacttaatagctgtgtgaccatgaacaagtttctttacctctctgtgcagccaggtggtacagtgagaaaaggcataaagagcatcaagggcaaagacagagaagcacaaaagaacaacgtgtattcctgaatacatgaactcttctgtttgacgggagaactgtgtgtgtgtgtgtgtgcgtgcacactcagggtgaaaggcaggcaggagtcaaaccgggaaggcttcactgagaaggtgacatttgttcaaagccttggaggaagcgaggggctaagccaggtggagttctgggagaagtgccagtgtagcaggcagaagggatgtcaactgcaaagaccctgaggcaggagcaggcctggccagttttgaacagtgaggagatatctgtggctggggcataaagggtaaagaggaggaggcaggaaaaggaaaggaagagtggctttttcaaggccttataggctataataaggtcttttaccctgaggattggatccattgaaggttcgttttgttttgatttgtttttcactaactctattataatatagtttacataaaataaaattaccatttattttatttacctatttacttatattttggagatgctatccaaaatataagtaaataggtaaataaaatggggtctcactgtcttgcccaggctggtctccaactgctaggctcaagcaatcctccccgcttggcctctcaaaaccctgggaatacaggcgtgagccactgtgactggctgtaaattacctattttaaatgtacagttccttggagtttgcccaatgtgtacatctcatctaatcaacatctcatttgagatgtaagacatttccatcacccccaaatgttccttgcactatttcccagccaggcagtccccaacctttatctctcacccccagctctgacaaccactaatctgctttctctcactaaactcttttgcagagtttcatatgaatgagtcactcagtatatactctcagtatatcctctttgatggcccaacataatgcttttaagagtcatccatgttgcaggtattggtagctggttcctttcattggagagtttcgagcaaggcatgacaccatctcaatggcagagtctgatgtgatgattctgccatgtaagcccccaattctttgatagatgccaagaaaactctcaactgcccaacatttgtgtccagggaggtaggagcagaacagagtaaagctgcatgggcaacacagggccctgagagtttaagcctcggaaattaacagttaacaggatttctaggagtgggtaaatgtgtgggagaaatgggaggtgggagatgccccttagggcttctcctgatctcacaggccggggaagtctcactgacttcctgctgcaatcttgatcattaatctcatcctgctcttgagacctcagcaccctcccctcattccattttgcaataaagagcttttggtcctgaattattcaggtagattctccctacttctacttcccttatataaatagcctccaagctttgtcattgagatagaattgaatttggcctggagaaaaaaaaaaaaaaaacccacaatacgtttgtggctccttagaaaacttaaatgactcagtctgtaataaactattttaaatgggatctggtgaaatacagtaattggtttttataatagtttttaccatagcggtatgggttatattcctgaagtttggtgtgtgtcagcattttcatttagtaagaattcagttttgcagtgcgtgaagctccttggttagttcttttgtttaatgcatatttatgaagacccactatgctggatgtcttccatttgcacctccagatcctctcccttgccttctccttgctccatgcctgagaatacttacctaaggggctgcatcagtatgctctcttgctctctggcttccagttgggctagatcaacaggagaatcagtgggagactggaggaggggaaggaagagagtgagttctgcrtattcattctttgcctcctcttgatgggcttttcacaaattggctatagccccagattgtgaaagaagatctgggtcctatatggtgtcttcttacatgcagccccctgtttggagataactattttctctctgctccaggattgggagtggtaacaagtccctcagttgccagycccaggatactgcccctcccgggtggttcccccatagtcggccctcacctttatagttccaagagtttgatgaatgactgtttcacataggatataaggacctatgtgaaagagtatagagaaagggtataaggacctatgcaaaagagtcactcatcaaactcctgggactcttcttacatgactgtgacacctgttttctgctggaaccctgaaatgcctactttgtgtccagtatggtgttagaagctggaaatcaagatgaagaatggaacagcagctgccgttactgacagcttgttattgccagggactgtgctgagatcttcttttgtgtattatctcatttaatccttgcaagcttttgagggaggggtcatcatgatccccatgttttagataaggtcactaagtctcagagggtttctgtagttttcctgagctcacacagctgatccctccagagctcaagtttcttcactamtaggccacattgccccctttgaggagttatcttaaggaaaccacacacttctataactgaattataatttgaataaaatgttgtggcatcacagaggaagacaaaggaaaattatatttattaagctaacatgtgccagatactgacctcgattctttgtgtgtaagatttcttacttattcctacaaactcttagggctggtattactcctgttctccaaaaggttaagtaacaggtccaaggtcacactggtgaaacctggataagaacccaaatctgtgcttcaaagccaaggagagtagggaatgctttactgcagatgtgatacttaaggggcttcccaaagtcatcttgggggacatggatgggcaggagaaagcgttacaggtgaatatattccaagcagaaaaggcaaagaactagaaaaaagaaaaaggatggaatgcttagggaatttaagcaggaggtgctgtggtctgaaggatcagttgcctcctcccagcagctgagggaaacccagcagtgggatgagaccctggaggagccatctcaagctgctcaggcctagggtactggaggggcctggggcaacaccgccttcccttcctgctccagagctgggctgaggccttggcactcaagggaagtggaggaactcctgaatgctcatacacctataccactcagctctggtccctgagcccatctgcttcctgttcccacaggttcaccggagccagcctcccagcccccgttatcagcagcaagaactggctgcgactgcacttcacatcggatggcaaccaccggcagcgcggattcagtgcccaataccaaggtaggcaggtcccaggactgtctggcttcctcagtgggcagcagagatgacacctggagggctcatcacctctccctactgggtccggtgtggcttcaggcatccttgccttctttgtacgtttctwtttgcagaccagaggtctgcagatttgcatctctgcatctgcccttgtcttttgccccagagagggatgtttcccaaattatgtagctggagctgcccctcacatgccaggctaatcataatagttaataccagatgcctgctaagagccaggcacagtgctaggcacttggcaagtascatctcctttaatcttcatcattatcctgcarakgaaacacggtcatcacctcactttatggacaaggaagctaaggcccagagaggttaagccaatttcccaaggccatctgaactcctgccttttgagtctggagcccaccctcttaaccaccagcctttgctgacctctgcagcctacatttctactctttttcattttatctaaaacatgaatatattccaaaatcactttagggagcatgatagctttgatgctcaaatctgtgaagaactgtctagtggcaacagatcagaccaggaatggcaggtggagatcgcagctaagcagatttctgctgcaataatgaagaatttcccaacccaagaaccacctatamaaaggagtgggttaacccagaagcaaggagctgtctgtaactggaagagatccaaaaatccagctgatagatgggagcggatgagcacattccttttcgacattgcgtttattcaaagtactcaaaatttatagagataaacaccaagggttggcctcataacatgctcattaagcctttagctattaccactctcaaattgttattggttttaatagaatagacagcaagcttatattgtgtacctattaagtataaggacctgtgtgaagccctgggctccaaggccaaatgcctgctggctcaccctcaaggtagcatagggcagagtagtgccccctccacaaggctcctagggccaggctttctggctggaaactgggataaaagcagctctgaaggaagaagcgttacgttcaaaatctgaaccttttaggaacggcctaatttacttagccttgggtggtgtacccatttgaaatatctagaaagtaaacaagaaaccaacttggttcagtagcttaacaaaggcttaccctgagagctttcttggagatgttttttccactgctgaggttgggtctttgtgtgagtggaacagctgtctgtatctttctgctgtgtttctcaaaagacaaaagcagagatgaatgctataattgtwtctgattaagtaagtgctgggtgtttctaatatttcaagttactgagggcccatttgtcagtttttaaggttaaggtttgatgccagcaatgggcgacaagaacccaagcctggcagtctccagatcacacatcgattccacatctgtgcacaccaggccccgtgctaggcactgtatgtacattgccccactcagtactccccacagtaaagtgatacatttgtttttatttctgtttattttttctccagctgaggaagctggggctcagagaggttgtaactagcccaagatcacacagcctgtgagctgtaaagctctaattcattctgtatttgcagaattacagggcctcctctgatggtgctttgggtgtcttccatttcctattaaccgtagctttcaaactttgttttgctcatcccaccccactgtaaaaaamaaaatcacaacccagtataagcatatatctgtagagctaaaaggaaaatatgaccaagtggtatttactgtgtacaatgtagtctgaaaatgtcatttttatttttaaatgctagttgcagcctctaaattaattttacaaatctgcagcagggaacaactcacaatctaaaaagcactgttttagttgcaaacttcttgaaagcaggccctgttctctgttccctctatcatccttagcatagcccagaatgaagttttgcatgttagtgtgcgccagtgtataaagaggacttgctagattttaagcgcttggcatttattactttgttcaatcctaacagcaactgcgtgaaggagatactattacccgtcccattttacagttgaggaacgagagtcatagagagggtaactagctggctcaggtctcattaatagtatgtaggagccaggatttgcagcccagcagtgttgatttgggtctggcatgctcaattattgtgattctgttaataaatgattcttccttgaaacctgctttttctagtgttttcctgactgagaccgcatagtgcaaggatatacagtgatcgtttagtaactccattgttgactttctaaagcaaggtttctcaggctctgcgctattgacattgtgagctggataattctttgttgtgaggaagtgtcctgtgcatagcaggatgtttagcagcgtgcttggcctctgcccattagatgctagacacagtgcagtaggagggagccacagggaccagcagccattagcagcgcccccccacacacacacagtcatgacaaccaaaaaagtctccagacattgccagatgtccctatgtgcacaagcacctccagttgacaactactactctgaaggaataaaaactctggagccaggaaagaccaagctaagctttattattgcaaatacaccctaaaacagtggcagaaatagatttcagtcaggggtccagcgggagacaggaggaatactgcacagctttaacggtagagggtttagtgaaggcacaatgtacagaggtgagggtggagtcaaaggagcccgcaagagatggtgaggcccctgaggactaagcagcaggtggcctacaccaccactaggtgtgcaaagggaccagggaagaaggtggcaagagctggagccatagaagagaggtctgccccttggcagacctggaaagctattccctacctgcagtgcaggaggaggggaccacagggatccatagtagccagggcgtgaggaggggatcaggggatcagtagcttgacctctctcctctctctctcccatccactgtgcttcccatctgccaatccaacaggaagccaagagcaaggaaacagaggccctgctctgtcctgctccctgccctgggatctctggctggcattaccaccaggctcccttgctctctagcagtccacagagrtcagcttcttggggcacagaacagggcagagaggtttaaagaatggacctggaagggcaggggaagaatcactggcattggatcagtttcacccacagtcagctttgtggcactatagtcttaagtgatttatggcacttcagagctaatgattaccaacttctaatggtattgasagakattttttcccagataaacaaaaagaagtaaacttaaaataaaagataacctacaacatagtacattatattctggtctcagtccaatcagaatttaggatgtctgtggccagacacarttttacctaataccacagggtatcagaaggcctgagttctagtcgggctctgcttcggactggttatcaggaggtaggcaactgtgttcagtttaacaagcattttggggtgacattactatgtgacagcaaaaaagatgaatgcgcctaggccaatctctgctcttaaggagaacaggttaaagagaggcacagacataaatctataacttctgtacagcatgataagagctgtaattgaggcctgattaagagttcctgggctagagataaaagggcaattagttttgccagaaggatttaaggaaagccaaaaaagaggcagtgacttmaatgtgggtctcagaaagatgccagacagaccatgggaagatatgttccaggtcaagcaaaggcaagaaagcatgaaactaccacatctaatgaaccacaactacttccatgcgtctaaagcagcagtcacagaccaaatccggccctccacctgcctttctatggccctccatcaaagaatgggttttacatttttgaacagttgaagaaaagaaaattgaaaaaaataatatttcgtgacacatgaaaactgcatgaaattcacatttcagtgtccagaaaggtttattgaaacacagctacgctcattcatttacacctggtctatggctgctttagcactgccagggcagagctgagcagtttatgactgacacaagaggcccacaggcctaatatatttactatcaggccctttacrgaaaaagtttgccaacctagaggcaagtctgccacctagagaaaagcaagcaggatasgtagcgagcactgagactggaaagtgtggtagtggtcaagttgtgaaagtctcagtagagttgggcttgattccatgagtcatagatgagaagtgatcagaagttgttaatgaaaggggagacgtgatcacattttcgttttaggaagatctttgccctagaatccaaattgagaaaatggttaagaatcttggggaattggtaacaagggccagagtttaaacaggagtgaagatgaaaaggaagggacagaccaaatgtatttctggtaaaccccactggactcatggctagttagatttggtgggagtgggaggggatggggttgaaggagatgaaggagtcagggatgartctagcttaagtggttttagmaaaatgatattaacaaagatggtctggggcagaaacagatgggggatgaagtttgcttgggacacattgattctgggtaatgttgggatgtcagggattgggagactatctagtgagcagttaactattctgtgggtctgtagctcagggaagaagggtctgggctagagataatgatgtgaaaagttcaaaccaaagtagaggctgagaccaccattcccctccccatgtataacatgagaggatagggccaaaaaagtggttttcaaattgggttccttggagactaacaggtcctccagcatggtttgatagtggctgagtgggtgggacttcaggtttccacccctacttcaacctgagcagtttctctttgaagtattttatgtagtgggtatttacctaagagtatgttaaaatgataagttcctgtagccaaagtgtttggcaaccacaagactttaaagttccttaaggttttttttttcagttctggtaggcctattgaggttgtgtaatcaatccgtctgcctccaggccaggaatgtttcaagtctatggaaatgatggtgagaagaacctttcttaatgcactcaatgcctgctaatcacaactggtgaggggcttccctggctgggaggacagcaccctcattatctccctcctcatctgtagagaggggctcttgttaaccctacagggctattggaaatgaaagaagatcccagtataaaatacctggcacttggtaggttctgaggaagtggaaccctcaatcctcatattcatcaatcactttgactcacttgttaaatggtgaaacccttgcacagtgagaaagagctggtgcctctggctctyccttagacacctgctctttgctttccactctgacctaatgatcgtcatttggcccctcccttcagtcagatcccagcctgcctttcctatacctgtcactgcctctcttgccaagtcaaccctgctgactgagagatggaagatattccacagtgaaaaccaytggctcctttgccttctagaagtcctgcactgagtttcaattgtctgcagaataaacttattcatttgaaaacatttgcatttactgagatggttgaggctttttataataacaagctgaagcttctgttttccattgaacatgttgggttcttgcctgtgacttggcttcaatctgaggccagaatgaaagtgcttcaggcatcctgtggtccatgttctgactcttttgtcctattcttggcctgctgatctgctaaactttccagcctaatttccaggttctgcacctccaaaggtctctgcaaaaattgcaggcttgttgctgcttggctcaggagcccagggtccacaaaactgagctcgtgagttcagtccagagtgagcctgttactgatgtaggcacacaaaatatggcacccgtgacctcaccaggtttcaagcgtaacccactccttttgacaggaaatgaatttaaagcacatattcttataacagtcgttcattcactcagtcatcaaactgtcaytgggaaacttctgtgtgcctggttcagtgtcatcacagaatatagatgcacaagctcatggggcaacagctagaagaacaggacatgattttgcagtgcgttggggtttcaacagaggtctgaaggaagtcttgaggagggcaatgacttctacctgagagatgtagacacccatagggaggcaataacatttgagtgargtcctgggtacctacaaataagaggtagccaggcagagaaggggaggaaagaatgtcccaggtagagaaaacagtattgcttaggccgcataggctatcaaaaccaataaccaatggctagagtgatttcttaaacatctctctttcctctcatcattgtctccagctgaattcaccgaagttagtgaataaccccacatggcttattaataatgacaaagcactattctgggaactagaacatgctactcccaacactgcttcccatttaccatgccagatccttctcttctttaggaattccagtggtctcagttttgctgtggttaactgagaatccacggaagcagcatccaacaaagcactttttacaaccttagttgagttgatgattattttttctaccattttcaaaaaatctctgagcgtagtgcataaccagcttctggggagctttgcataattttctcgactgtcggtgggtgatccttcaacacctgaattcttagcaatagctattgccagaattttgagtgttcttttaattatttctatactaactttttactcttcattagctggagcagtgaatctaaggatgaaatgtaccaaggcaaarcacccaaatgatatctttttcaattgtaactcctgtaacattcagtgtatctgactctgtttttttcattctcttccacatcatttttcccatcaaccttcagcacagctattgcatccaaaattttgycggatgttcttctagttttcctttttcatagacactaatagtaacatctaactgctcaattatttcttgcatatttttctcagtttgagtcttgtcaccttttccttccaagaacatggcatcatctttggtcacaatgrctgctccaacttttcctaagtcatgaaactgaacatcttcaagctttagggtcaagctctcttccaaayaccatgccattatagcaatagctttgtttggtctttctgtgtcaccaaagcctggagttttgactactgtagcccaaatgccaacttttatcctattttaaatgatcatactgagagcatcttcagcaattatgaccaaagactttcagtggacattggcaattttaaggtgggtacaattaactgcttactggaaatcccaagcatcctagaattctcctttctggacttctcatatgttattcaagtaggaagagatgtaatcttggtcaatctctgttgtctaattcattcagtatttttctgtcctttactgtgatgacacccttccaacatttgtgattacatcagaaatgatattgctgatttgtttgtctccatttgcagacattgtgtaaatggagaaatctcttcaggagttgtcacaggtttaggctgcttcttaagtttggtaattacagtatcagcacataacatcacacctttcctggtttccactggattaacacctttgctaatctctaccaagccttccatggtgayggagcatgccagtacagtagcaatggtggtgccaccccaccctcttcatttgtgtgttggcaacatcctgatcaaatctggtgccaacatttatcttgtaagtcaattgacccgcaacagacacatcatcttctgttactttgaggcttccctatctctgttcaggaatcactgttcttccctttggcatcatagtaatggctacagcacctgctagaaggtctgtaccttgaagcattaggtctcaagcatgtgcactgcattgtccatctttgggataattctgagtgaggtgaggaaccagtgtgccaaaccctggcttcatctggcaaargactgtgggtaatgaaagcatttctgcagggtaggtggctaaatggcraggcagccctcagctacaagggaggggcagaatgcaggatgtatacccaacaatttttcaagtaggaaaaaggcaaggtcagatttcagtttttgaaagatcaccccctgcaactttttaaaagatgggctggaggggatgaatctgcaaagaaaactctagcaaaaraggatgagtataggtaggagtgtcttagaacattgaaagaaggatacacattggagaaattgtrtaaggctgagcaaattggatttggagaaggagtagtggcaggaaaggaaaagatggttcagccagcaagactggcaagtggcagggcaaggggaatgatctagtttattggaggggctcaccctcatagagggaagtctgaatccattgggaagaaaagaagatgcagattccctccacttcttgactcccagagccttggagacaggttaggcctccctttgctctctcctctcctaacaggtccttgtctcccactagctcagcccagtaagtcatgctgcagactagagagacatttgtattgccagattcttctagctaaatgtgtaccatgtgtcccgctaacctttacaacagcgggaaaatgtcttgtaattaaccagaatataaagratgaatggagcagcctggcagtctcctgtagtcattatcattcggaggagatgaatgtacctagtaagatttccatcaaccagttacagccagcacttttcccttgggagtcctgactttgttcacatacagtgaaaaccatgcacagaatatatgtatgatgtgtatgacttcttttttgtatgtgaatatttgtatccatgtgtttacatgtgcttgaatatgtacttgtgagtgtgcttgttatacgcagaaatgtgcatgtatgcatgggtaagkgcacagtacgagaagcagcccagtgaatattaagcatactatcgggggtgtgcattaaattgtagccagaccattgagccagccccaggttccattttacctccactgcattgatagtamaraacttctttttacagacaagtggttcagtataatatcattgggacaaggctagtgggtgctccatraaaaaaaatccatgtacaaacaacatgaaygaatatatcccagaaattctctatgttctttctatgttgttcatcttcttgttttgaccttcttttctgactgggtctgctggtagtgcactctggagttttggagacctgcctttgttctctgactctcacaacctggtctgtcccagtctgttgagttagctcttcaatgagcttatttcatggctgatttcccatggtgctgcacattccatgatcactcatcaccccacccacctgagcagactgttaaaaaaacaagatggctatatataactcagggtgtgactgcttccckgggattgctcaaaaactgagaccccagcatctggaagtgatgtcttaatgctaatattctggaggtggagccaagatggccgaataggaacagctccagtctacagctcccagcgtgagcgacgcagaagatgaatgatttctgcatttccaactgaggtactggatgcatctcactggggattgtcggagagtgggtgcaggacagtggatgcagtgcactgagcctgagccgaagcagggcgaggcatggcctcacccaggaagtgcaaggggttggggaattcgctttcctagccaaggaaaggggtgatgcacggcacctggaaaatcgggtcactcccaccctaataatgtgcttttccgacagtcttagcaaatggcacaccaggagattatatcccacgcatggctcagagggtcctacacccacggagcctcgctcattgctagcacagcagtctgagatcaaactgcaaggtggcagggaggctaggggaggggtgcccaccattgctgaggcttgagtaggtaaacaaagcggctgggaagctcgaactgggtgaagcccaccacaactccaggatgctggtctgcctctgtagattccacctttggggacagggyatagccaaacaaaaggcagcagaaacttctgcagacttaaatgtccctgtctgacagctttgaagagagtagtggttctcccagcacgcagctcaagatctgagagcgggcagactgcctcctcaagtgggaacctgacccccgagtagcctaactgggaggcaccccccagtaggggcagactgacacctcacacagccgggtactcctctgagacaaaacttccagacgaacgatcaggcagcaacatttgctgttcaccaatatctgctgttctgcagsctycgctgctgatacccaggcaaacagggtctggagtggacctccggcaaacaccaacacacctgcagctgagggtcctgactgttagaaggaaaactaacaaacagaaaggacatccacaccaaaaccccatctgtatgtcaccatcatcaaagaccaaaggtagataaaaccacaaagatggggaaaaaacagagcagaaaaactgaaaattctaaaaatcagagctcctctcctcctccaaaggaacacagctcctcaccagcaayggaacgaagctggacagagaatgactttgacgagttragagaagaaggcttcagatgattaaactaygatgagctaaaggatgaagttcgaacccatggcaaagaagttaaaaaccttgaaaaaagattagacaaatggctaactagaataaccaatgcagagaagtcctttttttttttttttgaaatgtatttttgtttgttttttttttgttttttttgttttaatttattttattattattatactttaagttttagggtacatgtrcacattgtgcaggttagttacatatgtatacatgtgccatgctggtgtgctgcacccactaactcgtcatctagcattagttatatctcccaatgccatccctcccccctacccccaccccacaacagtccccagagtgtgatgttccccttcctgtgtccatgtgatctcattgttcagttccccactatgagtgagaatacgcagtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacacttgggttggttccaagtctttgctattgtgaataatgccgcaataaacatacatgtgcatgtgtctttatagcagcatgatttatagtcctttgggtatatacccagtaatgggatggctgggtcaaatggtatttctagttctagatccctgaggaatcgccacactgacttccacaatggytgaactagtttacagtcccaccaacagtgtaaaagtcttcctatttctccacatcctctccagcacctgttgtttcctgactttttaatgatcgccattctaactggtgtgagatggtatctcattgtggttttgatttgcatttctctgatggccagtgatggtgagcagtttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttgttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttggattgatttttgtataaggtgtaaggaagtgatccagtttcagctttctacatatggctagccagttttcccagcaccatttattaaatagggaatcctttccccattgcttgtttttctcaggtttgtcgaagatcagatagttgtagatatgcggcgttatttctgagggctctgttctgttccattgatctatatctctgttttggtaccagtaccatgctgttttggttactgtagccttgtagtgtagtttgaagtcaggtagcgtgatgcctccagctttgttcttttggcttaggattgatttggcgatgcgggctcttttttggttccatatgaactttaaagtagttttttccaattctgtgaagaaaggcattggtagcttcatggggatggcattgagtctataaattaccttgggcagtatggccattttcacgatattgattcttcctacccatgagcatggaatgttcttccatttggttgtatcctcttttatttcattgagcagtggtttgtagttctccttgaagagttccttcacatcccttgtaagttggattcctaggtattttattctctttgaagcaattgtgaatgggagttcactcatgatttggctctctgtttgtctgttattagtgtataagaatgcttgtgatttttgtacattgattttgtatcctgagactgctgaagttccttatcagcttaaggagattttgggctgagacaatggggttttctagatatacaatcatgtcatctgcaaacagggacaatttgacttcctcttttcctaattgaataccctttatttccttctcctgcctgattgccctggccagaacttccaacagtatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcccctattgagataatcatgtggtttttgtctttggctctgtttatatgctggattacatttattgatttgcgtatattgaaccagccttgcatcccagggatgaagctcatttgatcatggtggataagctttttgatgtgctgctggattctgtttgccagtattttattgaggatttttgcatcaatgttcatcaaggatattggtctaaaattctcttttttgattgtgtctctgcccggctttggtatcaggtatgaggcggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcgacttcttcctggtttagtcttgggagggtgtatgtgtctaggaatttatccatttcttctagattttctagtttatttgcgtagaaatgtttgtagtattctctgatggtagtttgtatttctgtgggatcagtggtgatatcccctttatcattttttattgtgtctgtttgattcttctctcttttcttctttattagtcttgctagcggtctatcaattttgttgatcctttcaaaaaaccagctcctggattcattaattttttgaagggttttttgtgtctctatttcctacagttctgctctgattttagttatttcttgccttctgctagcttttgaatatgtttgctcttgcttctctagttctcttaattgtgatgctagggtgtcaattttggatctttcctgctttctcttgtgggcatttagtgctataaatttccctctacacactgctttgaatgtgtcccagagattctggtatgttgtgtctttgttctccttggtttcaaagaacatctttatttctgccttcagttcgttatgtacccagtgcaggttgttcagtttccacgtagttgagcggttttgagtccgtttctgaatcctgagttctagtttgattgcactgtgttctgagagacagtttgttataatttctgttcttttacatttgctgaggagtgctttacttccaactatgtggtcaattttggaatagttatggtgtggtgctgaaaagaatgtatattctgttgatttggggtggagagttctgtagatgtctattaggtccacttggtgcagagctgagttcaattcctgggtatccttgttaactttctgtctcgttgatctgtctaatattgacagtggggtgttaaagtctcccattattattgtgtgggagtctaagtctctttgtaggtcactcaggacttgctttatgaacccgggtgctcctgtattgggtgcatatatatttaagatagttagctcttcttgttgaattgatccctttaccattatgtaatggccttctttgtctcttttgatctttattggtttaaagtctgtattatcagagactaggattgcaacccctgcctttttttgttttccatttkcttggtagatcttcctccatccttttattttgagcctatgtgtgtctctgcacrtgagatgggtttcctgaatacagcacactgatgggtcttgactctttatccaatttaccagtcgatgtcttttaattggagcatttagtccatttacatttaaggttaatattgttatgtgtgaatttgatcctgtcatgatgatgttagctggttattttgctcgttagttgatgcagtttcttcctagtctcgatggtctttacattttggcatgattttgcagcagctggtaccatttgttcctttccatgtttagtgcttccttcaggagctcttttagggcaggcctggtggtgacaaaatctctcagcatttgcttgtttgtaagggattttatttctccttcacttatgaagcttagtttggctggatatgaaattctgggttgaaaattcttttctttaagaatgttgaatattggcccccaatttcttctgacttgtagagtttctgccgagaaatccgctgttagtctgatgggcttccctttgtgggtaacctaacctttctctctggctgcccttaacattttttccttcatttcaactttggtgaatctgacaattatgtgtcttagagttgctcttctcgaggagtatctttgtggcgttctctgtatttcctgaatctgaacgttggcctgccttgctagattggagaagttctcctggatagtatcctgcagggtgttttccaacttggttccattctccccgtcactttcaggtacaccaatcagacgtagatttggtcttttcacatagtcccatatttcttggaatctttgttcgtttctttttattcttttttctctaaacttcccttctcacttcatttcattcatttgatcttccatcactgataccctttcttccagttgatcacttcagctcctgaggcttctgcactcttcacgtagttctcgagccttggctttcagctccatcagctcctttaagcacttctctgtattggttattctagttatacattcttctaaatttttttcaaagttttcaacttctttgcctttggtttgaatttcctcttgtagctcagagtagtttgatcatctgaaggcttcttctctcaattcgtcaaagtcattctccatccagctttgttccgttgctggtgaggaactgcgttcctttggaggaggagaggcgctctgctttttagagtttccagtttttctgctctgttttttccccatctttgtggttttatctacttttggtctttgatgatggtgatgtacagataggtttttggtgtggatgtcctttctgtttgttagttttccttctaacagacaggaccctcagctgcaagtctgttggagtttgctagaggtccactccagaccctgtttgcctgggtatcagcagcggtgtctgcagaacagcagattttcgtgaaccacgaatgctgctgtctgattattcctctggaagttttgtctcagaggagtacccggccgtgtgaggtgtcagtctgcccctactggggggtgcctcccagttaggctgctcgggggtcaagggtcagggacccacttgaggaggcagtctgcccattctcagatctccagctgcatgctgggagaaccactgctctcttcaaagctgtcagatgggggcatttaagtctgcagaggttactgctgtctttttgtttgtctgtgccctgcccccagaggtggagcctacagaggcaggcaggcctccttgagcagtggtgcactccacccagttcgagcttcccagctgctttgtttacctactgaagcctgggcaatggcgggcgcccctccccccgccttgctgctgccttgcagtttgatctcagactgctgtgctagcaatcagcgacactccgtgggcgtaggaccctccgagctaggtgcggaatataatctcctggtgtgccatttcctaagcccgttggaaaagcgcagtattcgggtgggagtgacccgattttccacgtgccgtctgtcacccctttccttgaccatgaaagggaactccctgatcccttgcacttcccgagtgaggcaatgcctcaccctgctttggctcatgcacggtgcgctgcacccactgtcctgcgcccactgtctagcacttcctagtgagatgaacccggtacctcagatggaaatgcagaaatcacccttcttctgcgtcgctcacgctgggagctgtagactggagctgttcctattcggccaccttggctcctccagatatacctaatgttaaatgacgagttaatgggtgcagcacaccgacatgacacatgtatatatatgtaacaaaactgcacgttgtgcacatgtaccctgaactttaagtataataataaaaaaaggaaagtyatttgaagagactgtaaataaaagtaaatttaatctaaaaaaaaatgctaatgttcctggtgatgtggatcttgcctagagcttacccctcagtgaaggatcttacatgacccgtcaatcagctcccatatggtgtgtgccaactgtaggttctaccatcaatcagctgggcctgaatatacattttgtagagtttgtgttgttggtatgcrgaacccttgcccaaagagctgtgacccctgtatttccctgcgctaacatgatgaggacaaagactctayctgtggattctagcatgcatccgatgaccatgtggtggctacaggcaacactggtgatataacctctcagacctagctcaaagcggtaatcaccaagttcatatgtacattatggagctccctgcagcttttcaggttccttctcactcagttctcatcaccttgacaaactccatcctatgctaagtagcaggaagtaaaagaggaagaacagaagttagctcaagcttgcgttgcatgatgacatcatccattactagaagcagcccaatgaatattaagcacagatccattaggttaggcagtctttccttgsggaggaatgagtggagagggtggacacagaaatcagaaggattmtttctgggcccttgagagaggcaaggagcaggagacttttcctcartgcaaccgtgagaagagaggaaggggaggctccctcttagcatcgcctcccctcatggccacrcatatctcacagtgcccacatcagcccctacatggaaaatccaagcagctttgcccctgggaatggcctctgtggtgctctggtccccttcctcattccccttcctctagcaacactrgagccagagacaaggagacgatgaagactctttcttcacctcccacttggccaggtgccctgagccatctccacagacctgaccacaaatgggctgcaccgggtcatagagacccctcacccactgctgccctgatgctggggtaccagggctatcaggctcaaattgttgttgtggtgctggaactgctcctgttctcccagggatagtgaatcagagggctatccccctgccrcactgtattagctaggcttgaataatgtatgtttccytactaatgccctctgtttgatcrtgtgtccatgttagtgttcattggaaattttcctgctggatacacatggagagtaatgcacatttataaaaacggtttgaatgcatgttgggaggctatgactccgtggtaataactgaattttatcaggcattcagattacacagtgacttgcctgccagggaacaaacccttggggaactttttcatgtagccagagttgggggactgggaggcagccttccttgcatatctgattactgtgagctttgatttggggattggcctgttacctcaagtccagagcaaatacctgagttttcagagcctgagcttgggagcagatcctggagaaggtttacagtttccctgagattgctttgggtgcagatcacaagaaaagaggctgaggctcagtgaagaacacagctgtttcctggctgtgtgacttacagcaagtcacctaaaccactttgaaccctgatttgattatctattgagtaggtataataactaccagtcaaggttgttgaaagtataaggaccaaatgaaatgattctaggcgttgaggatacaccatgaataaaaatccctgcctttgtagagcttacattgcaatgtggagtgacaaaaataactacataaatggtatagtatgttagaacattgggaagataacrttgggaaggaggcagggagagctggggttgcaggtgtcattttaatggagtggtcagggaaggcctyagtgaagaaatggtgtttgcacraacacttaagggaaaaggggagcaagtcgtagagatacctgaggaaaggccttttggggaattggcaggctgaagcagaagcatgcctggcatattgtaggcacatcagagaggcccatgaggctggagaagagcaatcgaggccaaatacagagtcagagaggtcatggggagaacagattggtcttgcaggccatcttaaggacttttactctagaagacatgggttgccactgatgagctttgagcagagatgtaatatggtttgacttatgttttaataggatccctctggttcttgtgctaaggacagactatatagggacaagggtggagaatgggaggccacagtcatgaggggaaaggtatctcrgacttgaatcaggatgatagacaatggaagttgtgagaagtggttgcctttgggatatatttggaaggattttctgatggattgtgtgtgggtttgagaaagaggagtcaaggacgctgatttaagtaaagaacttgtaaagcaccctggacctggcacgtatgaagtgcccagttacagttgttgtcaccactcctgggtatcaatctgagcagggctaagtcagcaggcggggccagctggaagatggcaccgtgggtagctgggattaaacagctgctccaaggcatataaccagagacagggtgaagctgttagaggccaagagaatgccttgggtaacaggggtggtcagaccaaaggcggctgatgggtacagaggaatggcctttggaattatggagttctggctctggcaccttttgtgtgctatttggcaaagttctgatgaactgaggactaggctggacttagtgacagggtcaaagccagatctgatccatcaggcacccacttgagtcaggccccatctcccagtgacctccaggattcagcttcccctgcctgtaagaggttggcttatgtaggctgggcttggcttggctaattccctcttcccccatgtgtctcttatcctcctgggagcagctatgttgtctcacaatgatggcagagatgcaagaggccaagcctaatctggcaagtgcttttatgcctttgaacacatcawggcctccaaatttcccatggccaaagcaagtcacaaggccaaacccaaagtcaaggagkgggggaatgtactccacctctgtaatggagggagctaaaaaatcacattgcaaatggtgagaatacaatgagtagygacaatttgggcccatattctgatctaccataccctgtcagggctgactcagaattgaggtagagaaaaagctgtggagaagcagaggtgggctgcaaggctgcacacgtcgacgctcatgaaaagtttgctgaggagcaggttgaattcagtaggtctggtgaaatctcagacatctgtgagaggccaccgggggagtcccagagcctctcagagcccacccagtaggagaccacatttttggcctccctcagagggctagccttgatagtaacttttccttcatgtctgaggtcctattgcccttgaccactacccttggaatgtcccagcccagaagttcctggctttgacccaccatggaatgttccaaggcacaagggggaatccttctagagggacccttatccctggtcacaggcaacaactcacattgtttttcctcttacctcctctctagtcaagaagcaaattgagttgaagtctcgaggtgtgaagctgatgcccagcaaagacaacagccagaagacgtctgtgtgtaagtgtccgcccgccagcccgcctgccgggcctcttgcttgaggtcacacgtgcaggcactaaaccgtggggaagccagatgatgctggaatgactttccttcaaccctgcttcctccatcctgggctctgcgcttggacacactgacccaacggccagagagcagccctggggcctgccctttgccttctcctcctcctcttcccattttcctccttgtcctctttctccctcacttcscatttgaactgcagtccagggagtcattactgctacatttctctctttattttccttttgaatcacttccacctgctaagacagtcctccttcagctcctcttttaggagtcagtaaccttgggctgggatcttgggggctgtagggccccagttccagctcccaaggccagattgggaaagggaggcaggggaatgcctagtaacctcctccaagggcccctggacctggctgagcaaagagaggactggggaagtgtgggggtgggtcctgcctcgggkcratggggaggcactgggggctctcttcttgggcrtggggaggatgacatctttcagaacatgttcctgctaccagtgtttgtaaggttaataggggtctagttctggggaatggtctggaatgtgggtcccagaaacacctgatcagggcctgtgctaaggggcttttgagctgaagcccaggaagggctggggaaggttctgggcacctccacaagactgggcttaaaagcaggggaggtttttttccagaaaccttccactttccttctgggccgagtggtagggagccttccttggtcctccaaatgactgacctggttttccttctccttccctccctttgcccttctcctgcatctctggtcctctctcccttcactttttctcctcttgccactttctgctccatcgttcttctcatccttctgctcccgcctcttctctccctgcttgtcttcctgtccctgacttgctcctcccaccctccccattcctccccttccatctcacctccatgtgctcactttcctggagatgctagaagtacttattgaggagagaagggcatagagtggcaccggtggttttcgagctctgtgccgatgtgtgtggccgggagaacatcaggagaagaggcactttggtctcaggmtccgactgaaccgagcctgggttggggattgtctgtggtctttgaagttgtctgagtggagacagttgccacaggctgttggatacagccaggaactggcatctccagtcaccaccctcagggactggatggcagagggcaccagaagagccttcttctgtgcttgactgggggtttaggggaaaggacagggtgctaggagagcccagggtcaggccaggaacctgcagagggctcaagccatggccctgaccctcacaggctttttctttctgtagccacaggagacccaatgaactgaggcaggcacagtttaatttcacagtttgccctggagccacaggcaaacttaaggaaatggccctgacttgggagatcaaatatttatcccaactgtgtcctcagggagcatgttaccccagacactaatgtttcagttttcacatctgtagaatggggatgcaaaatcctaccctgccttcctcccaagagtgttgccagatctaagatgggtcttgttgacctaggacttcaggaggcccatggactagccaaaaaagtacatgtgatgctctgggtgcatttttctggagacaggatgcagggttttcattaagccgactaagaagatgccaaaaactccctcaggaagataaagagaaaccctgttctaatgaaagaatgcaaatgctctttgcaaaataaatatatatatctctattgagaagatattagcctccattctaagagttcctcagaaagaatgggtgtgtgactccagctgcctcagacccaggtagccacatgtctkcaggtggctggcctcctgtgttctgcccaaattccctgtggacagctgccctgaagttcatggggagagtggacccaactctctacctwgccatcagttctgamcacccacccacctgtgactccctgcgttgggtagaaggtggtgccttcctgagcacattgcggcttctccctygccatagtggccctcccagagtagagtaaggattactccccattcctgtccctcagtagccaacaggaaagcaatgctgtaaacacaagcagctggttttgagtaggcagagaagactggaattaaaaaaaaaaaagaaagggagaaacacttcttgcctccataattcagacagtaaactgatcgctgagatttaagtttgcttgtttcctggggaagcttgaagatcctcgtgggaccaccatcccctgctcagtcctccctggaagggggcactggctgggtatragccgcgtcaccgttgggtttgtgactttctggatggtgcctgggtttcacctggggctggctgaggaaaggggaggcggtagggtctgctctgtctgtcaggggcttgtggcttggcgggtgggctttgccatggtctcgcctcttgagtccagccccgtcctgatggggcagacttctgttcgttctgcttcctgggtgatgtcaatactgaatgagagggcaagagaaggggaaagggaaccgccatatgttcttcacgtgctgcaagggggctgtgtggttcccatgaaatggtcagcagagactttgggatgggtatgactcrtgggtcacagggttgactagacagaatctaaagaaggtgggtgcttagctgggaagtctgcagtaggracggatcactgtgaagctctagggggacctggcttaccacagataaggcagcaaatacagctcaggcttcctcctccttcccaccttctgggtgccttagaggaccccctagttatctccgttccattacttgcaaaaaactgaggcttccaggaagcaggagcttcctctgcttcgggaatggcacttccatcttactttcccagcctgaggygtctggactggtgggaacggctcaggatgtgaaagctttggaggtaaaggcttggcaaggaaggggatgggsgtaagagacaagtaggggtaggggtaactggcttgaacgtgcactgcacacaaccaagaggatacctgtgtctggcttgagcacacagtctgtccaaatcctcaggttccatggccagccatagcctgggctacctggaggtttaaacacggtctacttcaggcctctaactgtagactccctcagtgagtctaaaacgagctccccaccttccttacttctatgaaaccacctgcatcctcacaggtacccaggccctggaaatcctggaaatgccctgctccttctcctcatgccctaggtcccctgtgagtcccagggattctttctttgccacatccattcctgctgtctcatgtctagcctcactccaggctcttgttgtcctcagcctgaataatcacaaaatttcctaactcatctctaggtaactggcccacctttgagccagcgggtctcaccacgccttctccccaccagaactctccagcggctccccatcattttcaggatcagactcaaacccygtaaaagtctgatctctgaaacctcaccatccactcttccttgtcactcttcaccttccctcctactctggtcacactgcataacacgcattctctttccaggtttccacctcactcctcrtgcctgtctatctttgtcatctctgttgccgtgtgtctaaatcctattagctcagaaggtccatgttcgatgccacctcttccaggcagcctcacatgcgggtgcatccttcatccctccccactgtggtcccacagtccgcttccgtggtttatgtcctcactcaactggaaactccttgaggacagtggtcttatctgactacctttcgcatttccatggtatccaaataaagccttgtacacagtaggtgctcaatgaatgcttgttgtgtacctatgtgagcaagtgggtgagtgagtaatggagtgctttgttcaccttatgggacattgaatgggatgggagggacatgcgcaaagttggaaaatgccgaatgctgtccagatgccctggaacccttgtctagaggttgctgttggggtcatgggattggtgaggctttgagtggaactcctccgaccaggctgtgtgcctggctccagctcctggtcatcctcaaagccaggaatccagcctcctcagtaccagcatcccgacgaaaaggaacaggcaggggccaaagggttgcctaccctccctactgtgtgtgtatccgctgccccctgaccaagcttctcctctagccaagacaactgtgcatatggtttttgtaaataggactctggcgctggcaagtgtcagagcattgcaccacctaccagaaccatcacaggtgccatctctgcccggtgcccttgatgggtggcactgggtaggggatgctctggtgactgcttactctggctcgagaagtatctgatgggaagaggtttctcagaagaaatgtctgtgtttgagctgaagtcccagctttgaactttgactgcagctttctcttacattctttaccgtttctgatcatgcacccaccttttatttaactttstttgagtcatttctccatctggggctgaggtggggggctcatttcatctagagtctccaccccagatctgaagcataggcgtggtggggggaggtcaccaggggctgtggatggtccacttctggctgctggtgtgggacgagggaagcaggtggtggttggcatggagggcctgtctctgagcccacacactngtgatgactttgctcacaaaggaatttgtcaaaagcagcctcctatnttgcacatccaagaaaccccaggccagtagactccggccaccccacacagccccaacaaagcagggcctcattctgtctctgcctccacctcccaccctgagacattgccccagctggtgcctccctgtgactgtccatctctgtgtgtgctgkttttttttttttttttttttttgccttgtagtaactcaggttggtgtgtcccaaggacataatatgtgtccagaccctggcatacccgaaaggggcaaaagactaggctcggatttcaggtaagatctatttgggaattttctgattgcaagaagggtggggtggcctggctgggaggaagacaggggctggcyttcctgcaggtggaaatggagaggatggcatggatataggaacagacacttcctggagaagagctatggctttgacattctctcctggttcagtccttggcatagtgcccatgctttagtggggggagagaactgtagactgccagtgttatccagaaaacctatgtacccagggtacaaagggctgccatctcagtaatgacacgccagaaggcaactcgcgcctgcaataatctaggagaccattttccttaaagtttatgggtatcatccacccaygcttagctgccctaactggtgcttatctcagaggatcgctgttttgctcacaaagtcaccttttaactcaatcctaaaaccattaaacagtccgaaaaaagaagatgaagagcagatgttccttccaatggagatttttagtgataaaacagtggagcagagattaagggccagaaggaaaaataacatgtgcggcttctttgtggaaccaggaaggacttggggcggggcttggcaggcccagggatggagctcacagacacactttgtctcccaggttaggatccagcgtccagttcacctgcaacgagggctatgacctgcaagggtccaarcggatcacctgtatgaaagtgagcgacatgtttgcggcytggagcgaccacaggccagtctgccgaggtgagggtgccctggggaagggaggctggccagagagttgggctgagcctggaggctgaagcccagctcccagcacctgaggcccaggctctcaagcagactggctcccctcccccctcactccctgcacttatttaccaataagcatacttatccagccctttctcagtatcaaggcctgcgctaggatcaggagatacagagatggggaagataagcattatggtgcttgccctgcatggaccttacagtctaatgggtgaggcacgtaagaaacagcttgctacctcattgaatggatactgaaccacacctagataggaaaggaagtcaccttttatacagtcaccttgaatccctctgttacaacacacatgcatcttgaaccctgtttctttccccatattgcaacagacagacttgtcacttctgcaagagtgtttttacctatgtagtgatgacatgcttctaaccccctatctgggtgttttgttccccagggccctgccaccacatccccaggtgtcacatgagccaagcctgggctggcctagcccctaccccccaaataatcttaaaataacagagccaagtgtattcctgctttggggcagggctacagctgcttctgtggtagagaagcccctgacctcatcccccagggaaccagcagagagagcccctgtgcactaggctgttaggtagtctttaaaagccaacaggtgctcttttgagtgcccctttagaggagaagatatgttgcccactgcaaagttacatgctggatccttctgatctaagaaagagattctttgcctctctttggcatatgcatcaagataaaattcatgcagagtaagaggatccaggaaaaataatatctcattattatactgagaaaggggcagagttggagctgaaacccatatcctgttttttaactgagtccataagtaatctagaagagtgtcactataacatctttcaaataagccttacatcctcattcaactttgaggtggccatgttctacagtttataatgttctttgcattttcactgattttagctatattatctcaaggattctacatagctactatgtttttaaaaaatcaaacaacaaaaaagaattcttgtcataactctcagcaattgggcaaatcacccattttccctaagcctttcttacctcyaaatgttgctaatagtatgtatcctacccttcttctgtttaatgtggagattgaatggagttgtgaatgtgtaagcagtttatgaattgaaaagtgctagaagaaaaaaaatatcctcatgccagtagaacatgagctctatagggcaaggacttctgttttgttcactgcctaaaatggggcgtggcatgtagcaggtactcagtaacaggtgttgaatggaygacggaatgaatgactcattgaatagcataccactccaatgccagggagcccagacaccagctgtgcagagaggcatagaattatcaagtctgaggaccaagggaccctgcccatctgtcgtttcagaattccttttgagaagccaggatgacaatgccttttgcagtggtgggatctggtccctcctcaagaccttttcactagaggaaggttgttctcttagttctcaagagatgatgattgtttacatgaacatgccaagggtggagaagggctggttttgacctgagggaagtttgtagctgaaaaagtgtgttcatccttttctccagtgatttggacccactgaagtctgagttctctgctgcattgtaactaagcattgggctgggctttttcacgtggtcatctcattccatcacctgctactgtaaaacaacaggaaatcatggtacaaatccaaccatcatcatttttagctggggcccttgggccagtttcttcacctctctgaatctcttttttcctgccaaaaagtggtgataatagaacattacttygtggggttactttgaggactagatgaggcagtccttgtttagaagtgatgccagtacgtctgtgagacttayrtgcacacrtattcagcttaacctgctgggcactgtccrcataagcttcctcaagccctggagcaaacctcagcctctagttgctgcaggttcttttagaagctgtcttgtctaatcctattgcaatcatacagtttgggagtcacatggactttgatctagatcacaactctgacaccttttagcttgctggccctgggcgggttccttcatcttttttagccacaggccttcatytgtgaacaaggaaaacaaaatcttccccgcctactgattatgaaatttaaacaaggcattttctagaaagtgaccagccctgacggtggtggagggtacattctcaacacaggttaatattcctgccttcttctctcttttttctcccctcctataggccattgtgaaggagaaagagagactgctaagtctcctgggtttgaacttggatgatatgtcctgggcttccctgaaggcccagggctgagatagatattagagtaaagsgtctttttattttggcaattttaaggtttttattttaaartmtttygttttcaattaatcgcaatyactattctgtgatttttaggacagtttaggtgaaccccaccttaagaatgaaaacgaacaaaactctttccattccaagaagttccactaacaagcaggttaccaaaagatcacattctaaaaaggattttaccataataatggtattattttttctttaatgcagttaaaatatgatttgattagaaatactcattttcccacacaattaattctactaaaacatggggcctggcaaataataggttctcagctaatgtttgaggaccacctgaatgaatcagtgattgaaatgaatgaacaatatgggactgtgccctcattttgagatatgaaattaggcgttcacaggcctttcttttctttccctcccatcagaagaaataagcttctaatttgactcctagaaaattttcatcacacaaaggagattgagggcaatgtgaaacactgttaaactaattctgttcagccccagatacaggcagagtccatagatatagagcttttcagacttattttacatatggagcccaatattyaaaaataagtttttgcagaaccctaataaataaaacagatacaagtggagcatctctgattaaagttgggtcaggggatttctagtctcccctccatcaccattttcagtagcctttgagtcctggtacccctggggccccagggaacactgtaaaccactggtatagtgagaggaccaaattaacaaccagctctgatttcttgtgatcacaaattggtgttgatagagtttagggactgagtaccaggcccagatgaaactcttacagttactgattcacaaagtaaataattaacaggaacttatatatattatttttcctttgtggctaaactcatatatatgtatatgcctttgggtggctagaataccaagcttgggacttagagacctaagttaaagttccgactttgttattaaccatgtggcacagggaaaatcactgaaacactatggatctttttcctcatctgtaaaagggcagtaaaacaggagaaatatggcacaaaccagggtgaattaaatgccatgataattacaggtggctgtcttcttggtggatttcattagatcagctttctggttttactccttaaacataattgttatccagagttctattttcagatctcttctcttctttcctctcttctcctctccacttattttccctggatgacacatactgattgtactagagtacrtgccccattgctccagccctgagaatgtccctcagtcccttacctatatgtgctaatgataaagctcttatttattaaattatgtatacttgtatatagcattgcactaggcatttttcataatttctttatgagtaaagtggcaataaccatattttatgtttagctgaagcttagagtgggcagccaacttgcccaagggcacaaagctacatctgttgagttgaatttcaaaccctgactccaaaggctgaatcctacttctacttgaaaattgtacctggacatccttcggagtcaatagattggatggaaccatgcagagcaactccccctccactccccactttttttgggtaacttttaattttgatatgattttaaacttgcagaaaagttgcaattaatgtgcaaaaagctcccatgtaccctttcctagatttaaacaactgcttttaaaaagttagtggagaagaagaaagctaagaagaaattcggtcagaaacgtaggagaaaagccaaaaagcgtcactgaagccaaagaatgtgagtttcacaaagagagaaagatcagtagtgtcagatactctagagaggtcaagtataatcacaactgaaaagtaaacattggggttagtgactcaaccaagtgttgaatatttgaacttgtttctgcaaggaattggtgaaggaagacatgggaaatgatagacttgggctgaagtttctattgtgatggcaaaccatgaatctgtmgtgataccacagttctcctggtagycccccagcccccaggattagagatggaaaaggtgagtggtagaattgatggaaagcaggcatttcaccaagcagatatgagagcgatgaggaagatgtaggtattggtgagtggtcttgaggtccagactggatagtgagggaagaggggtcaggcgaggatcaatagatgggatgaaatgtgggagccagaaggctagaggggcctatgatgtaggacaatggtgcattgagacccaagtcattctgctgggaacacaggcagtgggggaaggaatggaatgactgggtttaaaatctgtgagttggactttcctggctcccaggatagcaaggccctgggtgtggctataaacatggttgatcatgagttggaggaagagcagggtgtcagatctcataagagggcaatgccctccaaaacaagggacatctctccattgaaacaggagggaaaaaggaattgagtacacgtgcagatagaattgcattcttagagagtgggacaaaggacccgcctgctatatggcttctgttccctccaaagagaaagccaaagtcatcggctaagagtaaggggagataagaggaagaggaagatgttcaaggaatgtctagaacatgtgaaaaagtctttgagcagaatgagagagtgagctaatagagataaatggtagggtcactgggcaatagctaggatttttttgagatgagtaatcaggagtttataatagacattcatcttcctactagtgatttttttcacagcaaagctcaactgtatggtggcaggtatggagaaggcaggtagagagattcattccaaactgatgtcttctaggcaactgatgaaaggaggaagaagaaagggacttggaacaagcaagaaaatgagcctaatggtggcccatgtgatcaaawttgcataaggacagaagacaagaccgaaggagctgatgggtagagaggagatattgctgtcaacagagtggaggtctcagtggggaaagatgaactctactggaggttcagaaaacaactgtgaaagaaatacttgagggtgggagcaagatcttgactacagagggctgcataggaggcagtggcataggaggggaagatgggcttcagtcaggacagtagtgggagtaggaggttccgaaagatgttgcagctacaagtaggatttgttttccttagaactggtagtgggaggtggttccagaggactgtggaaagggttgggagggaggccaataggagaagcaagggaaggcagcatggaacaggatgggaatcagatttggagagaagatatgagaccagaggcacttgcacccggagcagttctcttctttggcaccaagttgtttcagtgtcagaactggctgtgggtccaggtggtagctccctatggtcccctgggatactgttcccattatatgataatgtccagaggaaaaatgggagtagctgcagagctcaggcatggaagatctcagggaagtctctcctgaaagcgatccagaagagcatttcagggaaaaaggcaaatagagaaacaaaatgatatgttcattcatttagtgagatattgagcacctaccattctgccagcccatctgggtcactgtgatgaactttctatctgttgatgggatcccatggagctggctgctcagggtgatgtctgtctgtctgtccacagaacccctgactttgcycagatagcagaggaaaaaagtagctaatgcttcattttgaacctagtttaaggtgctctatgctatctgcagactgtaatattttaattaaacccctctaagcccttaaagtggtaactgcctttttggcctgttctctctcattaccttcagcatgtttcaacagamtgcaaatataccatctaattcttggaaacaagtacaagataaattgattctgaagctgagggctttgggcagcaaaatctgactttccggaagaggtgtaagatggtgctggtggagctttgtaaggattctctgcagggctagagttctgagtccacaggtcctctttgcaaaggtgggacggaatcagggctttgattgtcttattytaatttgtttagtaatgttgccagtctcragtgtacttgtgggggaaaaaaacctatgtccagaaacttcaggaaaggcagaaaaaggatccttagccttgagagaaatcctgggcatagagaaacagaatagacatggcattgggagtctgattatctcttgtcccaaaggttgaatattgaccacatcccaggccctgggctgaaccttcacatccatcatctcatataatttcatcctcaccatatctcaatgaggtggtatcatttgtcccattttacagatgaagaaacaaaatcagagagattttctaactcatccagacttaagcgaccagcaaatggatttagatccagaaggctaagttcataaattttaaaacctgacctcgctttaaccatgccacattgccatagggcccagttgtatcaagtgcaatctaggaatctaagtgtttctcagtacagaatgaaaggagcaatcagatatacatgggggaatggagtgggggttcccccaggacttgttcaaacttgattgaacagattcttsagctcaggatgagggaggaggagatccttccagygcaggactacagtgagaagaaatctcctcccaggaggtgatgagctaacaaaaaggaggtaacagacctgtcccaaaagccccttgcaaataaccctctgacaacacctgctctgcttgatggtgaatgtttttccacctgctccctccacttgctgtggcccttcagagaggaggggctatgtcagacacttttttctccccacacttttcctggcccatagtaggcactcaataaatgttggaatgaatgagctragcgcaggaatgagtgcrtgaaatgagaagagattcattatgtctaggagctgcagaacctgcttcccagaccctcctaggaagggtgtcctgggaaaggtttatcatggccctttccacacatggcaaggagctctaggatatttggccccatcagaggaaactaggtttgacaccactttcattttayatagttaagcttgttgagtttgctcactatttctttactgttaggcactttgcctacaattaggataaattgccatgtgggcagcatgagaacaggctcttagaaccttttattaaaatagctgaacactaacgttaaagaatgaagtggctagaactaagcacacatttttaaagaaagcaaatacctaggtacaacgtagtaccttaactgttataaatcactacttaatctaattagtttagaagctattttaaagagcttaattagattaagctgtgattgataacactttatatctacttgagtagaacacttctaattcaccttgaatctttatgcttccagtcaaaagccrgtttcagggataagctgagtgtggagacggatttgggaagcagtgaaatcactctgggggcctggcactgagctgagtcaggggccttggcagagctcttgggcatagacattctgagacctaatggagtggccttgacaaggatatcctgaaattcctcttcaggaggaccaagggggtcacggaggaaggaactgaggggcaggcagaacctggaatgaggtcagactcctagttaagcagcattaggtccacagcagcactcagctggtttggagaattggagtgcaaatygggaaacagacaggtcagcagagtaaggcgtgggctgcttaggtgtccataggtgcctgcgatccacctagctttatgtcaacctgacaggttctagcccacaccctcttgacaaagaggaattgcatgatcatagtggagtcggggtgtgggggtaagtggggcatgcagaggggtcgcttagcctgccttagaagttcatcattgcctacagaacagcagtcacagtgctccaggcactgcggcttcccttcaagcctcccaagaactgtagaggaaggacccaggaagcagaaggttatgtccagggtgggaactgtacagatgcagtgtcttctgggtggggagtgggaggcaagaaggggaactggacctagtcttaattcaaaggcttgtctttcatctcctctgcagcccgcatgtgtgatgcccaccttcgaggcccctcgggcatcatcacctcccccaatttccccattcagtatgacaacaatgcacactgtgtgtggatcatcacagcactcaacccctccaaggtaagcctcttggggagcggggtggtgttctgtgggcagggctaggttggggacagttggcctacaaggtttttcaaacccagaacttactgatggtagattctctgcagacagttcttttacttttttttttattaatatcgagtggataaaaagcagattataaaatataagcaaaatataaagaacaccaatacaacaaacacctgtgcagccatcgttcagcttaaggggaaaagaaaatcgttaccttagtgatgcaggttcctcaccaatcctgtttcattccctacaccctcagaggtaaccattacctcaattgtgtgtttattattcctttgtttttctttatacttagcacttaagtgtgtatccctaaaaatacattgcttagtatgctaacgtttgaacttcatataaatgtaatcatgtatgtattcttaatcaacctcactcaaaattgtgttcctaagatttatctaagttattgtatgtagtttgtacttctacatacattttttcatgtttatttcctgttgagtttttttctcctgtgccctttgttctctcttataaattttacaagtatgttgccaagatccacaaaataacctgttggaatctttattttaattttatcaaaactacagattaattggagaagaactgatatctttttgatactgagtcttccagttcatgagtatggtatatctctctatttgtttagggtttctttaatggcttgcaataaacttgtataattttttccattacagatcttatgtatttcttaatatatttactcctaaatatcttatatttatygttgctattataaatcaaatcttttaaaattgcacattctacttgtttcttgctggtgtttagaaatgcaattgattttgtactttgatttttatattagcaactatcttgtaaaaatgtatctgaattctttgggcttttctacatggatagtcatcatctgcaaaaaaaatgatggtgttgtttctactttccatttcttataccttttcttttttattttcttgcctcagagttctggttggaacctcccagtataacatcaaatcattattatgatggtgacccctatggtcgttgtttgatatttaatagaatgtttttatttcttcaccatcaaacatcatcaagtatgatgtttgctgaagcttatttttcatttgtagatactccttttataatagaattagggaatttacttcctaatcgtagtttgctaagagcttttatcaagaatggttattgaattttatgaagcatcttcctatatctattgatacaatcatataatttttctcctttattctcttagtatagcaaatattgccttttctcatgtcaaaccaaccttgcattcttaagattaacataacttgatcatttagtattgtcatttttatacatgcctatatadtgtttagtaatttgtttctattttgttagtgagcttggcctgttatttgttttttcatattgcctttgccaatttttgtgtcaatatattgctagcctcagaaaatgatttgaagagtatttcctctctttctatcctttggggttattagtggaagattggcataacttttgccttgaaagtttggtagaatttttcagcaaaactatcgtggtctggtgtctcctttgtttgaagattttagactatagacttaatacatgtaatggctagagaattattttggtcatctgttttttttttcttgactccattttagtaaatattaaaatttattggatataaagttatacatactatctcttattatagttatgatacctgccattgttgtgtttcaattccctttttcatttctaatatgtatcattttttaattggtattggcagtggtttaacatttgttagtctttccagaaaatgaatttttgttttcttactattccttttaatatatttatttgctaatttgtcagtttctgctctcatctttattactttcttccttctaatgcacttgagtttattctgttgttctttttctagcatcttaattttgatgctttgttcattatttttcaatctgatttaagcatcaaaggctacraatttccctctgaggactactttggctacattcctacagatttttacagttatttattttctgttatagtttagttctgaatattttttaatttacattattgtttcatcttttaagcatgagctatttagaagtattttttaattttcaaaggatttttgtaactctctctttcctactgtttctaaatcttgtggtcagggaacattgatctgtatttgaatcatttgaaatttgtgcttttaggaccagaaatggtcatttttcacatagattctgtgtaggcttgaaaaaaaccctgcattttgcagtttttgttttctaatatgtccattacatcaagcttgttaattgtgtttgtctcttttatatcttcattgatttttcttgtcttcttcatcaatcaacggcagagggaggaatattaaaatcttccattatgatggtggatttgcctattattctttaaagttctgtcaatttttgcttcatgtattttgagactgtgttattagagcatcaaagttaaaactcagaattatatatcttcctggtaaattgaactgtttcaaaaataattatgtagtaactctctttatctgtrgtaatgtttttaaccttaaaggctttttccctccatccattgcatcagttttctcttggtctttgtctaataaatattttctattctcttactgttaacttttcgacttccttgtgctttatatgtgttttgtgtatagctggattttcaaaaatcccctctgaccatttgtcttttaactaaagaatttagaccttgtgaattatacaatcatttctattctttgaaatttgtcctaaaatactctagaaatagcaatatgcctacttaataaagcctagcattaaacaataattttgtgttcttcctgaaaagccaaggatcttaggacactatgactttaatcattccttccaattcatactctrtggtgtgtgtatattatgttaccttaattttttctcaagttattattgttattgtttgataaagccactgtccacttaggtttactcatatattgaccacttatttgtttaccactccttcttgtatatcagtccttctctttggaatatctttcagtgcaaatacatgctttaaaatttattttcttgtcaatgataaactctattagttcttgtttgtctttttaaaaaataatttcaatttttattttagattygggggtacatgtgcaggtttgttacatgggtatattgcatgatgctgaggttggggtacggatcctgtcacccagtctgtaagcatagaacctaatgtgtaattttttctttgtcttaaaatgtctgcttacccttgttcttgaaagaacgctagtattcactggacatttgattatcagttgatagttccattctctctgcacatggaaatattgttctggtgtcttctgggtttcactgttgctgtcagtttattgtcattgctttgtatagcatccttctggctgctcttactgtcttttcttgttctttaatgttatgtagtttcacccttatgtgtctaggtgtgaatattttttgtattcatcctgtttaattaagtttcttgaatctatggattgtatctttcatcagcttgggaaaatgtttacccattaycttttcaaatgcttcttttttcttcttctagaagactgacaagatatgttcatctttctcactccatcatcagtatttcttaacctctctcatactttctctctttcattctgttcactaattctctgttcagctgtgtccagcctctgttaaatccattcactgaagatttattttaatttcaaatgtagtctgcactttatgaagccctatttgattctttttcaaacgttcttagtcatattgtcatattttataaactcttgctccatactcttatgtttagatcattcttgaattctttccataattaaacatacttattttatattttgtgtctgttagtgtcaatatctgaagtttttgcaaatttgattctgttttttctcacctcttgcactcagaaccatgtttccttctttgttttatattgtttgattatgtggttagaagggtaaattttctctctggtaattctttgagacctgggtggatggtgggttcttccagagagggtttgcatctgcttctgcctagtgctgggggcattaccagccagaaacctcttcacacaaaattctcagtatggaggtttcaaaccacccaagtaatatgaaggctgcaaacccatgtgaaaactgacttactgttgtgaattctcagtggaaacatttttcttrtctactcagtgtcaaggtctaagataaacagtcagcctccagatcctcccagagggtggtagtgacaggtgagaaggagataggctcatttctaattcaccttcacactatgggtgcagatttaactaacccaactctttcagaagtatcgtattacagtcaccattgtgctgggccctgaattttgtctcctgttccctcttttctatgagttgctgaaaagtgaagctatattgaccgaatttttaaaaggtactcaagaccaaagccgtcttcatgttctgaatcacattttagattcctccattcactgtgttgagtattccttattacactaatgtagtctactcaggckactgtaacaaaatactgcccactagatagcttagacaacagacatttattttctcaccattctggaggctagaagtccatgatcaaagtgcaactaaattcggtttctgatgagggctctcatcctggctcgtaaatggccaccttctcactgtgtcctctcatggcttttcctctgtgcacacacgaagagagtgctctttgatgcctcctccccttcccataaggacaccactaccatcggattacagccccatccctatgaccttatttaaccttaattacttccctaaaagccccatcttcaaatatattcacattggggattcaacatgtgaattcagggggacatattataattcaatccttaacactaacttggaaaaagctgctttttttatttttatttttattttgtcattttaaaattttacctaacactttaaaattgtttggtccgggtgcctggaaccacagtgctgggaacactggaagcagatttcctctgcacaacattttrcaaagaaagattcacatttaattaaattatttcatgatgtacctagttaatgggaaaggacacttcagccacatggggtgagggtggaggctaggccagaaggacttaataccatgaaatcatattaagttgttgactagagggctcttccttgggcactgttacaatccttatctccattttcttttgaacctgaaggtgaggtgtcgggggaagtctaagtaaagtctgaggattttctaagaaacaattagattcacccccagaaggcctagccttggtcagtgtgtggagaccagtgacctccatatggtcactcccctacatgccttgcaagagatcccaccagcctgagtttctaaagatagcacctctgcagagcaccgcttagagtgtgcagagcagtgtttctaatatctctgtggggccttggtgggcttcaggtagtgctgagggagcccagaaaggctgaagagaaccctatcctgatccaggygggaggagacccagggaacatacaatgcaacaaggagggtctaagtgtggaaactcaaagtctaagactgaggaatagaagttgtcttctgggaaacagcaaggacaatggatgctgtgtgcctaaccctgttcatggaactggcctacaggtgagatacaggtgtatccaaggactgcctatccactcaccttcagacatctccttcagcaaaaagcatagtctctaagctcacagtatgttttatgagatgagcattcattcattcattgatgtagatatggcctctgcccttgaggagtgtgcacgtragagtgaagaacaggtctgaaaaaaaaaaaaagagtgcaggtaagtcctgatggaggcatgtccagagcgctatgggaaaactcagggaagagctgctaactgggagataagggaagttttcacaaaggaagtgacatgtcaacagggtcctgaaggatgagtaggcttggaaatcagtatctcagggaggacaaatgtgcaaaggcactgaggtttggaatagccccttagaactggaagtaattcaacatgcctggatgcaggtaaggacagaaaggtaagcaggattcagatcatggtgagcccacatgcttggcccagaagtttgggttttatctcaaaacacagattgctaaggctagcagtgttaggctgttgttaacaacaataatagctcttattgtatgcctgtcccattacaagctctaagctaagctgtctatatgaatgattttatttcattctcgtaataggacaatgaattttattttaatatacctatttggtagataaagaaactgaatcatggaaaggttaaaggttaggaaacagctgaagcacagagccagtaagtggcagaactgggatttaaaccccgtctttctagctccaaagcccatgcacttacatagctgggctgtgctgctggatggaacaagatctcagagtagatgaaaggggctgggcttcacctcagtgggatgagcctggaaggacgaggatcactctatctcctgaactaaagcaatascaggaagatctgagtttttggaaaattactctagcagcaatggagaagtttagaggtggatactggaaggagaaagaccagttaggaggatgaagcagttacctaagtaggaaaaatggggacatccaccaaggctttggaaatgtggaggggaaaacagatgagagagatttaggagatagagtgggacttggtagctgattggatgtgggagctgagggaggaagagaggtcttattcaatattgtatcccaagtgaccaacgtggttccaggcacatagtaggtactcggcctatatttattccatgaacagatgaatgatgacttagtgctttctggcttggtccagtggtagagttaaaaaggaaatacagatggaggaacatgctttgcaggggtcaggagagaaacagtgcatttggaatgtctgtggttcattcaatgtcatttggatatactggatggaaactctgggtaaatctgagtttaagagagaggtttgggtgttatctcagcacgtgggtgagaatagaagcttaaggaatggacaacatttcttggaaagactgaagagaataagaaaattcagaatggatctgagaataccgtcgtgacaggagaaagagcaaaatccagtgaaagaacagagaaggagcaatctgagaggcgggaggagaatcgtgatgcaaacacaggaagagtttccaactagggcatgtctgatcatggcaacgatgacaaatgtcttgctggaaaagtgctagaaggagaccattggctttggccttggaagaagactttgcagtgaagctctaggggcagcaacagacagcagtagggtgggaagcaaatggatgggaggtgaggctgtggaggccaggatgggcagtagccggcaaggaacataagatagagagaaagtttggggttactttggggcatgtgtttaaaatattggaactggagtatgttagtaggcttaggaaaaaatatgcacagagggagagagtgaaggtacaggagaagagggatggtgacagaagggagattctggagtgagagggccacgggattgagaatgcagggctccctttgcgaggagcaggggkagaaagatgctgttgttagaaggagctgaaaggtttgcttgtgggagtgtaagagggacatgtgtccccttgctctcctcatagtcatggaatgattatgatgcatccctgacacctacgcaggaggatccttcctgtaattccatctcccttgtaggacctctgctacctgggcttggcaaggagctaggaatgtcccagggactggggccctccaagggcaatgagaaggcccaaagagagaagcagggatgctgtggtgtgggaatggctaagaacctacatcaagacaccagcattaactgagcatctatgggctgtgcgcctctgcactgtgggaacaggaagaacttacagtcttattggagaggcaagttarggatatgtctgtactcaataaactaggagtaagggaaataaaaacaccccagtgcatcctcctggaaacttcatagattcaaggaacagaggaaagaaggctcagagcaagtgatgcaggcctactccacatgcagcctccatgccctcccttcgactgggatgtcctcgggcaatgttgacctcaccttgggcatttgggttatctcagtccttataatattaatctgacattaacrtctgcctacaataatttttcccaaatttcatcagaaatgccttggagacactttaaaaccacagattcccaagctcttttccccaaagatctgattcagtgggtctagggtaggtaccagaacttatttttaaagacgaccctggtggttctgaccagctaaacttctgtcaacaatgcaattccttcttccagcaaagcacacagtggtctctctgccccatctctccctttgggcagccccagcttcagccacactgaactcaggttcacagacacacctggccctttaagacctgtctgggcacatctggtcccagtgtgccttcccttctcctccaggcaaattcctatccccctttgagagacagtccaaacaacccctcttctgagaagccttcctaacttcatcatgtgttgctccttcctgttcctacagcactttttgttttcttgcatttagaatctatttcccccatagctcgtgagcatcctgaaagcaggaatagcactttgtttatttcttccacagttagcacagtgctgggcatagagaagcagctcagcgatatttgaacatgtgagtgactgttggaggaggagctcctctgggatggttctgcccatcccagaggcttgagattcaggccttcttcctccagggcctcctcttgttaggtcccttcagctcagcctcatggaaaaacaaagatgtagacaggactgaaacccagacctgccttgatgccccctacctacacacatctgtctttcttttgcagcttctcagtatgaacacaaaacatttgatccaatttgcacatgagcctcacttgatttgatcaggatagttaatccacctttgctagaaaagaatgaaaagcgagacagaagagagatggagagtgaggatgggagggagagggagggggcatggaaggaagagggaaaggaaagctcgttatatgaacttcaaagcaaagataacagcgttttgattattcactccttggggattatcactgtcactgtttcctttgtagacctgaagaactgagaattaattctccaggcaggtgatcggcagctagtgcaaatgtcagggacatactcgttggcccatttgttcactcacttattcattcagcaaacatttactcaaacaccctctctgtgccaggccctgtgcaagacacctgcgatcagaggtttgccgtgtgcctccacagcccctcctcacatctgggggaccctttaatagcctcctcaagtccaaagcctcattcctttcccttttacagctgtctcgaaatcatgtgctggcatttcccctcgcccagatctggctgtggccatgtggtatccccacacaccttctctgttgctgaagacaaaccctgcccgcttgctagccaggattttgtgcccctcctgtctcccatccatgcttccctggtttgagccctcatcccactgtattgtagtctatgtactcagggtcttctgtgaagctttctagaaacttagaggtctctattggcagcagccatgttatcttgcctgccaatgcccctccaaagcccggcacttggcaggtgtgtaactgttgaatgaatcagtgaataaatgaatcagtcaatccataagtgaatgagtccaagggcttactgctctcagaaccaccaaaatgaaacctcaggtagtgaccaaagttccagaacctctgacccttcttagtmcctgctggaggcctctgtccttgaactcctgggagttcaggtcttcagccttcctactggcctcccctcctcctcaccccaggagttaattctctagctcttccctagggcctcagcaagaccctggagggaatcatggttcaagctgtgcccaggaaaagtgagttcccttcctttcatggagctaatagttacactggcagcaacattgtaaactgaggctgggtgggccaaggtcagccctcaggggctcaaagaaatgctctgaggagaaatatgggaggtaaggctggagcacagcattgtggcagggcctctacctagccaggaagtggcaggggcaggccttgcaaagcccacactttccaagccaagatgctgaactctatcctgcagtttcaagagttggcaaactcttctgcggtgacaaacacctgtcttcagaacctgtagccattaggtcgtaattgactgggaggtgcagaaaattcctctgcagaagcttaaaaaacacaccgtttattttctccacataccaaaagtccagaggcagaaagtccagggctggcttggtggttccctcckggtctcatgctccttgtatttttccctctgctgcttttcatatgactctcatcctcatgatcacaagaaggttgctccctctctgtcctcacatctgtattccaggaaaagcaaggagaaagatgaggaaatggtctgaggactcctcaacccatgtttccttgcccagagctctgtcacatagacatctttagctctgagattggcaagatacatacattgccacactcccaataaagttggggttctgttagggagaaataaatggaggaagggacattaagtaacccactatccatggtgttcacagcatcccaaattatgaactagatcaaaatggagctgttttggtttaagcagaggcttccctcctctggctcctcttccacccttgtgggttggccctggagtacctttatggaaccctggggtacctgggagcccagtttgaaaaccattgctctagggaagccatcagcaaacttcttctgtaaagagctagacmataaatattttaggctttaaagtccatgtaaggtctctgttgcatattcttctatgttgtaggttttgttttttcactcattgaaagtgtaaaaaatcattcttaactccaaagtccacaggtccacatataaaaataggctataggacagatttggtctgagagctagttttccaacccctgctgtaggagatagggaggtgctaagagcatttggtacagagtgaaggatgggctgcagagacagacagcccagttaggaaagtgttgtagcaaagcagtccttaaacaaaacagcctcagtctacatctcccgggactctagcttcccacaagactgccctgagctggcagatcctctgcaggcttgtgcaggctttgggcacatgctggcagcaccyggagtcctatcttttggctaatcctggacagcacgtggcaaggggagaatgttctccagggcctccagtgggtgtcctccagggtcccactccatctcccatgattctcaggacaaggtggctgtgacaccccctaatttctcctcatgctcttggaccctgcatcagcctccactggtctctctgcctccaatcctcccttcacactgaattatagcttcccatcgacttgaccatgaagtccagactgcctgctctggctgtgggtaaaatcccctgcagactcagccaggctcttcttcctgtcccactctccttggcccttcacttctcacagtgtagcctgggctgagcccacacacacccttctccatcccgccaggcccagacccacctcctctatggacccccttccatctctctcctctttgcactcctcyagcactcaccatcagcaccatgtcctgggcatttagattctactctaaattgtcaggcaagcaagataacttatgggaagcagctagctctgggcttggcacatggcaggtgctcagtaattatgtcctagatgatgggtttgtttattcatttatctaatgggtttaaattgggtgtctgagctgtatacaaatgtgcctctttgatcatgcctatttcatgtgctgccatttctcctgcctccgaaaggcgctttgtgagcttgattgatctgcatgttagttaatgagtcattataggagcctgtctttaaacaaaggccaaagcagagaaggaaaaaaagaaacgaaaaaaagagagtgctagtacattgtgcactagaggctcgtcctgaaactgcagcattgtgtatgttgaacagtcttcttgtgtaattagctcctgcatcagggtcggcactctgaaatgtggttcacatcaatggcagctctaaccagtgatgtgaatcattttatagctctgggttctggccttcaaagcaatattttcccattataggcgtaataatcatacactccctttttggaggtggctgggtgagccgtgtcctctgccccagggctggctggaaggggctgatatggtgagaatatgcagccgggcccctcagtccctgcagagcccaggcccttcctccagcagaagacactacctgccttgtggtgttttatatgcagcagctgtttcctgaccccctgctgggacccagaaaaaagaactcaaggaaagtgtgagagaaaacagaggcttaagtcatgcttcctaccttgtgggcctgtgaccttgttggaacatcatgaggcagtagagcagagtgacaaagagcctggcctctgactgcctgcctggtgggagtcccagctctaccacttgcctgtgtgaccccaggcaagttgcctaaattctgtgcctagcctgtcccatttgtgaaatggaggtactcaaaatagctattgtgctgtattgggggaacctgcccctaatatttagacatcgattctttctattttccataagtgtcagctggctgagaaataaagagaaagagtacraagagaggaattttacagctgggcctccagggatgacatcacataacagtaggaccgtgctgtccacctgaaccttaaagccagcaagttttattaaggatttcaaaaggggagggggtgcaagaacagggagtaggtcacaagatcacatgcttcaaagggcaaaaaggagaacaaagatcacatgcttctgaggaaacaggacaaggacaaattcagaactactgataagggtctatgttcagctgtgcaggtattgtcttgataaacatcttaaacaacagaaaacagggttcgagagcagagaacyggtctgacctcagatttaccagggtgggtttttttcgccaccctaataagcctgagrgtactgcaggagaccagggcttatttcagtccttgtctcaaccacataagacagacactcccagagcggccatttatagacctccccccaggaatgcattcctttcccagggtcttaattattaatattccttgttaggaaaagaatttagcaatatcttccctacttgcacatccatttataggttctctgcaacaagaaaaatatgrctctattctgcccawccctgcaggcagtcagaccttatggttgtcttcccttgttccatgaaaattgctgttattcttttctttctcaaggtgcactgatttcatattgttcaaacacacgttttacaatcagtttgtacagttaacacaatagtggtcctgaggtgatgtatactctcagmttacaaagataacaggattaagagattaaagtaaagacaggcataagaaattataaaagtattaattttgggaactgataaatgtccatattaaaatgaaatcttcacaatttacattcagagattgaagtaaagacaggcgtaagaaattataaaagtattatttgggaactgatatatgtccatattaaaatgaaatcttcacaatttatgctcctctgccacagctccagctggtccctccattcagtgtccctgacttcccacaacagtgctgcatttctcatgagttgatatgtgtaaagtgttcagaacagaattgagcacattgtaggtctcagctcttggagtgatgaaatcgcataagagaagatgatcaaagactatgattgtcttgaagaatctcctagaccagggatcagcaaactatagcctacaggccaaatacagctctttgcttgttttgtaaataaagttytgttggaacacagccacacccattcatgtacacattgtgtatggctatgttcatgctacatcaatagagctgaatatctgtgatacagatcacatgacacacaaagggggaaatatttaccatctgtccctttacagaaaaagtttgccaacttttgttctagatggtaaccactgtgaggggtctgagagcctagcaatccatccatgctagagaagcaggaaagctttggaaattgttctcccagtctacattttttcagcccctggcatgggcctggcccaccgacaggaactggtacagaggcagtgaggcctgacccctgccctccaggagttcatggtgtagtggaggaataagtaaacagacccatcacagtccagcaggtaagtgctaaaacagacgagaggaaggggctgagmaggggctgctccccttgtcaaggttagtcagagagaactgagacaagtcaggctcacagatgagaagaaatattctagggcagtgacagggagcaggaagagcctgcgtaagtcagggtcatgaataggctgycctggtgtgaatgcccaggacttcaagtggccacacaggctgtgcagtggagggcagtcagcagggagcaggtgcagagatgcccttcttatgtttcatgctaggaaatgagactccaggaaatgttctgtaaagcaggagtgtggagtgtgagagatgggtgggagatcccagcctgaggaaatgatcccatgatgatgccattagccaacagggaacattctggataggaaacccagaagggccaaggaatccccactcactattgacaaatcccatctcctctttaataactcgctccaaacactgattgctacaggctcacaccccgcctcamctagacgttgctgcaggcccacatcctacttcacctagaccttgctacaggtccacatcccacctcacctagaccttgctacaggcttacatcccgcctcaccttgaccttgctacaggtccacatcccgcctcacctaraccttgctataggtccataccctgcctcacctagacattgctacaggcccacatcccacttcatctagaccttgctacaggtccacatcccgcctcacctagaccttgctacaggctcacatcctacctcacctagaccttgctacaggcccacatcccacctcacctagaccttgctacaggcccacatcctacctcacctagatcttgctacgggcccacaacccacttcacctagaccttgctacaggtccacaccctgcctcatctagaacttgctacaggctcacatcccacctcacctagaccttgctgcgaattggactccgagctttcaactctccctcaatgctcctgctcctagaacaaaaatctcatgtcatgcctttactgccaacccttccataactccccgttgactttaggacaaagcccaaaattcttagcattaccggcagcctctcataatctgactgctcctatttctctcctatcgccaccctccaccacctccttgcttaaacaactactcagtagttagacctctctggataagtcatcctgttccacaccgctgcctttccctctgcctgggttgctttcccttccatatccattggttgaactccagttcatcttccaaactcagcctgagtttcctttcctccaagaagcctcctttaacctttctcccagtcaaaagcaatcacttccttcctcttctgtgtctatctgtagacccactgacgtgctcacagatactattatccagagatgcatctttctgtgactctcaggccactgcagaggggccctgcatagacactacccaggcttatgaatgagggcagtgtcagtttgcctctgggatacctgagaaagcaccttggggtaaggctctgcagggtccctggcaggatgtgggtgctgaacggtttgatttggatggaggaaacctgcagaaggcgtcagccacaactaggaaaaaatatccacagaaattatatactccttgagttgtagaacagaaagcaaaggagcaacttcagtctccctgttgggggaatgaggatcatcatcagattgaaaccagactgaaacagacaaaaagagatacagattagacatcaggagtgagtgcctgtgtgtgtcctgtccttatgaatggcaccatcccccacccaaacaattgcacaagccagaaacctgcaacttatcctggatctttccctcccctcagcaccacatgcatcctgtctcaaagccctaaatatcactaggaccctccctcttctccgtccacactgctactcttccatcgttcacctgcactaccaaaaaagcctgcaaccatcctcaccaccagcctcactcctgccaatgagttccacacatactgccacactgacatttyctcaaacacctatgcgwccctgtcacccactatttaaaactctactgctcctcccctggcataaattctaattttggagggtagaggtatgagaccttttgaaccaaactccaggaaaacttttcaaattccagaccttcccaagtcaccttcttgcactgaaggcccagtcacattatccccgagagccaggcagctagcaggtatgttcagtttgtagatctgctagcaacagacactgaataatttcttctggaatgttccatctctgccatagctcaggccctgtgcacctgactccttcccagagcatccccctccctccctctccaagcatccccctttggcctgatggggtcatcagtagccttcagaatttcctcagacacccccatctccagtagcacctgcccctgactccagctgggtgagccataggctcctcttcgctcccacagccccctgtagcatccatcccaccccagtgctgtggttatcagtttgcatttctatctccccttcttagcgagggcagataccatgtcatgctcactgtggaaacccaccgcccagcctggcatatggggagtgcttagtaaatatttgtggaaggcaggattaaaacaagaggggggaatcttgttgaaatctctttctgagaacattcatttattcaacaaataaacaaaaaggatggagaaaagcagtcagaggagaagacgagagaaacttctgcaggtccctgggggcaagagagctgagattccacatgtggcctgaaaagttgccaacaagcccatggggatttctgtgcattaaggcgtgaagaaagagtctaatcatctcgctgttggccagatgtgcccggttgctgtgacagccaccagaattggccagatgtgctatgaacatcttcagaaacatcagggggccctggagactgcatggcctggagagaaatagttcacactcattaaagtgggacagaaatggtcagtttgtttaggatggtgtcaccagtgactctgagcattgggacataacacagaaaatccttcctcccctcaaggctttggaaggcttcctcacagcccctgcctgctcctaaccctgtgttccctccctaggtgatcaagctcgcctttgaggagtttgatttggagaggggctatgacaccctgacggtcggtgatggtggtcaggatggggaccagaagacagttctctacatgtaagtgcagtggggcatgttgtttggaaggtgggacggtggctggggttggtggggtggggtttgtggagtcctgcctggtccctagaccatactacagcaaagacagtatcctgcaatgttcctagtttcagcaataatccttctacctctctctactctgaccaaggggaaaagagcactgggcaccttctcactgaattcatrtgaaatgtgaatagaatgagcagtctgttagggggcaggggagatcgaggttttgtggatgaacctggagccttccactggctggctgcttccatgcagaccttgattctgccaccctgacagtttttactccaggccacatccagccgtggcagcctgacctcagacagagataatggaaatgagttgctaacctttctgcatgctcagagctccctgggaaatggatggtttcagagaatcaggaccatatagacatagtggccacacttcctgagccaaaaaagaccagtatgacatgttccagacaagggagaggagaatatcaagctgtcatgggattctgctatgttgagtctgtgctcttggggaccatttagcttctcttttgcccaccaccaatagcctgacttgaaaaccaggaaaaaggccaagcgtggtggtgtattgatgtaatcccagcactttggcaggccaaggcagacggattgcttgagctcaggaggtcaaaaccagcctgggcaacatgttgaaaacccatctctacaaaaaattcaaaaattagctggatgtggtggtgcacgcctgtatagtcccagctactcaggaggctgaggcaggaggatagcttgagcctgggaggttgaggctgcagtgagctgagagcatgccactacactctagcctgggtgacagagtgagatcctgtctaaaaaaagaaaaaaaaagtcaggaaatgcttctgctcaggacatgtggcttagcttcagagacaaacaccctgaccacatccatctcccttccaggaaggaggtggagtgtcaccaacattaaacacctaccatgctcccaggcactgggatggaaacttttgcatcaattatctcgcttaagccctggtgttattattctcttttaacagatggggagactgaggcccaaaggtttcagagaaggttgatagcagaaccagcactcaagttcatgtcttttgatttcagccaaggacaatgtcccatgccacactccttcccaacaaggctagctccaggatatctccttctggttctaatgctgaatgaraaatggccatttagtaacagctggcttgtcctgaggctgttcttttctgggtgtttttcacaacttccctacacctacctggagatgatgctatacaggcagttacatgactcatcttatccaatggtacccactgaatcaggtgacatggctgggacttgggatttctccagacaaaggaatggaatgtgagcccacagggcattctcccccatgcctaattcactgtattagtgagggttctccagagaaacagaacaataggagatagagatagatagatagatgatagatagatagatagatagatagatagatattagagagatgatagacgattgattgatagatgatagatgatacacagatagatgataaatagatgatagatgattgatagatgatagacagatagatgatagatagatagatagatagatagatagatagatagatagatagatagatagacagacaaacagcaaatagatagataatttgttgtaaagaattgtctcatgtgattttgggagactgacaggtcccaagatcttccaggtgagttaagaagctagaaacccaggatagtcaataatggagttgcagtccaaatgccagtaggttcaagatccaggaagagctgatgttacagttcaagttcaaaagccagaagtgagctgatgtctcagtttaaagccaattggacaggaggaattctcttattcaggggagggtccatctttttgttctgtttggcccttcaactgattggatgaggtccacccaccttggagagggcaatctgctttactcagtctgtcgatttcagtgttcatctcattcaaacacactctcacagaaacacccagaataatgtttgaccaagtagctgggtaccctgtggcctagtcaagttgacacataaaattcaccatcacacttacctctccccctcacttggtgcatccccatcactcattttctgccctagtttactgacccatatggtgcctcagctctttgtgcccaagagactaggatcccagctctctttcctcccacaatcccaatgtgctttgacatagagagaaccttagaatagcagaacttttgaaaaggctattgaggatcataccatacaatcccctcatttaacatagagtgaaaaagcccagagaggctcaaccacttgcccaaggtcccacagcaaatgaatggtggactcagagcctggtgctgtaattgggtcaaacagaggaaaagcaggggtcccagccttttcccttgctcatcagcaccccagagtcaggagccagcactggcctggccacaatccttactcagcttgtcagagcccaggctcagggatgtcacacaggccaggctgttggatcccatgtgctctatccgagctccacttccatatcccccatggtgtgatgacctctctgcagctgactcaacagcctcccaagctctgagaccctgggtgaagcagagattaggactcattagttcagttgcccactccacaaccccctgcctccatctgtgctggtaatttgtctgatctcaacaaaagaatgaggttggatttcttctggaaatcccagcctgcacaggggacccctggctctgccactgtatcaggttgaccttggagaagccactgcccattctgcacttccatattctcattgtactatgggctgacaacccctaccttcctggcaacagggccattaaatgagataatgggtaggaaaytgataagtgcagtatcttacatgggtaggtgcttggggttgggattgtgaattgaatccccccctccccgcccccacacccatgcttaaaccctcttcttcaataagaatgtggccctcagataatgactacactctaagccttgttccttatcctggaatggaaggagatgtctcattgaaagaatggcytgggttccaactggagaaatgggtttctgtgaggggaaacccacataaagacagcaaggaggtgggggtggcggyggtcttttctgcaatacaggtcacacaagagatcaaaagttgcaagaatgtagacaccctcttgattggatttggctccaactatccctgtcccctgagcaagtaaggacacagatctcccttgtgagcccaagggtcagggctagagagtcaaagttgtgattcaacccatgagattctacccacagccaaggggaagacaggatgagtcttcccagcacagggagagcatgctgctgggctccagagtcagaaacacagtggggcccagaatttgcccgagcrggcctggatcctggatagtcctttaaatgtcatcggtcaggcaatcattctattcgggtgtcatggtggagagcacacctctaaatatctctctcctgccagcctgacaggtacatcggtcccggatctcattgtcagcaccaatcatcaaatgtggctcctcttccagactgatggcagtggcagttccctgggattcaaggcttcttatgaaggtaactgcttttggcaagccagatgaactgtgtcctgggagtcagagacggggtctggatttgcagtcagaattttttttttttttttttttgagacggagtctcactctgttgcccaggctggagtgccgtggcacgatcttagctcactacagcctccgcctcccaggttcaagtgattctcctgcctcagcctcccgagtagctgggactacaggcgcacaccaacatgcctggctaatttttgtatttttagtagagacggggtctcaccatgttggccaagctgatctcgaactcctgacctcaaatgacccacctgcctcagcctcccaacgtgctggggttacaggcgtgagccaccatgcccggccacgggatcctggttctcccctgcactagcttcctcccccttaggcatgttattccacttctctgagccccagccacctctttgttctgagggccttctggttgttttgaggattatctgggataaaacacttaaaatgctaggcacccagcatcagatgcacacctcagttccatccccaattcatacctggttcatggagacttttaagaggcctcacttatttttaaaatctttagagaggacaatagcttcccaagataccctattgggttgcatgtgatgaatgagtgactctgtgcatagggctaggaacagataaacaccactgttggtggcctgagaaagatgcagacaagagtcttcatctcttgcttagaataggcattaagggaactgcaaaccctggggcccaggagataccctcaacatcacccttctgaccacttccaaaccccctttggcsaataacagctaacgccagtccctacaaaggtggaaggagaagccatccacaagttactgttaagcccctcttaggtactagacgctagaccagcacaagggggacagacacatcaagtctaggcatcgtctcaactgacttgtgctctagtggcgagatggaggggaaagcaaacgaagtggcatgcaaaagagctgcctggacagtgccagtgggagcamagagaagggagcagacatcttttcaggaacatctgaaaggggatcaggaaagcgctttgtcacaaaagtgagcctaaagtcctcagaatgactaggtggstactagggagacaggcccagggagcggggagaaggtgtcccttcagtgtggctcacacagcatacccccagtgtaccataggttcctcctgctccaggacctgtactctgtttcgaaactgggtacaggtacacaggaggtgtattcgtgttcttgggctggctggcttcacacaacggacatttattctctcacattctggagcctggaagtctgacgccaaggctcagcagggccatgcccccactatgggtagaatcctcccctgcttctccctagcttctggtggtggctgtgagtccttgctgttccttggctgtagctgcatcactccagtctctgcctttgtcatcacacaaccttcctgtgtgtctctctgtcctcttcttataaggacaccagcatattagactaagggccctccctactccagcatggctccatcttaacttgattacatttgcagcaactctgtttccaaataagatcacatttataagtaccagaagtcagaacttcagcacgtctttttggggaacacagttcaccccataacaggaggctagcccatactacactaacaatgtcatacaatgatgtctcctggggtaaagatgacagctatactgagattttttaagaataggaggccatgtgtctagggaagacagaacaacagacagaaaatacttatggggtgacagactctgagtgcagatcctggttctgtcactttctagctccatggcaggtcatggaacctttctcaggatctgtttcttcatctgtgaaacagagataataatacaacctrggtctcaagggtcctgtgaagatggttagattaagaaatgtgaacataagaaatgttgcaaattgcaaagcaattagtgagtaactaatgagccagtacacaggtagttcaatgagcgggctgttccggtgcataaagttacacataagcagctgtggggctatgagaggagcagcagacaaaactatcaggagaccttgattcaggtccaagccctgtcactcactactttgaaaaggggaatggagatggatgcaaagttgctaagttttcacccatttcagaaattctatggatgttcagcagtgaatgttcccaaaagcagggagaaatgattccatgtcatcctcatgcccttaatctgtccatattttgccaacggtttgaataagaagtaaatagcgtgaacttgaaagggatgacaatactagtcagcaaacagagtgcagaaagatctgggtggggtagagccrttgactaaattagtaggaaaagataaagtgggaataaatatcaagtcatgatttaagacttaaaaagaaattagctactggaatttatcccaggaagttagttgtgctttatcctgccctgagcaggcaccagagaattgagcttagatgtgggacctcagcttgggatagataaggagaggatttaaggcaattcctgtaagaaatgttgatggcccccgaatgtttatgcaggagaagaagtggacttgggagatttgagagctgtgtccrgatatctgaagggctttcatgtgggaaagaggaattagatgcatttggtgtgatcttgttggaaaagaaagggacataccacttgttgaaagcctgctatgtgccatagctttatgttcattatctcagggttttcacagtgtcttgcaaagacctgcggtaccctycrgggacctccatggtaggatagggcatgcccaggatggagggttctgaccaccctgcctctgtttcttctcctttcttctcttttgctctttgtaagccttcttttaagagaggattcatagctaaccactggcttgaaagacattacttcatctcattcattgcttacaatgataaaatggctgctattttatggatgaagaatctgagactcagaggggtgaagtaatctgcctgaggtcacacacaagtgtggaaagtagcagagctgggatttgaacccatgtctccctggcttcagaagcccatggattttccccttgcaccagaagcctcccaaggttacataatttcaattccttataaaatctttaatagaagccaaagctttgccccagtcaaatagaccaagtatcatgagcctggattccatgtcaccagaggttggggagttagttcacaagttcatttgtccatttcactcagccagtattggctaagcttttgttatgtgaccaacattttgctgggtgctgtgattataatagctagcagcttggatgtggtataaagcatatgctatgtgaatgctgctcatggactaggtgtcagcaggacttctccttggagccgtgacaaattaggaaggacagtctgggtgtttagagacatggcaaacccacagggactacgtcaggttctgtgcacagaggcagtggattctagaaaatagcacagactctgaaattgcaccagacctagtaaatcccagtgtggtcccagctgtgtaagcttgagtcttgtggtctctctgagcctcagttccccgacttgtacaatggaaataatgatgccaatctgagagcrttgttaggagagtgaaatgagatctcaaagctccttgcacattgcctggcatagagatggtgccttccctgggggtgtcaccaaagtttctctccagccaaaccttccacatttcttgtcctccaggccaggcacctggatctgcctccaggtgctctgataggccctgggtttaggtccctgccttacaccagcactccccacctagggccctccctccccatactggcagagaaatgaggtggctctgtaaggcctcagtgcagggcgtggagccagaagtggcaggaggcagaatcaggctcgcaggagcctggaggcctcacagtgcgttggaacctggctcagtgaaaattcaaggggctaagttgggtgggccacttttttgtttttgtcccttccacctttgactttttatatgaggggcaaagcccatcattctcacaccctcctggtgaggagccccctctactataaaaaggtgggtgggttgagtccccggcaccccgatgtgactccctgtccttgcccatcctgctccttgggctcctatcacctccacctcctggttttcttttacctctctggctgctccttcacagctcctccatggctccccactgcccctcagagtctatcctcagccttcagtcctcttattctagaaccttctgcagttgatcacgtgtacttccatggtttcagcctcaacccaaactctggtgacttccacatctgttctccacttgcatttcagtcttcctgttacacattttgatatggcttccctctcagctgtctcaaacccacccacctgtatagtctgctgacaacaaaatgccctgggatagggagtcacatggtgggggccggggactcaacccacccacctttttatagtatagggagctcctcaccaggagggtgtgagaatgatgggcttcgcccctcaaataaaaagtcaaaggcggaagggacaaaaacaaaaaagactgggtggtttacatttgcaacaactctgttttcaaataagatcacatttataggtaccggagtcagaacttcaacacgtctttttggggggcacagagcaccccataacagaaggccrgcccrtctttcctacactaacactgtcataccacaatgtcccctggggtaaagataacggttgtactgttttaataggaggccatgtgtctagagaaggcagaacagcaccccgttttctcccagttctagaggctggaaatccaaggttaaggatttggccaatttggtttctgatgagggctttcttcgtggcttgtagacagctaccttctcaccatggccttgcatgggctttcctgggtgcatgcacacacaggagagagagagagagagagagagagagagagagagagaatgagagaatgagcmtggtgttgtttcttcttagacatccatcctctcagatcggggccctgcccttatgacctcatttaaccttaattacttccttagaggccccatcttcaaatacagtcacactgggggctaagagcctcaatacaggaatttgggggagttgggggaacacacaagttcagtccgtaataccrtccaaaaccaagctcgccatctctgcccccacacctgtgacctgcacctgtgtaccccatcttcacgaacagcaccaccatccatgccatccctaggcctcatctccgcctcctccttttccctctccccacctctgactccattcccagattctgtcagttttccgcatcccacttctgtttcactgctgagctgagtccctccctcatcacctctcacttgaatagtggcagagtcttcccaaccagcatcgctggctctagtcctctcactcccatctacccatctgccacatggagcagtgatcttcccagaatccaaatctggcacaattcccccctagttaaaaaaaaaatgacaacttcccattgattttaggataaagtataacgttttctacatgacatccgaagttctccataataataattccaccaagttctggtttctacgaatccattcaagacaaaaatctctgcagtcctgtagagcctaattcagtgcctggcacaggacacatgctcagaaaagcatgtagaattaaattgtaatgaggatctactcagtcataatcaggtaccctcctcagcaccctctcaattcccttttggtccactttaccaccttcctagtgcacagatgccaacagcccatgcattctctattgtccctgtaggatttggggttgggcaaacccagcttataatcaggatcttcctttgactccctgtgtgccagtctctccccatcaatgagcctgaatttcctaayctgtgaagaggggctgatgaatggttatctttccagggtctcatgaggactcagtatagtcaagcacccagcatagggcctgacatttagtaaatgctcagttggaagcttactcccytctctgctctccaaggcctacagctcttcttccaacctacatcattaccygaagcttcagaattacctctgcctccattttagcccctgttattccagctcctggggagttccacacaggatagacatctcgactcaggaacgagcaggggttggggggcgggtagctgtgatgcaggtttctcgtaggatggcataaggcatccaagggcagagacctcccatatccatcatttccactcatcccttaggcacatctggctgcatcatcatcatcaatacccactctgtcccaatttgagcagagagatacaaccttaggggcaggcaggtggcactccagtatcatcctttcttcctcattgaaagcatgaacctggtgggaaaattggggcatttgcttcccagaaatccctccagttctgcttgtcacaatcccaggtcagggggcgggggaggggactcctgatctgtcaatatctgagcactctgagccagtctccctccatgggggcgaccagctgtgggaaatgcagtcatagttgcaatttctttgcttcccagtagaacaagaaatatttaaggaacaggcaattagcacttaccagaaacattataaaattacatacaacttgctaacaagttttagcatcaatctggaagtctccttgcttccttactggagtctggaatctggcagcttaatgctgagtctgggaggctggcccaggggaggaagaagctgggacctggaccctacagacatgaaggagcaggacagtagagattatgcagaggggctgcccaacagtccagggcactcatgttagaaatgagctcatctgtttgttcaacattttctaaggccctgtgatgtgttgcagacaatgttcaggacactgaggctacaaggacagcaagacaatctctgccttcacctaattcatagtccattttcagtagcatagaacaagtgctagaagacagggaaatacaaaggaggggcagcaaatcttgctcaagggcatcaggggagtctccctggaggaggtgatgtctgaaactgagacttgcttgaaggatgaaaaagagtttgtcagactcccttgagagagggaacaggtgggcttagaaagctgacatgcagataagattgaggctaaaacctcagtaaaaataaagtctgagagcaagttggggagaagagggccaagacttgctctctgcaggcagtgccacatccccttcttcagaacttcactccagtggtgggcactgctgagcccccagaagaggtggttttagaagcagacttcaaaggaggccaagggcagccraccagcatcactcaccactccctctaggacaccgcctttcctcttgtcagatgccaagcacatggctattttcagcctctcttctgttattytcagtacacctctatttcttgtcttttccccataaactggaaggcccaaacattccaactttggccaagaatgtcactaacatgttcctaagatgcccgctgagtttccatgatacctctaaaggtttttcaggcactgggagccaaagttgagctagatacaagcagcagctgcctcttctcaaaaagtcccagtgggatccagcctgttctagcccctggaggctgggctggcaaacagcagaggatgctgccgcattaaaatttggtagaaagtaatttgtcagtgagatgtrctctctaaatacatagcttttgcaaacggtaagctttagtttggggctaatgcagacagcttggaggctacctccatgtcctttgtttccagcctcctttggctggtgacaaacccatgacagtgttatagaggaaggagatggggagggaagaatgtcacccacttcatccagccatacctccattccacttgtggcaatcgtgtgcagaaaaacacatcagtccccataggtgcacatacagatgtggggtctctcacctcctggtgcccttcgcataatcagaagtagaaaagcagagtggggtgtggttctgaggcaatccaggtggtctgggcatgcccacagggtgttcctaatgcaccgaagatgtcctggtcactcactaggagtttgtgctgattcaacaacaggtctgagcacttagtatgcataaggcactgggcttggttctggagatacaaagagtggaagggatgcgacccctggctctgagggagctgacaacccacaggatggagcttaaatgacttattactcatcgaaccaagcccttcagggtctccctccaaccatctctccggcctcttctctcttcatcacttgagcttcccactacactgagcttctagctcttctctagactctacgctgttgtcctccatttctcctttcctgctgctttccttccatcctctcctccatcctcccccatcatgcctcaaaagtttattgratcccctctctgtgccttgcacttcactagaaaagctgggatrtagacatttcaaaaaacattggctcggtcctcaaggaacttaccaattaacagtgggaaacacacgcccaaaattgcagcacccgttgctataacaacagaaatgtccaagggggctgggagcgagagagaaagagctcctaagtctgcctgggcgattcgaaagaaggtcccacatgggaatgcacttgcaccaacactgaaagatgattctttgtctggtagacaaagcaaagggtgttcatttcgggaagagaggatggcaggtgccacgttacagccatctgaggggcggctgggctctgcaaacagcagcgacaataacactgaggaaatatggttagtcactggttacacactgcatactggacattttgacaattatcttgtgtacagaagctcatttaatcctcacaacaaccttgttattaccatttccattttacagatgacaaaactaaggctcagagaaaataagtcacatgcccaaggtctgttccttagtatcagagccaggatttagatcctggrctttgtgatcccagagctcttgccactgcactattctacctccctacagatcactcattgctgtgccgtgtaaatctcaaggtcgctgatggccaaagagcaggctggggtgggaggggtaggcaagggtcctgccatgctgaggagttaggattttagtctgtggatttcaggaagctgtaaaaggatcaatgagcaggggatggtaatcatcatatttttatttctgagtgatcttgtgctcctttgtagagtatgaaatagaaggaagagccaggggaaccataggctgctactggcacccagatgaggagttgcaagggctgaactcaggcagggagagacggggtggatagcagagggttctgggtatgtgggaggaggagtcaacaggaggagactaaggagagctgagggagaaggacagggcaatccaggctgactcccagatttgaacaacctgtaagaaacctgtccagcgctcccagccagaggcttgagctgccccttctgctatcacccaagtcatgtggtcaggtctacatcctctccattgccctggtcatttgtattggaattatctccatacccacctgaccctgagttctccaggggcaggggccgtggggcaggcaaygctatacctttagtgcttagtgtggcatttggcacggtttccatgcaaaatatttgctaagctcagagtattctgtgtgttccagggactgtgctaagtgccgggtacacagtgatcaaaaatacataatggatgcctgccttcatggggcttacattctagggggtgggagtgaggggggctgggtggtgaatcatcttgtgcccaatgcccaaccagagctccagaagaacaaattttcatccttttattcgctgttatacccccaatgtctagaacagtaaccagtaaaatacttgttgaatgaacagatgggtagttacaaggggcatcattgctataaagggaaagaatgtggtgccaaaatgggaggattgctcgagcccaggagttcgaggctgcagtaagctgtgatagcaccactgcactccagtttgggcaacagagcaagaccctgtctcaaaagaaaaaataaaaagaatggggtgcaaagaaagaaaagtaaaagggaaatgtctaagatctaaggtgtgtggtcaaggaaaatgtcttggaggaggtaacattgtaaaccaaagtctgttaatgcaaggcgttagtcatgccaaaggaagaggagaggaagctcaagccaggggaayaatgagttagtgaaggagccagtgaagcctcccagcctcatgtgaaaggcagcaaatcctcgtcttcctccaagcagtgcctcccctcttggagcacatcaaatattcagtgaatttacagaaccacatgatacagtcccttctgtacagacattttcataaaagacgattccaatttggtattagaaatggaaaaacctggggagaagagtgagattgatcacagatgatggggataaaacagctgagaaaggggaagcaaatatgctgagtggcagagctcagtcatgatggacttctgaggcatcttagaagcaatcatctcatgttttccagtttgcttttggtaggcaaaaggagagagacaggagaaacactcataaaacggaattatattaaaccagataacaggaaattgcatgtgtgatttttctgcaagtcaaaatccatttgtctatttgcaattctgggtcctgacgtcagacttggtcagcacctgaccagaagtgccaagatcaaacacctttcaggcagggcagtggagcacagggagccctttgcaggaaggcagcggccgtggtctctgtgtttccagcaggagttgactctgagcttggagagaaggcttaggccaggacaggaggtgtcaaagggacagaagccagccagcagccccctctgccttcctggaaggagctcccaaactctcaccccaccctgctctgttcttcctcttccttccacccaatcttgattctctgagcaacacatcccccaatgccttagaactctttgccaaatgcttccttgaatctgagttcccgtgaagtcaccacgaccctgtagccctctgcagtgctagcagctcacttccccacacccaatgaacttcaccttgagaggggctcgtatgcttgctcgccgatgccattccacccacgtgtaaaccccttcccctttgaccttatgctgtcttcagctctgacactttctacccctcctcatcactgtcactgatctcctcctccctacttgccatcaccttgcctctcaggccttgaccttctcacttcctttcagtgtacttcaccctggctgcagctggacctcatcatcaagcacctctgaaatctcaattccacatacttcagctttttcacatgacactccctttactcctgcccatcatcccttcccatcctctatttcccccatcgccccctgctcctttcacctctttccttcttcattctaagcctcttggataacactttggccattctttttaacaacatgttcagctcctttgccccgttgtcttccatttctccaagcccaatcccccctcactcagtcaatcctcctacccctttctctacttctacaggaactgagtggccaagggctgctgggacaagtcatatagccctgctggatggtatccctacaaatgagtcatctgcaccctcggcgggccccagaggtgcatggcaatccatctaggcatgatttcctcttctccagagtgacagcttcagacattctcttcaagtcgttttcccatgacttgtccctcaccttcagcaaagactgtgacctcctccacttagaaaatagagcctgtgtcatcacaggatctccctcggtctcctgccatcctacctgaaaactcactgccaccacttcttccctctttactgcagtcttgagggaaggacatccctcacggtctctaaggctgggcctctagtgtgctctcagtcccatgcctctctccttctctggagcccctgtagggggcccctttctcctccacatcttcagctaaccattcaatacatctttcctcccaccccttcattcttctctagcatttcaatatggtcaagtttctcctgtactaaactactttaaccactcccacccaggccatatgcctcatgagctgctacctaatttctctagagagagtgatatcaccttctcttctcctgttkggtattggccccatcagtacacacaatcctggcagtatcaatgtgacctctttttgctaacctgtttttcaatcctatgtaaacttccctgcagcattcaaggctgttgatctccttcttgaaactcattcttctttaagctcctgtgaccccactctcccagtctagcattctgctggtccctacattgttcctaactgtcctgtcctagaccaacatcccttctcactctccttgggtaatttcatccttgtcatggcttcttttacaatctatgagctgaatttctagaccaggcttctctcttgaacttaagacccatatagccacttcctgctagatatttccacttggaggtcccactagtaccttaaaactcagcatcccctactgatgaccctccattcagacctatacctctttctgcattcttgtctcagtgagggtacacccaagtgctcaggccaggcacttagttatgtaactaaagttagctgtgacaataactattgggttattggaggaccacatcctccaagaagcctttcctgacccaggtctgggactagggtcaggtgagcagggcactcatgggcacgaaatttaagtgatggggaaaaaaaaactcagcaattaagataaataacacttaatgcaaattttttttaaaaattaatattagtgcaaaatatccrtgttaaaacacatcaacatttgaatcaaagacaggctctgacagtgctgggactatggtgaagaccagtgaggtgagtgatctgagcatagggttggatccaggctttattttaaatgttggtatttttcttcattgtgaattggatttatggcattaattgtaattttctagaaaaaaatatcgcactaagatattatttgtcatgataactgagattttggcgccccttgaaattttgtagatgaggttagtacttccattctccacaccctatttccagactgatcctccacatttgagttaggtgcttctcctatgtgcatccacagcacgaatcccctgtatcataaacacctatttccttgtctgttcatttcttgagggcagagaccatatccagatgtcaagggtctagcacagcaactggcacatagtaggtgctcattgcattgttcgtaagtgggtgcctgtgattgcatgatggtaggaggaagtgatgggtgggtggatgtgggcatgtgcgcagggctgtgcctacacgatgggaaggctgggcagattccttcatcccccttaggatcccctttttcttaagccaatcayagcctcagactagctgctgtgggcaggaacacaggcacatgtaccccacgtgcatatctcctgcagcaatggtggggcctcactaggaaaccttatatctgggttctgcccctggcagcaggaaggatccagctctgtyttgaaatgctgtgtaactttcaccaggtctcaaaatgcctgcagtgacagccctcacaccccaggctctcgcatcccagagagcatgtctggggacatctggaggcaggtgggtcctgctgcttgcttctccacgttgacttatcacaggagccccttctttccttcagattccctggagctctgggacctgtagcaaagggaccatgttcctggaatgcctcagtgtatcccctcccccatccctgagcctgagcaaagccagcttcagaggggtttcagctatgttttcagcagatgtacttgtagagggtgaggccagggggacatgtgaggtgagaggcaagtgggctgacttacatttgatttgagatgcctcacacctggcacatggtcacacagactcccctgcacaaaggggaggacccttgttgttcaacttagatgatcacacacacacacacacacacacacacacacacacacacacaatcccagccatagaatgccttgtcctgcctgctctcagcacaaagctggcagccttcgttttgggttaacatgaatgcaacagtcaagagcccgcccataaaaggcagtgcctggagctgcccagcccacagaagcccccagtgtggtaggaaagcctttgcagaatcatccctgtcaggatcacacacaccaacttcagggactgtggctctgacagcccatgatggtgtctaccgaacaggcagggtccctttttcctgagaatcctargtagtgtccaaaaaactcccctgatgactctgggcccctctctcccaaatctcgggactcatacagtcctcacctcaccgtctggcactggcttcatgacctcctgtctatcctgcaggacgcccttctccccggaaacagagctcccctccttccctcttcttcctcctcccctccaccaccccctcctcctcgtccatctctcacagcattaagcacagcatgagtgggagtggaggtgactccagaggaagctccagaggcttggccaggacatactcctttccagaagcatctggatcctgactgcctctccggtgaggtagccagcccatcatgcccactgggttcagggcccccagagctgtctcagggaacccactccatgtctgtctcaccactgttgactcaagtgaactttcaaagcatactcaatgagtcatttgtttcattttacctgctaccattgcaaattgaattaaggaaacatctccatgaaggttcttccacatcagcaggcagtgaacatttattctcaattaatctctggtttgggaaaaagacagggagcaaagcctcaactgcygtgtcatcttgacttgcctttgctgctcagaaatggactgtacttgagatctgtcgtgacattagcagttcagatgcaaggtcaggttcagtgaggaagtctccaaagacttctaatgctgtggaacttgttgctcctgggacaggtaacctgtgaagaatgtagacccaccttctccctaaaattgcttcatctcatattggatttagggaggggtaagggatcaaaacatccaagcatctagaacactttatgtggacacagagtctcaggcacttgatagctggaagcccattcatcctaggatgctgcgatgaaacaggacattgcaggatttctcacaaacctcattccttataagaacgttgaatcctacctgtgtcactctgagcactgacttatggcagaagagcagtagagcttgtcatgtggaccttcagctccaaaagaggtataaagtcaccttttgtctctgttttctcatcttcctgtctttcagagatcgagcagggcagttgcggtgaccctggcatacctgcatatggccggagggaaggctcccggtttcrccacggtgacacactcaagtttgagtgccagcccgcctttgagctggtgggacagaaggcaatcacatgccaaaagaataaccaatggtcggctaagaagccaggctgcgtgtgtaagtgagcagggaggaggccacgccagggtcttcactgagaggcaggggcccgtttcctagctaatccaggggccccgtccctgggaaccttgcaggttgtaacaacagctgcactctggttggtttattctactcctcggaacgttgctggtggggtccttatttctggcaggaatgtcgactgtagcactgagaacaagtgctcctgacatttggggatgctcttcaacaccgtcttacccttcttggtgatccttaagagcaaggagacaccactgggacaaagcccaccaggctcagacccagacatttcctgctcaccgtcattgccacccctgacaccatctaatccagcagggtggaagggactgtcaagtttgtaaggctgtagacaccaccagcctccagtaactgtgggaaactggccttgccaggatataaacagtttcctaaaattgctttatctcatattggatttagggagggaaaagggatcaagctatctttggactgttgatcttttggggaaggggttggagttgagtgctctgttctgtggagataacaaagaagcccttcttccttcctcttggatgacctgaccatactttgcagcacaaatgatatcttaaatcttcagtcgcgttgggattggcaaggatgaggggctgtgtgtagccaagggaggcccagacatggtctctgtgggaaatcaaaatttccagcttctctgggctgttacgtcttctcccatcccttgtcactccaccttctccatctctttccatgtgcttctctcagggaaaggcaggcagcctgaccctcagatccttcacccggctcagtgggttacttggggcctcgagttctgcacactagagatcggtgatccctcagggctgggagaggaatagcctgggagactgtcagggtctctgtgatgactgagagtttggtgtatgagttgatgagttgggatgaaccatggtgatgatactttttaaatgaaaaaaaaaaatcackttgtccaacaaagcattttgatgacttttgagtttatttatgtaaaaagtcttgagaggtttaaagatcaagtcacccttaaatacacattgaacaactcacccttattgaaaaaaaaataaattgcatgatatctgcccatccctgctccccactgtggttagaatatagagcccaacagcattagccacgtagcatgctgggagccacaaggacctggaggagcagggagcagctcggggcaggcaaacacaaaggctttgcccattgcagagaccaagcccagggacaggtgcacggggcagggctctgcagaagcagggcctgagaagataaaggtacacacagtgggagccccaggtgccatgggggcttaatctctgaaatccatctagataaaacaaggcagggagaaatggaggagggtctagcttctgcgacaaagagctgggaggattcacatgggaagcaaaaccagccagcctcttaggaccaggataagattcactgtcccccaagctgaaagaggcaggtagcagaatgccagctgrgggactgttgcttgacccctccaagagtttacttggccctttggctcttaggagcaggtttataacatccctgtaaaaccttcaccaagggcagaagaccttgaagtgctgcccagcaggcccttggtgtccacaagcagggccggcagcctccagtgagctgggcactgcttgcaaacagctgagaaggaaagaagataggtctgtcccaacaagtatgtgtcagtgctccctgtggtttgaaacaaggatgaggggtctgaggcttatggatgaaagctaagcaggtactctggggagctgacatggcatttcttcttctagacaattctgggatagagcaggatgacatccccaggcccttccatcactcaagtgtgtctggacattggagagyaagaggacacagcttgaatctcagggatgctggcttccatggaggaagccagagggagccaaccggccccatgcctttgcagcatatagccaggtcacccttgcatttcaacaaagtgagggacttccatctgcccactccctactgagtacccagcaggtaagctgatgcttttataggtcctgggcattgccctcagggagctcatagtccaattggtgataagaaagtatggtgataagaaaggcctggtacactgagatgactttggtttcaaaatctgaagaccaggttcttagttctagctcagctttgtggctaaagccaagcatcttctctctggattttcatgtactgacctatccaatagggtagcactccattgtggctccaaatattctaagcctctatgatcatatttrtagaaaaagatgactatgacatgaatagtcctcacatttcccacaataaatacctggaagctactttgaaagtggatcattacagagcaggtcatacttcgattgagagacratgttaaactttggagttctgctcttaactctagatcaaatataatgttatcaatagaaaagggacaatacctataaacatctataaaaatataaaatataaggttggtctctgtgttttacaaagcgctcataaatgtacatacaaaagctcctctagcaaaagtcagcataagtgccctaaattttccaatacattagtcacaataaatattaatacaatacttggcaaataacattgccctttccttattgagagctataaggggattggggatattatttcaatggctcaaatttatttgagaagttgtctgaagaggtgcaaagtattgtattgttcttctcttgaaacattttcttcaaaacaactctttactagggaattaccctgccaagaatacacaaatacactcttccttcatgttccaaaacattttctgtagcaagcagagacttcagaatcattttgttggcttttgagctgccctcacagtagtrgatgctcaatagatagtctttttttaatttaggtttttaagaagatgatttatctcacagtgaaaaacgttttgaaagaaaaggtggagctagcttctttgctcttactctctggtcctcagttaattcacatctcccgggacccctgctcaaaatcaatgggaagtaataccactttccatccattcaagctattgactgcctgtcttccctgtgctgagcaccatgcattggattcagagttgttcagtctctgcctaggaaattgctcatcctggctgtcatggtgggaaagctttggccaggctgcatatattctttaccttccagaagctttgccattttacttccttccttacaaaagaatagagagcatttcccatacaatcttgtccagctattcttccaccacaagagatacaatggcaaggaagatacaaataactctgatggtggtttgcacaatacttgatgctttgacgacaggctggcagaatgcttcacacttcttaaggaagccaggaaaccaattatcaatccattagcagccactttcaaaagaagcttcaaaacagccttcaccagagatatgccaagaatgcatgaatgcacactttcctttgccattttgtaaaccaccttaagaagatgtgaatcctaattgctcagttcttaatgtgtatagtatatgtgtgaaatgtgaaggcaggaacttcttggatgtatacgatttaagttacaaatcagcaatctaatcttgagaggtcaagggagggaaaattggatccttgggtgctcagggaaaatgtcccagaagatacaagacttgagctgggcttttggagagttggaagggaaagagatgctgtgggaaatggcccacagagatgctgtgggaaatggccctactggccctctgctagtatcttcctgtcctttactctgacttcctccttacttatcccaccttctgttctggtgacacamacacacacacacacacacacacacacacacacatgcacgcacacattccgggatgaattgggtaatgggatctgcaagaatctggtctctcccatggaccattactccagagtagagtttctcaaacttagcactattgatattttggcctagataattctttttgtgtggggcagtattgtgtattataggatatttaacacatctctgtcatctaccagtagcacccgccccacacaccagctgtgacagccaaaaatatctctagacattgccaaatattccctgggggaaaaaaatcacagattaagaacgactagtctaggataacttagttttgtcaaattccaaatatgaagaatcctatggatttgtgttttaagtgaggctatgattaaagtctgtagcattatgacagtgggaaggcatgggttagaggagaatgccaattttattaaatgttctacattattgggaatatatgagtcctccctactgtgttatagggtatttattctctcaatttatagattaaaacaaggttcaaagaaatataactaacacgatggtcatagaaccactaaataataggctggaatttgagctgttaattaacagagcagcaatttgcacccaggttcttgctgcaagtcttgccctgtctccattgcactagatttctagaagtttagggatcatctgcaaatgtaaggacaaggaagccttaggataaaaatactaggccagagtatagaagcaaactgctggccgagttacctktatgaagcaacaaaggttgwcaggagttagacaaatccaagaaaggtagatttgtgacccttactggaaatctatcaatattgtatacccccamcatacaatatactggggttgaaacctcttcctaatctttacattttctctgttccttctacccgttcatttatttatccatcttgatttattgagtacctgctatgtacaaagttagctgcataagagggtatggctgttcctggtcaaattctaaactgaagggcctttggggatgatcctgctaaggttaaagggacaatctcatggtgtcatgccctatataatgtgctgtaactctatctctagacgtatctggagctcaagggccaatacttgacagagacttttggtatgttctcatatttttcaagtttaagctaatttaatggtttaaataaatctacaagtttaaataaagaaaatattcatattctctctcccttaaaccaaactgatttcaaattcgaccagtctttttttattcttacccatctatacacatatgttatgtggtcttcatcagagtgagcataccattttgcattctatgttttaaagcccatattctgctgtgaatcttaccatgttgctacatagttatcattcttaaaaatctgtgggttcttctgtcaagtgaataaaccatgacttattcaaccaattatatttaattattttatataaggctataatgagcatcttcagcctatggctttttcttctcttgaattatttccttagaataaatttctagaattgacattatccgatcaggacatgagtatttttatgactcttgatgcatactgttgcatggtttccccaaaatatggtgtcggttcataatgccagtagcaaaagctgtaagattaagaacaagactcaaaacgtatggtctttccatccagaaacatggcatgcctctatttcatgtttatctactttcacttttctaaagataacaactttgtggttttctcgtttaggtcacatatatattgcttgtaaactttgttagcttcactaaacttcaaatatttgtgtggccatttaaaagttgctaatttaatagctrtaagttgaatctatttctgtagcacacctttgtggactactgtgaagtgcccaakgttaagtgccacgaattcagagatgaattgggcacggtccgtgtcctcaaggagctcttctcatgtggagatagacaccattatataaatgaagtgggcccttgtggcttataatttagtttttcaatgagaaaacattgatgctatgaatattaggttcattcttttatttaacacatatttattgagtgcctgcaatgtggtgggcatcatagtggstgctgaacagaagagcaacagcccctcttctcatggggcatagacttgacatcttctctgttagaatggttgggcccgaaagatgagaggccctgctggaaaaggagacatccaagaggcagcagtgggttctgggagaagccactgggtttgggcctatgcaaaagggacatgttccgtagatacattgacgcacacataaacacccacacacacrcgcgcgcccacactgcaggactgggtacttgggtttgtaatggttcctataggggttggctgttgcctaatggatatgaatgaagaagggaggtgggtttatgggagcacagtctggagacagactgctgggtagccatgggccagagacatgtccctgttggggtaagaggtataaaagaggtgtctggaggactgccaagattgccatcacagggcactggatagagacttcagtcttggcctttcttcagccgacctggttccagccctgtctaggagggacatggggcatttgctgtttccaatccctgtatagtgactactggtactgacatgtggctactgaggtgttggtattctttcccaatttgaaggcattctttctacattgtgtatagaaattctttgtggtatttgatatatgtattttcccaacctcattttccctatttattttctatttttcattgtatagttgtcttacatttctatataaacaagtctctcagtatttgtgatttattttcaaagctgacaaagttattctgccatggatctgagaaacagttygttctatttttggttatttgtcagtaatttgattttttaaaatataatttgttactccatctggagtttacttagatgaatgtataatattgtccaaactattatgcagttttccaacacaatttattaagtaattcatttcccttttgatttgagggaaatgaattgttttattacatactgaatcctcaaatgtagttaagtctatttcttgagtcaccactttgttctgctgctctatttctatcttagcactggtattgaataattttaattgttgttttataatgtgttctaatatctggcagagctagaaacaactccttcctccctgaattattttctctttcagaatattcattgttattctcatctgtttgttgttcaagattaattttagaatcattttgtcagagtaaaaaaaacatcctattgggatttttgtatgtgcackcctgttaaaatataaattaacttgaagaaaataggcatttttataatacacagccctcatatccagacacatgtttttgttcgcctacttccgtctttctaaatataacagctccatggttttcttcatataggtcacatgcattgcttcgcatacattgcttgtcacctttattcttaaataggcaggtacttttttcatttctcctcccaccctgacctcaatgccacatgcacaggtgaagcatgctctattttccctcccctctatggctgaaacctagtgttccctgtaaacatacaatcccagattttccaggacaaatgcaatttcaaacatcatttcccttggcccagaaaatatgatcacaatagctagagtccttggaaattgcctttttcaaatgatcagagccagagttgggatcagcaaagatttaaatgcatcagcctcagcatgagggataatattcctgggaactgtttgtgattaggccagggaccgtgatcggtgtgagcttcctctgcttaatgtaacattcccctcatttctctagacttctttcaaggtttcattgacctacagatagccccagaaaataaacagggaacttaggaagtcccaggtctccctccctctgttatccagtcctcaagaacctgaacactgaagacctgtggtttccctttgctagtggcaggcagagcagggggtgcccgctctgcagaattctcccagtgatctgaaggggacgtcgccttgagtggaaagtcaggggtggtagcaggatgggggagggtctgtatctgctactgtactggagaatgggcactagtcatagctatgaagcgtcccagggccatggggcagcctgggaagtgtatgccagagttgagggagtccagggctgaaagagctgaccctggatgaaggaatgggtcacaaaggaggctgctggtgttgcctctcagaatgtacaaggaggtggagtcaattcttgtcctaccaggccagtatgggtcayatcattgcctgttacctttgttttcaaataggcagatactttatgggggaaggaagattctggattgactcatgtcctcacccaagggaatagggtgtatcccggcaaagtatatccttgacccatccaaaggcttcagtctccaaaaagagacttcagtctcacagcagagactagagaggaaaccatgaaccagaatagaagcccagtccttggactggggcatacatattgaagaagggttagcaggagagggagatcctaaaactgagtgggcctatatgtatgctgggcttctcacaagcccaccagttactggctctgtgcagccacacacatctcaccccaacagtttgtaggactagaacttcccaaagtaccatcatgcttagctgggcttggcttagaatctggctgtaagaaccaagcccgtgggatccagctcttcagtgtacctggccagggtgaaatcaggcagactgaagggatggctcacgaaggaggctcccagcatttcctatcaggatgtccaaggaaktagtcaacactttccctgccaggccagtgtgagtcacatacatcacttgtttcctttatgcctaaacagtsaggtactttataggagaaggaagtgtctttggtggccctgcgtggtctaaagtagacccaaacccagctaaccattagaatcactcataggccttttaaaatacaaaattcttggccttgtcccccaaaattccaattcagtaggtccaaaatggggcctaggaattgtagttctaaaaaactcctagatgatctagacattaggtcatatttctgaacaactagtatggaacacatactgtatgccagttgcttggggaaagttttgtgtcagttctgtgaggtttggtcccttgaatttgtctcttgaattcctttcttgaattcctctgggctaatgggaaggcttgagctcttggattacatcatgccaagagacttttttcctagctaatacttgtgtcatgccaagatacatggggttgtgatacatgtggtgwtacgttgtgttcatatgctgttgctattaagttggccaggctgagctgccataactcagttattaggatgattgtagtctcccagggtccgtgggatgttgacctccatgttggtatcccatcaaggagtgagatgcatggtccagtactcccacattacaacttgatgtttttcatttaatttaaatgcagcaaaatgtggaagggagtgggtactatgtactggccattacactcagcaccgggcaagtgatgaagatgattcaaacatggttcttgccctccaagagctcatagtctagtgagtaagataagcrtgtgcttttattttaaagcagtctctgaattattgcacatagatgtggtcacaaagtgctaccagaatgtagaggaagaaaaattcattccaactggcagattttcagaagtcttcttggaagattgtagcacaggcaaaaatttcagtccaatccaacccaggaatctgtccaaaaccaaactgtgaacacagtttaatccaaggcccagttcaaaggccttattccagctaagagtcctggtccaaggtatattaggaccacagctacctgcgtggaagaggaactgggaaaactggtcaagctttaggagtctaatcctgggctgtgacctctacttataggggaatgaggtatctctgtcattctcatttcagctttcacctttgggatcaagccaacaggctctgttttctctgtaaaatatccaaagttgtgtgtatgcattctccactgtgctctgccatgcctgactcagagagctgtggaggccaacagagtttccccagccagggtctgttttcacagctgctggctcaaaagctggagcttgaagttctatcaataccccaaccctgttctttgagcctcttggtgaatttgtcatcttacttgaacatatgtgcattactatcagccctcagtgatgtgggtgtcctcagactctgtggtcctcggggaaggcactacataccttttctagggcttggctttctaagagggccttgggttaccccctcttgtgttgattggcccttcctctaggccttatgtacaagagcaatcttttgggtgactcaggggaggtgggttcagagaaaaggctcctggccctaggctacctgatcaactctcatcttgctctgggacttagatcagactcccccatggtcttgcagggagctcccccaggctacctgtaaactcccttggattatcgtgtttcccctggaagaaaatccaaatgtacttccttgtgtcatggagaacaaycagcatgtattgttttccagtcttcagtgggtggtggtctgaggcatgaatggaccatggcagttctagactccttgagtgaggatgctctgacgaacaggcttagaatgcatgatggagctctctaacagagctcaggggctcaagtgaagaggacaggccctgagtgcctcaaagacccagggacctgggcctacagtcctgagaacatcccctgagttgttgaagatgtgatccacacccttccttgaattcctctgggctaatgggaaggcttgagctcttggattacatcatgccaagatacttttttcctagctaatacctgtgtctggctgaccagattaataagagcagctgaagctaaccttagctgggcatagagaccatctgggatctgcccatgtaggaagaataggacgctacgagtatcactcataggatcctgggggctgggtgcaggcagctgtgggatctcacaggagagaagcacttttgagtagcctttgcttgggacatggaaagactgggtcatcaggacttccatctgttccccaacatgtcacagttcctcagaatctcacagtgagactcaagactgacagaatatccaacactcaagtgaagggctgttcagtaccaggtacccccatgcagctgacagtgcctctcctttctaaggttatctgcccacagatctgctcacagaaggtgcctcaccaggtcacagttggcagtcgagcagtcagtcattcctgcaaatggggagttttgtcagaatcttctggacttggagttacctgttcattccttgaggagaggagggactgaggatcaaagagcaaaccttttggcctggggtcttgctggattgagggtgtggtaagggagaagtggggagacaccacttttgctgccttagtaggctgattaagactaggagatacaccaagcagaagcatgcgtggagacagccatcagcagcagagtggggatgtccctcttgtttcaaattcagccaaaattgaatgtataccttccctgagcccagcacagtgctgtgttccatgccttcacaaacttcattgcgttgagtcttcacaacaaagctgtaatttagaagttattaatcccatttttatatatgaggggaaagactcaatgatgtaaagtacctgccctcttccttcctcccaaatgcgtacagctaataagtgaaaaatacatgcaaacccccaatttttagaaggattcatatttgctccaactttggcatggtggcttggtctggctacgtatattttccaaagaacttatggtctgttttcaaggtaaaagctgagccccaagagtgtggactcagctacttcccagtagcmtagggcaggaggccttttttgtgctttgttccataaggtatcagaatctttcctgtgagctggggatatgagttcctcagccagccactgaggaatgcatgaaaatcccagtgcagagcctggccttgggaaagacctctaaacatctcaatgaagagggcctaaaggccggggtaagcacctggaatggtttggtggggacaatgcattattccaraggtgtggcaagaatcagtcatggccacagggtaattccaggcagtgggtaatttccaaaggttatgctgatgaacagtcatgtaatttataccaagaacctagccaacctctatgggatacaggtaacagggtccagccatagagggcaagaacttagcaatcatcagacccctaccaatgagcttcagtttaggattccagttccagaggggattgagttgtgaatgaggaacttgaagcaaaagctagtttcatgaatagctgctaccatgagtagggtgacaatatatccctatttgcttgggacaatcccagtttacatcttttgttctaggtaattatccatagtgccatctttcattctcaaaaccagtttgggcaatatgttacgtgggtaccctaacatgccaaagacctcatgccaagaaaggaattgggcctcagtgattgatttgaatgccatgccaagagggatctgagtcagaggtctatgaggctatatatagtggtttatcttttttttcttacttgtcactgacttgaaactcaagctctgggctgggcacagtcgctcatgcctgtaatcccagcactttgggaggccaaggcaggcagatcacgaggtcaggagatcgagaccatcctggctaacaccgtgaaaccccatctctactaaaaatacaaaaaattagccgggcatggtggcgggcgcctgtagtcccaggtactcaggaggctgaggcaggagaatggcgtgaacccgggaggcagagcttgcagtgagcagagattgcgccactgcactctagcctgggtgacagagagaaactctgtctcaaaaaaaaaaaaaaaaaaagaaaaaaaaagaaaagaaactcaagctctgtatgattaaccccttcctacctctctccccstcatcccatgccgctcttccatcaaaactcttgcctacctcaatgcctttccacttacagttcaccatgttggagtgtccctcacaagastggctccatctcatcattccttaactgtcacattcccagagagaccatctctaaccaccttatccagaagagcgatgtcactttttatttccttcatacccttttttataagtgtattagtcaacttttgctgtggcatcaacagcccgaaactctcaatgacttgaaacaataaatatttatttattactcatatctcaagagggttgtaagtcagctgcagctctgcagggctctcctgggctccacataacatctcgttctgggacacaggctgaaggaccacgttgtgcctagagcatgttgttctcatgccagaaggcagaagcttcagggaacagagccaaactactcaagtacatttatagcctctgcttggaaatgcctacgtcatgtccactcacaattccgtgggctaaagtaaattgcaagactaagcccaaagtcaatggggatagggaagagagcaccacctcaagagatgtatagcaagggcaaggagagaacaaatgattgtgaacaattagtatgatctaccataataagtgatgcttattttatttgttgattatctggcaccctcactaaactataaactccctgagggcagacctgtatatgtctagttcattgttgtaccaatcatacagcaaattctttgtagtattttcctatttttgttacaattattattagtagtgttatattgctgctattatataaacaaagccaacacagctggagtgagagagcatttggtttggaagatgcttggccacccagggtctactggcagcaggattttattccacagccctcaagctagtgtagttatagccaagagtggctgaggccctgagtgcaatgagcctgtcatacagactctatcactgcagctaggaagggtaagtgggggaggagcgaacattctagaaaaagaaaatcactggggcaaaaatacaaacatggattagccttgcacatttggagagctgcaagtagtttaatctgactggagtgtagggtgcaataggggagggtggggagagtggaaaaataaaaaagattggcaagggccttaggtcactgagagtcttttgtgcccctacgaggagtctagactttatcttctgtgcagcagggagtctttaagaagtcccaagcacggatgtaacagcaaaagaatttgtgagtttcaaaattgaccctggagccgatatggaggatggattcaaaatgagtgaaatttaaaataggacaccaggtagactctggcagtagaaagagggcctccacttaatagggatgtgatgaggatgtgacaagtacaagagatactgaagagatagaatcaacagaagttagttactgattgaatatgagagcgagggagaaggagttgacatattttgcttaggcaactgggtgttgtcattcatggagataaggaatgaaggaggcttaggaaaatagataaagagttcaattttggacatgcatttgaggtgccggtgggatctccaggagggatgtacatcagacagttttgcctcaagtctggagtgtggtaggagggtttgggttactagaatttattttggaggcagtggcataaaggaagcaagagtggggagtgagaagagcgcctagggcaaacctatacctgggtgatggaagggctgagtcatttgttaatgccagggaacattccaggtcccagagaaccttggttcccttgagaaccaagtttggggaaccttagcccctgagaatcaagtttggggaagaagacaaaaagttcaattgtggacatgttttaagttgctgtgacaaaatccaaactgactctcatgatttttttttattattatactttaagttttagggtacatgtgcacaatgtgcaggttagttacatatgtatacatgtgccatgctggtgtgctgcacccattaactcgtcatttagctttaggtatatctcctaatgctatccctccccactccccccaccccacaacagtccccagattgtgatgttccccttcctgtgtccacgtgttctcattgttcaattcccacctatgagtgagaacatgtgttgtttggttttttgtccttgygatagtttactgagaatgatgatttccagtttcatccatgtccctacaaaggacatgaactcatcactttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttataatcctttgggtatatacccagtaatgggatggctgggtcaaatggtatttctagttctagatccctggactctcatgatttttaaaagaccttgccatccractctcataatttttagaagaccttgtcatcctctttagtttgtcttgtgttccttgctccatctgtcaccctgcttctacctaccatgctggcctcccttctgtccctcacatgcaccaagctcattcccaccccagggcctttgcccttgtaattctttccccctgcagtgaaccttccttagaatgattgrttccttatcatcagaccacagtccaaaggccacctcctcagacaggccattcctgctgccttattaaaagcagcccacctctatgccattcattccttttttcgtcacctcttagaatgtaaacttcagaggggctaaggacttkcttatccatcttggtggctgctgatcccatacctagaatagggacagacacatagcaggtgctccgtcactccatcaatacttgagctaggtggagacatttcaaagaccactggatacacaggtctggcgttcagaagaaatgtctttcctgcaggcatacacttaggagttaygtgaggatgaggtgccctaaagaggacaagcaagtgagaagatgaccctgaaatggatctgttcatatttcaaaaggtaaaagccaggtagagaggaaagctttcaaatgactgccaagggacggtcagagctagagatggaaaacctggagaaggtattatggaagaaccaaagtgtcttaggaatgagagagggctagctctgttgaatgcccttctaatttgtctcagaacaccgatgctcaagttctacctgtccaagaggtggaaactgggcagaaaaaaaagaaacacaaaaacttgtgtacaagccaggtgtctaagaccagagtgagcaacatagtgagaccccccyscccccgcasacacacatctcttaaaaaaaaataaaaataattagtcagacatagtggcacacacctatagtcccagctacttgggaagctgaggtgggaggatcacttttagcccaggagttcaggactacagtgagctaggattgcaccactgcactgcagcctagagacagtgagacccctttctctaaaaaattgtttaaagaawaaataacttgggcacaatttatggtttttggactggattatatcaaatatgaatctaggaggacatacatgtgctcaggaaatgtgcagccagtattgcccatttatccttcatactccttttggaatgtgtgtgagtttctagactgcatcctcagtattctccttagaaagaaaggagcctaaagttaacttaatcttgtttatgataaggataagccctgcccagtaactagctttgccctgatgcaggtgaccttgagaaactcacacagtgtctttgggactaacatagttaaatgataactttcaccaggctctagtgccagagatgacattaagataactgagacacaactttacatacactgagcttctgagcagaaagaggtgaaagaaatttaaggttgggtttgtgaagcctctgcctccagctcaacaatagctgaatcagcagagctgcctcagtttacttacctagattcatacactgaagcaagaacaatctgattgggccacttctgcttgggtgagcattgctggataaaatcacccaaccagacaaattggcactgctataaattcatgaacaccaatctcagtcaggcttacaacagtgcctagcaatccatctgtgtttctcaagtcattctcttctccatttctccatggaaactaccccaaacattcactaccctgctcgaacccatgaacagccccttctcctcaccttactcctacctcacaggcaacactctcaattttcaaatactaaagacaccaagcctacagaccaacacccatcctcgcccttcctctattcttcccaccttttataagagatgatcaatcctttctcccatcaraaaacaatttccctataaattacccatcaaaaaatttttagcataactccatttatgctttagataaggaacctttaaaaacttttaacataacagtgagaaatgtatttttaccttgtaactttgtacacacttgcacataattgaaacatacatttcacaagcagtacttacctttactacttacattgaactcagatatttcctrtgctcttcctttattagcccattcttgcattgttataaagaaatttctgaggctgggtaatttataaagaaaagagtttgaatttggctcacagttctgcaggctgtacaggcatggcaccaagatctgttcagctcctgatgagggcctcaggaagcttacaattatggcagaaggcaaaggagagccagtgtatcacatggcaagagtgggagcaagatgggggtggggtaggtgataggtaccacattcttttaaacaaccagatcttgcatgaactagcagagcaaggattcacttgtagccaaggggatgatgctaagccactcatgaagaatctaaccccattatccaaatacctccccccaggccccatgtccaacattaaggattacatttcaatgtgctattyggaggagacaaatatccaaaccatatcattctgtccctggctccccaaatctcatgtccttttcacattgtaaaatacaattatcccttcccaatagtcccccaaagtcttaacttattccagcatgaacccaaaagtcctaagtctaaaggctcatctgaagatgaattccttccacctatgagctggtgagatcaaaagcaaattatttacttcccagatacaatggtgtgcagacatttggcaaacattctcattccaaaagggagaaactggccaaaagaaaggggtaacaggccccacacagttctaaaacccagcaaggcagagattaaatcttaaagatccaacataaccctcgactccatatcccacatcctgggcacattggtgcatggggtgaactcccaaggccttggacagctgtgcctctgtagctttgcagagtgcagtccttgtggctgctctcatgagttggacttgaacacctgttgcttttccaggctcaggatgcaagcttgccatgactctaccattttggagtctggagggtggcagcccccttcccacagctccaccaggcacttcactggtgggactctgtgtgggggttccaaccccacattgccactccacatcatcctctgaaatctatggagaaattgccaagccttcttcatacttgcatgctgtgcacccacaggcttaatatcgcatgaaagctgctaaggcttatggcagcttacactctccagagcagcagcccaagctgtatctggagccctttgagctgtggttgcagctggagcagccaggatgcagggagcgatgttctgaggctgcacaggactgcagtgccccaggcctggtccctgaaatcattctttcctcctgggcctctgggcctatgatgcgagaggctgctgcaaagattgctgaaatgccgtcaaggccttttttccattgtcttggatgttagcacttggctccctttcagtaatgctaatctctctagcaagtggttgctctacagactgcttagattctttctttaccacagggycaggttgcaaattttccaaacttttgtgcttttcttctctttcaaatgtaagtcccaactttaagtcatctctttgctcctgttctgatcatgagctgttagaagcagccatgctaattcttgaatgctttgctgcttagaaattttttccatcagataccctaggtcgtcactcttaagttcaaacttgcaaaaagccctaggatatggacttaatgcagccaagttatttgctagggagtagcaagggtgacctctacaccaattccccataagttcctcatttccatctragacctgttagcctggccttcactgtccctatttctatcagcattttggtgacaaccttttaaacagtctctaagaaattacaaactctccctcattttcttatcttctgagaccttcaaactcttccaacctatccctgttacccagttccaaagctgcttccacatcatcaggtatcttatagtaacatcccacacccctggtaccaattttctgtgttagcccattcttgtatttctataaatacttgaagctgggtaatttataaagaaaagaggtttgatttggctcgtggttctgcaggctgtacaggcatggcaccaacatctgctcagctcctggtgagggtctcaggaggcttacaatcatggcagaaggcaaaayggagccagcgtatcatatggtaaaagtaggagcaaggtagggtgggggcaccacactcttaagaaaccagatttcatgtgaactaccaraacaaaaattcactcatcaccaaggggatggcgctaagccattcaagagggatctgcccccatgagtcccaccaggcccaacctcaaacattggggattacatttcaacctgagatttggaggagacaaaaaaccaaactatatatttttttgtttgttgtttgttttgtttcttaacatgaaatttatgaccagctaataacgggttgcaatccactgtttaatacatttagctataaattcttcctcacctttcaccttttcatgaatcttatgcttcaaataattcttcctccttctgctaactcttcagccacttcccttctgccagttgcattccatcaacattgaaattttctcaggctgctctcatcaaaacaaaacaaaacaaaaaacacccaacttggctgggcacagtggctcatgcctgtaatcccagcactttgggaggccaaggcaggcagatcatgaggtcgaaagatcaagaccatcctggccaacatggtgaaaccctatctctactaaaaatacaaaaaaaaaaaaattagctgggcgtggtggcacacacctgtattcccagctactcaggaggctgacacaggagtgcatgaacccaggaggcagaggttacggtgagccaagattgcgccactgcactccagcctggcaacaaagtgagactccrtctcaataataataattttaaaaagtatctttcttcacactctcatctccttgcaggttctctaagtctctttcatacccaaacttctgtagcaggatgtctatgtacccttgctgtgttcatttctcacctcccagtaccctgttaccccactccattctgatttctgagtccaccacgtctctgaaattgctctcacaaaactcaccaatgagtctcatgttgctgaaacccagtggatcattttcagcctagatgatacatggcgctcagcagtctttcaaaacagatgtcccttcctccttctggyaaccctctttccttgtctgtatgacaccactctcctgtgttttctcctacctcttgactgcttggtccctgtctgccctgccagtcccctttctctcaaaaagttcaatgccatcttttttttttttcccaactcaatagctctgttgttttaagtttttgttttctaataatattatatgttttttcacctctttattaaccaactttatttattctttgttggttgcctcttaatttccttggccaatatttctatgttgagtgtacatctttctrtcaaattccaattcttcatagatgaaggatagtaaatatytaaatgtagtaacttgcacatattttctctccatttgtctctcattattcagcttttgtttatggtgatttttgaaatctaaaatcttccatttctgtagtttaaaatttcccttatgatttctaattttggtgtaatactaataaagtccttccttgcctccaacattatacaaatattccttatattttcttctaggacttctctggtacatggaatgaagtgtggacctaattttgtcattaactggctagccatttgttctagcatcaggtattgatcaatcaaccctctctctgctaatttsaaaagccccctttatcatatatttttggttccttttctggactttcttttccagctctgttgatctctcttttgaagtcaatatagtataaattatattattacagctttataatatgttttagtatttaatatctgggttgtcaagcccttcctcctctgggaggaagtaggtgtcgtggtcaagagcttgagctctggtactggcctgactggttcatcttcccagctctatcatctacagtgactgtatgaccatgggcagattaatttaacatttggactcagcgtctgtctctgtaaagtaggttaataatagtacctatctcagagggttgctgtgagagttaatgagttgagatacaggaagctctcagaatgccaactagcaccttatatgctattattccttatctgtctcaaggagagctcggctgttttcacctgtttaccaacagatggatcttgcaatggttttaagttccagaaaaaaaaaagatctggcctggaattgtgttaaatttgtaccatgatttaggacacttttcatcttagtaatatgaattattttcaaccaggaacatagtttgcctctccattaaaaattttttttcttcctatcagtacagttttgttgtttttgttgtgtaggtcatgttggcttattgttgtagggctgaatttgattttctagcactttgcatgaaggattttctatactgtaggtgtrtcattgtgttggtggatatgattgtgtgtgtatcatacatatcattgttatgggagtattgtatcaaaatcaatttaaatagcatggctattacaagtttgtttatagttttgaagcactggccatgaaaccacctacccactaagtattttccagtttcctcaggtttttcccttcatgctaattttggtaattcaaatttctctaggaaatgctccatcttatccatatttcatatgttatgtatactattcttttatagttggattatcaccttagtgttattatagcctcctatccctatgtatatttatcttttctatttctacttattgagcaaaccaatcagaaatttttattgatctcttcagaagccaatttttttttctgtttttgtcttttctaagtttattctctcttctctccttaatcatgttcagttattcttttggtaactttttaagtataaacactaattgcacttattttatttctttattgtttaatcatgaataaagctatgaattttctccttactacagctttggtctagtatcatcatcattataagaagtctgtattggcygggcgcagtggctcacgcctgtaatcccagcactttgggaggccgaggcgggtggatcatgaggtcaggagatcgagaccatcctggctaacacggcgaaaccctgtctctactaaaaatacaaaaaaattagccgggcgaggtggcaggtgcctgtagtccmagctactcgggatgctgaggcargagaatggcgtgaacctgggggggyggagcctgcagtgagccgagatcaggccactgcactccagcctgggtgacagcgagactccgtctcaaaaaaaaaaaaaaaaaaaaaaaaagaagtctgtattgatagctttgttttcctcattgagctcaggaacttatttggaaagagttttatgaatttttaagtgattatggatttttctttgttcttttcttattgatgtctagtttatttgtactgtgaacagaaaatgtggcccaacagtttttgcattgtgatagaatttatggggattttcttatagcctamtgtaaggtcaattttgtaatagtccatgggcacctgtaaagaagtttgcattccttgtttgaagactacagagtttcatataatatacacactcataatattttcagatcctttttatcttgatcttgatttcagggtagtatattttattttgtctctttcatgcttttggacataaagtattataacwgtcatatctttattttgtaatgggctcattatccatgttttaaatatgatatttggattttgtattaggtctctataaaggactactgaaaactctctttgtttggtgacaacaccaaaagaaaaacataataaaagaggggtcttcaacaagccccttttattttctactcaagctcatgttaaataataacctaatataatgcacagtaattacacatctacctgttaatawgtttyccacctttattatttgtcaacagtctgacgcttctgacttaaaagtttagtcgacatcaagatccatgagcacagyctggtcactactctgaaggaggaaggtgcctgatctccttcttttaacctgggtgattgagggtgatgagatccaattacaactttttaaaaatccctcatttgcgacactgagaagtaggctcttcctattctcttacagaaatattacaatacaacatgcatacataattttccagagcaagaaagattagatctttgtaagacaacgcacacttcctcttcctgcccttgttgcaacaagtctgagtactcttttgagatggaagacagagctttataaggccacattcttgttctaagagtgtcagtttatcagccctgtctccttccaggtataataagaaatgcctcttggtagctgtccagaaaactcttggcataagaaaaggatcatccaagagtcaggtgtaatataatatccaaggatcagatattaatattaaaattccttttttgttgttcacatttgcctccaccagtagttctcaaaccctggctgcaatttgggatcacctggggaactttttaaaatcggtgatgccctgagcccagtccaccaattaaataggaatatttgagacttataytgataaattacarcactcttctaatgtaaagcctgagctatcttggcccattcctttacttttgagtattcagagtcactttgtcttagctgtgtgttttgtcccaaagagagggttgtatattactgggagattaacctgtatacatttattgtcataacygatgttttatcttttttaaagcatcttacgttacaacccccctaccccatgcttccttgttgtttcctttgaatttcttttttcctccctgaactactttgctttttcccctttggtaattttgaagayaagctatttcatattctattactaattacacytaacatctttaaaagcatgctccaacctatatttctctaattaaccacagaaactacaaaacaggatttcttgcaagatgagcaaattagcatatctccttgctccaactttactctttgtgtcagtagaatctggaatrttctaccctagagtttgggcaggaataacgtcttatattttctgttccaaggaatatttgttacgcttgcatttcattttataactatgtttacataaattatttaaattcattaccatattggtttatttgctcattgtcaatctttttttatgctttttgttaacctcaactttatcctacttgagtttgttgtttaaattcatctcttggttggataggagacatctttgagtggatgtgagtaggacatgttttgaggcctttgatatttaagagcagctttctgttgcctttgctgtttaacaacttggctcattcatacccttttccactgtaaattatctagggacacatctgtactatgtctaagataaatacatgcagggttacagcacagtatgtttctctgttttccagagttgacacaggtatccatctattaatatttgtacagactttggtcaatctgttggtcgaggtttggagtgggatggggttatgagacccacatgttcatgtcaccttctttcagaatggtttcaaccattaggtactcattgattcattcagcaaatattggttgagcacctacaatgtgtcaggcattgtgggagccactagggattcagcagaatcagatgagatttctgctgtcatggaagatctgtgtatgtgttggggagagggaaggactgaccatcaacagctaaacatgtaaacaagataattttagagaatgataagcagagctatcatatatagctgctcaaattccaaaatggtgcccctggagctttgcaacatgacaatcctggttaaaggttctagagaaaaaataatacactgatagagtgatggaggtggggagagggtctcaggccttattaattaaatagtcctctgcagcaaatttatttgctcacatactcacagtgcccctgaccatcttccctctgaaactttagcacctttctttgtcttcatctgccttggacttgctcagcaggccctgtgacttgccccctctgccttcaaggtctttgcctttgggttttgattcctcattatttgcattatgttcccaactgaactcccacaaagctggagacaagatggctgtgtgggggcatscatgtccagcctagagactcccaattcagtgctaatgtaatatttcaagtcgacagatgaatcttcagcagatttgaggaacgccttctaagactccacggtcacataggcccagggggaagtgtyattctcatactgagagacatggtggggggttagtaagagcttggtctctagaatyaggctgcaytgatttggctttggcgctaccatttactggccctgcattacttaacctctgtgtgcctcagtgtcttcatctttaaatggggttaataacaatacctacctcgtagcattatagtgacagttaaattgagcaagtgatggaagtgcttagaatggtgtctactcttagttaaaccctcaataatatataataataattgccattaactatatattacattacctaaaagccttttcatgtccttctctccccttggctcgaattctttctatacttaaaatatacatggattacagggatgagactgaatgtgtcttaagaaccaggcttactttgctgaattgcatgggagggcttttacagctgcagactggaaaagaaatacttaatgcagaaaatggggagctgggcagagtcagggagaatcaagactaaactcatcacaaggagtcaccaatttttttgttttaatgttttcccccctttggcaaacatgattttattatttttcatcttagcatcattacctttagtaagtcaaatattttactcacttaaatatcaatttaattaacaccaaacatctatataaatgttataaatggacttaaatgtttatccatatttggaactaccttttttatgcttgtatatattaaaagatgtttagaatgaacctacagcatttttgcaatcagaaaaattaaatgttgtttcattttgaacgcctrcgaccctgatatagtttttatttgggggcttatgtccagtctttatccatwtataaacaaatatttaatagctataatcaaaagcatgcatataattttatgatctactgctttatttaaaattatgtttaacattctttctacagggtcwtatttatcactttaatgattgcagtcaaactgtatcacattaaaggctataatttacctcacattattgggctgacatatagtttgttcacatttttcctctataataaaattatgtcattgtaaacatctttggctaggtggctctttttcttttgaattaattcctagagattactgagtcagtctttgagtagttytgtggctctggatgcgaacttacatactcccttcaaaaaggatcatatcagttttgctctgcaattggcaataaatgcatgtatgagattccatgaagcctcaacaatattgsattctatattttttctttattttttctattgaaatggactgtgttgtcatattaattctattttctttcatatgaatcctctaagcactctctttactcatcttagtgatgttcttagataattataaaggttctaattcaatattgatatttttcctgtgtcataagcgttgtgattatttttttcattttattattttcttttataattttgttttagtatttatttgttttctcatttacagcactttctttgcctattcttattccagggtctgctactagttggcatgaaaatagcttaaaataagggtttttggaagggtggatcyttagggtgaaataggggagagagaacaggacgtggacagggatcacaatggatgctgtcacctccctcccccagtttcttcagaagctttggtctctgaaagatggtgctcctggcacctctttagcatagtgtggcatcttggggttgtcagaatcccatggcacacctatcatttttccatcaaaaatgtttgaaggagacaaatggtcctgggctgtctccacccggttaccgcctggggaattagcactgctgtgtcattaagcaatgtcctttcctactgctgtaaacccagctgagaggggtcagggactgtgactctacacttaggcttgagttgtggctttgccccacccaagggacccaaagcacgaagacgcagtgtttcacatccagacacatccaatctgtaaatactcaaaaaatgggagaggtcaaaggagagatgttaaccactacccaaaatcccccagccagaaatgatccttgccaacaattggtggacactattacagatatcacatagttttctatgcatttatacaaatagacagttggatggattgatagaaataatttttaaaaatctgggccgcatcctaggtgrgcgtgctgaccaggggagaggggccaagagaagaccagttctgccatgtctgccttttgccaaaggggccctacccattgctaagtccagcatggagcccagcatgtctccccacctggagctcagagcccagccagtccagcccaacccttgtgccactctttctttctgttgctttttagactaagaagatgttccccctgccagccctcagtggtgcaggcagaatgttggggatgcttactgacctccactgctcttctcttgcagtctcctgcttcttcaacttcaccagcccgtctggggttgtcctgtctcccaactacccagaggactatggcaaccacctccactgtgtctggctcatcctggccaggcctgagagccgcatccacctggccttcaacgacattgacgtggagcctcagtttgatttcctggtcatcaaggatggggccaccgccgaggcgcccgtcctgggcaccttctcaggaaaccagcttccctcctccatcacaagcagtggccacgtggcccgtctcgagttccagactgaccactccacagggaagaggggcttcaacatcacttttaccagtgagtcctccctctgtcaccagctggccctccatctgagtgtctgcctctgaggatgatcgaaggtgctcccatggagggaggaggaggtgtggatggggcagttcccagggcattgcagggctgcagtgcccagtcatggagctcccagcatgaccaagaaagggcataaagcactggctgccaggcagggtgctcttttctggaagtccctctctgaagggcatttatctcccatagttgtgatatataatgtaaaaggaacctggaacctcatttttgccccaaccttccccatcctacaagacccaaccagaactagggagggcccaagagaaagaaagcctctatcattctcattggtttctgatgccctctctgaggtgctctccgaaatccctgaatgcctgcctgctgctgacctctgagttcgtgccggggctgctcactttgctttgcccagttcccattcccatagtcamatcagaatcaaagctttggagcaacacttctgttgggctcccagacttactggggacaactcttagggaatttcctcatagcccctctgagggccaccatctgaaagttgccacctccagtttcaatcctgggccccttctctagaagcagcctaaactcagcagtgattatttttatttctgtatctcgtggttacagagggggttggggggggggcgggcagaagcttggtgactagaaatagcaagccaccaaagatagcaagaagtggttatcaggtcgtaagaagctataaatccagtggacttggctgatgacaaacagtcaagtgaggctggaggtgggtccatctgagcaattaactagatcctttcccagaggctgcttgtgaagggcgagtccccagtgcaagctctgctccatgcccacaaacactgatctcccaacccccattcccaccgttggcataaaggccttgcctccgttttccacctatctctggagtccagttggactgaagacattagatgctacctggtgggccatttgggtcccccgattccaagagaccagccaggtaaagcccattccattcccctcaccactcttgtttaggacacaatcaaccttctcagggcatgtctcctccaggggattcctgtttcatctgctgtgggcaggaagaagcagggggagatcctagttctgtctttcctaaccctagtctagcactgaccatgctgcttcacactagaaaggagcgagtatgctttccttatctttatatcccttggccccgcacagggcctggtgtgtgctaaggatcagcaaatgtttacggaatggaaggatccatgaatgagtaaatgctttctcttgccctggcggagtaggaagaacaaggataaaaggtatcctggggagcacayttatccaggatggtgagggccaagaagtcatgtgggtttgcagcatgtgtggacactgagtgggaacttgggaggaggaggcagctgatggcccaggggctgagcttcatcatgacggcagcagactaacctgaggatagctcttacttgtatttctttccaaggtttctctaccattgtaaaaatgatacacatccaatctgtaaatactcaaaaaatgggagaggtcaaaggagagatgttaaccactacccaaaatcccccagccagaaatgatycttgccaacaattggtggacactattacagatatcacatagttttctatgcatttatacaaatagacagttggatggattgatagaaataatttttaaaaatctgggccgcatcctagacctgctgaattagaatcactaaagggatggggccccagaatctacatttttggtaggcttctgaggcgatcggatgcagtcagtgaaacaatcstccatggccaagtgtcagggaattagtgtagtctctcccataggaytttaatctcctcctacatcccaactgatgatcactgaggctgagcttgartttgcccagtgtcagggagctygcctccccagacagctctctccatagctagcaggcactctagatttcaagtcaacttatgttgacttgaaatctgtgtccctgtaacaaggatcagtggtcccacttccacccctagaactcccggtaacaaggctaattcctcttccacatggaacataatgaacaacaatgacagtagctgccatccattaagcacctcctgtgggctgaacctggtgctgagcactcaacagtcatcactggaagcctcacaacaaaaactccataaagcaagatctacccctttcacatgccagaaaactgaggtttggaaaggtacacagggagaagtgggtccttgactcagagcttttgctcccagatgttggaaataactccatattcctgctatgtgcatttgcgcttgtgtgtgtgcgcatgcacgcgcgcgcgtgtatgtgtgtgttcatatgtgggtgtatgtatctgtgcctacatgtgtatgactgatgcatttgaaagaaaaatgcctggacttctgggccccaagcatcattttttttcccacaccatatttctaaatgtcagggtgacttcgtggtcatagtttccaacgaagaaaggttgggagactcaagtctgggctgacctaagcgttcaaatggaagggtgttgggcactcaactgaagccctgcatgggatcatcacagtcatctccacatcagaggctcccttacctcatctgcaatgggaagggtcaggtttgcaggcctcttgcctctagcaagatccagcagcccctagggccactgctgtttctgaatgtgcaaatgtttctatcactagggaatttcagaggccaagaaatttttttttcaagtggcccatacccatgcagccatggatcctggtctccactggaaagctgccatcctcagaacaacaggggtgaaaatagagcctggcttcggagacatttagtaagagaactgtgaygcccctgctggaggaaggcagggaacatgcttggtagagactgagcaggaaagagtatcttcccatgcagaggagggaagaaggaagggaactcatcttcagtgagcacttaccatctgtcacgtgccgcaccgaacaattgccactctcatattcacatcaactttcattttatttctatctcagaatgaccctgcaagtgaaggatgatctccatattatcagtcaggaaactaaggctcatcagaattgcataagttgtccaggaccatgtaacgaataaaaggcaaagcatgattaaatctacagcgttctgactctgtcctctccccactctgcattatcaattgcctgggtagagtgagaggcagccctgacaataggcaaggaaataaaggaaatagcttcagacagggttaattctagggcacctcctttatgatgcttagagtctattagcgtcacagaatttagagtccagctcacctcaagcagaaatgatcccataactgtctgaagttagggaatcttggaatggatttgacattgaggagacagatcagctcattaaccacactgagcctcagtttcctcatttgtaaagtagggtaacaagagctacttcatagaatcattatgtggtgtaaatgagctaacagcagaaacacttagcttattgcctgatctataaatgtccattagaatgcagtgggattaggtgctcgggaaggcaggaaatcaagtttaatgagcacctgcttaatgccgaggtcctagaatgcctagctctcccrccaacatggcaagttcttggggaggtggtggagttctagggtttcccatcccaaggaagctaattttctttagggattcttctctactccagcaatgtctgatcatgtccttgaactccatctacacagccttccgacacaacgagtgcccggatcctggcgttccagtaaatggcaaacggtttggggacagcctccagctgggcagctccatctccttcctctgtgatgaaggcttccttgggactcagggctcagagaccatcacctgcgtcctgaaggagggcagcgtggtctggaacagcgctgtgctgcggtgtgaaggtacgagcctgcaggctgggagcagtggccattgtcagccagagaggctggggagggggagcaagcagcccaggccatggtggttcctttctgcgttggtccttcctcttctcccagaacgaagggccactctctcaccctcatgctggaatagcaggggcttcataaggccactgtgcgtaggaatttaaattataaccagagattaaagtagagaaacggctctggattgtcaggyatcaaaagcacctcttctttcaaatgagaactctcttcggtatcacagccattaagatccctgtttccagctcctgcccaggggagctccggcagcccaaagtagcattggcagcgctgcgagttttcgggtctttcaagctgcctgtcactctttccttctccacatgtttattttccccaattccctgggatgtctcccagtctcggcctttgtgccctgttaaatgctgactttatatccttgtggtcagtctccaggagactcagggccaaccagccagaagaaacacagcttgcagcaggcacacggctgatgatggcagttcttcagtcctgcctcgccacacaagacagtttttgactcaattttcaagaccagccatctgttccaccaaactacagacatttaaaatacagataaagcttcttgaggcaggagtcaggttaaatttgtgtaccaagcatggtgtaccaagcatttgtgcaccaggcaaatttgtgtaccaagcattgtgtaccaaccgtggtacctggcacggaataggtgcttaataaatatttgtgaataatggatgaatagtgagtatcccaagggccccttggggaaactgacagtatccaagsagacgaaggctgtgattctctccttttaggaggcagaaaccttcttctcacatttcatgtgatagaaagaggatagagacttaagagacctcttgacttaacccaattcctaaactcaaatctgggcatagtggccatgaacaggaaggacaggagaatgaagaagggagcatgcctgagagagagtrttacccagagcttacaaatggctcgatgggagacaagggaccactgagaacactggaggtggcaagcagtccaggtgggcatttgagtgagaggggcccaagctgggatcctggcaattcacttttccccttgagcctttgtattttccagctggaaaaaaaaggagggataatgataattatcagatgtgtatggagtaggcagtcctggtataaagtaagtcctcataagctgcgccttcactgtcacgtaaactccatgaggttagggaatcttccttggcctcatattcccacagctggtgtgttgtttgatacttggtagatgctcaatcaatactggttgatgagtcaccgaataaatgaatgaatgaatggccttttaactaggctagagcctccctaatgagacgcatatcaatgaaaggcctccagagccccgactctcaccagactgcctgctgtctccaccctgcaacttatcatccaagccaccctggggaagtaacttgacctctctgtgcctcagttgccccactgtaaaatgcaggttgataatgggaacccgcttgaagagttgtcttgagcatgcacagttcttggagcagtgcctggtgagaggtaacactcaataagtgttggccattagcgttaacttgattttaactatttcttcattggaccaaccagatcaatatttgctccactttgggggatcaagtggtgcgtttccatccttccaggaacttgccccaaccgtgacatgaatagayatttttttctgacttccaaacttcccgcagtgtggtctgtacaacctcatctgccattcttcctcagtgcaatcagcacttttggaaagaacagaagctttggagttagagaaacaacacgaaactcagtctccatgcttcccagctgtagaattaatgggcttaggttaagtaactagacctagacctcaggtccctcactggcaacaggggaataagtatgcatatctgatggagttmtttgctggtgaaacaggtcaccgtacaaagcatccatgcagaacccagtctggagggttgtgaatcggtggtctttcaccttcctacagaccagccccctcattttcccttgcactcattgaccacttctaatttctttagttttcgttgtgttggttcatatctctgagatcttccctgctgtctctagctcacctgatctcttccttctcctaatttctattatttttcatgggccaccaccactggaccactttcttggatactggttcttaccattattacatttaccagttccacaggccttggtcctgtctgcccaacaagactgtgagtggtctcagggcagaaggccagattcccattgcccctgagcctgcaggggcttagtcccaaattagttgactgctctgaggaaccctcaggaattagtaactgcacaatcctcctctccacctgccaccctcctgaatcaagtgctcttagactttagctctgcgatgcattgaaaccytcaaggccatgtatgaacacatgagataatttgacctttgttaatggatcttcaagtggctcactattttttttttttctttgagacggagtcttgctgtcgcccaggctggagtgcagtggcgtgatcttggctcactgcaagctccacctcccaggttcacgccattctcctgcctcagcctcccaagtagctgggactacaggcgcccaccaccacacccagctaattttttgtattttcagtagagacagggtttcaccgtgttagccaggatggtcttgatctcctgacctcgtgatccacccacctcagcctcccgcggctcactatttcataagcaaggtcttcattttaaagttaaaaaggtctttttcattctgtccctggagggggaaatgctgtagggttggggcagtaggcactagaagtaagggacagtctattggagaccctgaccccagggagagcccgctcggttttctcagagcgatgggcatttgatgccagcctggttttcagggatctgggaagttgcatgccaggcagagtgtgagagcctgatgccacttagggtggctgaatcccagccttaaaaccttagacagagctggctaaagaagcccctgggaacctgtcccttcttggctcctctccctccttttgtctgagccttggtagagctctgctttgcaatcagcatctttgtcttttccgttttttttctagttttgtttttgattaagtgtccccaccttgtggacaattaaatgcagaagctaatggtcttttagaaaatcttttaatatatgctaagagccacttagcttttgagaggctataataggacaagagagacgatggcttctcctaaatttagaaagaaggatgattatctggaggatctaaagcaggggtcggcaaactttttcttaaagggccagagaggaagtattttcgactgtgtgggctataactctgctgtcctaatgcaacagcagccttagacaatacggaagtgaatgggctagattgaccaagtctgtgatcttgagttcacaggacacaggagtcccttaggtgtaaaatcagaaatttcccaagaaagacttccgggtagtgaaggcagctacaccggcgtacctgcctgactttctctcccctacacttacctcttccttgtctctttaaaggaaaaataatcataccccactaggataagtgtcttacagtgtcacctcatttcaaccttgcaccagtcctaggaaatagatgtcgttattgtccctgctaggacacagacaggttaagtcacctgcgtaggatcttcccagcttgtaaatgatggagccagaattcaaatccagactcttggctaccctgttactgtatttttcttgaattatatcactgaagagaatatagtttccaacacctctatgaaagacttaaaagcatctccaaatagaacgaaaagcaggatttctactttcgacatccccgtagaaaattaaaaggaaatacattgcctaatgcataagacaaagaagacaggacatcacatggagacatcggaaattgacagcatgaaacaaaatgacagcagaagacaaacatatcagttatgataataaaagtaattaaactccctattaaaagacaaagagctgagctttaagaatattctgcttacaagaaatacacacaaaaaaagataaattatctacagtgagtgtgtattttcttttttctttttcttttttcttttttttttttgagatggaatcttgctctgtcatccaggctggagtgcagtggtgtgatctcagctcactgcagcctctgcctcccaagttcaagcgattctcctgcctcagcctcccgagtagctgggactacaggtgtatgcaaccatgcctggctaatttttgtattcttagtagagacggggtttcactatgttggccagactggtctcaaactcctgacctcatgatcttccagcctcggcctcccaaaatgcggggattacaggcttgagccaccacacctggcccctgtattttcattttttaaattttaaagaaatactcggagggttgcttgagcctgggaattagaggctgcagtgagctatgattgtactactgctctccagcctgggcgacagagctagactctgtcaaataaacaaataaaggaatacttggtggttgtaaaaatttcaaatgatgcacaagtgcaatacagctcaaagtggaaatgctcatttcccagtcccactccccagaggaaaatggtttaacagtttggtataaacacatccacatttattctctatctacaccaaatgtgttacttttaaaatcaggaaaaaagcaagtactgtaataaagaaagaaggtcagttctcctcatgaccacaaagaaatctaagtggtggtggtagctcattttggcattaaggaagaactataagggtagttactgcatttctagcaatctctcatttaatcttcttgccactcttgcaagaaagatgtaattgtgctttatccatgagaatccgcaaaaacagtgaggtgagttgacgttcccaaaatcacccagctggtaatcattgagcacatactatgtgctaaataccaggccaattgctttacatctgtattagtccattctcacattgctatgaagaaatgcccaagactgggtaatttataaaggaaaggtttaattgactcacagtttcacattgctggggaggcctcaggaaacttacactcatggtgaaaggcaaaagagaagcaggcaccttcttcacagggcgtcaggacagagtgagtgcaagcaagggaaatgccagatgcaaaccatcaaatctcctgcgactcactatcatgacagcagcatgggggaaactgcccccatgatccgattacctccacctggtcctgcccttgacacgcagggattatggggattataactcgaggtgagatttgggtggggacacagagcccaaccatatcaacatccactgccccattgactcttcatgaggaggtattgttatcctcacttcacagatgaagaaactgaagctcaaaatggttatgtaacttgcttaagaccatagctaagtgaatgagagagtcaaggttcaaatccagatattctgattccagaatcatcacttttaacctccaagtgaggtctgagtcccaagttcattctgcttatattctaccacaaaacagtggaagacaggtggtaaggggcacaggtgggtagtggggaggcagagctagagagtaggaggcaacacttccagccgcagggctgagtaactccagaggcactctggtcagaggaaaggacttccactacttctggtcactcacactggacagctagtcaacaaaaccccttagcagcagcctacatcccgttacagaagcagtggttgaggtgggcattcccacgtccacccagagtggttaaaaatgcaggctctggagctggactgcccaggtttaaatcctgaccctgcgacttcctagtgtgtgttcctggccagtcgcctaagctctttgtacctcaagtatgttccctcagctatgaaatgaggttaatgtctgtgcccgccttataggtggctgtgaagactaacacacaggggaagcaaaagcatacatgaaggtcagagcctggcatgttgtagagctcagtgctcaatgagtatttgttctctgtattctattctgtcaccattccctattcctctttgccttgcacaactttagcatcagggtcaggagaagtggctcatccctcacaggggacagcaacccctcatcagaagctcagtgtatcagtcagcctgggctgccgtaacacagtgccacagacttggtgccttaaacaacataaatttattttctcacaggtctgaaagctggaagttcaagatcaaggtactggcagggctggtttctcctgaagcatctctccttggcttgcagatgcccacttcctctctgtgttctcacgtggcctgttttcctgtgcacatgcacccctggtgtcttcctcttataatgaggacaccagtcctactggactagggctctatcctcatgacctcatttaaccttatttacctcctgaaaggctctctctccaaatgcagtcacattggtggctagggtttcaacctctacattttgggaggacacaattccatccataacacccagtatccctgcctatcaaccagtatttcattccttcaacaaatattgaacatctagtgagtaccaggtgctgggacagtcacagggtccctcttttgtcttattgctgagctcttctccctgttcaagagaggatccttccttctttttccttcttttctttgtgtgtgtgtgtgtgtgcatgtgcacgcacacagacatgtgtgtgcttccctgtttttgccttcaccttgtttaaatgaaaaatttcaaacatataccaaaacagagagaatagtataatgaacccacatgtacctatcagtcaacctcaacaattataaactcatggcctattttgttttcatttatatccccacccattcccccacaaccaccctgctggttctgggattatttcgcagcaaatttcagtcatcacacttcatctatgacattttagtaatgtgtctccaacagataaaactagctctttaaaacataaccacattgctatcattttaaaaaattaaaaacaattaatataatcaaatttccatgattggctaatacgttctttgatagtatttttaagtcagtatccttgttagcttcatacattataattggctgatatgtctcaagtcttttctaatctataggtgtctactccccacccccttgagatttttttgttgttgcagaagtcgggtcatttatctggagataaatgagaattattcagaatgaggagtctcctgcattcggaattttgccagttgcttccctgggaggttgtttaacacaattgtctctcttttatgttccctttaattggcagtaagatctagaaacttaatcagattgarcttccatttttttagcragaatatcttgtaggcaatgtcttcaacagaatcatatgatatttgggtatctctcttttggggtcattaggaaccattaatgatcataccctaggaattacaaaatggtaacatgctataatttattttttcataagctgaaatgctacacttaaagaaaacttgtcctcatcaactatttggttactccgagatacagtttgtaaaggaaaagcaaggaaataattatttgtatttgccggtttttgtattaatgagttgattccctaacaccttccaaagttgcacatttttaaatatcattacaatccaaacatactttatgtatttaaatctactgcagtttgttctaattaatgctcaaattgtgtcattggctagtgggagccttttgaagttggcctaacatcatcttgtacattttctgtctctgacccagaatcagttatttctcctagaaaccctggttccttttagtggaaactgatatttaaaatttgggcactaggggtactttttattattgacttcgttcctgtttctaagccttttcaatgarcacagctaggaaacagtttttaaaagaaaattcgtcatgggtttatttcatttccaatgtaaaaacactttttcttttttacttaacttctttaatatcatatccatatctcctttcactcttgctgaaaatcccagttcccaacaccattaatataatttcccaattcataggacatgcctaagagtcccaaagtagtaataccaatggctaccaacaataatataattacagagaatagtttaagggtttttttttttttcatttctttttgtatcctattaaggtaggctatcaaattattgtgttttaaaatctcttttactagtttcttcatgtgggattatgctaccaactaatctagcattgcattcatttatttcactctgcttctgagtttctagaaattgcttatcagtttattgatttgcttaatctttcattttaattatttaaaatatttacatagttccaaagctaaatatataaaaaaggtatattctgagaaagcctagcwtctatccctatcttctctaccctgttccctccgtccttctgtgaataatcttttagtttttggtttatcctttcagtgattgttaatatgagtgaatatgtgtgtatgcctctgcccctttcttagataaagagaatcataccatacctactaatctctaccatgcttttattcacttaacaacatagtctgggaaccactccatgatattatatagaatatccctcattcttgttttatagctgcataaatagtccattttgttgattaccctagtttattcagttagatctctaccactgaacatttgggctgtttccatacatttgctatcacaaatagtgctaccttgcataaccttgtacatatatgtcatttcatatttttgccagtgtatctttgggagagttctagaaatagaattgctgggtcagagagtaaatgcatatgcattttgttggatattaccaaattcctctgcacagcagttgtaccatattgcacgttcaccagcaaggtcctagaatccttggtttctcacggcctcatgtgtcattaaactttggattttgcctatctgatggatgagaaacaatatttcactgtgcttttaatatgtatttttatgtttaagagtgaggtcratcatcttttcaaatgtgaaagagacattgcatttaagaatcctcccctccaacatcacactctggggactgttgtggggtggggggaggggggagggatagctttaggagatatacctaatgctaaatgacgagttaatgggtgcagcacaccagcatggcacatgtatacatatgtaactaacctgcacattgtgcacatgtactctaaaacttaaagtataataataataaaattttaaaaaattaaaaaaaaaaaaaaaaagaatcctcccctccaaatccctgccgggcaactaccactctgcaatatgaagatgaacaacagagaaagtgaaggacagaatgattaaataggtcactggacaatcacaggtgcacaggaagagattaactagccaaactaatgaagcaacacagcagagaaagaaagcaaagtggtgaccgccaaaggaagggattgaatttccctctctggagattgtagatggggtttcgttgatatgtatgcactgagtggagagtggcctagacaggcaatggagactgcatgatctgtagctccccgggcagtaaatggggaratcacagtccaacaaccagagatgctgggcctgtgctgagatggagccaagaaagagtccctcctcactgctgagatgcaaacctgtattgtaacaatgggatgtagcaataggcacgcccctccccacctctaaggtctcatgtgtccacctgagaaatggaggaaagcattagtagttgcagtgagatggatggatgggttttgaaaactggggttacccaggaagtgacaatacacatacacaatttactctcccaatgtttgatatagctctatgtaattatttagtttctctaagcctcaatttactgaaaatggggtaataatccccgcctataaaacgaggatgataatagtacgtgccatttagtgttgccattgtcacaaggataatccacattaagccctgacacatagtaagttatcgatacacatgagcttattactgttggctgtggttgtagcactattatgtgtcacgggggatttagagacagaagtcttgagattcaatctcagctctaatttcattagctctgtatccttgatctagtctcttaacctacttggccttagttttcttctctataaaatagggataataacttcataaatgcatgcatttaaatgagataacacatgtgtagcaattagcatagtaagtcatcagtaagagttgacgactactacccttattataatcttctttgttaattaaacttcctaatataagtttctattaagaatacttgacaactattttagataattcttgaaggttatagcattaaaaaaaaaagaggattgggtatattagactatcttttatgaaactgattacctcgagaaatctacaaaactttgcagagagagaagtgctatgtagctctttattcctccccagtcttgttcagggaatttttggcatctgatagctccatagtaagggagtacaaaggagcagaggttcctttgacatgggaggcggcttagcttaaratctctggatttacgctgtcttgcctaggtctgaatccaagctctgcaacttgctaacccaaggctagttactcaacctccgtaagcctcagctttcctaggaggtaataatagcaccaacctcacaggggattttgttttgcaaagagtgaacatgattacgtatgtaagctcagtgcctgactgaggtggagtcaacccccagtcaatggcagtggtgatggcagtgacagaagcagtaatagtggatgtcatcatcatcctcatcatcagccttggggaggtgtgctagtctgggtgggctaggctacacggtgttaacttacaacctccaaatcccagcggcttaaaaatcaggagcttatatctcacacagaccactgaagctacatatttaacatgggtcatcagggatgtctgctccttagagtcacttaggggcccagattgatgagacttccctcttgacacttgcttccacaattaccgaggccggaaaaggaaactgtgtgcagatcacacacaggcttataaagtttccacagagacatgatgtacagcacttctgctctcattttattggtcacagcagtcacgtgaccttgcataacttcaaaaggggtgggcagtgaaatccaatcatgtgcccttgaaagaggaatagctctaatgactaccttaggggctgagggtctggttgcaggaagagacagtggtggtgggaaagaggcagctgagaatggggaagcccaggatgggacatgtggacagaggcataaataacagactttgcaagaccagagacagccagcagctgtgcctaggcctcccagtgtcctgtggagttmcctgccttggactgtattcattcatcctgtcattaactcattgattcatccaaccagcaatcattgagaaacaactgtgtgccaagcaccatgctcaatactggggatacccagttgtgtaacacaattaacacatcccatgccctcctggagtttacagtgaagcagggagtaccggcaccctgagctgaacgtctgagttgtagggtcctggggttctgaccttctccagggccagatgtgaggaggttggctgggtctatgcccctgcctcaggcctgacaattgagtgaggaacgaaggaaaaacaccatgtggcccaaatattagttgtacttcagcccttctagaatgacaaagggactttgcttaaaggattcttttcatttctcccatctggcctttaataacactccacatgatataactggacctacccataaaggtcccagtagacaaaactcacagtttatagtttatgtaattttccataaaaacaaaaactatacttattgcctgacacattttatagagagattttctgtttgtttactcatttgtccctgaagaaagctgcctctcttccttctgtccccccagctccctgtggtggtcacctgacttcgcccagcggcaccatcctctctccgggctggcctggcttctacaaggatgccttgagctgtgcctgggtgattgaggcccagccaggctaccccatcaaaatcaccttcgacaggtgcttgtgaccacagccttgggggagagggmaagggggagatttttacagagccacgtgggagggaatgcagggtggataggggaccagtaccaaygctgaaatgtcagcaaggttggagaacactggaccaaattgccctgggtggggcagacctcactggctctgcccttgggcttggtttgtgctgtttaggggactatggcaggaggggtgaagagaaggcttgggtaccatttgggatgttagagctcccccctccccagcccccaaggagggggagtgggcagatagacaccatcagatgttaaagcatgactctggtatctgacgagcattctcctggaaatgtccaacgtgggaaggcagccccccacctctgccccaaatcctgctcatgtgccccacttctagctcccaccctggctatgccccttgggtggagaacgtagccacctaaatgtgaaaacaaacttcttccggacaaagtgttcctggcctggaatagcagtctgcaaacttttgtgtgaagagccagatggtaaatattttaggctttgtgggccacttgcctacttgcatatctctgatgcatgctctgctttgcctttttttttttttaagatctctttacaaatgtaaaaagcatccttagctctccaggctatagaccagatctggccctgaggctttagtgtgctgacccctagcctagaatgttctgacctccatgaggctagtcattgtgcctctaggtcttaagctggctcacagatcaggccacagagaggatgagagcagtttccaaccatggaaggaggaggagggatgttaaatagagtggagaaggtccttctgcatcgctagtgaatgtgtgcaaattatattaaaagatcccagcctgccaaaatctggttattcggaagccctgggtcaggcagggctttatgtcatttgcaaattaataagcttggatttctcaagaaggcttcatttctgtcatttggcagattcaaaaccgaggtcaactatgacaccctggaagtacgcgatgggcggacttactcagcgcccttgatcggggtttaccacgggacccaggttccccagttcctcatcagcaccagcaactacctctacctcctyttctctaccgacaagagtcactcggacatcggcttccagctccgctatgasagtgagtctcagtgggctcaggaaaagggatgacaaggtcagcccaggtgggtcaaaggcctcaggactgtgctccaccacaggcccctgcttggccccatccccatggtgttcttggctaggctgtgcccttcagaaggccctggggaaggcactctgttgctctcagcatccctcaggtcatgggagcttagagttgttcacaaccttcacgctaggcccttgcgtgcagacctcctggcaggtgattgggtgccgccacgcygggcactctgggatcagaacatttgactgaccatgaagttaacccaagatggcatctcacacccacacttgtccttcctcatcacctcccacattcatcccctcgatttaaaggatcattgtcacttcagttctctgtagaccaacatagaaagctggagctgcgagcaccatgaggacaaggtcattttcttactcctaagccttagcatagcacctaagccactctcagcaaattctgacggccacatttcatgagtcagtaattggcaacttctgcctttaataaaccagggctctcttcttactctttggagtcaactggggtccctctgtagtgacagtaagctgtctgtcccagctgtggcctctctctttcagctataacactgcagtcagaccactgtctggatccaggaatcccagtaaatggacagcgtcatgggaatgacttctacgtgggcgcgctggtgaccttcagctgtgactcgggctacacattaagtgacggggagcctctggagtgtgagcccaacttccagtggagccgggccctgcccagttgtgaaggtgagggacaccatgagggggcgctaaagtagcagactcctctcctgccacagaaacacaggtgctcaaaagaccactgactccctcaccccatcagcgaaggttgggctttcgagagatgggggatggggtcccaggaggatgacgggggtgctccctgaggccctctggtctttcactgccctcttcactccttctrtagctctctgtggtggcttcattcaaggytccagtgggaccatcttgtcrccagggttccctgacttctaccccaacaacttgaactgcacctggattatcgaaacatctcatggcaagggtgagtgtttcagcccatagcaggcattgggatgtgacgaggtcagggacccaagttcctcaggtcaagttgacctcaatggggatctccctagatagtgacctctgggcttcgtctgaacttttctcaccaacaagaaaacttccagagtcttctcatccctttgaatggtagaacttgttcaataagtattgttgagattctaaaatctccctgctggaagagctcttagaggttaccagctrtccaatctcactcagtacaggaaccttctctaaatcactccctgcaagatggcaacacrccagctcagctcaccctctgcctaaacatgcctgatgtggggaggccaccaacccgttcaacaratgggcacctactatcatttttgcacagatgctttcttctaatagtctattaggtgtctctgaaaatgtttttcttgtattgcatcctggaggagcatcagatacacctgctccctcttcttcacattcacccttcagatactgaacacagcgatccccttcttgcataactcagctcctcccctgatgccatctttcatatgggtcaccagcctgcactgctgcctcagctcccctaacgtgagtgacctttgggagtccaagttcaaagtaaaagtgctggttataaataaatgttaattaatatattaatactcttttctcaacaaatatgtattcggtgccacccatgtggctgacactggggctgggcatcagcagtaaccaggcagatttggcttctagcctcagaagcttattgccaagttcatccagagtcatggttcttgcagtttggcaaatacactaatgcttaggcccaaggctagaggttttgattttctacgttggcggtggaaaccaggcatctatgttttcagaacactttgccagtaattttgatgcatgcttttaattaagaacctctgatctagaagaattaacatgcagaagagccaaaaaactaattttaaaggaagattaatcyttccggatattaaaatgttgttatgggctaaattaatgttaacaatgtggtatgagtacaagagtggacatacaaataagacgtggagaataattgtccagaaatagatccctccgtgtgtgcacacacatgcctgtgtacgtgtgagaaagagacagactttagtatataagtaaagtgtcatttcagatccattgaagaaaggatggattatgtaataaatggtgttaaaacagtgggttgaaccattggaacaaaagaaaaaaaaaccgtctatacctcaagcattctcaagcatttaatcacataaactccagcactagaggaacatgaatctctaacctcaggtgggcacgtactttaaagagtaacaacaaaggtagaatccataaaggcaaagactgctagattcaattaaaaaaaactttgaaaggatttaggttaaaaaaaaaaagttccataaaaatttaaagtcaaatactaaatagaaaaaaaaaaatcgcaacatgtgatcgactaaggattagcaaccagacacacaaagagttctttaaaatttttaggagacatatgcctagccaaaccagcccgcaaaatgagcaaagctataaagtaacactttgtaacagaggaaatacaaatggaaaatcatggacctcattaataatgaaacaagtgtaattttaaaagagaaataccatttccctttttaagtcatcaaagaaaattgtaacagtctgggggataatgtggacacttgcatgctattgactgctgacattgtgcgaaatggttcaggcattccagagggtgacttggtgatgtgaatcaaaagtctcgaaaatatattgtaagggacttaggaatctgcagattttggtatccaagggtggtcctggaacaaatcccctgcagatacagagggamaactgtacctgcctttgcatctagcaattccacttactggaatttatctgaagaaaataagtaaaactctacatcaagatttagcttcaaagatttcccctaagatattatgtattatactgaaaaattaagaactattaaaatgtccatcaataaggaaatgttaaataaacatagggtatggccatagaataaaatactaggcagctcctaaaaggaataacatgaaagaatatttaaagacctacaggggtggttgcaatactttgttaagtaaaaaaaataagtttgccaaaagaatatatttagtttaaaagacatccttgtttgcatagaaaacagcctggaaaaaatataccccaagatgttgtctcttattttcatcttttggcttttttctaattttgagcagtaaacacattacatctaaaatatactatttgtataacaaagaagatttgaaagaaaagtcatttatagtcccaccacatgtacttaagtgtgtcacttggcctttactaggcctgccctacccagggctagggtggcctggagcttactgcatcaaggcaagactagccaggtggtcagggtgaggcccaggattgtccgcttcccacaacattgttcctaaggaggggagggctggaacagtgtccttgttcatcctgcagagctgtttccaccaagcctggtcagaggagaccattggaaagaaaagcagcccctcacgatccctagagaaacaacccctgtcattgtggttttctctgtgtctgggcatctgtgattacaggaggtgtatgtttttctgtgagtttctatgtgtgtgttttttcctggaagtcaatcaagctcaccaactattttacaaatgtttatttgatacttgcactacccaaattgctaggaaaacagctgaacaagccactctgccagtgcctgccttcaggaagtttatgctttagtggtagtagacagcctaaaccaagatctcagtatatagcatgaccaatatgtgatagagcagacagagatgtgaaaacatcccaagcccagcccagggcttaggaaggtgtcctggagttgagacttcagctggtcttcaaagatgaacaggacatagcccggttgaaaggtgctcagcagagaatcaacaagaaatcatggatgaatgaccagatcacttcttccttagaaccacttaaaggcatcacctaattcttagcatagatccccaaattataaaatcgctaggccaggcacggtggctcatgcctgtaatcccagcactttgggtgtcaaggcaggcagatcacctgaggttgggagttcgaggccagcctgaccaacatggagaaaccccgtgtctactaaaaatacaaaaaaaattatttggcgggggtggcacatgcctgtaatcccagctactcaggaggctgaggcaggagaattgcttaaacccaggaggcagaggttgcggtgagccgagatcgtgccattgcactccagcctgggcaacaagagcaaaacttcatctcaaaaaataagaaataaaataaaataaaatagctggcacagcctcatagtccttacctgtctcagcctcattctgagccctctaaactaagttctagctacacaaaacttccttcagtttctrgaacttgccaggcttcccttctcctctagagctttacacatttgtacaatgttcttctctctggaacacttcgtctccccaagcaaggggaatgggaatctctgccgttgcccttgcctggccagcccttcatccttctgaatccccttcctctaatgagccttccctgaccccctctccccagctctgcatctaggttgggctcttctcccctgggctcccatagcatgcattctatacctccatgatttcagactttactccactgtagagaacttgcattttcatcatcagtctccctgacagactaggagctctgtgagagataggtctgtcttgtttcctgtagttttcttggcttctggctctatgcccggcacataaggaactcaagaagcatttggtgatatgaatcaaattgaactgagcccaggcccttctccagagggcattcttcgttctctgtttctaagagtatctcgggttaacagacctattaagctgctgtctgtgattgctccctaagaggcagcagtatggctcaggaaactcaaaactctgtgaaatttgaaatagttcaacttgccacctgcccagtccaagggagcagccaattcaggagtcctgagaatgtgcccttgctgagaccccagagctgacaccttttaacccgtgaggctttccgggagttagatgagttgagcaaagggaatgccttctgttgcacccctactgtgtgccagccactatgctgtgtgctttgcatatactttcccagttatgactcacttcgggggtaaatgtcacctgtaagagagatattattgcctacatattacagttgaagaacctggaacctgaggtgttaagcaaccttagccaagacctttgagcaggtaaatgggcttttgatccaggtgtttcttacccccaagtccatgccttttccactgccctgctctttctgctcctatgtggtattgatgtcattggtacgattttgcttggttcagtcaagtgaagtatttgtgtgtgcatctgtcacatcaaatctggattcaaactccaacatggggcctctctatttctgcaacaatgtcttcattttcacacaatggcccaaaaagccccaagcagtcagcgcagctgggaaacccagaggtttcagctcagatgtttgctcatccttagaatcccagccaaatgtttacccctttggaagggctctatttgcatgctagaagaatagagtgcaaagcgcgatgcttaatcaacttgtttccacctgtgactgggtctcacccgctctccacccaactccatgtcctaggtaggagggaaaggacgtatatttcctaagctgtatagactgagaacagttttctcatttgcagacatgtttrtatgtcaggagtakagcatgcacgtgggcacatgcacccacaagccttttcacatcaaggattttgacccccgtgaagccttcccaaccagtgaggcatagttcccattcttcctccatgccccactctgaattctcactagtagtgatgtgtctgtcttctccactaaactgggagatctttctcagtgcttagcacaaggcctggcacttggtaggtgcttaggccttgatgcttctcagttgcctgggaacagggtatttacaagctgcatctttggtcccatcgcttctgttgggttctgtctcctccacctctatctatagaagcccaaatcctccaggatcaccagcctctatcaacagagatgcaaggatataaaaacctttaaaatgctttagcattagaggcttatctccaaccatcatttataaaaaatgtagcagtaattatctagagaagtacttctcaaattgtaagtgtgtataaatcatttgggatctgaagagcatgcagattctgattcagtaggtcttcagtggaggccaaagattctgcaattctagtaagtcccccagtgctgaccacactgctggttcatggaccatactttgagtagaaagtgggatcacacttggagtagcaggtgggtcctagtctaacatgagttcctgtcctggcaccatccacaacacatagtcccaataggatactcacttggtgtgattctgcatggttcattcaagttaagtatttgtgtgtgcatctgtcacatcaaatctggattcaagctccgacatggggcatggcccatgtgcatggccacgcacttacacacatgcccaccaaacacaactgccatctggacaagttctagaattgctttgggtgttaagaccatgctgctctataacttccctcactacctgatctcttaccctacctggctgttcttaactacctgctctctttctgtagcctgagaggccgcaccctggagtagctgagagcacagcctctgcaatcggattgccttagttcagatcctagctctaccacatactagctgggcgaccttggacagatgacttcatctctttgtgcctccgtttccttggatgtaaactggagatgataataacatacccacgccacagggttcctggcagaattaaatgagtttttctgtctcccttccaagggacaggggctgactatagtgcaagtaaaagcagttaggacagtaaatatttagtgcttgaaatgttaatgaatatcattactttgattttattttatgctcttaaccttcccccttactggagctccctcctccctctttccagctctctgattgctctttgaccatctcccccatcgctccaacttcacctggtctcctactccctgtcacttctgcccatgcttccaatcaccccttctctgattctcactctgccctcttctctcctagccctcttctccttgcttgtggcttcagatatcaactatttgctggtgactcaaatctacctctgtagtccccctttaatcctgaacttccaaatctgtccttccagtggcccactagctctcactgcttgcatgcagaaaaggctaagtccattactcttctacaacccacaccttcctcctgcgtgcccttccctaggtaacagaagacatcaccatccttcaggtggacgtgccactggatgtcatgttatttctcctttgcattaagtgcctgctgtcttggctaccctaccctgacccctgaagsctcatggccatctcctgctcttgctccttctgccaagccccatcctctcccagtgcagagcagccaccaatataactgatctccctccctgctctccctccacttcatcctccttacagccaccaacatcttgctaaaactgagatctggtccactctggataggatggcttctcattgcctccagaaaaatattgggtctggcccccgtctacctatccagcttcaattccaggagtagccacacccagctgctgctcaacaaacctggaattgacagtccctttacacatatgggtctcctgcctgggacactcttccttcccttacctggttaattcctgtgcatccttttaagatccatgtcaattgtttactccttggtgaagccatcctccacctgcctcttcctgctgtcaactgctttctgttccggcccccatggcatgctgtctacattcattccagcactcagcactctgtattgcagctattcgtttaatgtctggtatatcctcttgcacctaaccctggatcctagcccatagtaaagactcaacaaatacacaaatgcttgttggatgaattaatgaatgtctctaaagcattctcataggtcaagccataaatctctcttttaaattttgagaactgtaaaattctccctgtaattttagaactgtaaaagaagaactgtaaaattcttctccctgactgaatctctgggcacttgtgtgttcaggttccttcattcagattcacctgtatgatttgtcaatgcatgcttgtagtcatacacacagatagacatttgcaaactggaaatgtttgtgtagatcctgtcttgcagctgaggttctccagccatctcgccatcaacaacctgaccctctggtctcttggcaggtgtgttcttcactttccacaccttccacctggaaagtggccatgactacctcctcatcactgagaacggcagcttcacccagcccctgaggcagctaactggatctcggctgccagctcccatcagcgctgggctctatggcaacttcactgcccaggtccgcttcatctctgatttctccatgtcatatgaaggattcaacatcaccttctcaggtaaagagtatgagggtccctgaggggaagagaccatggtgctatttgctctctcyttctgctaccagtctctggttttcctagcagatagatattaatccactctccagtccctgggaagttgaccttagtgcttcagcaaaagatgcttgggttagacccaagtaagaacttacctataatggtcttggaaggagttagcataatcactgaggattcttattctatgaaggtgtttaggatttgctctgaacatggcccacctagctggatgaactagaggacttcacaaaagtcccttcctaccttagttattcgagatttttcttctgattccacttccacattgccaaccccagcaatatgaaaaaaaaaaaggtttgaaattaacatattggagtggtttagtctcatttgggatctttttcatcaatgctaattttgtagtaatagatatttatctctctgtttagggatttggaaaagaaagtgcttttatttggcattcagggagaaaagaggacccttggctcctctcataccgagcccttcaccattcttgtcccgtagcaccccagagtacctccctccacctttctcagccacggccaggagtatcagatggattcctcctgggatggacaagaggtatccagcttctaggaactggggtgtggcccagcttagtcccctgccaggcctccaatgcagaagtcacctgtcacatccctggattcacttggccaatgggacatatccagccagtgagactcaacccttatgagagagaccctctttctcatcacacatccctggaggactgcatcctgaagggagaagcccttgcagacgagggactagtcacttctatgctgtcactagaggccccaggcagggctttggcccataaatgcccctggtcatgcttgccgtctgcctcaagtgccaacgtagctgagacatggcttctcgtcaggcatttggagtgtcttcaccagtgggagttgcctgaggctaagtcatgtattctgaccttctagaacctgctggttgaatgtatctagtttgttgcccagagacaaggaagcaggagagcctgtgagccccaaggcacaggtttaaaatggagataaaaggatagcacagagaagagctgagtcctgaggatcctcagaaatcctcctgggaagcctgtctaggaaaggctgtgccctttcactgctcacaggagtgggtgcagaccgcccgtcctggcctccccgtgcttctctctgcctctgcctccccgtgcttccccatgtttctctctgcctctgctcccctcgggctctcacttcttctctttttgggccagtgtcaccttttgtgggccagtgtgcgcatgccctcttctctgtctttcgttgtccctggccctttccccctggtgttttgcctgtgcgttcccatctttttgctttgtgtctcccygcaatgtctctgagcccggatctcctgctacctttccagagtacgacttggagccctgtgaggagcccgaggtcccagcctacagcatccggaagggcttgcagtttggcgtgggcracaccttgaccttctcctgcttccccgggtaccgtctggagggcaccgcccgcatcacgtgcctggggggcagacggcgcctgtggagctcgcctctgccaaggtgtgttggtaggtggtcacgtgctttcattttgcttcactaatggggtgggacagattatagtcaattgatgtgaggtggtggacggcacacaggccaagaggctgacttagcccacacttaccacacttacctgcagtgggacccggggcaggtaacctaacctccttctgctccatcctccttatctgcaaaatagggatggcaatccctgcttcatcaggcagttctgtataaactacagtgacctttacaaattaggtccacagtgggcactcacatgaagtcgatttcagtactcttacctccccaccctcagcacacagacccatggcttaaggatgcctcttaccgaggaatctggatgggcactaggtgggcctgtaggaggggtatatgacctttgcccagggggagtccccatctggaggagtagatgggtgcttttactaatccaatggyggtgctcactcttagagacgccttaggaaggcttcatccattcagcaggggaggacaaaaggaacaggggcggggtcatttatagatgacccactacatctcaggcatctgctaggttctgaaggtacaaaggtgaacaaaacagagaaattcttcactcgtggtccacattctggtggtggggacacaagctgtgaatatttagatatgtgatgtgtcaggcagtgttgaggcatacagagaaaaattaagtcagcttagaaagtgctggagctagggttgctcttttatcatggycagaaaaggcctctctgatgagttgacrtttggccagagatagatatctgggagaagagggaacagaggaccaagacccaaaccatgagcatgctcagcatttgaggaacagctcagaggccaagctggagcaagcggcagggagaacaggagatgtggaggttagaggcagctgttggaagttggaagtgggccctgccagcctccttgcaagagctttaaagaagtctgttcagagcgctgtgcccaggtagtaggggaagcaagtattttccccagggcggagtgattgctgtctgtccctaatgtatgaggctcctgggtgcctgtttgctcaatccttataatgtagggctggataaaacactagctgcattcatggagtattttccatgctcactgttagccatggacctcacgtaaagtgaaatagtatataaaaccccataaaaatatacaaaacagatcaaagcagcactgcactgactgaaacagggaccagcatctcaaatgccagtgaggtcagctgtgcccgagacaagtccatggagccctcaggctatgccgaggacagcttagacaggctggcaagatgagccgggcccaggctgtgcactcatgcaggccaaggtggggtcactgctctgccacttaccaacgcctagatctcaggcaggccagcaaacccccttaacctcagcttccttgtttataaaacagagataacagcatccaattcacaggctttactctaccttagatgacatcatttacataaaccaagaggtggcatataattwtcagcattttgccaataacatttttatctgtatttatcaataaccaattatygttattttgccaataaccttttacaatctcagaaaggaaacattaaaacaaagagctacagaattccatttctgarcaattaaataaccccagggtttactccgtctcctataaccatccccaaaggcatccacccaccctgatctggccacacacactcagaaacacatagaaccccgccacccaccccaggaaggttcagttcatgtctggctgctagcagctcctttagtctctgggaaagcatcctcagctaaatggttctgggggaaattctccttgaatggaattaaccaggaccacagatgcacacagcccttaagctcttgcctcattgatctcattacataaactcattctttaacttattattccaattactgtttgttcatgacacctcacaatattttcattattacatttgtcttctgtttcacatgttattaataatgcacagtagttatagtcacctctaattaccaccagccctgctgccgaggctcaggctggaggcatctcrggaatgcccaccgggggctgctcccagtcgccatgcaaattggatgatttagtccacatagtgctaccaggaacatttccagccgagaaggagatgaacagccctgggctttaatgcatggtgtgacgtgggtggcggggagggaggtgacatagcccctgayatcaggggcccctgaatttgatgtagaagagacagccctgaccccaggggaccccagtctgcagcaagagacatggccctgtccttgggaatcctggtgtgatggagaagacctaaccctctgcctcagaagccccaggctgatggataaggtacaacctctgcccttaacgagaccccttctgatgggggcgacagaagtcacagatgccagaatcagccacagcacttacctgtggttgtgactgtttgtttctctggaacatttatttgtttccatttgtgcctgtgtttggcttctragttcatctgttcacctcccctgttactttggagactctcccggaagcaagtgccccgtccctctatccctcctgtcccctccctggtgcccaggacaaaggcctgacagggagtcaggacctggggattggccaaggactggccacatctaaagctatcagcccctcctcgtaaaggtatcaggcgtgtgggaaggaggagaggctcgtgctggggcagaggtggggcacatagctcttatgcaggaagcagggccaggaaggaggtccaaaaacacacccaagcccatgtttaagggaagccagctgtcgagaattaggcagagggcaagaggcatcaggaaccatgagggtgctgtgagcctcgggcagctaatgcaygcttcccatatgcttctcaggctttctgccagtcccagaatccaggcagttagggttccaaatggaagcaggtaatccatgtagattcacctgggacattggtggagaggctactatgtgctaaccattcccctatgtttacctatcttatatataaaatctcatgcgttgattctacagtcttatgagaatgctattattgtccagatgaaggcagatgaagagattaaatttcagtgagttgacacaatgtatctaactccaaagtccatgatcatcccactgcaccacaggcctctgcctagatggaggggaaaggtagtaatctcagagaaaatggagagatgcttcagaaggctgcccatgtgatatgactgagtaataagtgtttacatatgcatggccctaagcaactccccctccccccgacaaatcctcaccctcaccctcatctgagatcatcaaagaaatgtacacatgctggaaacgtctatgtaaattatcagcagccactgcccccagggagcctgcccaccactgtcccttgagttttatgagccatctcagcacattcatcatgatatttggaagttttgcaaacagactaagtttaaaagtactgtaaagttagatttctcctccaagagaaataaatgaggccatatataaagtcttaggaaactgaagctggtcctgaattgagcaggacacagggaggagggtccattcagaaaagtagggacttggtggtgggacatgtggcccccatcttcaaaggactaatgaggagccttaggacaagataaaacacaagatgtataactaagcccatgagcagttcagctctgaaggtttccatgttctccatctatgctgcctcagcctagtacgctcctggcttagggtaattagggttaactataaggcccaagcaatggccctttggtcaaccccagggcttttctagccacagactgtgcctggactgaaggatactgagggatggtttagagaaagcagatttgctaccagccgcctgaaagattcaaggcatgctccaaattccccatatgtccacacgaataacaggcctgccatctggacttgtatttacatccttccggaacctaattattatttttaggactgtacatcttctgaggtcagtgtactccatatccattcattcattcattcattcattcattcagtaaatatttattttacagacaatccaggctaagccttggaaattcatagattcatccagcatgaccctagycctcaagttactgacagtttaggtgggggacayaggacaggcagcaagcaatcaaggtgcaatatgggaggtgctcagatacaggaaggaacagggaggggccccccaattattaaagatcccattcctctgtgcatgccctaagcctgccctgcctacgcactgtgtgggtgttaaggagacagtaacacgaccaagccccaaaggatccacagtgcagtagaggacatagaaatgttaacaaataagtgaagtaaaatgggatgactactataaataaaggtatgagaacaatggggaaagaatgactaattctggaggaggagaagcagtttccagaggagggtgtgatttcattagctgttgaatgaaacaggctgcaatgagactatgctaaaaactttccccaggacccaggaggttgagttctcagccccctcctcctcgtgaatccacagagaggcttggtctcagtggttgagtacctggttccttatctttaaaccagaaatgatcattgtgcctacattatggggctggctgttgcgactaatgactgaaatggtccttgtaaagtgtcaatcgtgctgttttgcacataagggttagcgattatgatgtgatcttgccccctcttagtttctattctgtgatactgaaaggcttcatctctcctcacttaactgcccccctcttcccctgacctcctcctcggtcatttctgttgctacgctactatatgaataggtatgtggcacggctgctttatagcactgagaaattgtaaaggatgcctggtgggttagcgtctgtttctgtaggagagagacagacaaacagcacaagagacagaaacaaagcaggcagcaccataggtagggaagtattttttttttaagtttgagaggcatttctgtagacagtccaacaactggacagacacgcaggcaccttggcaggtagacaggcaaacgacttgtcatctttgtcaggttcttcagagctgtgagttgctttctggatgcagctgatgggggttaatctatggttattgtgattctctttccagctgagtgtgggaattcagtcacaggcactcagggtactttgctgtcccccaactttcctgtgaactacaataacaatcatgaatgcatctactccatccagacccagccagggaagggaatycagctgaaagccagggcattcgaactctccgaaggagatgtcctcaaggtaaaattgatcgatttcagagtatgtgtgttatagtatgcaatagtctagtcaatactcactcctttgtctctgtgtgaatgatccaaactttctccttccttcctgagtcccaaaatactgtcctcactcatctgggagaaagagaggaccaaaagagaggggtatatgggtatctaagaatatggttttagagtttgtttagaagctgcctgctatcaaatgcatgtgtaattgagtatgggttgactgcataataaaagayaataatttagcttagggaacatggcaaagccccatctctacaaaaaatacaaaaattagctgggtgtggtggtgcatgcctgtagtcccagctactgggtaggctgaggtgggagggtcacttgagccagggaggttgaggttacagtgagccatgatcatgccactgcactccagactgggtgacagagtcagaccctgtctcaaaataataataataataataataataataataataataagttcggttggagcagccaatggatccagttttccattttgagccctgaccrtcaacatggatgatgaagagctcatagaacatgtatatatatgcatgtgtgtgttcatttgtgtagctatgtatttatggatatagatgcttttttaaatatgtttccacctgtgtgtgaatcggtgtccatgwatttggttttggggatctgtgtctgtgcayacctgtgtcagcatattgtgtgtatgtgcacttgtgcattgtgtatgttttggttgaataacaggctattgcagtagcttcagtgtactacgatgatggcctggtgtggcagtggggttaaagaaagtgagtttgagacatatgtaagggaargaaatgataggacttggattacagagaaggtcatagagagggatttgttaagacactgagcatatatgtcttatgtttctttgcataaatacaaagaatatgtgattgagtacctccaataatgtgtggtgtatgtctgtgtaatcacagagttgagcgtggagaatttattaaagagctgccttaataaaatgaatgataaggaaagcctcatacaaagcatgttcattttcattctaggccaaggaatttttttagctttttctaatatagttttattccttgtagccagagaagtccttacattggaaaaagttgaaccagagcccactactctggaaaatccaaagataaaccattaaatttccatgctttcagattatctccagatgtgataaatgtgctgtcctttttatgtacagatgatggatactcttggccaaccccctggggcatatgtcctctggggtgtatggtgtgtgtgtgtgtgtgtgtgtgtgtgtgtgtgtgtgtgtgtgtgtgtgcgcgcgcgtgtgcacgcgtgcgtgtttgaaatgcatttctcactcttacctaatcctttttgaacccaagaagattcactcatgagatcactggctgggactggatgtgcctgaaatgggatagaacaatctcattggcttcttaagctctgctttccaaccccacataaaaacagtgtgtgtctcccaacaagagaatacaagacaagggttttatgcccttccaataaccatgtctttaggcatcacccttgaccttcacttccctccatccatttgagtctcagagggtgcaatcagtacagcagcaccagagggacctcctctctgtagaggtacagatggagtaacgcaagctgggcaatgcagaggctttcttggatgaaggccattagcacaaaaagccagctttgaggcatagtttacaattttcaggttttgaagggagtataagcagtggttctgtgcaagtgacctgatagagccagcagaaatggctcccaggttgctggaggtcatatggagtatggccagtgcccatgcttcctcactaagggggtctagattcagaatagcacctaagacatagtcagcaggtgtgcacactcaacggcaccgtcagggttctggcttcagggtcaggtgggcagctcagtagataagcagagagagtctttctgaggtggtcagggtaagaaaggaggagggacatggggcataaaacctaggtcagagttcagggaggactaacagaggatgcaggagcccaggtagtgcacacacatacgtgcacacacacacgcatacacaaacacatgcacacacatgcayacrcacacaatgcacacacgcacacacacatacacacgcacgcacaaacacatgcacgcrcacacacacacacgtacatgcacacacacacacactctttagcaccagggtaggaaatgctcctgctacggcctctttgagtttagctcctctgctctcccttagagactgctgagtgtttccattcccaatttccattttccctctgttgtggtgtgccaacaagaaaattaactggatatgtgtaaatattcagtagatcagaagaagaagacatgtcttcggaatcagagctaattgcccctctgtaggcaacgaagaacagagacatactttaaaagctcctaatttgtattcttaagagaatttgagagaatattatatttatgacacaaaaataggcaataatgaaaacagagcaatctgagatgaggagagattgaatagagatgaaaaacatgatcacccaattaaaaaatggaatggaggcaatgaacggaagatggtaaaccacagaaaaatgaaatcagtttattaaaagataaatttgagaatttctcccacatctcataaggaaatgaaaaagaggattattttatattaataaaatggataatcaatccacagtaaaactttatgtgccaaataacatagcacgaataaattaaataaaaaccgctggaaatgtaaaamaatttaataaagttacagccatcatggaagattttaatatacctctgtaagtctgtgacatatcacctaacttaacgataaataaagatttgggtagcttgaataatgtaacataataaatcagaagaaagtaggagaaagatacttttaaagataaaggcagaaatgactagagaaacaaaactaaaaagcaatagcaattgtcaaccaaaccaactgtttttttttttttwaaataataaagtagacaatactagcagaactgatcaaggaataaagaagccacaaatatgtaatattaggaattgaaaagggacataatcaaagatataggagagattatggaaataagaaaatgtttagggatcacgccactgcactccagcctgggcgacaaagtgagaccctttttcaaaaaagagaaggaatgtttaggaacaactgtaagccaagaaatctgaaagctcagatgaaatggaaatttttatagataaaaagtactaatattaaaaaaaatctgaaaaaaaaacaatgaccattaaaaaattatgattcccccgtatcctctctcaaaagccccaggccttaactattttacaggtaagcttaacaaaacttcaagaagcaattaatccctgcaataaactcttcagaagagagaaaaataaagaaccatctcccaactcattttttcttaatgaggcaagtagaaactttggtatcaacgagtaaaattatggttaccaggkkattgagggaatggggagataatggtcaaagtatagamagcatcaattagacagaagaattaagggtttctttttcctttgagatgtattgcacgttacagtgaatatagcaaataataatgtatcatacatttcaaaatcactaaaagagtaaatttcaaatgttctcaccacagaaaaagataagtatttgaggtgatggttatgttagtttgatttactaattccacatygtattcataaatcataacatactttctactgcatgaatatattcagctataatttatcaatttataatttaaaataaaaattttaaaaagaacagaaatcagaaactattagggcagtctcacttttgatcacagatctaaaaattttgagtataaatctgattgaatttggctatgtattaaaacaaagatgagaccatcctggttaatacagtgaaaccctgtctctagtaaaaatacaaaaaaaaaaaaaaaattagcgggacgtgatggcgggtgcctgtagtcccagctacttgggaagctagggcaggagaatggcgtgaacctggaaggtggagcttgcagtgagccaagattgcagccactgcactccagcctgggtgacagagagagactccgtctcaaaaaacaaacaagcaaacaaagacgaccaagtaggtttgattccaggaatgtgaggatgtgtcaaaattagaaaagctcataatgttatttgttagacaaaccatatgaaattgctatttttgtaggtcaaaactgttaaaatattggcaatttcatggctcaacctaatagcctataaacagattagcaaagaaaaagacattatcctgctaatacaccccaaaacatcatgtgattaagttcaacacccactcatgatttttgaaaacatctcataaaactacaaatagaactttcctaacttgataaaaatatttctaccaaatgcctatagcaaacattatacttaatggcaaaacttcctaaagattttcagtaaagtcaagaacaagatcaatagttctactatcaccaatagaacgcagcattgtactgaagagacaaaccattacatttataccagaaaaagaaaaaaaggaactataaaaattagaaaggaatatagaaaattgtgacttttgtttcaaaaatacaaaacaatcaactaataaactcaaaatcaataagaaaattcacaaagcttctggtgtttctataaccaaataaaacttgcaatcaggagggaaagtctcatttataatagaaacaaaaactgtaagacacctagaaataagccctccaaaatgtgcatgatcttaactgagagaagataaaattttattttgatattgatgtaactaaaataaatgcagggagatttcattctcatggatgcacagagggtatgaaaaggcaggcaattcacagaaaaggaagtaagaactgttgataaacataaaaagatgctcaacttcaatggcgatcaaggatttacatattaaagtgagataccactttacactcatcaaattggaaaacatcataatgccctaaaataccaagtatcagcaaggatataaagcaatgaaagctgtcagacgttgctggtgagagagcaaattgctattccttttcaaagagcaatctggtaatatctaaccaaattgaagatgtgtcatccccacaaccagcttttccatgctagatgtatgctctagagaaactcaagcacacgtgtgcaagcggacatgcaggaatattcatagaaattatgcttacattgtttgtaattgtgtatagaaagctttctgcttagcatattcattttgaaaccagccatcttgctgacctgctttattggatgtaatggatgtgcatagattctcttggatttctcaatcacctgcacataatgatgaattggaccatcaagcaatattctgttaggaaataaatgtatacaaaggcccaattcccaatagcaatcaaaaatataaaaatacccaggaataagaacagaatggtagtgagagacataaaagacattttgattaaatggagctagacaccatgtatatggattggaagactcaatatcacatagatagatttttctcaaatccgtctatacatttaatgtagctcagtcagaattacacaagttttgttggggagttttttgttttactttttataattcaggaaaattcttgagtttagaagagtacatctgggagaattttgtttaagttaaaagaagacaaatgaggacttttcctactaattatttaaatatattgtaaagctacagtagctaaaacagtgtgggtcatgcacaggaatagacaaatagacaaatgcaatagaatagaaagttgacaaacaaaaccaaatgtatataattatatgttaattatatatgtgataaagactgatttgaaattagtagtgtgtggaatatttacaaacagagtttggttaaatgactaatctatcagggagttaaggtagaattgtatatcatatcccaaaataaattccaggtagatttaacgacatgaattctagaggaaaatattggtttatttatcatacatttactgagtgagccttatgtgccagagcatatattttgggcgctgatatgtaaataattatcttgcagattgggttaatttttattatagaaattcctgccaccatttaaatgctgttatggaaaaaatatttaatgactttaaaaatatacacattatattaagtgaaagagcagtttgccctatagtatctataattcgatcttattgttataaaaaattataaaaacataaatttatgcaaggaaataaatgcatagaataaaggctagaaggacacttaccaacatgttgtaagttctgaaagttatttgcacatttctgttttataagtttttctgcaattaatattgtaatgatgcaagtaacatttttgttcttgatgaattaggatgaattatgcttggaaattaaggaaaatatcctgttcccatcatactttttattaattaaccataatttcttaatagcatcatatatccagtgagggtttaaatttccaattatctcatagatgtcataatattttttaaatttatagtttatttgaatcaggattcaataaggtccacacattagattcattgtctgatgtgttttttaatctgtaggtttctccctccatctcttttcttttcccccttgtaacttacttgttgaggaaatcagatcatttgttcagtggaactttccactctggattttgctgaatgcactcacagggtatcatttcgtatgttcctctgtcctcggtatttattgcctgtaagttggaaattggatccagtggcttgatctgatcaggtctgattttttgggcaagataactccatgggtgatggtatatcttttattaaagaaacacatggtgtctgattgtctttcttactgcaattgatgattattatttcttattgcaattgatgattcctagtccattgatgataaatgccttggtccattgatttccatatgtttcggtgattaaaaatatttttgtaacaatttaagctaaactctttgaacttgtattatcttgatgtctgttggaaccccagaattcactcagtctatcagtgatacacagcaattacacaaggatctggaaacagacttcaggctcccaggagcctaaacaaatctctgtaatatacaacactgttagtttgaaggatggcttcttttagaaagctttgcttcataaatagtacaatggaaatattgtgccaatttgctggcagctggcatcacattgtgtgccatgcacaaatattcatcacccactcagagatcccatctttgatatttacaaaagcaccagggggtctttcactcaatcacaacttctgttgttatttgtacaattatctggaaaggagcagcaaccttgaaacctggggagccagttcattattctgatgattgttgtctttgctggtactaagaagttcaggggacagatgggagtgagggaagccagatgcctgtacgattccacccttggcaagcccagcaggccctagctggagccctcattttaggagggaaggggcagaggctgagcttggggaagaaaaagtcaccatgacatgctggtgtctggatcccagggatgatgtccagcagagtgctcaagacaggctactgccacagtggggtgggatcaggtgagaggatggctgtctcatctactggaaggacaggattgagggtttagcaatgtagagatgaatgctttcagcctgtctctctgaagaaacagatggtttgacaagyaggcaacccaaacctggcctccccaggctgctaaagagtaagctggtgctatatgggcattgcgggaacaagaacaaatctccactggaaagattagaatagcaatgagttcccaaagactagattcacactaaagatgggctgagcatagaactgacatcaagggaaaacgagataacttgctcagttgatagcttccctctgccatcttccttgcatctgataactcactgtgcctctgatagttgttaccagtgctaaastccaggastgtgggttgtggggtaaggaggtgttgttcaacataaggccatgctgacgacattgggttgggggtctctcctgtgtccaggtttatgatggcaacaacaactccgcccgtttgctgggagtttttagccattctgagatgatgggggtgactttgaacagcacatccagcagtctgtggcttgatttcatcactgatgctgaaaacaccagcaagggctttgaactgcacttttccagtaagtctttcttgcatctgtgtggacaaggaagtcagggtttcccrttttattcatttatttgagcttctgcttgctcacgagatacaaagaatgtgctcttaagactgttttaaaatccaatatgtatccatcagtggatgcatgggtaaacaaaatgtgatatgttcatacaatggaatagcatttgtccataaaaaggagtgaagtggccgggcacagtggttcatgcctataatcccagcactttgggaggccaaggcgggtggatcacgaggtcaggagttcaagaccagcctggccaagatggtgaaaccccatctctactaaaactacaaaaattagctgggcgtggtggcgggtgcctgtaatcccagctacttgggaggctgaggcaggagaattgcttgaacccggaaggcagaggttgcagtgagccgagattgygccactgcactctagcctgggtgacagagcaagactgtctaaaaaaagaaaaaaaaaaaatggagtaaagtatacatgctttgacatggatgacccttgaaaagattgcagtaagtgaaagaatccagtctcaaaggccacatattgtttgagctccatcatatgaactgtccagaacaggcaaatccatagagccagaaagtaaagggcagttgcctagggctgagggagttgggggaaaaatgtgtatggaacttctttttgaggtgataaaaatgttctagaactgattatggcaatagctgtacaactctgaatctactaaaagacattggattgtacacattaggtgggagaatgtatggtatgtgaattgtatctcaataaagaaagctattggggaaaatcatgcacggagtatagtcaggtttcccctcgtctgggctcaaggctgcctggcagaggatccttgcctgttacagcaagaggttcagtggaagaggattagagacacctttgaattccacttctatcatgtgaaaattgtgtaagtttggaacaatttatttaaccttcccaaatcaatgctctccgttgtaaaatgcagataattatacccacctgtaagactcctgtgaataacaaatgagagagaacacatgtatagcgccrtagagtgggagctctgcataaatctgtttccttttccagcccatttcaacagcgtatgtttaagcaggtcataactcagcttttaaacatacatttaaagtgacttctccatattacaccatcttatcagaatgtctcaataagcaaaatgaaaagaacgctcctgctagcaaaaatgctacggggtcaaacaaaagaaatagaaaatgcagaccttaggcctgaaaactattaaaagcagaaatcatttacatatagcaacagagaaatggatgttccttaatataccctcaactgagcatagaaatgaggaaatcctgactggtgaatccatcagaacccagggtccgtggctgagacagcttccttgaggacgtgggctttgagggaagagaggaagcatggtttctgccacaataggtcttactcactctacctcttctctcctcaccaggctttgaactcatcaaatgtgaggacccaggaacccccaagtttggctacaaggttcatgatgaaggtcattttgcagggagctccgtgtccttcagctgtgaccctggatacagcctgcggggtagtgaggagctgctgtgtctgagtggagagcgccggacctgggaccggcctctgcccacctgtgtcggtaggagggctcttcctctgcagggaacccttgggtctcccataataccaagctctagtcctggtcycattccagttagaccccatgctccagggcctgggggccatcaacttggactgaatcctcttgttaacaggcatcatggttcacctgcaccccttctccacttcctcactttcacacctcattacacccmtgcagcagtgcagtcaggcgggtggcttgcctttgtcgcacatttagcaagtgggaccacagccaagtcatgccctcaaaattgtaacgcgggtgatagcgatgaggtgggagagtccattagaaagggagagatggggcttttgcctgagttccagggcttatcgtaacgccaagactcaaatgagtctcccacccactttaggtctcagtttccctataggtaaaatggggctcattctccctttactggaggaatgtcaaaagacatagtaagataaagaacacccattgctctcactgataaagaatgcaataatgaacttgcatcttcttaaacctgtgattcttccagaatgtcatcagaggttctctagaatctttacacatgtgtcacaggacaagagacagtgatctgaggcagaagtgcaaaataggcaaaattggttgttctgtttggccttttcatctcttaccacccatctccctgctaatgtgagttcccccatactgcttcgtcctgcctcctacctttccaaaaccagatctgtctctctctccacccccttccccatgtcccacaacctcaacgtgtctgtgccagcactggctaatcttgtaagaacaaaacctccactggaaaaacacatacatgcctaccaagccccacatgccaaaattggtgcacatgtatgtctgggtatttgtggaggcagagaaataaatgaagaataaaacctgttcactgcccttgtcagggcccatactccagcatggagaatagacacataaacagataagtataatgtaagagaagcactgtaaaaagagttaagtgcaaaatgttgggaggatatgagaatgttttgcatgggaggtgatatttcaattgagacttggaagaatggattagaattcaccaacaggagggagaggaagggaggttgacattctagactgagcacgtgcaagggtgaaagtgtgaaccagcatggtgggaagtgttaaaggccacagatgcttttcccctagacgactacattttcacaggatctttaacactgttatacaatggagggtctaagtggaccctctgcaagtggacagaccraaacagtagcctttatggaacctctagggtcttcctctccctttgcctttgacctggtcttcaggcatatctcccctttcgccctccatctctttttatatctcccctcattcatgtgccaggaactatgctaggcactaggaatacagagaagagcagatctcaggccaggaagggtgatgcttgcataaacacacaaccgtataatgccacagacaagcaagccagagcacacaaaatgaaaaggagggatgatgactcgtattacaagataattatttgctttgcagaaaagattcactgtaagattactttgaatatcaaatatgccagttggactggacttattgggttcactcaagcagtataagagcatttaaacttagacttacactagaaccttggaggccttccccattgagactgcctctagcctgmtaggggattgaggctgtgtatttgagattatgtgcatatttttgtatatgtcatgttgtggtcgacttcatcatggtctaccacaaatgactgctatagcttaaaacatccaaatgttttattcttcggtgagtggactctgcagcccaaacaaagcagccaagactcaagggtgggaagaagggagaagaccagaaagagtagacttacatgttctcaatgttgttgaatctgctacatgctggcccactcagccccctcctgcccacctgccaggccccaggtaaggtatctagttgtccatgatgacatgttcccagtgctgctgcctccaaatcctcacttcccaggaagcaggaggtccttctctgtctggaatatggaaggaagctctaaccaaggacatggataatgccctcccacctttctagctacttcctctatttgtggaaccagtcaagcctcctccccacaattgtagtccatcctctcaccagcaccctactccctgccatgggtccattcagcctggcatctttcaatcaggttggcacctcccaccccaacagcaccttggagagaagagtgaagcttgagcagagggtcttgtagagggcctctcctgcaacccttccttagtggtcctgtgtgaaaccaacgggtccatgaaatgtttgatgtgtcctttatagcaacaggtaggggtcagtcttccatctgtgaccctgatcccttcttctcmtatttctagcatcttgcctaatcaactattccttttcctaaatagctctgcaatgaacatcctcctcttcatttgtaytcattctcccttgattcagacgcttatagtaatttgcatggaaagcaataatctgcttccattcatttgattgtccagccatccattaattcaataaacgttaagcatctataatgtgccaaacagtatactaggtacttgatgtgcagatataagacaaggtccctgctgccaaggagctcttagtcttgtggaggaaatagacatgattttaataacatgttacacatgctatagtagaaatctattcacattgtaatgcagacacaaaggagggcagtgtcagttctacctggggaggggaggtatgtcacaaaagatgtcacagcgaggatgtttattcaggtcctccatccaaatagagcttgtggacttcatcagcctagaccaaagagttcacggaggccaaagggagccactctggtgggctcagtgggctctactgaaaagtttagacttcatttggggagtgaatgcaagcagtgacttgtttgcatttgataaagatccgttgatggcactgcctagagcgtgggcaactctgccagcctagagattgtgagggcctgagtcaagactccagcaatgtgggcaaagtagagtcaaacatgaataataccacacaggtttagcgactgggtctcagaggcagattagatgtcggggaggaaggaggagaacaccagcaggaacccccagcttctgacttcagtgactgctccaatggggaatgtagacctcttcacctgcctccctgcctccagtttcacccctgctgtaccccatcatactgccaccacagtgactcctcctaacatgcaaagttcactgatgtgtcatgcagtcaattaactcacatgtataatcactgcaattctttcctggaacagtgaatatatgacagcctggtatccaaggtccttcaacctgtgatgcttcctcacctttccrgtcccatctccccsmtctccctatctcataccccagcctccagcctgccatgctgttcctcacctccaggaactttgcagttactcttctgtctctctctgcagtgccctccttcccatcctacccttgccacccaaccgacctggtcaactcttgcttctccttcaaggttcatttaagaccagcaccctccctgaccctcgctgtcctttgctcagggagattggtcacttctgctgctacttgttgttaggatacctagcacacagtgtggctgtcttctctactasacagtaaactcttccaggggagggcagtatcctgttgatctctgctgtcctggcagccagcagaggtcctgttgctatcaagaagcaggttgaagtacttgcatgttcctccctaggaggctttgaggaggttggtcacagaacaggcaatcagccctacactcagggaccatttttatttaccagtgtacaattcagttgtttgtagttatattagtctgttctcacactgctgtaaagatactacctgagactaggtaatttgtaaagaaaagaggcttaattgactcacagttcctcatggctggggaagcctcaggaaacatacaatcatggcggaaggggaagcaggcaccttctttacaaggcagcaggagagagaaaagtgagagaaggaggaacttcataagttctgatggaacttatamaaccatcagatctcgtgagagctcactcactatcatgagaacagtatggggaaaactggccccatgatccagtcacctcccaccaggttcctccctcaatatctggggattacaattcaagacgaaatttgggtagggacacaaagcctaaccatgtgagtagtatactcacaggcttgtacagccatcaccacaatctaatttttgaacattttgtcccccacaagagaaaacccatgcccattaacagccactccccgttgtccccttccccaggccctggcaaccactaacgtaccttctgtctccaagatttgcctattctaggtatttcacataagtggaatcgcacaatgtgtctgacttccttcacttaactaatgttttcagcgttcatctatattgtagcatgtagcaagccttgattccttgttgttgttgttgttgttgttattgttttgagatggagtttcgcatttgttgcccaggctggagtgcaatggtgcgatctcggttcaccacaacctccacctcctgggttcaagtgattctcctacctcagcctcctgagtagctgggattacaggcatgtaccaccacgcctggctaattttttgtatttttagtagagatggggtttctccatgttggtcaggctgatctgaaactcccgaccgcaggtaagccacccacctcagccccacaaaatgctgagattacagggatgagccaccatgcccggccgccttgattcctttttatggttgaatactattccattgtatggctatgccacattttgtttattcattcatcagttgatagacatttgggttgtttccactttttgataactatgaataacgttgctatgaacattcatgttcaagtttttatgtgaacatgttttcatttatcttgggtatatgcctaagagcagaattgctaggtcatatggtgactatgtttaacattttgaggaaccaccaacttgtttttgaaagcagctgcaccattttacatttccatcaataatgatgagagttccagtttctccactccccacctacgcttgtatagtctttttgactatagacatcccagtgggtgtgaagtgatatctcattgtgagtttgatttgtatttccctaatgactaacaatgttaaacatcttttcatgtatgtattggctatttatatatcctctttggagaaatgtttattcgaatcctttgccttttataaattgggttacttgtctttttattgttgatttgtaggggttctttataggttctggatataagtctcatccagagaccttttaatatgctgtgctcaatcacttgaaatgaatgggagagggaagggactcaagagcaaacaggcaaaaggagccactgagtgactgctggcagctcaggccaccccatgaagctcactcttttgggatttctttcagccgagtgtggagggacagtgagaggagaggtgtcggggcaggtgctgtcacccgggtatccagctccctatgaacacaatctcaactgcatctggaccatcgaagcagaggccggctgcaccattgggtaagtgtcagggctgacaaagtaactatcgccagttgttcaggggarccatcatcagcatcatcaccaggccatccagctagtgcctggcctgcctgcctcacctggagaaccttgtgatcaatagtggttgctatactggatgccttagaaaatctagaaaggtcagtctcagcctctcagggcttcatgccaagtccatacacctcactggcccagatagcacagttacagcagagtagccgagggcatggattgaaggcatgcagacccccatttgaatccaacccttccatgtactgtttgcaggactttgggaaagttccttatcctctctgcatctcattgtcctcttctgtagagtgtggatctcaggataaagcacttgaatgagatattgcatgtaatatgctcagtatagtatttggaacatagtgaaatatttaataacagttgctgtggttatttctgacagttagcaagcactaactcagctttagctgtatggcccctggcagattgcttcccttttttaggctgtttcctcatctttaaaatgaggacagaaatgcttgtattttagagttgtggaggaagtaaatagcaaaagaccagcagtggtatgtacttcttcaaaagataaattccttcaaaataggtatgccatcaaaatgtaacttccttccaggcattccttattggaatttcaaggagtcagaggagaaagaaccatcaccatttactgaacacagagcctaccttattaactccctgcaatagccctattgataataatagtaagccctaataacaaataggcattattgtaattcccattttatagatgagaaaactcagattccaagaggatgcatagcatttctaagtttgcacagggaatcaaaactctgagatccgaacccaggtctttctgaatcttcacactattgcactgctggcaaaacggggccttgagccatggctcaggtgagttaggaggaaaagagcaggttggggtagcagtatgagcggaggtatgaaaggaggatagaacaagggaattgggggggaaacagtctggctggagtaggggaaacacatgggtaaggaatgggagatagataggggtaaagtatagcctggttatggaccatcttaaatgccagtaactaagagggagccatggaaggttcttgagcagsgtcggtccaccagggttatttgcagtgtagagagctcatggggagacaccatcaggagtctgttacaatgatccaggaagtaagtgctaaggatttggaatagtgaggagccaagaaaaggaatagaagtatagctaggagaagattcctgcatgtaagagtttccaattaagaagaactggctgaatgggtgttttgctgcaagaaatatagatattcacttatgtacacagttcaattaatgttaaggaaatgtattaagtatttaatatgtacaaattttttagctaaactctgaggaaaataaggtcagcagtgtacatagggactttgcattgttagggaacaagttaaatatgcacattcatcctgcacggcactgctgggataaccttctgaaagcatacctgatcaattcaccctctgatcagaaaccggattccatggccaccccacgctcacagaataaaagctaaacattttattctggcctttgaggctacagcgacttcagcctccctccccaaccttattttccacttctcttcaatgacattccggcaaagcaaaattattggtgacccctgtacatggcctagctcagggcctagctcagggcctttgtttctactctgcccttcctctggaacgccctcctccctccaaaggcttacatctaaaattatccatccctcaaagtcaagtgcaaatgtcagctcacccgggaggtcatccctcaccccctctcttgcggggctcctaggagtcctttctgcctcttttgaacttccattrcctgttgcatatattttcctgatgacactgaccacttttctcctttatttatgctcatgccttacctcccctcctggagctgtggtctctgcctgattcatctttgcaagtctcccagctcttagcacagtgcccccggctcaacaagtgtcaagtgtttgatgaatgaaagaatgaatgaagcaagacccaagtataaaggtagttatatgcctagtggatctatgatagttcctcggtgactagtggttgaacaatgagtggatcgagaacataatgactatttcactttagtatacacatgtgcaaatcaagaggttttcccactttcttcacttggagcatcattcattgatgcattcattccctcatattcacaaatatctgtttgtttactacctggttgtscctgtgccagatgctggcattatataaatgaatgagatgtggccatggttcacaaagagcagacgcacatgtctgtccagaacaaggtggtggcacaatgaggaaggggaatgaaaaagcaggacaggaggagatgggagaagttattctggaaaaggtgaccctagagctgagtcctgaaggaaggagaggaggttgccaggtagccaaggaggaaggtgggtgggagggtaatgggcctctaggcagagtgaagcagtgtggtcagcctcaaggagctggaaatggttcccgcagctggatgatcacctgcgatttggtgggtggcggcattcatgggagatgaagctggtggtggaggctgtggggagcacagagggcgttggggctatgaggctgcgttttgacagctcctggcagtttggaggagaatgggcggagtgggacgggctgggccggtaagcgcagtgaggaagctgcctccagagtgtggctggggacgaggaggccagaagtcaggcagtggcagtggagatggagaagaagagaaaattcaggggacattcaagtgatcacaccaacttttctcaactactgtktgtgacaacaatacaccaagtaccygcgtacctaccgcctacacccaaatggcgttactattttgccatatatgcttatgtgctttctttgtkcttctctttccatccttttgttttcctttttgctgagctgctggaaagtacactgtcaacatcatgatacttcatttctagatgctttggcacacatcgtctaaagagaaggatgtgttcatccatggcatagcggccgtaatgtacctaaaaggcacagcattaattctctgggaattaaggagagcagagcagatctaggtgtggctggcacaaggaaattacaataaactgatgaatggatttctgggcagtagtgaggaccattttcactgatgagaatggtggctatgggggtggaggggagacaggaggcgcctttctagccctcaggaagacaagatcaaaaccaatacaggaaacgtcctctccagagtaacatagcaagaaatatgaagtcatggggggcatgctgaggatcccaaaatgggaagaagaaagtaaaggtccaaagaaggtaaagataacatcagtccttagtctggatggcttcttggagccacagcaacctcaaaggagctaatgtgaagtaagaagatgtcttcccagtttcactgagagctgcagaaagatggagatagagtggcaagacactgtcccttcctcattctcccaccccagtctgccatcccagccagtatgcatagcatgcacacgtacagctgtatttatgtgtgctcactccgtcctccccctttctctccccttcccttcttctttcccactccctctctccctctcctcctctccttccctccttctttcccactccctctcttcctctccttccctccctctctctctttttctcctctccctccgcctcaacccccaacacacacacacacctgtcttgaataaccagcagcaaagttaggataactcacactcataattagacaaacacaaaaagcccctttgtgtttgagtccttatttagttattatcttttttattagaaatatctttatagaatttttctatatacaaattaggtactcttttttttggaggagggttggacagtcttgttctattgcccagactggaatacagtggcactgtctcagctcactgcaacccctaccttccaggttcaagcagttctcatgcctcagcctcccaagtagctgggattacaggcaagcgccatcacgcctggctaatttttgtagagacagggtttcaccatgttagccaggctggtctcgaactcctggcctcaagtgattctcctgcctcagcctcccaaagtgctgggattacaggtgtgagccactgtgcccagccagataatcatttttttaaaattcaaaatttaaacaaatttataaactcgaaatgaaacgtttccacaatcttactctgtaatcttactcctcctcacaccccacataaaataactattaatgtctgtytgctctacttattcttttggatattttgtgtgccaatatgtacataaagcaaatgtaatgcacatgtttctaaaccaagttcatccacatgcatggcttagtagcttgttttctgttttacctcttaatcatatgtcaccatctcatcatgtcaatgtctatagacctacctcatcctgtttgatgggtacagagaattytattgtatgtaccaccataatttatttaactattcccctgttgaataagtgaatcttttcagcttttcactccaacattcttattcctgaatcttcgaacagttgtccatttatttccttaggatatatttttaggaggtaaattttgatacatgacctcaaattttcttctagatattatagcaatttacaagtctaccagaagtctatgggaaggcctgctaccccacgcagtatcactagacattgtcaatactttcagtcttcaccgcttagatggacaataggatatttaattgtctttgctgtttctggttctttgtgtgttttctgtttggacaatttgtctttttcatatagagtgttcarctgggctcatttctagtctataactcatttaggtttctcttaaatccaataatatttaagaattttttcagttactaagtggtttatagatcttgtatgcttttcattatttttattttgactgcattgtgcctttttttacttttcaaactttttgttttatttatgttccatgggcattgaagaatatgaaatgagtacaaggggctatatttcttttacataaaatgtattatgctttctttcaaacaraatacattatgcttctatattgcttttttttattgttaactcttcctgttgttagctgatctgctttaattggctttttgttctagtgatttcagagttctatatcctgtttttattttgccagtgatcttgtgttttcattaattcagttctcaacagtaattatcctgttctttaccctctttttgttttggaaatcttgcttttgtttttatttcaaggaaactaattttctgtttctagactgctcttgacagcctacttttgtttttatcaatatgttatcatcttgtatccctgagaatactatttgtgttttgttttacaatggttgtcagtttttccctgtgtcaactgcattttgcacttgagccatttggtttgattattcagctggattctttatgtcccatgagttttattgtttattcactatcaagtcatagctaagcgctggactctggtaccagcctacctgaactcttatttgctgtgttgctcagggaactctttaagccctctgtgcctcagttctcttatgtttaagatggtaattaaagagggtaccctccttaaggttgctatgaagattgagtgaacatatataaagcacctagaatgtggctggcttgtaattcccaaatgatgagaactcccacctggagctaggtggatagttgttcattttacccaaacagagtattcctaagcacagcaggctgtaagtcacccctaaaggatctcaggtggtgggtgctgtactgtgggtgggagcatgtgtgctaggtgggaagggacatgggctaggcagcaggctagccgatgaggctatttccaggggcacagacaggagaaggcttgcagatgcatctccctaccctgcttcagccctgatccagcactgagggtgaccagagggatctgtagccaggtttgctccagcaagctgggcaaggatggtcccttcccaggagtgcccaagaggcaaagtagttggctgcaggaatctacagtcaggcttacccttgggtgtggtccaagctggaaaatgggtcctgcctggatgtgtgtgacaagagtggaatggaaggcagcccctttccttgaaccctggtaatacctacagcatctggcaagtgcttcttcctaagtgccaagaatggggtggatgagccaatgcactccatccaggcctggcagctgacagcaggagggcagacccatgagctgctccctccctgtcacccttgcctgtgtcatcagtacatagaacacagaagtttcatcctataggagtggaaactcttctcagcttctggtgttgagctggagggttttgttttgttttgtttttaataatcagtgggcgagctcagatgaaaactggaaaagaaagggagggaaagccctttgctcttggttctgcccctctaaaacattcatcaaatacctatagcacaccaggttctgaatcagttattactgtccccattttatagatgagatcatcgaggcccagaaagaatgaatgaccttccttgagatctgacaattacccagtaatgtgggattggaacatgttccgtctaatgtcagtctttkctctttcccatctgccattcaggctgtggtctgattccatctaacaaaatatgcaatgattacctgctctgtgccagagactgtgtgatgctgtgcagtcggaaacacaaagtccagaccaaggccaggccttgtctgccaagagttcacattctagtggggaaatagtcaaacagacaggtacctccaagataaaatagatgctataagtgcaagccaagtgacggagttcagtaacagagaagagagagaggagttctgcctgggactgtagaggcaatctttccagctaggggtaagagagcaaaggtatgaacataggggaaaatacaggatctggccacgaaagggcactcacttgaygtggctggagctgcgtgcatgtgggcaaataaggctgtgtgggtaaggaggagtctttacacactgaaggccaagacaagaactctgaatggatttctcagtataataaggagctgttggaacactttaaagacagtaacaacattcagttcaatttaaaaacttggagcatttactcagtgctgggcattctgccaggcacgggggtataaatataaataagaaacagcttttccccttgaaggtctcagtattatagacagaaattatatcagttaggaatgaaaatagaaaaacggactaaagctggcttcaacagatgggggttcatttttctcctggaacaagaatctgaaggtcccatccagacttggtaccgctgctcaggaagccataaccttccttcttggtctgccatcctgaggctttcatcctcgtggctacctagttggctgccgcagctccagacattatgtctgtgttccagtctaaaagaagagggaagaggaaagggcacggagctctctcctgatgaaagtttgcttgtgtatttgggaagaaccactatccttagagatactgtcctacatctcattagtcagaacttgccatgcctggcagggaaaaagtgggaaatcaattttgctttgcttttagagcctcaatagtagagagatragaggtttggaaatgaagcacagatcatccaacccacagtttctgctatagattctaagataatgtgatgaatgctatagtggaagtatgcacgaaacacaatagaaaagtgtctgcgaggacagatcataattctgtatggcagttgggggtggactacagggaggaagcacctttccagctgcactttaaagaacagtaggagctcaccatgcagggtggaggtgaggccctcccaggcatgtgaaagggaggaagatatgaatgtacacagctgcttctggaagagctcattgtctaggggggatatgaggacttcaggaagatctgtggcagcagtgcagaggataaattggctgggaagccagggaggagcctaggagcactgttgagggatcctggttatattcaaaagaactgagtcatttcttatgcgcaaatgtggttcgggttgaagctacggttgtctggcttcgtggagggggaaggaagaagggagaggagacagtcctctgccgatgtgctttccctgcagagatctgggacccatggaaggtggagaacttctcactctggacactcggatttctgctatgcccataaagctcatatttggctaatagtccttgttttttaacttcagggatacttcttaatgattaacayacagggaaaactgaaaactccattcttggattttggtcaccatgcagcaggcattggcgggcatggttttgattaaccaggacccctgcccagtggagcttatcttcctgggaggatgctgggctagaaaaacatctggttgtgcctgaagcctggattcccttgctgtcgtttcagatcagtcacagggcagcaactccccacagtggtcagtgttgcctccctccagccagcaagtgggcagctggcccagaggaggcagaaggcaccagaagtgaagcttgcattcacagctcttgccaggaatcatggccacaggttcagcagcttccagagggtttatttctgagcaattatagcaagttaaaccttaaacagagaaggttcgtgtacttacactgcaagagctgatctcctaaaggaactgaacagagaagcacacacacagtggggtattcctttgtcagatttaagtcttcaacaaattggagaatagccaaaaggaatgtacacattttttgaaggagaggatgtggatagcctggaaggtataaatgaagctttgagaatggtggcactctccggccattcagtttttcatagaacacctctagagaaagaaacacaaactacttcaaattatcctcatacgataatctaaccgagctacactgagtagttgaattggccagaatgcatcaacttgactgccagtttaagatcccaaaactgaattccaacatctcttaggaggaaaataaactattcaaccaaagaaatgcacgttccctgtgggttgaccacactgaaycagtatagatctctccctttccaaaaataagtaaagaaataagcaaaaagtacataaaataaacttgtatgatgccacttaaaacataccactcattaaaagagaaccatctccctaaaaaaatacaaaatttttttctaaacatgttttactataatagacatgaaaatttaaatggatatagacataataatctcatttaaatataagaaatatgcatgatcaatagaagatggatgatgaaatgcaggaggagagattctgaaatagacagacagtgattaaggtaagaaaggaatgcgaagaaattaaacacacagyaacaactaaaatccacaatagcagcatttgccttgtaagaaataaaagcattgaagtagtagacaagctagactctaagtaatgaaaagtagacaaacatggaagacaaagtgccaatccaggaagcacaaatgcagaagagcaatgaaactgagcagaaggaataataatatacaaaaggccatcacctcccctggggaaaaggtggggagtgggttgaccaaggctaaaatgtgctcagtgaagtgaaaggagtcgttgaatttccagggaaaaaataaattagatacaacgtgatgaaaaatgaaatcgttccaaggggtgggagtgcttactccacaaagtaattcggggctctagaccttgggtgaggtagaagggaaagggggaggcagaggcaacctctagagcagaccaagggtataggagctcaggatgaattataaaaaatccctacaagcatttggcaaaaccgactcacacaggcaagtacatagtcatccctcattctataaaatattcatttacaaaaccaccmcaactaatccaaccctcctaagactccttttcttttccataataccaaagtccaaagtcagtggtgctattggcctcaagaattgttgattcagccaggaaatatgattcacttacaaaggtaacatattatcctcagatatgcacaaaagccacataaaattggctctcatcggcttcctgaggaacttacaaaaacattgtagtaggttgaayggtggcccccaaaaatgtgaggttccaatgcgtggaacctgtaaatattgccttatttggataaagggtctctgcaggtgtgattaaattaaggattttgaaatgaaggggttatcctggattatctgggtgaaccctakatgccaccacatgcaactttgtaagaagaagacagagggagattttatacacgtagaggagaaggtgattcaaagacagaggtagaggttagagtgatatagccataagccaacgaatgccagcagcatcagaaattggaagaggcaggaacagagtctattctggagcttccagagggagcatggccctactgacacattgattgaagcgcagcaatactgatttcagacatctggcctccagaactatgaaagaataaatttctggttttgtttatgtttgtttgtttgtttgatttggagtctcgctctgttgcccaggctggagtgcagtggtgcgatttcagctcactgcaaactccacctcccgggttcaagtgattctccgacctcagcctcccaagtacctggggttaaaggcacctgccaccacacctggctaatttttgtacttttagtagagacagggtttcatcatgtttgccaggctggtctagaactcctgacctcaggtgatctacctgcctcggcctcccaaagtgctgggattacaggcatgagccatcatgcctggccaaatttctagtgttttaagccaccaagtttgttgtaatatgttacagcatccacaggaagctaatacagacatacaatttttagccaactgagatgtttagaaaaactacacggtactaagaattggtgactatgaaagattgtgtgtaacttgggcctctagtccctacttatattgtcaatggtttgatggttgggagagggcatagggaaaggtgaaacctttttaagatttactgtcttacataagaagaagtaaaatggtataatatattatttttcttaaatttgatgattagagaaaatacaagtttaggagtacttttgaaaatgcttaaagaaaaccacccatagaatttaaaataaaatgtgtactttgcaaatcactaaagaaaacttacaaactaaggaatattacccaaaaaagcaagaaaatataataaacaaaagcataaaacacagccaggcgtggtgtctcatgcctgtaatcccagcactttgggaggctgagggaggtgaatcacttgaggccaggagttcgagaccagcatggtcaacccagctaaaccccatcttactaaaaatagaaaaattagccaggcatggtggcatgcacctgtagtcccagctattcaggaggctgaggcatgagaatcacttgaacacaggaggcggagcttatagtgggcttagatcatgccactgtactccagcctgggtgccagagtgagattctgtctcaaaaaaaaaaaaaaaaaaaaaaaaagcataaaacaggatgatggaaataagcttgtattattagtcaacagtaatggctaactgatataacagataacccccaaatctcagtggtttaacacaataaaggttaatttttcacacacttcacagtccagtgctagtctgcagtggggaacagggtcctgggtggggctggaggtgtctgttccacaaagtaattcaaggctccaggcctcatgtagggaaaagagaatggggggagaggaggcagcctctggagcagatcaaggttacaggagctcaggatgggcaggagactgagaggctgaccggatataaggcccagagcacagaagtgctaccgtctgaggcttctctgaaggatcagcaaagagctaaagtcaggtgcctgggcggagtgcaagactcagatgctgagcaaagggtctgcaaagggagcaaacacaggatcccagagagaggccccaagacgacggtgcacagggaaaggaagcctctaccgtgatgtgtagagtaactactgactgacctgtggcagggaaagcaggagccgtaaagagctatgagctggtgcccacatgggaaacattcatattgcaaggcaaagattcttgggttggataaaatttaaaagaatgctgctaaacagaagaacaacaaaatattaaaaataaaaggttgggacaaaagaatagcatgagaacacatggaagtaaaaagcagggatcacaatattgcttttctgttaaaaaaaaaaaaaaaaaaaaaaaaggcgaggccatcctggctaacacggtgaaaccccgtctctactaaaaataaaaataaaaaattagccaggcgtggtggcgggcacctgtagccccagctactcgggaggctgagacaggagaatggcttgaacccgggaggcagagcttgcagtgagctgagattgtgccactgcactccagcctgggtgacagagcaagactccatctcaaaaagaaaaaaaaaaaaagtaaaattcaaggttaaataacattaaaagagacacagggaatgctttcatatgataaaatgcatagtccacaataatgctaacagtcatgaatctgcactaagtaacctaatgagaaaacataaagcaaaatctgtcagaaatatgaggagaaattgacaatccttataggagactttagcacatctctcttagtcaagtaaaaaataaaataaattgaacaaaaatggaattattttaggtgattttaccatttgatgattatttaatactatgtgctagatgctttctatgtgatttcatttatgataatactcttagcaacgctgcttgatagattgaaattacagccattttacacgggggtaaattgaggctctgcaaggtcaccaagttagctctctcagaactagtatttgaggctgggcgcagtggctcacgcctgtaatcccaacactttgggagaccgaggtgggtggatcacgaggtcaggagattgagaccatcctggccaacatggtgaaaccccatctctactataaatacaaaaattagctggatgtggtggcatgagcctgtaatcccagctacttgaaaggctgaggcaggagaatcgcttgaacccagggggcggagattgcagtgagccaagatggcaccactgcactccaacctggtgacagagcaagactctatctcaaaaaaaaaaaaaaaaaaaacaactgcaatttgaacccaggtctttggttccacagccagtgttttgactttatggaaacatttcttccaaggacaaagatacattggcccctcacagaatccctgacacctacagggcagactctggactctgtctagtgataggcagtctcagagcctccagtgacagggtgatgaggaagagagggcagctggccggaggtcacccagcacgttagagggaagcacaaggtcacagcttaagtccaagacagcagtcactaccctggaacattctgcaacgttttcagtgacctgaagcccagttttatttttccactttagaaaataaccaaagaatcttttatttcttttgcatgccagctggtccctgaagagaagagccttttattttgctatagacaccaatgctggatttgggctttggtctgtcttctcagtttttgctctttggatagcgtgatacttaattattattgtctgctattatgatcatggtttaattgttggtttgcagctcggtcagcttagaggggggcatttgataaaacaagtattattttcttattgccctttccgatgtcaccaaggataattgcagctgcattctcatgtggggacaggagtgatttctgacccccttccccctgcagcagctgttcattcacatgccattttcccctaatgtaaagatccaccatcatgactcacatcagcgatgggtttattgtgttcctgcagtggtgactgttggttgggaacatccaaagccctttcatattctggggcccagtcagaaggcaagtgaaatcaacaggtcaaggtgccatgaattttttttattttctcatttttgcatgtctttctttcttttttttttttttaatttataaagaaaagaggtttatttggctcatggttctacaagctgtacaagaagcatggtgccagcatctccttttggtgagggcctcagtaagcttctactcatggtggatagagaagggggagcgagcatgtcacatggcaagagaatgagcaagagaagtcggggaggagccacgctcttttttttttaattttattattattatactttaagttttagggtatatgtgcagaacgtgcaggtttgttacatatgtatacatgtgccatgttggtgtgctgcacgcattaactcatcatttagcattaggtatatctcctaatgctatccctcccccctccccccaccccacaatagtccccagtgtgtgatgttccccttcctgtgtccacgtgttctcattgttcaattcccacctgtgagtgagaacatgcggtgtttggttttttgtccttgtgatagtttgctgagaatgatggttcccagcttcatccatgtccctacaaaggacatgaactcaccattttttatggctgcatagtattccatggtgtatatgtgccacattttcttaatccagtctatcattgttggacatctgggttggttccaagtctttgctattgtgaatagtgccgccataaacatacatgtgcatgtgtctttatagctgcatgatttataatcctttgggcatatacccagtaatggaatggctgaatcaaatggtatttctagttctagatccctgaggaatcgccacactgacttccacaatggttgaactagtttacagtcccaccaacagtgtaaaagtgttcctatttctccacatcctctccagcacctgttgtttcctgacttaatgattgccattctaactggtgtgagatggtatctcattgtggttttgatttgcatttctctgatggccagtgatgatgagcattttttcatgtgttttttgactgcataaatgtcttcttttgagaagtatctgttcatatccgttgcccactttttgatggggttgtttgtttttttcttgtaaatttgtttgagttcactgtagattctggatrttagccctttgtcagatgagtaggttgccaaaattttctcccatkytgtaggttgcctgttcactctgatgttcgtttcttttgctgtgcagaagctctttagtttaattagatcccatttgtcaattttggcttttgttcccattgcttttggtgttttagagatgaagtccttgcccatgcctatgtcctgcatggtattgcctaggttttcttctagggtttttatggttttaggtctaacatgtaagtctttaatccatcttgaattaatttttgtataaggtgtaaggaagtgatccagtttcagctttctacatatggctagccagttttcccagcaccatttattaaatagggaatcctttccccattgcttgtttttctcaggtttgtcaaagatcaggtggttgtaaatatgtggcattatttctgagggctctgttctgttctattggtctatatctctgttttggtaccagtaccatgctgttttggttactgtagccttgtagtatagtttgaagtcaggtagtgtgatgcctccagctttgttcttttggcttaggattgacttggtgatgcgggctcttttttgatgccatatgaactttaaagtagttttttccaattctgtgaagaaagtcattggtagcttaatggggatggcattgaatctataaattacgttgggcagtatggccattttcacaatattgattcttcctacccatgagcatggaatgttctttcttttctttgtatcctcttttatttccttgagcagtggtttgtagttctccttgaagaggtccttcacatcccttgtaagttggattcctagctattttactcactttgaagcaattgtgaatgggagttcactcatgatttggctctctgtttgtctgttattggtgtataggaatgcttgtgatttttgcacattgattttgtatcctgagactttgctgaagttgcttatcagcttaaggagattttgggctgagatgatggggttttctagatatacaatcatgtcatctgcaaacagggacaattttatttcctcttttcctaattgaataccctttatttccttctcctgcctgattgcccaggccagaacttccaacactatgttgaataggagtggtgagagagggcatccctgtcttgtgccagttttcaaagggaatgcttccagtttttatccattcagtatgacattggctttgggtttgtcataaatagctcttattattttgagatacgtcccatcaatacctaatttattgagagtttttagcatgaagagttgttgaattttgtcaaaggccttttctgcatctattgagataatcatctggtttttgtctttggttctgtttatatgctggattatgtttattgatttgcgtatgttgaaccagtcttgcatcccagggatgaagcccacttgatcatggtggataagctttttgatgtgctgctggattcggtttgccagtattttattgtggatttttgcatcaatgttcatcaaggatattggtctaaaattctctttttttgttgtgtctctgccaggctttggtatcagaatgatgctggcctcataaaatgagttagggaggattccctctttttctgttgattggaatagtttcagaagtaatggtaccagcttctccttgtacctctggtagaattcggctgtgaatccatctggtcctggacttttttggttggtaagctattaattattgcctcaatttcagagcctgttattggtctattcagagattcaacttcttcctggtttagtcttgggagggtgtatgtttgtaggaatttatccattttttctagattttctagtttatttgcatagaggtgtttgtagtattctctgatggtagtttgtatttctgtgggatcrgtggtgatatcccctttatcattttttattgcatctatttgattcttctctcttttcttctttattagtcttgctagcagtctatcaattttgttgmtcttttcaaaaaactagctcctggattcattgattttttgaagggttttttgtgtctctatttccttcagttctgccctgatcttagttatttcttgccttctgctagcttttgaatgtgtttgctcttccttctctagttcttttaattgtgatgttaggatgtcaattttggatctttcctgctttctcttgtgggcatttagtgctataaatttccctctacacactkctttgaatgtgtcccagagattctggtatgttgtrtctttgttctcattggtttcaaagaacatctttttttctgccttcatttcgttatgtacccagtagtcattcaggagcagattgttcagtttccatgtagttgagcggttttgagtgagtttcttaaccctgagttctagtttgattgcactgtggtctgagagatagtttgttataatttctgttcttttacatttgctgaggagttctttacttccaactatgtgatccattttggaataggtgtggtgtggtgctgaaaagaatgtatattctgttgatttggggtggagagttctgaagatgtctattaggtctgcttggtgcagagctgagttcaattcctggatatccttgttaactttctgtcttgttgatctgtctaatgttgacagtggggtgttaaagtctcccattattattgtgtgagagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgttctttgttggttcaaagtctgttttatcagagactaggattgcaacccctgcctttttttgttttccatttgcttggtagatcttccttcatccctttattttgagcttatgtgtgtctctgcacgtgagataggtttcctgaatacagcacactgataggtcttgactctatccaatttgccagtctgtgtcttttaattggagcatttagcccatatacatttaaggttaatattgttatgtgtgaatttgatcctgtcatgatgatgttagctggttattttgctcgttagttgatgcagtttcttcctagccttgatggtctttacaatttggcatgttttgcagcggctgttaccagttgttcctttccatgtttagtgcttccttcaggagctcttttagggcaggcctsgtggtgacaaaatctctcagcatttgcttktctgtaaaggatttcatttctccttcacttatgaagctagtttggctggatatgaaattctgggttgaaaattcttttctttaagaatgttgaatattggtccccactctcttctggcttgcagagtttctgccgagaggtcagctgttagtctgatgggcttccctttgtgggtaacccgacctttctctctggctgcccttaacattttttccttcatttcaactttggtgaatctgacaattatgtgtcttggagttgctcttctcgaggagtatctttgtggtgctctctgtatttcctgaatttgaatgttggcctgccttgctagattggggaagttctcctggatcatatcctgcagagtgttttccaacttggttccattctccccgtcactttcaggtacaccgatcagacgtagatttggtcttttcacatagtcccatatttcttggaagctttgttcatttctttttattcttttttctctaaacttctcttctcgcttcatttcattcatttcgtcttccatcgctgataccctttcttacagttgaacgcatcagctactgaggcttgtgcattcgtcacgtagttctcgtgccgtggttttcagcaccatcaggtcctttaaggacttctctgaattggttattctagttagccattcgtctaatttttttcaaggtttttaacttctttgccattggttcaaccttcctcctttagcttggagtagtttgatcttctgaagccttcttctctcaactcgtcaaagtcattctccgtccagctttgttccattgctggtgaggagctgcgttcctttggaggaggagaggcactctgatttttagagcttctggtttttctgctctgttttttccccatctttgtggttttatctacctttggtctttgatgatggtgacgtacagatggggttttggtgtggatgtcctttctgtttgttagttttccttctaacagtcaggaccctcagctgcaggtctgttggagtttgctggaggtccactccagaccctgtttgcctgggtatcagcagcggtggctgcagaacagcagatattggtgaactgcaaatgctgctgcctgatcgttcctctggaagttttatctcagaggagtacccagccgtgtgaggtgtcagtccgcccctactgggggttgcctcccagttaggctactcgggggtcagggacccacttgaggcggcagtctgcccattctcagatctcaagctgcgtgctgggagaaccactactctcttcatagctgtcagacagggacatttaagtctgcagaggttactgccgccttttgattgtctgtgccctgcccccaggggtggagcctatagaggcaggcagggctccttgagctgtggtgggctccatccagttcgagcttcccagctgctttgtttacctactcaagcctgggcaatggcaggcgcccctcccccagccttgctgccgccttgcagtttgatctcagactgctgtgctagcaaggctccgtgggcgtaggaccctccgagccaggtgcggaatataatctcctggtgtgccgtttgttaagcccrttggaaaagcgcagtattagggtgggagtgacccgattttccaggtgccgtctgtcacccctttctttgactaggaaagggaatttcctgaccccttgtgcttcccaggtgaggcgatgcctcgccctgcttcggctcacacayggtgcactgcacccactgtccggcactccccagtgagatgaacccggtacctcagttggaaatgcagaaatcacccgtcttctgcatcactcatgctgggagctgtagactggggctgttcctatttggccatcttggctccacccccctttgcatgtctttccaatttgcaatgggatagagataaactgcctataagcagggaggtgggaatcatttgtttgtttgtttttgtttttgtttttaaaaaatacctagtgtgtccaagtttccttcagastaaaagaactgaggaccrtgatctcagaagcaagttttgcctgtgggcagcacttgagagggacgggcccctgcagtgaaaatccactgtcctcccagcttcttagatttaggctctggtagaaaatctcctgttgctgaagctgagtgttgtgaaccttacactagcctcagcaaagcacagtggagtctcagagggggctggtgggaagaggtacgggagtgagggccaggtgggtccacccttagctagggcctgctattggttggtgggggcgtgggtgtggcagtgggaggtggaactctgaaaacactttgaggaaaggcatgtggagatctcagacttgaacagggwtatctgcacatcccagggtgtccctgcagccagcaatgaagtcaagatccagcccccgcagagcaagcagaatttcagggcagccccaccaaggaatgggagggagaaccaggggcccagtgagacccagttacctgagctggcatacttgctggagttagactgcagattatcatgagtgcccaagatgcaacctaggcaaaccagataccagacttaggatgatgagaccaactcaaaagccctcctttggtggaacccctccctcactgccctcagccctgccccagcaccaaggaaactgctctcactaggagaatggggaccatgaattcctcactcctctgcagcttggacattatcaccattccctgagccacggcttcaggtctcagccacccgcatttcatgctttgtcttcctgaagagcttgtcatttcctgggtgggccagcctctacatcccctctgtgtctttgcataccctattttctctgcctgcattctgtccccttctcaccctcctcacccacccccttcatctggactcatcctgttaatctctcatctctcttttctcttataaagatatcaagactcagctcagtagttacctctcccaggaggcctggtctcatacccttggcctaagttagggggmttctccgtacatacctttactgtagactgtaccacatgcaggggtggaagcatgccatattcttatctgaatcaccagtgcctagtatgctatctgaacctagtacttactatttatagatttaaagtatgactatcagtatcactgtaggctcagggaacctacagggctggatttwaaaagtgtgagaccatggttgcagtatcccagtttctcccagatttagattcagcagtgagctctggcccaggttctgtgtggctagattctatgtctttggtagtgtagagcaccaaagatacagctgtaagatccgaggggctagatgtggatggtaaaggaagagctcagaacttccagagaaataggaagtatcctccttagtatataggatttgtttaagttgcctcttgtagagtgacagatgcttggcaaggacagtgggtgagtttggatgaaccacaggggtccctgaaagctggtgagccattcgttcattcatcaattcagtcagacaacattcaccaaggggctagtacaggtcaggcctcatgctgggtaccagagatatagaagtgaatgagacactggcacaagagttaagggattcagcaagacagggaagtcaatggatgactctgatagagcaggagcctgtagagggagcatctcactagactgaggggatggggaggacaaggagaagcctgtggaaaagctccccactggatgtgaggcacctaccagtacacatcagtcagggggtagaagaatttactagggctgctgtaacaaactgaatagcttaaaataacagaaatgtgttttgttcacagttctagaggctagaagtccaaaatcatgttctcaatgggccaagatccctctggaaatactggggaagaatctgtctcatgtgtctcatagcttctggtggttgccaggaacccttcgcattccttgtgttgcagacacattacttctatctgtgcctccatcacatggtctccttccctgtgtctctcctgtgtctctgtatccaaatctccctctcttttctcttacgatatcagtcattggatttacggcccaccctaatccagtatgcccttcttgtcataacttgattacatctgattctatttccaaataaggtcacagtcacacaggtaccaggggtaaggacttgagcatatccttttgggggacacaagtcaacccgctacaagtggcatggggccatttgcagggggaacttccaggcagagagaaggctctgaagcaagagaataagaaggaaatcagtaaagggttagaagaatgggagaaggcaactggggaagcccaggggggacttggtgtgtcccctcggaagtctgactttatcctgtagagaaggaggagagactgggtcagaggagtggttcagaaagatagacrtggtcctgatggaaaaggtggattgaaaggatgggaggggaactggatccaggaaggccagttactctttcgattcctcttaatttgcttttccctcttttgccatctttctctccctcaatttctccacactttcctttcttcaaaactgtttcaaagacactgcctccttgaagctttccttgcctcttcaaattaaaagaaaaagaagatggtgtaaaagaaaggcctttggtaccagacagacatggtttgaataccgtctctgacccttgctagttgcctctgttaatcccttggaacttcagttcctccacagcaaaatagtgagaatacactctcaactgcagggctttatgaggatattcagcaatgtacataaagcagttggcacatgggagattttctacaaacgtttagctctttttgtcctccggttattttgatagcatcttatttattccactctttagcacctattgcacatattattatgttttgggtgtctccttcagtaagtttcctccagggcaagcacagagccttgcacatttctgcagctctcaacacagagcttgacatgcaacatgcttcatttctcttccctggaaatggcctgttttgtgtttgtggtccaaagaaacgcacacacagacaagcaagtcatcaataggaaggaagatcttttcacctctttcctccacttcagtttctcctacctaggggcacagtacaatggggaggggagctgcaaactgttctcaggatatcaaaagccagaagaagacccagtgttcacctacaggggagctgctcacacaaaccacaatggctgttttggcctggaattatctctgtcgatcagaactgctcattagcatttatagactctgatttctataagataagtattcaataagagtcttaataaatgtggttgggttggcaaaccaagtctttactggccatcatcaaaggtttataataaaaggggtcactggccccctgtggcagcccctagctaatttccctgcatccactcttgcccttgtcaatcttttcttacccaggcaccaagagtgatcgcaaaatgtaaatcggaacctgtcagagctcagcttaaaatataccaatgacttccctcagctcctatagtacacaccaaacatctycccccatccacggagtcccgccagccctgcccctgcctacctctcctggcccagtgtcgcctccatggcctttccattgtgacctttgcacatgctctcctttattcactgcaggcttcctcccacctctcacccctcctgctctccatgtggcttggcatcttgcttaaatgccacttccttagaaggtcttctccggccactctgtctaaagtggatgctctgcctcagcactctgccatgtcctgccctgtgctagacacagctgataattttttagtgagtttgtgtctggggggttattgcccatctccagaagctcccggagaatggcaccctgtctgtcatcttcactgtwatacagcagcaccccgcatatgggaggcgcttaagtgaatgagtgccgaaaggggcttgaactttagcctctgtcctttccgttgccaacttgtattgttcgtgcacacagagaaccccgccttctcctcccttcttctgcactcctctccgcaacatcaatgccaagcctttgactttgtctgtttatcagatcagctaagccgaatgcaatcaactggcatttttaattcatatcagcttacgtatgactcacatataaactgttgatgattgatagagcctctccagcccctgcctagctctcaaccacagcctcttcctcccagagatgtgggcagcattgttaggagagagtagaagcactaaggtctgacctggattagtattaaataatagcaattccagcttactgtctaaccagcccatgaccttgtgcaagttacctaccctctcagagcctcagtattctcattgttaaagatgagactagtcctagctacaaaataaagatgcttgcatggactccatgggctaatgtgaaagtgccttatacacagtggttgttatggaaacacgttttccttcatgtctatttagtccccatattcttgcttttctcagcttcstgtcagactggggtttcattcgttcattcattgattcactcactcattcattcagttgttcaccctcaggatttcacatggcctctagagtcagtctctaactagaatacaataaagcccaaactcccatagctaattttgagactcattctcttccctctctcaatcagctgtattctctatggcatcctaataccacctgaactcaagtatggagttgcctttcttcccggacagcttcacctcctctctgcctccaggtcttatctcatgttattaaatccaaagaaagcactctcctttcacgccacytaaacttcaggtctcatttccttttgccttccctgatgagygtggcccacaccgatgtcttttctgagagcacgtacagccacaccacacggctggcactcggtctcctcttggctgctgatttcacagtgcattgatcaccacagagaaagcagagaaggcagggggcagcctggcacagcagtgagtatgtgtgtttgtgctctgtcctagggatctccttctcctcttttcaaatcaaatgtggggccccagccttacacaggtcctggttttaaggaatcccctcctatatctataaaagattctacctaggaaatccaagagattctgttggtttctaatagtactaactagtgaccgaaagtaagaaacacacacacacacacacacacacatatatatatctgacaataaataactagaaaatgtaactaaacattaaatctcattcacaatagaaccaaaaccataaacttgtggactgccaaagaggaaatttaacaagaggtgtgcaaagaagaaaaccataacaaagatgaaaaacataaaactttgcaaagtacataaactaagttatctacaatgttcctggctggggaaaattagtaacataaagatatcaattatctccaaattaatcaatgtgtatataatcccaatcaaaatctcaatcacatttttttgggacttggtaaccataaagtttatctaaaagagtaaatttgggaaattagtaagttttagggaaaaaatcaaaatttgagaatatggaaacccaagtaaggtgagtagctacgttcctggtaccacaagtagattctagtatagggaaaggagagatcactggacttgagagaagagtccagaaacagcccgcaactaaggggatatttcaaatcagtagggagaatcaggattcttcagctatgagcgtgtcatcatccatgggtatcatgagcaccatccaaaatgtcagatacatcttaggcaaacaaggcctggttccacactcatgaaaattatgatctagttagggagaagcatagtctacaaataggtacactaaagatagactggtagatgctacggagggagtaaacagatgttttggtaggcaaagtgtggaagaggctactttagataggtgttgggagaattgagtgtcaatttggaagagtaatgaacttgttagcctcaaaaaatgaaactagccaggtgcagtggctcacacctgtaatcccaggaattttggaggctgaggcaggaggattgcttgaatcccagcattcaagaccagcctgagcaacacagaaaaaccccatccctacaaaaaataaaattagtcaaacatggtggcatgttaactgtggtcccagctactcaggaggttgtagtgagttacgattgcaccactgaactccaacctgggcaaccagataggccctgtcgcaaaaaaaaaaaaaaaaaaaaaaaaaagagagaagaaagaaactatacaagtcccaggaaagtattaaagttttgattaaagttttgttttgtttttgaatcgttgggtcggggagaggtctgcccaagcataacatgacatccagtatccttaaaggaaaatattaacgtatttggttacataaaattaatcacttcttaccaaaatggataccacaaaccaaagttaaatgagaaaaagtcaccagacactaggagaaaagattagcaacaaatatatcatataaaagagaaatcaaaaatataaggtaaataaaagtcataatatataagtagaatttcaaaagtttgcatccatcaattaagatggataaagaatttgaaagctacaaatgcccagtaaatatgtgcagagatacccaaccttactaaatcatctaaactcaaaactgccagagagattccactgtggtctagcagatgggggagtattttcgtaaagaatatatttacaacattataatatctaatgctgatgaggtgaactttagagagaatagtaacatcaatactgattagtgcgaatataaattgaaacaatcacttgagaggataatttagcaagatttattttaaaatttttatktattttattttctttttatttatttatttatttatttttgagacggagtctcgctgtgtcgcccaggctggagtgcagtggtgcaatcttggctcactgcaagctccacctcccgggttcattacattctcctgcctcagcctcccaagtagctgggactacaggcgcccgccacctcgcccggctaattttttgtatttttagtaaagacggggtttcactgtgttaggatgatcttgatctcctgacctcgtgatcctgacctcctgacctcagcctcccaaagtgctgggattacagacatgagccaccgctcctggcctaaaatttttaaatagatgcccttcttcccctagaattactttggcaagtcaactgaaatattagcagaaatgcacaaagctacataaagatgcaaatgttccttgcaatttcatgtgaaattgtgttatataacaatgtccatttctgcagaaaaatgagggtgatgtttttgtccatgatatagtattaaatgaagaaagaaagttatagaaaactacataaaatatgtctcattttgagggaacaatatatttgcgtgctcattgaaaaaaactctggaagcatatgtaccaaacctactattaattgaatagctctggagaacaggttggcwgtgtgaaagagagacttttttaaaattcagtacatctgtatattgtttgccttttctctgccttgagtatgtcttatttttaaaatttaaaaagatatttttaaaaagagatagtgataaatggattggatcctggaacacaaaaaaagacatcagtggagaaactggtgaaattcaaataaagtctggagtgtagttcatagtaagtatgccaacattgctttcttagtcgtgacaaatgcaccgtggaaatgtaagatgttagcaatagaagaaatggtgaaaggtctatgggaacaccgtattrtctttgcaacttttctgtaagtctaaaattattccacaataataaaaaaaattaattaacagagagagtcacacaggcttgtagccaaggtatctttggctgttggaatctttggttccagaaaaattcaggttactacttgagctcccttgctctgagagctctatctctgtcctgcagacccccacacagggagactcccacctggcctcctgaggtctgcagagattatctaagccaggcctacatatagctaatatccccagaattctgctctgggaaagcaaggtatgaggtcacccctacctgcaccatggctgggccagcttctcagagactccacagttccccctgccctctagccccaattatttttttttttttacctatatcctttgtccaagccagatcctgccttctcagtattccccttccaacctagaatggtaacaatatgggctcagggagaggtctgcgggctatgtaaggttgaggagagggatgcagtctgacaatggcaacatggagctcataataagaaaaggatgcacaaaacctacacctcgcacccttgtccccattgctggaggccccagtgggaggagctggcctggtgaaatgaggatgctgccagacgctgccttctctcccctcctgctgggcttcggaggtttagggctttgtaggtttagggccagtcttcgtaggtttaggaccttctgaccagaagcccctggaaagaagggctgagtccagatgaccactgcctcttctctccgtgcaggctacacttcctggtgtttgacacagaggaggttcacgacgtgctgcgcatctgggatgggcctgtggagagcggggttctgctgaaggagctgagtggcccggccctgcccaaggacctgcatagcaccttcaactcggtcgtcctgcagttcagcactgacttcttcaccagcaagcagggctttgccattcaattttcaggtctgtgcgtgccctctgccagccccactccacatgtcctgacacatggcacccaccttcctctggccctcactttccttcatccctcagtccatgtaaagatagttattgaacatctgctatgtgcctggtacatggttagcacctgttcaaatgtctgtgctgagctcactctggtagggaagacaggtgggttaatagacacatacaaataggtaagcatctggatggagacatacggtccataatggtcaccttggagcatcaaggaagatgttccagaaaagatgatgtccaagctcagacccaacggacaagtagaagttactcaagaaaagaaagtgtttcaaggagcaagtagtcatctatgacaaggaaaggtgccactgaaatggactttggaggacttgtgcacccctattagatggaaaagagagaaaagggcatcctaggtgcaaagaacacatgaacaagtgtagatgcaggaatgtgggctttggaagtggagggctaccccatgtggctgaagcacagggagcaaggagggatgtgggaggtacaagtagacggtggcttggggcatggttatgaataagctgatgggacatgctgcacgctcaggttcttagttgagtgcagatctcagcaaagactggaagtgaacatgagtcatctaaatttaattaattaggcactgcaatagccaattatggaggagcatgacaaagagctacccaaaatggccaatgctcaaacatccaaatcccagtatgagataatttatatgattggtcctgcctctccctggaatgcatcatctcatctcctctgaagtgcctcttccatcattcctccccctgatcaagtgactctgcttcggtttctgctcgtgtttattatacagcagctgtcttcattaccatctccttactccactgtgtgtgtggtgggagggagggggggagtttccatggtgattccagagcaatttcttgtggcacctgtgccgtggctttgcccccgagctctttcccagttggtgtatcagctaagggtggttggggtatatccctggcaccactgagattgttacagagttgcaaatcctgcttctagctcttttctgctacgtctgtcatctctgtggaaataagcatttagcagcgtggggagcagatgagagtctccaggatcacattgctttatacttataaatttgtccatttaacactcatgcatgcttctagtctagcattttccatctattcctaagagttccatggaatactaattgatattgcaagaaaaaagaagtttgcatgatcaagtgatgctggggaggtgctcaggctgatgcagacccaaggaaatgatctgcaatatggggcctctgagaacgtttgctatgctaatgcccttaaattcaaaagatgtctggtaggccacaatttccaaacatattccatcatggatgacttttttcaaggccatctcaagagactaacatttcgtggaacaaacttgggaagttgctggaataagcaatggaaggatctcccagcagtaaggagggtagaatgctaaagagacggctcgatccactctctggggaaagaagtattatgaataattaaagccagacatattttctccaactgcgcccaagctgatgggtgcggcttaaaagaaaagaaaaagcccataattatgctgacaaattcacccacagatttgcattatctgacctcgactgcatactcagtgtagccacgcgggacagagtccctgggtgctctcctatgctgtatgcaggctgctttctcatgcattgcccagctcatggaagtcctattcatccttcaaggttcatctcagatgccactgcctcctaatctccccattcagagtaaaactgctatagcccacggcaccctggcactttacttctatttattcaataccaggcattctgtctcgtcttgaagctgggcacctacttgacatcccactaaaagctcttagaagacagggtcatgccatgcctcccgactctctcatagtgtatgtatgcagcaggtgctcactcacagcttagtgagcaaatgggcacatgaagatatgaacacatgaatggatggttttctctaacagaagggtttccttgggcaagctgcccttagcattgcttargcagagtagcatggtcaaagctacctagcctgggctccagaaaggtcatgacagcctggcccagtgttatgggcataaccaaggtttgggaaaggtcaccttccctgttrctgtcatcagttagcaaataccaggactactctagggaagagagaacggctcaccccatgttaactttatagtgtgtatttgacaggggattgtacagaaatgccagggacgattagtgcaggcttggctttattaagtaaacatgactgtgtaacatctaacatcctgtctgtaccacgtggatccagcctttccccgggtgctttgccaagcagctccaattcaggagcattaaagagagaaagtgagaacaaaaaaaaaggtgagcgggaagcataatcacagccattcctattgagtggctgccacactaagctctccactacatcagctcttacaattttcacaaaacccttacagtatgggcaccattattactccatgttgcagatgtgggctccgaggcttctcatacaaggtcatctagttaatagcaaaaaccatgtgtctgtttcttaaacctaagctgctaatcattgtactctattgcctcccatataaataatccttccaagtatggccagaacaatgagctatttttcttctaggggaacatttacatgtgtacagtgccctataaagctagagatgaaagctaagtctgattttaactgggaaggaaaaagattgatgcatatttgactttacaaataagttcagtagctgtcaaatgttgatatgtaaacaaatgagtgtgcctgtgttccagtaaaactttatttacaaaaataggcataggcccagatatggccgtgggccatagtttgctgtatgcttccttaggtgttattgagtagaaggtatcagattgtgtaactcaagactcgtatacaatcccagaggttataattagtgacatcagtgtatacagttgccctaggctgccgcttctcaaacttttccgctgatgtcctcctgatagcagaagagaatgggtgtgcatcctcaggatgtctggtggctgtagcaagcacaaaatatctttaaggcttcacatttttgcttaaaaactaatatgaattttaccttgtaatccagaataaattcttttgttttagtataaaagtagtttttccttaaattgttgagaaaactgatattccaatcaaatcagtattatttatcctgtggtttcaagaacctccttgccctagagtgccctgagcacaggctatgagggatgacatasctggggactgggaccgggccccgctgtcagctctgggctgtggaggcagccagggttgttccagctcttgagattcctttctctggactaactcttgcacccattcctccggtgtgttttctcatgccacatttgttcatttattcacccactcattctcctatttatgtattccttccatctagcattcattcagtattcgcttataaaacacctgctctatgttaaactaggttaggtaatagacacgaagacgtcgcaaattcctgagtattttgaatttttaatatatctcagytatttttgaattcttctctgcccacttgctacaaatatctgacttttcttcaaatatggtttcagtctaatggatccttggttgtctgccattgcaagagagagcatgatcttgacctaacttcagtaactcccggtaacctcacaaccactgcttagcatttaggcaggccaactcgcaaagtcctttgcaaacccttccaattgaatacatggagtttatttgtttgtttgttttagagatgagctcttactctgtcacccacactcgagtgcagtgacatgatcatggctcactgcagccttaacctcctgggcttaaaggatcctcccacctcagcctccagagtagctagaataacaggcaactatcaccacacccagctaatcttttttatttttttgtagggtcagggtcttgctgtgttgctcaggctggtctcgagctcctgacctcaagtgaccttcctgccttgacctcccaaagtgctggaattataggcgtgagccaccatacctggcagcatggagtttagacttaattatcttgtcacttcctccttctgatcatgttagttacattatacaaaattgcaatgctttgtttatgtaacaatgcttgtattcttaagctgaattcaattctataattataacagtataatcatgcttaactcatagcatctcatgacaggcagatgacagtaatggtgaaggtactggaagaatggtagtggtgatatcagtgagagtgacaagtgtgatcacaattggtggtggaggcagtgatagtaatgggagtgagaatagtggcactgtggctacagctgatgatgatgatggggaggttctggtggttgtggcaatgcacggatgatggcaatcagtgagggtgatgagctgggagcctcctgagtggcagacacccaggcgaccttaccctctcttctatttccttgccccagtgtccacagcaacgtcctgcaatgaccctgggatcccgcagaatgggagtcggagtggtgacagttgggaagscggcgactccacagtgttccagtgtgaccctggctacgcgctgcagggaagtgcagagatcagctgtgtgaagatcgagaacaggttcttctggcagcccagcccgccaacatgcatcggtacaaagcagctgcagggtgcactctgctcttggggctcacagttgtgtgctccagaaccttccatgcacagcagctgcatsttgggcctggggccaagagaattgaaacagacaaaagttgcagaaaacccattgtttaccctgctttgcatgcatgtgtccccacacgcactcactcacgttcacactctatacacagagcactacaaattcctcacttgctaaaattgtcccagagatttccaagtcagacaggtctgtccctttctctctggcccaggctgtacaggtcagaaggaggacagtgggtcatcttgggtaataaaggctaacagattccgaaatgacccttctattacctgaagcaatagaagggcacccacagcctcagaatgtaaagaaaagaaccttgcttttgctgttctcaaggaaattattggttacctgggttttggttcttttaggttttagagatagagtctcactctgtcgcccagactggagtgcagtggcaccatcacaactcactgcagccttgacctcctgagctcaagtgatactcctacctcagcctcccaagtagctgggcttgcaggcctgtgccaccacacccagcaaatttttgtatttttgttgttgttgttgagatggagtctcactatgttgctcaggctggtctggaactcctgggctcaagtgatcctcctgccttaacctcccaaaatgctgggattacaggttttgtttctttagatctgtcctcagtcttaaaaccttcctgtatgagagatgaagacatgaaggacctgagacttgtctaaggtcccatcacttaaaaagggtggggcctgaaaaatcctgcctctaactacttgagactgagaggaggagggaacttgaagggaggctgggatgggaaagaaaggtaaatagatagagacaaaccctccaggtgcccacttccacatgtctattttgctcaggtgaaataatgagtgtttatctcccctgtcaatgctggctgttagaagagaagagaacccatggtcactgagtccttactgtgtacttgccccatactggacatttacttagataacctcatttaactttcccaacagctctctgaaattagcaccatttcctcatttacacttgaaactgaaacttagacaaatttggatatcttgtcccaaatcacagagctaggatatggcagagccaagatttacacccacgccagtctgaatgcaaagcctctcattttcctacctcccacactgcctcccctgctggagatgggtgtaaggggcttcctgagacagctcctgcaggagcgtctgccctggcctgcacctctctcactcaggcttaatgggaggcagtacgctgcccaggcctctgaggactggcctatgacagtcatggctctgaggcctggccctgaagttgacacactaaatcctgctcctcagtgggaattaggagccgcataggtatgtggggcaggaggttgagacctgggtttcagatccagctgagttcttcactacgtattctgctgtgtagggaacagtatgggatactgaagtagacacatccagatttactttctagctctgccatttactactttggtgaccttgggaaattacttcaactctctgagcctgagtttccttatctctgagggtaaatacacttcccttatggcattgtggggtgaggacacgcctaaccccaatctcaagaaatactaatttccttcctttctatcttccttccttccttcttttcatccttcccttcttcgattccttctttcaagtcttcagactcccttcccttccctaagccagaattccatctgctcaagggaattctgttgaggcccaggagagaatctgggaacctctgaggctccttccaaattcagccttctgcaaggctgtgattccttagacttattttacagaaaagcaggtcctgagatgagattgtcccaagtggagaaggaggattgtgctaagctgaggagagcaataaatgtgcagtgggtagggtggagaggttaattcagttttcatcacccgttcttctacactcggctttgggaaatgttcctcaggcaacagaataaatgcctttgcctcttctctcaaatgaactggaaatcccagtgacatgcttctgatttccagctccctgggcgttctgccatgagcgggtctagctggccctgataacccttcattacagggaggaagcaaaggaagaaaacaaatactcattggatgctgtccccgtgataggcaccgggctaaacattttagctacattattgcagctgaaatcactctgtggtgaggttagagctcgggattccactccctggctcaggtctgccttcaccacagcaagctgtgtggccttagacaaattgcccaacttccctgtgccttaatttcctcaccagtaaaatagtgaaaatggtagtacttaccatctagcattgttttgaggattaaaaaagaaaatactataaagcaataagaactgtgcctggctcatagttagcactgtgtatgttagaagccattatcatcattattcttttactttcgagatgaggaaatagaggctcagaggggtggacagctggcccaaactcacacagccaatgagtggcattgtcagaatttgtgctcaggattgtatgacttccaaatcaatgccctttccacaactctcaccctcagtccaacctgcccacttcttggctgtctagaaggatstgcagcttgcacccactcccatctgggcaaccatggtttagtaagctcaaaaggacccctcgactaaccctgagcagtaggagccttcctgttggcgaggcagcccagggatccaagcaaggccttggggcacaactggcagcagccagggaagcccatgcccgatgccatggaactatctagaagagatctgtgcccagacagcagcctagaacccagagacactgatagtactttgggggttggtgggagagtaacaggggcagtttcagaaacacagagactcaccccatctgtggcaaacttaagggaagaagcccctgagctggcaaagggacgtggaggctgggaaccagaatggaggcctcgttgtgcccccttgggaagatttccccagagttgggacttctgatatgacactggctttccactctcactggccacatcagactctgtttctaggctggcctgggcaaggccacgctccatggactggacattacagtcttgctttgttaagctcaagggtctagactgattgtactggcctctgcttggccccacttatctagccctctgctcctgaaggattcagtggtggagacacaagtgagacataagcagacccaacttaaggcaccacctcgctcagaagctcctgcaacaactgtgctctccctgctggccagcggggagaagcacgcctcctctactctggctactgctaccgactgtatggaagtagaaagggggaaaacaacagactttggagccagtcccatgtgagtttgagtctcagagtgactctgggcaagttacttaggctttctgagactcactttcctcctttataaatcaggaagaataatccattgctcattgagttgttaatgagacataaatgagatagtgtatctaaaatgtgatttgttaagtctaatacgtaatagatgcctatttgagtgtttctgatactcaggatggttcttgggatatattttcccatggaacaaaaagcagactactcatgaccactcggattttatgttcagccacattagggctcttatggcctgacctgaagacctaccatttgtttgagaccctgttagggattgacccagccctttaagcctcaccctgagtaaaagccacagccagaggtggctccatgacacagctaaagtaccagtgctcagctctatgacaagccaaaggctgctcctaactttggagtcaggtatacccttttgctccccccacaaagactcatcttggattttctagccagcccttaaatggctctctgtgttcctgtgggctcagtgttgacaacctctgatggtgccctgtggtttccagaccaaaccatacctatagtcttggccatcctgctaacgaccccacacgcttcccagctcttactctatccagtcctcatgccacggtacagcagccccagccatggaggaagagacctgatccaggctctggggaagctgccccagaaggtccctaggtaaataggttgctgtgtcacctggccactttctccctccccacctgcttgagagacctgtcatctcaggggagggcgaccacgtagactgattggggattaataatagctccatacaactgaggtacacacatactcttggacaaggccttttggaaagttggaaagtatctgcagccgcgagcagatgccaggagcactggcagcgtaggagaccagctgcgcttggcaggcgaatgtgagcctgtttcccactcctcctgacattgagtgcacgggaactcacagtcagtacccacaaagcttgccgggaagccgatgtgaggcagtgaaggaaggccatgtacttcataggtgtacagacagtgccggctccgtctatcaaccattcactctctaccaaatacttcagcagacatctccaataatctttacaaccaccccacagagaagatattgtctctttttatgatacgggagagacatcgagggctagagaggctagatgagttccctgagttcacacagctaggaagtagcagggtcaggtatttttaaagaataatttattaggccgggcgcggtggctcacgcctgaaatcctgtgactttggaaggctgagatgggtggatcacaaggtcaggagatcaagaccatcctggctaatacagtgaaaccctgtatctactaaaaatacaaaaaaaaattaggtgggcatggtggcgggcgcctgtagtcccagctgcttgggaggctgaggcaggagaatggtgtgaacctgggaggcggagcttgcagtgagccgagatcgcgctactgcaatccagcctggggctgggggacagagcgagactccgtctcaaaaaataataataataatttattgaggtgaaatgcacctaacataaaattacctgtttttcaatgaacagttcagtggcatctggtactttcgaaatgttgcgcaaccaccaccactatctctgaaatattcccaccctccaaagtagaagtccatcatttcaccttctcctgagtccctaagccaggttcaacttcagcctgtcagcctcagcctctcctctctcaatagtgcattagcaacacccatgaaaatgagcccagggtgaagaggcagcctcaccctcgtcttcttctctcctcagctccctgcgggggagacctgacaggaccatctggagtcatcctctcaccaaattacccagaaccctacccgccaggcaaggagtgtgactggaaagtgaccgtctcaccagactacgtcatcgccctggtatttaacatgtatgtacctttcccccgggtgggagacgaagggttcagagtggctaggggctctgggacctgggtctccaggtgagtattcacaggtctgtagcagagttctcagctccagggaggtgaagaagccgagagagagagaaactagcatttattgaacatctacrtgccaagcactgtgctcagtggtctcatgcatatcatcacatctaatccttgtagtaatttgtgaggaagcaattattatttcctctctacctctgaagatactgggacctggaaaggaggcctttgttggatgcccttgccctgccctctgcattcccagtctgcttccccggccccttccaccccactccagaggtataaacaggcgggcttgggtcccaggcaccccccccaatctagctcctgcacttgcttttccattcctgctacagaaaagctcttcaaaagaactgcctctgcctttctctacttcctcacctcccgttcactctcaaccccctggaacctggtttctgcctccatggttctactggaaactcctctgataaaagccacccacgaactcctggttccaaacaaaatgggcctttctgtgttttatccactccacctcttgatcaccctttccatccttagactgctttttcccttggtttgtgtgaagttactcttcccagttctccaagctcttctgtgacttcacgtggacctcttgttaaaccatcttcttttgccgggctttgtcaaaacctcctcttcttcccctacacccctttcctggacaagttcggtcattcctgtctccactctcctcttataagtggaagactccattctgctgcccaccctggctttattctgagcgtcagcatcgctatccagatgttgggcatctctgtctggggcctgcagacactgcaaatgagcatgtacaaaatcaagcatattttttctcccccagaagagctctgttctgagccttggggctggcattgacacctgctctcacggcttcttccactagcagcaaccaaggcatgcagcctctatcgccttcactctcctcatgtatttcctcttctccatcctcctagctcctgtcctggtttaagtcctatcatttcccatctaaattactgccctcatctcctagctggttcctctgccccatcttgcctcccatgccgatctctcccttagctagctgtcagagtgatcgtgtcactcaaaaatgctgaaataaccaccctactttccattttaacatcctctaatgacagtgctcagcaataaaaaagaatgaactactgatacatgcaacaaygtggatgagtcccaaaaatattatgctgagtgaaagaagacagacataaaaaagtacataatgtatgattcaactcctataaaattgtaggatcagcaaaactaatccctggtgaagaattctaatcagtgttggcatctgagggtagggaaggttgaatgggaaggggcatttggaactctctggggtggtgggacagttctgggtcttgatatgcatgtgtcaaaactgatagagtggcacaccttagggctgatcatttcacacggtgtaaatcatacctcaattcaaaaacaaagaaacaaacaaatagatcctttatttttaaatcctatcatggccctctattgcttataataaaggcccaaactttggagtttcattccaaacaatctggtgcttgcctacctctccagtcagccccccaccccatcctaagcccaccccatcctaagccctaagctccagccagatggaactccttgcagtttcagggcctcacggattctttcatgcccttatgactttgcctctgtttctgccttcacagcaacttcctgttccctccttgtcctatctgtaagggtcttctcatctcccaagactcagttcaggcttgatttcctccataaatgtttgatttttcatcctccccaaggaaccttgctttgtgtttctgctctgcctcgggctgacttcatacattattttgttgttgatatatctgtcacttcctacagcaccatcaatttttgaaggcagaagtggtgtcttacatgtccccatgtccttggcaccttgcacagtgcctggaatatcgagggtgctcaaaatttgatgatggaagggagagacagaaagaaggcagttagttaggaagtggtgatgccatcatttgtgaccaagactcactccctccgaaacccttcgccggtgactttcaaaagagcagatgtcaagaagctgaattacaggggcaagaagaccgtgtcacccagccatggtgtgttgaccccgcaactgacaccagtgtgacaaggtgccaggtgggaaggaggccagtgcgcatctggctctgtgccccgtgcctcccagtcccccatcctgtctcttagccagccttatctcctttgtcctagagatgtatgacctcctccccctgctatatatcttagccaaaaggtagaacagtcattttactctcaatctcaaatagagtacagtaagtcctcagtatcatcaacaggttcttggaaactgttgactttaagtaaaacaaagtatagcaggtcttcaaatgtttccttcaatgtcatttcattatrttgtttttgttttgttttgtttctgagacaaagtttcattctgtcacccaggctggagtacagtggcacaatcttggctcactgcaacccttccttcctgagtttaagcaattctcatgcctcagcctcccgagtagctgggattacaggtgcatgccaccacacccagctaatttttgtatttttagtagagacagggtttcgccattttggccaggctggtctcaaactcctggcctcaagtgacctgcccaccttggcctcccaaagtgctgagattacagacatgagccactgtgcccagcctgtatgttgatgagaaataaacaattggttttgttatatgtcatttcacttaaagtcatggtttctgagagcctgtggacaatgctgaggacttgctgtatctgagtatcccagaccatggctgggcaggagcaaatttgcatctgaaatctattctctgcaagctcatttacttttctattgttttcatctttgcacacttgattggtatcaattgcctttgttagatatatacttaagagtggaattgctgcaccagagcacaggcatacaggggggacttcaaaaagtttgtggaaaaattgaatttaagatgaaaataaaaaatataaactttattactcaacataaactccatcaagttcaagacacttttgtaaccaactattccagtcattttgtccatccctaaagaacagagggtcctggtaatttaaccatgtcaatgtagtcttttttactttattaacggaagaaaaaatgggtgctctttaaagatttttttaagattagaaaacaaaaagcaataagaaggagccaaatcaggactgtaaagtggatgcctaatgatttcccattgaaactcttgaaaaattacccttgttggatgagagaaatgatcaggagcattgttgtcgggcagaaggagtctctctcgaagctttccaggcactttactgctaaagctttagctaactttctcaaaacaaactcctaagaagcagatgttatcattctttggcccttcagaaaatcaaccacaaaatgtctggagcatccataaaaaagaaaaaaacccattaccttgacctttgctccacttttgctttgactgtacacttccattccctggtagccattgctttgattgtgctttgtcttccrgattgtactggtaaatccatgttccatctcctgttcttgggagaaatgtttcaggatcttgatcccacattttttaaatttccactgaaagctctgcttttttttttttttttttgagacagagtctcgctctgtcacccagactggagtacagtggcacaatctctgctgactgcaaactccacctcccgggttcatgccattctcctgcctcagcttcctgagtagttgggactacaggtgcccaccaccacgcctggctaattttttgtatttttagtagagacggggtttcaccgtgttagtcaggatggtctcgatctccggaccttgtgatccgcccacctcagcctcccaaagtgctgggattacaggcatgagccaccatgcccggccaaaagccctgcttttgtctgcagctgatctaggcacaatggttttgacacccatcaagtagaaagtttgatcaaccttaattttttagtcaaaattgtgtaatctgaaccagtcgagatgtmtatggkgtkggctttcgttagtgmtattaatcattggkcctattcaattaggacacaaacaagattaatttttttcctctccaactgatgtggaggtccgccttggcaggcttcatcttcattatcatsccctcccttcgtgaaacaagttatccatttgtaaactgctgatttctttgggtcattgtccccataaactttttgtaaagcatcagtgatgtcaccattcttctacccaagcttcaccataaatttaatgtttttccttgcttcaattttagcagaattcatgttgctctgatagaggcttttttcaagctgatatcttgtccttcttaatgcctcacattagatcctgtgcagacatgttataacaagttagtgtgagtttattttggtgcaaaaaacttttgaactccatgcataattttttcgtaatatgcattttccatcattttcactcgagccattccagtgggataaattacattcatgaactctaatattcaatttgctcaactaagtttttaaaatggatttttctctcataccagggtcagaatagctaagggttagsacatttgtgggtgctaggcgtggggcaatagcagaccctgaggagagctggagcactggcttgggatgaaggcacaaagctagggtccttcayggtaacaggtcccttcctccctgagaatggcaccatagttggctcattctctcttagaaaatgaggttcagaagagcacagtataaggacattagtgtcaggtaagagagttgggttttggacctactttggttgacagcttggtgtccagagttggcaactcattttcccttctgtataaggaggacgttaggttttcagctccagatttttagacactgactggaatctgactcctctgcccctgagcctgcctcttccatcttctcacctgactgaggtcatcagggcctcatcttctcccttcccaccagccagtcttcaggggttgggtaccagtgggatggtgggcttgctccctgggaggccctatgctttggttgagcctaagaccccggcaaaagcctttatttgaccttagtggggtgggggtgggatgtttttgttccccagctttaacctggagcctggctatgacttcctccatatctacgacggacgggactctctcagccctctcataggaagcttctatggctcccagctcccaggccgcattgaaagcagcagcaacagcctcttcctygccttccgcagcgatgcatctgtgagcaatgctggcttcgtcattgactatacaggtaagggccctggtgccagagagtactgaggacaggtccagctaacaaggcagagggcaagtagtgtagcgtagtgaggagagccctgggctggaccacagcaagcccacaccaaccctagcactgctgccgcctgcagaaacctgcctttcctgcggcccccatctgggcttagtctttcacccctatattctccaggggtgggaaaaaagggaaccagcattctttttgcacctcatctatttccaaccactastcctcttctctttttctatgagggtcattcctaactctatttcaacctcatagctatcagctggtatcttccttcactccacttcactaaagaggattctgatatgaggcacaatcttcctctccactcagagcttctcaccatcctgggtaacttcaacatccctatggacagcccatctaatcctagggtcatggtgcttagacctctgtcccaaggacactccttggccacactctgacacctcgtcatagactggtcactttctgatacctcctgatcacatttgctcatccttccagctgtgctaattaaggcaagttcagtagtgttgtggtagagagcaagagtcaacaatttttcccctaaaaatagtaaatattgtaggtttacctatcacaactactcagccctactactgtagtgctaaagcagccacagacaaaacagaaagaaatgggcgtggctgcatttgaagaaaaattcacttacaaaaacaggctgtccctgcccagttaagagcattgactgtcaaattaattggattgaaagttcatgtttatgacttaacatttgcgtgaccttggataaagcattgaacctcttgaagcctccatttcttcctttataaaacgatggtaggaaaattcctgcttcatakaaatgtaaagatcagtgagtccacacatgaaagtccttggtacagtgcctggcacatatcatgcattctgtaatgttcaagtatcattagtagtagtaagaggagttccaggctctcgagcactccactgtcttctacgctattatctctttttgaccttttagtcttccctaattatcccaaatcccattatctaaatcccagctcccttccttgcttgatttgtgagcttgrcaagtattatctcttggaacatcatctacaaattgttgctagtaataattatgttgcaggaggttaagattaaaagatattttatacatgcatattttatatatgtgtgtgtgtgtgtgtgtgtgtgtgtgtgtgtgtgtgtgtgtgtgtataatgctccatatgtactaaacactctacagatgctctgggaatgatagattttgttattgttactataacccgggttcacccaggcctcatcagcctgagcatacaaatggggtcgcattaccagctaaaattaaaaattttctggctcatgttccccacttgcataacataagacctcagataccttttaaagtgtcccctaattaaatatttccggccacccctgggaatatctcacatgagctcacacataacactaattagaacaatggcaaacttagtgttttcccactgccagcaccagcctaagtgctctatatccatcaactcattggactcctcatagttcttgattatctcctgtttgtcgggtacagttctagaagactggtgtgcaaaatggagaatgttttacttgtagtcttcttgcctcacggggctggcctaggcaatggatattctgccatcctttcttcctccaggcacctgccatttggtaaacctcctgggcccaaaccctcttccacacactgatatcagcacagtcagacactttggaattctaacaaacagaagccacaacttagacccagtctgggacctccattgctcccaccaccaccatccccactgccatatcatcaccatttcttattattcatctcttccttcatattctcatcagtaccctcaattgtcctgcccgctagtcctccaagtgcataaaccttgcaaaactgtaccctttgttgaacccacacccacacagctgaggacacccagacaaagctgcacaaacgtgatacttagagtcactacgagtgatgtcctttcccccagccaagccttagcaaccaccagagctgcctccgacttgacccaactgagttcttcttggcagagattccaaaattcaccccaaatgtcaccccgtcagcctcattttttataagatgatttcatttcagcttccctggatacagtaagctattgggtagaaaccccctgagcttcctctccagtcaccttgttcatgcctacctgcctgtggccatctctcccccaggtcttctccaaggaaattcatggtccgagagccatactttcaaaacctctttcccagtgaagttctttccacttttgcctgttgacccaaggtgggtatctagaggggtctttaggtctaaaccataacccggggaataagacctccccagctgccatcggagccagccaagcagccaattactggagagaggggagaagagaggcacatcctacagacgtatcccccatcaccctattaggatctgtagtgcaagtaccaagataaagataactatgtgtgtttgaggggtagggggtgcctgttggaagcctcaagcatccttcattatttcatttgttccttccttccttccttccttccttccttccttccttccttcattcccagactacacacctcctaatattagtcaccctctactatctccctgggcctctggtctagtagcccatttggtggaacctagggacccctaccttaccctctggtctgcttctgcctatgccaggatccctggattcctggaatgggtctactttgctatcaggtcccatggctttgaggatattttcccatgtacactatctttctttatagggtaggctccatcacttcataactgtatgccctgaaacaagttgcctaactcctctgagcattgcttcctcmtccatgaaaaagggacagtgacactaaacgaaggagttgttgtgaggattagcacataggcacagcatcaagcagagtgcccagtgccaataagtatttgatatgtactttgatccacccactttcatcccacctcctttttcctaygtcactggtattgcatttgttgtgcctttgtttggaagggagaatggggctaacccaggggaacacggtacatgttcttttctgtttactgaagatgtaaagtgtgagcataatgttttgcacatgtaataagtgtgggatatttataacatgaatatttgtgatagacgtatgtgtcccatatgctttgccagcccatagcaaagaatttagacattccacaccctgtaagtctggagagaaccatagatggagaggcagcccactgaggacctccacagggaggcagggctgggtcctcaggaaaagcagaattggcctctgcatccaggaagcatctgtgtccatgtcttttagagagatccagggctctgctaaaactgagagtctgggtatcctgggagctgtggcttcaggggtcttgcttagggaggtgaaaggggcctacgagcgccccacatagagagatgttgctggactcagttgggctcagcacaggggaaattactctctgagattaacccttcccctgacccaaggcagagagaccaggagcctttctccacacacagcttcccaagtgagaagcagaaacagtttggtagaatcttaggaaatatcaaaaaaccactcagagcaacttaagcaaacaaaggggtaacttattataaaaacacaagaaacagaaacccactcaaaacaatctgacacaaaaaggagacatgattatgagaaaacaactaacagcctaagtaacttaagctaaaaggtttctatattttaacaatacagataacaataactctgacacaaaaaagcaaaatacttttagaatacaagagcccaagggcagaaagcataaactcccaaaggactggaatcaggatggcagaggcacagactgagaccatcatccgcactccagaatcgttctctctcctccctgcctccttctgagcacttgctacattctcccctccctgcagatcaattttccttgcttttccattctcctgggataaatgtggctgtctcactcctgactttttttgtttgtttgtttgtttgttgttgttgttttctttccttttttttttttttttttgagacagagtgtcactctgtcacccaggctggagtgcagtggcgcaatctcagctcactgcaacctccacctcccaggttcaagtgattcgcttgccttagcctcctgagtagctgggattacaggcatgcatcaccacacccggctagtttttgtatttttagtagagatggggtttcgccatgttggccaagctggttttgaactcctgacctccagtgatccacccaccttggcctcccaaagtgtgatacagggtgtgagccaccgtgcccagatcactcttggctttgaatcacttcccagtttagattccagtttcagatcccaaaggatcatctgagggaacaggcttaattcaagtgtccactgagcagcatcatgggattaggcttttgcagaaggggcaagagcaggtcaggcatttttatttatttattcattcggtaaatacgaattgagcagctaccatatgccagaccttcttacaggggctgagaacagaccagaaaaccaaacaaagtctctgcctccatggagttcacatcctcgtgacaactagaccgacggacccttctgtagatgagatgttggaagcccacctggttctaaggcaaagaggggtgggtttttagatgtctctgttcagttgcttctgaagggtgactgtagtgtcttagtcatctctgggcagactttctaggagatgattctgaatgcagtcatgtcatctgtggatttctattagaccattgatcagaggcacttctattctgaattcatcctcctgggtggctttaccctttgctaaaaggaaacaaagaacagcagggatcctgtgttttggayacagttaccaaaatggagtcacagggaggtttatgtctttctccaggccacggatatcaacagaaccagtggggtggaaggacctttattctcatataccagcatgtgtggcagccttttcctaggcaggaatgtgctgaaacatccacgcacatgcaagacatattcattcattcaacaaatgcttgatgactcctacttcatgccatgccctctgctgggtgttgagaatacagcagggagcaaagtaatcatcatccctaccctaatgtaacttacaggtgagtgagggaaacagcaagaagtaagaagcataagaagttaggaaagaaaacaacaggctcctctgagaaacaaatcagaagggttgctgtgaaggcctctctgagcaggatccatttagacagagccctaaaggttaagtagaagccctctgtgccagagtgggggccaggggcgtttcagaggraagagtttraagtgtgtgttagagaatctgaaagaacacaggaaagaccaaagtgaatcgatttttaatggaaggtcctaaaragcatgtattttctctttcaagcccttgraagtaacactgtgggcctggaagctacggccacacctgctaccacccctattcccaccacctgctgctgttatgggtcattcttcttaaatgcaaattagaactatcttatattctgcctccttttaaaggaatgcatgtttgttggaaaaattcaaacaatatataagcatataagatatactcttaaagacttagcatgcccccaaataccatcatcccgtgcaataccattattaacagcttggtatctcatttcggatactttctataaatataaagtaatgtaaagtctgtatcaggagttggcaaactttttctggaaagggccagagagtaagtatttttactccagatggtctctgttgccactgctcagctctgcttcgtaatgctaaaggcagccacagacaatatgtaaacaaatggctgtgttccagtaaaactttatttacaaaaccaggcagccaccgacctgtgggctgtagtttgctgatccctgttctatatgaatgagattgcaccatatgtactcatctgtaatctgatttttttgtatgtgagcccaagaatagatcttggactccttcccatatcagtattcaaagaatagtgctattcttttaaaaggctgctagtgtttcagtagatggccctaatccaccctttgtaaccagttccttactggttgaatgtttgggttatattcagatttttgcagttataaggtttggaagtaagcctcatctattaggaccagagagaagctggctcttctcattttcccattttgaagggcttgggttttatttattataatcaccatgatgttttagtcatttagtgttatcattcacagctgagctttggtttggctgactaaagacctgattttggtcttaattctacctctaaatagctgaaaggcttggaagactcatttggcctctctgatcaccatattcctcatctataaactgaacatgagcataaccggccctgccttctgcagagggtattgtgagacacaaatgagataacggcttggaaagtgccttgaaaattatgaagtgatattcctatgtaaggggctatcatcactgtcattatccatgtcattattattaatgtggtaatgcttgggatgatgagctcatctttctcttacgtgtgagtaaatatagaatagagtctgtagttggaatcgttgatgtggttgttgattttccaagcctcaaagtattcagccaaacaattcagcagccatttattaagcctctattatgtgccaaatagggctagccttggtgccaagttctgtgctagttgccagggttatgagaagatcaggtgatgaaccttctcctccaggagttcagaacctactggaaagaaatacccttacccaagttaccaaaatagcgtgatacatgttataaccagggaaagaaaaacagaattctgccagagagaaggtggcattaaaagtgtaggattttgccacacaaataaggaaagaaaggacattctgacatctgtaaagttctgggccagtcattcccagctagggtccaatgctggtgcagcagttacccaaaaacacagttgcctgaacaaggtagacatttatcagacttcctataaaagaaatctggaggacagcgcccaggattgatgagggagctccaccttggctgcttttgtctccctactctaccatgctagtccatggatcccatttcaacgttatctccgatccaagatggcaactgaggttccagccatcatgtctgagttccagactgagagaaggaggaaagatgcaaggaaggaaaggccaataagcatttccctcagctgagtcaacttcccttaaacagtctttttaaaagttccacaataatccactgaagatatttgttaagtgcccaccatgtgacagacactggaatatggccgtgaacaaaactgaacagctgccyttctgaaatctatattmtagtggaggaagacagaaaaaaataaggtcwatatagagtcgatgagagagtattaactgcagtggagagaaatatagcagaggagggtgttgggggcattggggagaggagtattgcaattttaagtagctgctcaaagagtgtcactgaaggagaaattgagctaagtcctgaaagaggtaagacagggagccacaaagaccagaggccagtgtcgttggagcaaagctagcatagagaygacaggagctgaggtcacagaggggactaytggggccacatgtgcagggccttgaaggcctgtaaggattttggttttaccccaagtgacacgggaggctattggattgttttcagcagacatgatctaactcgtgtttacacaaggaggctgggaaatgtagaatttagctgatgccttcaagctctggataaaattggagttctgttattgatggatgaaggtggggaaagtggttattggggactacagctagttttgcctcttatgagctgtgtgaactttgattccaagttacttaatttttctgaactttagtaagatttaacccactttgaatttataaaaaggatagatgaaacaaaagacatgatgacaggtccctggatctctatgactcacatatgggtcacccagtggccagttctattctggccagagacactaggcatatggagaagacagatttgataaaggaggtcaaggcaatgcatcacggggcacatgaggaaaccactgaggagtgccctgtgacgagtggccatgttgtcggtcccacttgggtttaaatgcagtagtgcatccagagctgctccactctcagctgcgggcaacgacttaaggtgcaggatcttctcacatgctcctgtgcaatagtgagactctcagagttccatcccatcagtcaaccagatgattggcagctgagtgacagcctcaagtagtggccgcctcctgtgtaggtaatctaaaaggtacccaggtgacaaggacggccctcagcaaaattcctcctgagccattcatctctgatgaatgaacactgatcccttctattctggttcttccctccttaactccactctttgaatttctgagtccttctgcaaggactgtcagcacccttttgtgagtccccatctctagacctctctgttgccccccaataatgtatcctccaaaatgctcatcagtcaacctgatactcagttgcatctccctggtactgactggcctcagctgtatcctgttactgcccagccctggtgacaaccctcttgaccatcagttatcttagaacaaggaggacggaggaaaggtaatcatgcatagaagcgtgagcatgggctcccagttgctgctcaggatttccagctgatggtgagggatgctggagagtgtcctactccagagatttgggacttggactagtactctcaagccacaggcaatgtcaagagtggtcttgtttgatgcagagcgacagagtagaggactgtttattcataaactgtatgactgatagggaagacatgtaagggtcaatagccacatgaaaaaaatactgtggttttcataaactggcaagcacccaatacccagtgcagagccctggaaaactgcactggagacatcaacttatcccaccggtcgggtaacccaacccagaggtggaagtgagttttgtacttcctccctgaatctaagtattggtacccatgcactcagaagaacctgcaacagatgggtatgactgggcctgcagaacagatgccagctctactccccagccagtggtacagatggggcagaagagagaggaagagaaagagcatctccaaaagcagactgtctgccctgcttctcaggtgaacacaaaaggccaggaggctgctgagtgtggggggtcaaagatgagtaaagtgatgggctgtacctaagcactgacctttaccacartgaccctgccggcagctgagatgtggtccagggactgtcagcccccaccagccagagaaacacaygtttcccttggggaggagcaagcaggggatgagagagggcctcagcgattttgctgggcctccttcctctgtgggtcaaggcaagaacatggggggaggaggggaaattgccctcttcaatgtgatttccatccttcaatttctacccaaatttagagacgtttctagacctgaggggaataggagccacagtcacgcatccccgtgtgctctgtggctaattaaagtcgggttctcctcatgggcactggagcccaagaatagcctcctcatgagccctctgtgtgtgtgcacgtgtttgtatytctttttcccagaaaacccgcgggagtcatgttttgatcctggttcyatcaagaacggcacacgggtggggtccgacctgaagctgggctcctccgtcacctactactgccacgggggctacgaagttgagggcacctcgaccctgagctgcatcctggggcctgatgggaagcccgtgtggaacaatccccggccagtctgcacaggtggtggaagcctggggatggcaggggtctgaggaactgagggcatgccaggggyagagggtgctgtgggctggggaagggaggggggcaaggtcctcaagcccggctcctccaagcctggcaaacctgggtttgccgtggatgtgtatagaagtggcttataattcactaggtgtgcagttcctttcaaggtatcatctcagaacccatggtgtccctacccccattcacayagatgctcatgccctcaacagaggcccccagacatgccacatcagggagctcacaccagggagaagtcatttaaaggtggctcctggactagttcctaggcctagggaaaatcactgagagatcagatatgttgaagtaaggcccgcagggtgtgctgattccaggtgggtctgggtgagccatgggggtcctgacaagagagataggaatgagtatcagggctttaagagcttggtgaccacccattgaaaagccaagcataccccctttgtcatggtaagagaggcaggctcagacccgccccttgtggaaattgggcaccttggagaggaacagaaggtggctgggtcacatgggctggccactccccatggggttagtccggggaagcttcagctccctattcacactgacactcactgtccaggttagatgtcagccagggcagcagatcatttctaggctccacgtgtaagcagaagaggttcctaatgtgctccctaaggctgtgacttcagggaccaatgccagggttaataggtagagggcaagaactgacacctgcccaagagggccctcggtagcttcagggcaagtttcaggctacatgccaggccaggggtgcacgttcttgggcagggcagggtccgcaggacttgccttctccaagctagggcctgcccacctcagggcagccctactggggccagaagctcaggctggggcagaacagaggatggtcactggtaagaggcccacaaggtcacctgactctctatctggtttctctttcakccccctgtgggggacagtatgtgggttcggacggagtggtcttgtcccccaactacccccagaactacaccagtggacagatctgcttgtattttgttactgtgcccaaggactatggtatgggttttggttgttgttgttcatatgttttctgactcctcaccctcattccaaaatgagcaattcctcagacgcctcccaattatatacagccccattgtgggaatcgcagaacagtctccccaaaaggacggccgagtgctgacgtttctcaaacgggctgcagaatacattccggacacaagagggcagaagggcacaagtgagccccgccagaaccaaggggacagagttggtgagaaactggccaagacagagggaaggcaaggtgccccaggggactacccagtatggcccaagtcctaagggaggtgccgcagatctagacctgttaggaacccagggtgagtggccaaggagcaggagggaggagaggaatgggatggagctgggcttgaaagtgcaggtgagggagaycaggagccacatcattctggtgtcccatctgagaaccaaagcctggtccagaagctataggtaggacaagcaagaaaaaagtgaaaagcagaccagtgccctgggaagacagagaaacttccagattccaagagatgtgggcagaaaaaccaacccaggctcattacctggttggcagtggggacattcaagagtcctgccagccttggaggcattcaggaagatgaagggcaaccaggtgaccaggctggcttctttcttcctggatctcctctttgtaggaggactaacaaccatatctaaacacaattgatgttggatgtggcaaaggacatcaacatgtcccgaccacccaggggaggagcaggacggagggagcagcctgcagagagccagctccttattccccaagacaggatgggcaagcacagagcaaggcctgatgcttgaggcgttcgccaaacatttagtaagcacccattgggggccacgcactttactgggtcctggagttgcagagatgagagagacatgttctctgtcctctataaattcccagtctcatctctacccatagctccagccatcagtacacccactcctgccccagaaccaggacacctatgtacatgtacacacactccccaatatactgaggtggcaggggcctcagacctgcaggatcgcagttagaaaagtcctgaaaggctgtccaatctgatctgctacccagagcagaatccttggtaggtgggcatgcagtttgtgcctggatccctccagtgataaggagctcacagcactgactacagatctctgtatacagttttcaactcaatgacactgactaactgacgttgggacgcatgaatgtggggtcctgacatcgcatggagaatgagggatggtacccaaagccctctgatggcctccagatagctgctgcagctgctatctgggaaaggaacaaagttggctccatttcgcctctacccgcctgacctttgggtgcagccctccatgttgtcttgacccttgtgaaggccagcccggccttcccagctccccgcctccctgtgccgggtgtctggccactgccagactgtgccactgcactaaccagtgcagcaagccacagcccaggaaccaacaacttccccagggctgccctcctcctggcttgggcccctagacccctagatcccctctcctgcccccagcgtgcctgcccagtccccacactgtgtctcctccacagtggtgtttggccagttcgccttctttcacacggccctcaacgacgtggtggaggttcacgacggccacagccagcactcgcggctcctcagctccctctcgggctcccatacaggtatccggggctcggccagtgtggggatggttgtgggccgggggcatcacgtccggctaaagsaaggaggctctagaagcaccccatggccgcaggtggaaccctacggctctgcgtgcctgtcgtgttctggtgcttgtctacaacgcagcagccagctcgtgagagctccaactagcggggccttcagcagctgccctcacccagactgtgtctacaccgcccccttgtggtgtagccttctcctgttggttcgtattcagayrcaactttttttcttactataaatgtrttgcattttcattatagaaaacttagtgacaaaacaaaataattgcatacagaatcaaaataaagactaccccgaaagagccactgacaagatgtagtggatttccttccagtctttgtatctacttcgacgtttacatattttattcaacaaaccaatatacatattttattgaaatattcgctacgagcttttctctgtcattttttttcttctaggctaggatttttaagtgctacatagtagtctctcayacagttagttaaaatttatgtaacgaattccctattattgaacatttagattgtaatgttttgtgcttatgaatagtaatgcaatgtattgtacatacatctttatatacatttctgttactttagaatatctagaagtggaattgtcaagttaaaggatatgtgagatctttaaggctttttatgcagattatcaaatatccctctagaaagrtcttgtcagtttgatcaccaacaagaaagagggcatgttttattctcacaaaaaccaggtaattaaaaaaacaaaagcgtcatcagtttgaaaagtgaaaayggtatctcattttctaatttgccttgttttattactagttaggttaaatttttataatgtgtttattggcctgtgcattttttatttgtgaatttattgtgaatttgtgtcgatttttctacaagcacttattttcttatttattgagtagagctccatattttatragctacataaatatatataatatgctataaaaagccctcctctccagcttgtcttttgctatataattttcttcagggtgctttaatgtcagaatatgtaaatttcccatgctatcaaatctatcaatgttttcttatatagttttctcctttgcttttatgctggtcaaataaatattcctctgtgttttctttcacttcytagtttcatcacactgctttaatacctttggaatttattttgatttattatttgatatagggaatctaaccatattctttcaaatatagttaatcagttgtcctagcagaattttcaaaatgccaaatttacatatactaaatttttatgaagggtctgttcttagactttttatccatttcttccaagtgtctatttattccttttttagttttaattattataacactataatagtgtttactatataataattttaaatacatggtactataagtccccagagccattctttgttttgaatttttattggctgttgttgcttacttttgcctccaaattatatttagaaatattttgttaagtttaaaacattgcatcagaatcttgactgggatttaataaaacttacacgttaaattagggtgaactcacgtttatattaactcttcttcccatccaggaatacaatatgtctctccatttgtttatcttctgtagcccttgggagggtgctataatttttatttaggcrgtattcattgtttgttaactttattcccagatatttcatggagatttttgttgctgttgtaaatgggtcttttttcccccattatgttttmtagctggtctttactagtatattcaaagactgttgtttttggcatatttgctttgtaaagtcatcagactcttcataatactgcttacactgccaactaattctcctggctcytctaggcaagaagtaatatcatctgcaaataaatttgtctcattattttatctcctccttttcagtggcttttcttttattttcttccatggttattggtctattcaggtatattactctaatatcaatgttgatattttagcttttagtaaaaaatccatttcataatttcatttacatttagtaccacaatgtatataatgtactatggtgatgtttaccctgctttgtattagtggtgatattcctgcctttgttatcctgcatcgtgcattcatcatcccctttttactcggytgtaccaggtgttttgtgtttttgtgggttttttttaatttttattgctgcaatttatcaattattctgcagtttgttgttgcttttttttattaatctctgcctttatttcatcatttccttcctcatatttttcttctgattattttgttcttgttctaacatcttgaattgagagctctgttcattattttctctgtgtaataaagaacatgtttacagcgatgtattcacctccaagcatagttttggcttcatgccataaattttgatatgtactatgttcatcatcattactttttaaatagctcatcatggtgttgtttactctttttgcccaagtgttggctaagaatgtcttttcttttcccctaagaatatggattttgttcttattgcattaaacttttgtgttaatttatatttttatttccatgtagtgaaagaatgtggcctgtaccatttcttctttggggattaattgaagtcccttcagtagccaaggacctttttttttagttttctaaatatttaagaaggatgtgtgttctctgtaaggtagagaagcaagacgaatgagctcaggctctacaatcacactcttttcttagctctcctatttgttttctaggtgacttaaggcacaatacttgacctctctgagcttcagttttctcctctgtaaaatgcaaagaaaaagagtcctacctcctaaagttagtgttaggagtaaatgagttttgtaattgccattaaatcaatcttactcaattttgttattcagatctattgtatcagtgattctcaaccaaatgaattttttgtaaccaccacctcacacatacacacccaaccaagagtgtaaatcaggaactcctggagtaggatgccttttcaaaacagatagatagataatgtatagctatagatttagagttatagtaaggattttcaagtaaagagctatagagaggtctacatttaagacctatagatgtaaatatggatgtagatataggtgtataggaccaatagaaacaggaagtaaggaaggaaggaagcaaggaaggaaggaaggaaggaaggaagaagatgggggaggaagatgagagagtgagagagaaagagagaaagatgtataagacctgtagatataaaactcctgacctcaagtgatctacctgcctcagcctcccaaagtgctgggattacagtgaaaccccatctctactaaaaatacaaaaattcactgggcatggtcgtgggtgcctgtaatcccagccactcgggaggctgaggcaggagaatcacttgaacccgggaggtggaggtagcagtaagccaagatcgcgccattgcactccagcctgggcgacagagagagactccgtctcaaaagaaaaaaaaaaaacctgtagatatcaatatcagtatattcagagagtcccttattcctcatttggagaaacactgataacaagccattggtactgatgggagtgcactatgtccctgtccctgagttgcgttgggggagaaaaagcttaaggaccgctactcaacagtcttcattttgtttttctatttgatgtatcaatgattgtgaatgttgcatgaaagtatttcccattacagttatgatattttgttgtcttcttgtatatctagcaatttttgcatctgttttcctgacatatcttctctcattttctccaagtctttctcttttaagaggaagttgactcatttattttacaagtgaattatttggtctgatatctgtcatcttgtgttgttctttctgcgcttttgtttgtgttgttttgattttgcttcctcgcttttccatacatacctgacccatctctaattttcaagtttttcttgatatatttggacttttatattaatgttatagtagttattttttaaattgtggacttcttccccaagagcaaatttttgaatttgcatttgcattttgttttgttagctcattgacaatagttattatacttttctggttgtatttatccctgctggtgtctgaattccctactttagttttgggttttgtttttttttttttcagtagggcttataactgcagtactttctgtaccatgcatatatgagaatgctttccttttgacatgggatataaatgacamcttgattgtaaatcaaattacgggtcaaactttatctttcaaaactgcagtaattattccactctattccaacatttactgttacasacaaattggggtccaacgtgattctttgtccttgtaagtaacctgtgcttttctgtctatrtgattttctttttttgttgttgttaattaaaaagcccactgggaggtgttgtggtggaggtctcttctcactaattctaccttgcacttggcaaatatttcaatctgtacctcacatcttaggaaaagtgtcttctttcttaaatgattttttttttttttttttttgagacagagtctcactctgtcacccaggctggagtgtagtggtgcaatctcagctcactgcaacctctgcctcccaggctcaagagattctcctgcctcagccttccgagtagctgagactccaggtgtgctccaccatacccggctaatttttgtatgtttagtagagatggattttcaccatgttggtcaggctggtcacaaactcctgacctcaggtgatccgcccgcctcagcctcccaaagtgttgggatcacagatgtgagctacttcaccctgccttaaatgattttttttctccttcaatttctctgtcttctctttctgaaattcctgatacatgcatatggatttttttttcatctttcacgtcacttgtcatttctctcgttattttaatctctttatcctttttctgtggattctgagagaatttcccaaatttcatctcgacttcactgttcagtttttgtggaatccagctgcttgcactagcatttctcatctctttgcagcctttattgatctcagatccttcttcctctgacttcacagatgcaatgctagatttaatctcatgacaaccatgactgaacatctgctgagagttttgcctgttctttgttgtggttcacataaagtatttgctttgacttcttagagtgatctccttcctcaaaactttaacattttttcttatgtccagtgattttactatttgctctcccttgaagatggaggcccgtgtgccttcagggctgcagttgacatgggttctgtgagagctcactagggtcgttatccacatctgtcaggccaaatagaaaagttgagtttcactctgctcacatccatctggaggaggagttggagatggcagtgatatcaaagggatgctttgccttcatgagtttctttctgctttggcagctacatgttagctgggggcaataactgttagctgggacaatgactcctagccaggctcagccttctgggtcacatacacatctaagcctgccttgcaaaagctctctgctcccatattggtggcatcacatgagcttcctggaagtacaggtggacctcccagtagttccgttgtgggtcccaactctagccctcactgtagtggagatagagcctggttctctgtaatccctgcttcgtcctgagaatggggtctggggtcagcagcgcttctcaggggtccctgaggctgcaggggggcagcaggcagagtggccatgctgctgcctccacccatgttctccctgcgcttccccagaatggcaactacactaattggctgcaggtccagttggtgctgtctctcccctggcccatctgtactgcaccaagcagaagatatacctttgtcttctgctacaaaagctgtcagtctaccctggtttcctgtgcccatgcaggttccccccagtttgtgtgttattggccggcaatagtacatcctggtttgcctgggacagtcccaccataactattgatagcactttctttgactctcaaaaatgttctagtatgaacaatacattacaccatcgctctggtaatcatttcacaggatggtgggagagtgtctgggaaagaccagttgctcctagatgatcacatcatcctccttcctagaggccaatgctatttttaaaaactcagattgatgtcagttttccaagtaaaccaccagtcagccggcttggtaacagctgctgtctccatccctgtcgctccacacatccctagcagccttctcctttccggcacaggtcatttaatctttctggacctctctttccttctttattaaatgagggtactgaactctgtcatgccaacctcacagtgaccacaggtcaagttaagaccgtgaatgaaaaagctttctataaactttaaattgtaaagtgcagtaaaaatacgtgagattttatttcaggaaggcctggaatgtggaaggaattgctgcatggggtactggcagcccctccttcctggccaggattttatcttctgggcccacctgctggactcactgttctctcctccttgccccttatctcggcaggagaatcactgcccttggccacctccaatcaagttctcattaagttcagcgccaaaggcctcgcaccagccagaggcttccactttgtctaccaaggtatggaggacatggacgccggaggtaggaaggtgatctcggttcttaagggactcgtgatcgaagggacagggatctttgacctctagtctgagtccctttctcagggtgtttgggggcagttactagtttgtagggcaattccctgaaatccagttaattttatgcattcacttactcagcagacatttcttagacaagttctgtgtttaatgaggaaggaaatcagacaaaggcagccagttttttccccttccccactccacccattgtctggcatggtccagatggcactgaagagaccagcccaggcatcttacctggactcccctggagcttggttttgtctgccaggcacagtaaaggtgcggggaaaacacaggctttgaagtgccgtggacatcgatttgaatcccacctccccaccttcgagctaggctccagctacgccaggcctcagagcctgtttgctcacctgtaaggagcgggcaatcacaatgcctcactgataggatgcaaagaggcttcgggaagtagctggtaccaaccagccagttggtgttagttcccttccttattggcccagaaaggtagtttggagcatcctggttttcacccccaggtcccaacctctgcttgcccaggagaacatccacttttgtagggcccaggttctaagcatggtcctgttcattcgactctgcccaggatgagctgtgtttctctttgcaggagtgatcctatcacaggggaggccatcccgggcccatcagccattctgggcggcaggagggaggggagactgggggtcatggagggcagggccccaggcaggatcttaaggcacatggggaaaacaggacagaggcagggcaaaggccctgaaggtagaggaggaaggcccattctccttgctagggaacgtgggaccctgatgagtgaggggcgtcgttgggaaagcaaagaacaaaactgggcctaaggtctgtgggaggtccacggctctacctcccgtgctttccaggagctgtgctgtagcgctgtgtgtccaactataattcggtataacaggcatcctcctagttagccctcgagcccttccctacgggagagcatccagagcctcccagggtttcatccagacggtctttgttccagacccgttgtatgtccgtccctgggccagtttctgaggggtgaggcctccmctcagtgcccttgtcccccacagcggttcctcgaaccagcgccacgcagtgcagctctgtgccggaaccccgctatggcaagaggctgggcagtgacttctcggtgggggccatcgtccgcttcgawtgcaactccggctatgccctgcaggggtcgccagagatcgagtgcctccctgtgcctggggccttggcccartggaatgtctcagcgcccacgtgtgtgggtgagtaaccaggacccgggcgttgagggtgcggggggcggcacgtagtcctttctctgtaggggaggcagtcagccccagtgatgccccacgacacacagcagccgcttcccaccgcatggctgaggtggggtgtcccagtcaaccccagtccccggcgctgtgggctgtgtgaagacagccggtgtactggggacggggcacacgtggagagaggagctgggcccagggccccgaacagagttgcatggggagaggccgtggagaaggcaggactggggacattagggagacacccccatggggaggaggacaaacagaggctgggggccatgagggaggagtcagcttgggaaggctyccacgggaggccacaaagcctctgacccgatggcctctcctcccagtgccgtgtggaggcaacctcacagagcgcaggggcaccatcctgtcccctggcttcccagagccgtacctcaacagcctcaactgtgtgtggaagatcgtggtcccygaaggcgctggcatccaggtaggggcaagggggcgcctcggtcgggcaggtggccgtctgctcccaggtaacagctcacaggtgacaaccacaggtgctggctggtgccaaggcctgagtcagggtgagccaggaagagacatatcagccctgtacctgcccctgcggctaaggaggctcagtccaagtgtggagatgtggctcccatgcagaaaacacagcaggttccaggccccaagagcttcagggacatgcggtgggagtcgggtaacccaggaaggaggagaggtgggcattgattggccatggccaggaggggaggctaaaagaagaaatgggcctggagctggaatctgaagtgtgggaaggattcatagaagttgttcctcaaatggctaaagattttcttaagattgtgagggttagaaggggaggcagtgctaatgagaagaaagagcaaagcacccagcacagctgaagcacagagaacccccaggcacacacctagggaaccacgcacagcatgagctgtagaagctgaactgggggcataactggtacccaggggtaagagccaggcagagggaggccccagcattggcgtcaaggcagggaagagggtcaggagcctgcaaggccaacagagaggcagcaaactgggagtccagcagacagatctgggcaggagtgggttacgggctcattgctgcaggacgtctgatgaaatcaaggcaggaaagtgrggaaacccaaggaacattccagagatgaggagacagtcagtgagactgtctttccacttcctggaacttcttttccccattctctgccttgcaaaatatccactgtcttctaatcatttttttccacatctgtcttccccactggacaacgagctccttggagtcggttctgcatcttacttttattgaaagggactagcacagtgttaggcccagagtagattctcaacaaattgaattaactacgggaagggcagaaagggaaagcagagaaggagggagggacgcaggctgcctaaccaacaattcactcttctcccttcccagatccaagttgtcagttttgtgacagagcagaactgggactcgctggaagtatttgatggtgcagataacactgtaaccatgctggggagtttctcaggtaagctgggtttccaggggcttcaatttggagggtagtactagagctcatcatcatgaacattgttattatcattattattattgagatatcacttatattccatgaaattcaccattttcaagtggacacatcagtggttttcaggagattcgaaaggtcctgcaaccatcactactatctaatcccagaacattttgaccaccccaaaataaaccaggtacccatttgcactcccctccccagcccacacctagcctctagtaaccagtaatctactttctatctctctggatttgcctattccaggcatttcatataaatggaagccttctgtgtttggcttctttcacttaacgtgatgttttcaaagttcccccagtcacagtatggttcagcacttcattgtaaggacagagcatattttgtgtgtccattcatcagtcaatggcttgtttccacttttgtgctgttatgaataatgctcatgcacaagtcttggtgtgaacacacattgtcacttctcttgagtatatacctaggagtggaattgctgggtcatgtgggaactctatgtttaacttttggaggaacttcctgttttccaaagtggcaacaccattttgccattctagtaatggacttctgactgagtgtggtgtataggtgtgcccagtggccagggcaattatctgaatcttttaggcccagaactctaggtggccaagagataaagaggagtcacatgcttcagataaactgtccacactgcaggactgcccagagaataatacaggtcagagttatcctgaagatggctatgaggagacccaactcatccctcaccctcctgcgggcacatggctctgccactgctcatcttacaggaagcagattggagtttcccctccctcagccagtagagacctagccctctgaggagtgctaatttgtcatttagtgagtttcataactggggacatctgggggccttgggagcagaatgtcagcaggtagcaaaatccagaggaatggggaggaatgcaagggcctggaggagccaaacttaaatggttttccctggtgtccttgccctaggaacaaccgtgcctgcccttctgaacagcacctccaaccagctctaccttcatttctactcagatatcagcgtatctgcagctggcttccacttggagtacaaaagtgagaatccagggtcttggctggtacagggttcagggtgggacctaaaagttgctgagccccttctgagcaaggattaaactggagctgcatattgtccatcccacttaagccttcccacaaacctaggtgaagatgctaaagcccagagaaggtctgaaacctcctcaaggctgtgttctcgtccaagtgtctgttactcgaaaacctgtatgcctgttcagtatccacaccaggaatgggaaggggacttgcattggccaaggtcccagtatataattgggatgtaagaaaattgtgctttcctcccccaggtctaaaacctggcctttctaacccctagttctatgatgcgattatttttgaagttcctcctttcattggctacctcactcatcttctaccagatttctcactgcaggctcaaacccttatatcctggcttctggcatccctaagtggtcactaccaaatactcttcacagagaaagatttgtggatgtgccttctggggaacaaagaaagaggtttctagggaaactgcttgcatactgggactgcctgccctaccccctttctccactgggtacaggaaagaataggtaggcagcagcattttttacacttttattcggcaaatatttattgagcatttacaacatgccaggcactgtgctgggttttgccacgattgggaaagattaagatgggtcagtcaaagtccactaaagagaggtagacacatagacagagaggtgcatgacagcattacaggtgctctcatggatggctctagatggtagagaaatggttcaagggagagaatggttgtgggcgggtggagatgcaaatgttgtgaagaaacattgagcacctgcaatgtgccccgccctgtgttaggtccccgcagtacaaaggtcaataagacaaggcccctgccttcaaaagcacaaaatctagaaggagagatggacatgggcacagtcattttagtgaaacctaagaaagtgcagaggaaaggagagatgctaagaaagtacaaaggaaaggagctaaagctagccatgtaaggccttgcagaaggggatgcctgagttaagtttgcaatgagaagtgaaaaatgcaggaaggcatggttggctagaccatctgcgacagcatgggcctgtgcagaaagaaggcccactgggtgctagatgtctgattgggtcagaactgtgttatgcacatgcccatctgggtctgtgaaacaaatgaacttcatccagctgcttcagaaagaattaaacaggtccyaggatgctcatcacctgaaagaactgaagcatgcacctggaaaaaaaaaaaaaaaaaaaaaaaagacccaggacagctagaagcagaccctgcagggtaaagggtaggacagggacctctgagactccttccagcagatatgtaaggcttcactcccctggtggagtgaaatatcctgggtttctcgactaaatcacatttttttcctttcatcccttcttctctgttctctccagttttctctatccaatattttgagctcttaaatgttccctagaatcttctctgttctttcttcttccaaagatacattttctttgtaaatcactttgccattctactgcctcattcccaggaaaaaaatccacctcttctcaattttcttcgtccaaggggactggcagttttcccagtagctgacatttcatgtgttgtcccctcatgatgggaagagctacggagaaacagagcttcccactggtatttggagactggaattcctaggagccagggccctgtagttatattttattttgtaggataatctacaaagagctcacagacaatagagaattaactgctattgtacaggcaaatggttttgaagggtactgaaaagtcacatccactgctatgattcataattgtttatttaatttaaatggaaatggagcaatatgctttcaaaagtaataaattacatatgataaaaaataatttttcctttgttgtaagcatggcttaaataaaatcaatctgtgtagcataagataagttagaatggacttttctatatccccctccatttttctcttcagcctcatctttctcccattccatttttcttcctaccacgcttttttgtcctcattctgctcttctctccatcactggacagtaagtaggtctttccaataagtaggtctagttagttgcaactactgcactaaatagtgagttttgttctacttggagtgtggagaggaatggggagaaatagacaagatgacaagtgaaacacttgaaactcagtttgatgggttttttttaatgcttgtccttggggtcttttgtctcagctgctgagagttttggacaaggctcaaagagttttcatttccaaatatcacactcatatcttaaaagcacatgtgggacaggaattgcctgggaaaagtgtgaggaatttccagagtgatagcaacgttctgtggttttgacaggtgtttgggttacaaaggtacaggcatttgtcaaaactcagcacatgtacactcaagattatgatgtttacttgattattaccatgttcatgcacagtttttgcattttgttatatgtgagtttccctcagagggaaaaaaagcacatgtagttatcagagtctcatctctgaatgtggcatgaggactcattagctgctgcctgggaagatgggttggtggctgatggtctaggctgattggtcctttcctgtttcttttccatgagcccctagctgcctgtgggcactggatacacgtgggctcctcagggagcctgtatcccccaaaggagcctgtatcccccaagggagcctccagaagggccaaggctgccatctcccacattctctgggccatgccacccagatacggtctgccatccttccatttctgccgccttggttaggaagaccactttagagtttacagctacctctccgcctcctcatgagtcttctggcccttgcccctggacaagtgccctccaagtccagtccagcaagacacagaaactttttagtgcatgtgaagtgcctgcacctgtacatggactcctgcagagcacaggagaggcaggaagccccctgtctggaaatgctacactcccatttgctgtgtgggaggcagccagggagggattcaaagcaggatgaggactgttttaggaggggaggcagggagagcaggggacagggtcagacatgggctcatgtggcctcagggcttggcttctgcttggccgacctggggtcagactgggcttggtctgaatcctgggtctgtggcttactaaggaaatgtttcagtgcctcctatggcctgtgtcctcatctgtgaaatgggatgtgaagacctgcttgaagggtatgaggggataccctcaccaatgggccccagccttgctcatggaagtgctcagtgagcacttctcttgggaagatggtatggactggcagaaaggaggaggaggaagattaagctgggtgctctagcaaaacattgtgtgcaatgccaggcatgtaatgaggaataaatgagtgcaggttgaatttgaaaagtcaagaaaggagactgaaggaggagcatttgagatcctgtggaggtgatcttgaaagaggactaggccaagatcatgaaagtccttagaacatcaggatgagaaagttggattccatattataggccatgaggacctgcttcaaatcactgagcaaggaggtcccacaattcaaggagagattttaagcaacacgagttgcctgtgagtgcagggtggactggactagcagtggcttggggtaggggatgaaggagggttttagcggggccagtgctcagtgaggccagagctgaacacgggagttgaagtgtgagaggccaccagtgctgctcccagaaaggggctggcctgaccttgaaaacacaacaggagaaataaggcagtggagagtcttatctgctaacacacttttctcagagtcttggaaagtcggactctaactgagcccctgagcatcgctgatgtgtccctccctgctctccttccttcttgaccttcttttccctctctctctctctgtctctctgtctctgtctctctgtcttagcccacaggatctgtcttcttagggtaaggaagacagaggggagttaagagtaagaagcaggagggatgtgggaggagagcatgcagagaagtctccctagctaagccccctagctaagagctcagtgagtggacaggacagccagcatcccctgggatcacacccaccttctcaaggagctttggtctgttgagcctccgtgccatgtaaatatactctttttctctgtgtgctgcaaggtgaagagagttgggaagaactagcctacaggatgagagaaagcacaaattagaagcaccccttctccctgccaccagcatctcaccccagcctaccgccacgttgacctgctgggctagtccattctcctttccttctgtctctgtcttgtctagcggtgggcctgagcagttgtccggaacctgctgtgcccagtaacggggtgaagactggcgagcgctacttggtgaatgatgtggtgtctttccagtgtgagccgggatatgccctccaggtacctcccctgacaccctagagcaggaaacaggtgtcccctgagatgtggttggccagccttacaccagcagagctacagtcaccaaagaacagggagcagcccccaggtcccccgggtaccattatcctctcctggagctgttcatgcaaaagataaactctgctgactttaacaatttggcacaagccaacctccaatgtgttcctgcaaagttgggtttgattcggctttagggaaatttaatttccctttgaaggccatcagggaatttagtaattaaaggactctcacaaggaaacctctaataatgagaattctttagtaatcgttgttaataattgtccttccccaaattctctctccctctacctcactcccatcccacagtggatctgtgtgtctttgtgtatcttgttccttaacatgaggcccctgaaccagacccctgtacagcccctggttgtacatacaattgtgcccacggggacagctagcccatccctgttcctgattcctccagggccacgcccacatctcctgcatgcccggaacagtgcggcgatggaactaccctcctccactctgtattggtaagacagcccagactttacaattcattccaaccaattttctctcagggatcttagctcagtagtgtatcattgagttcaagttcaaatcagaagaaagtttgatattctggatttgttccaagtcagtcattttaaactgatgtttttataatctctaactcccatttaatgcagtcatcacttttggaaactctgccccaccaaatgaaaagttacaggaggtctgcccatttgaaaacatgatgatgaccgttctggctctagttaatcaaccagatcccagatggaatttctaggcactttgggcttcccccgtgacttcttgtgggacagacagacaaatctaataaagaaatgatgaggttggccgggtgcagtggctcatgcctgtaatcccagcactttgggaggccgagtcaggcggatcacttgaagtcaggagttcgagaccagcctggccaacatggtgaaaccccatctctactaaaaatacaaaaattaggcagatgtggtggcacacacttgtaatctcagctactcaggaggctgaggcaggagaatcacttgaacccaggaggcggaggttgcagtgagctgagactgcaccactgtactccagcctgggtgatagagcacaactccgtcccaaaaaaaaaacgaaagacaagaaaaaaggaaaagaaatgctgagggctacgtgcgaaacaaggacttggcttcgtcccttaccctgtgctacggcagtgatgagcagatcagcagacacaagaaaagacagcatctccccttcagaagcttctggtccagttaggcaaagaagaaaggcacatttatttaatatctactatatgctaggcatggagcttcatatttcctcagatcagccctgcaggggaggtaccattaccctcaatttgcaaacaggaaatctcagtcttttaggattaaaaaggaagtggcagagtcaggaacggaaacctaaggttctctggtgcccagtcgattgtgaggtgcccctcaaggctgaccttggggcagggaggtaagggagtgacactcaagcacgatggcatttctcttctgtggtttcaccacggtgtagggcataggcatctgtggagcaggtcagaaatgtgaacggtcagcccaaggcactttcccccattagagactacaaagaccttgctatggaaaccattcatttaacggcagctgctgttcattaggggtttacaacatgtgccagccttgtcccaagtaaatgcagtcctttctgatatgacctcacaacaaccccattagaagggtgctgtcactagttccattttacagttgtgggaaaccgagttctggagggttttgaacttgcccacggtcccatcggaagtgaaggtgggattgtgacacaggcagtcgaggctggagcctactctgcactgttttcgggtctgtttgccaagctgtcctctccccagaaagcacttgcctggacctgccaatccctgttctatgatcctttccctgggtctctaagactggctagcccctttctgttcacacaaccttttcctaataagatgcaaaagaaaagaactgatgtcaactgaccagactgcaggggtgccccagccctgcatcctcagatgactctgaattcaccttgattggcatatcagatgtccctaagcccctgggtcactcagacagcctggtggttggctcctgtgggatgctgatcaccgtcacttttctgaggatgggctcgtggtgagcctcccctgccgcccaccctgccccctgaaatatatatttgagaagagcctggcatggtgccgggcacagagtggggacttgatgcatgccagtccccttccttcatcctttttctgcagtcttgaaagagtagattgggcagtgaggagagggagatttgggggatacggtaagaaatggttggacttcttttggcacagaacttcctcacttttcctggacatcctcaccagggaactgacctgtgaagggcatgttcaaggtcaagagtccataacttgggtttgtggacttttaggctgtcctagaatgtacctcccttcctgaatgtacatattgaatgttgcccgtgggcttagtcttttaagaagattcctttggattctcaaggggctatatgactcatgaaagcttaaaaactgctgcttgaagggagcttccaaacattggcagggccctgtacaccccttgatgttgtcctgaccctctgtctcatctcaktgtcacagcacagtgtgggggaacagtggaggagatggagggggtgatcctgagccccggcttcccaggcaactaccccagtaacatggactgctcctggaaaatagcactgcccgtgggctttggtaagtctctgcagcccccagaggagacaggcttcaagcccagacccttgagcttaaaactactgtcygccaaaatctcttagcacaaacttgggccaagtctgtttagtactctgcctctctgttttctcatctgttgacctcttgtacaattgtgaagaccaattaagaatggcagagattaacatataggggggagaaaaatcttaggggttgccattattattatttgagccataaactaaaatccaggaatgtggaatgagaaattactcggattatacctaactaacactgtatcacttgatattaaaaataaaaaataaaaataaattactcagggacttaaaaaaaaaggcgggggtggggcggaaatctgtcgtacagagactggacctcaagttgtacttttaaccccagtgtctaatttatcatcctaattaaattgagccaaatcaatgagaaatcgagtttgcattcttcttcgtatgcacattctagctggcctagagactgggaaggttgtttttttggttttggggggttatttttgttttgttttgtttttggagctggagtatgctaggcatgggaggttgtcagggtgtggaggacatcagtgtgggtacaaaatgtaattgctggtgatccacatattatgcactgggaatatcatttaacccaaatgtctctgttgaagggatgagggctttgtgctgacatggaactgatgggccgtacgcacgggtcatcttgcccaagccattgcactgcttctaggaatgaaatgtcccaaggggattatgcctgcatagccctgaatgccagtctgtgagcctcagaaatgaagatctcccattttatccttcattattcagcctggagtgtgattagagattagggaaggggcttttgggagaaagcagtctaactggccttctctaaatccggttggaggggaggagagagcttggtggccctctgaaagatgttattttctgttcagtaccatcttctgaaggaaactgggtgttcagtaccatcttctgaaggaaactgggagcaaagcgatgacgccctcggcagtcttaggagactccagactttgagacattaagaggatctgggagaccctgtacctctgcatccagtcttgaggcagaaccaagatgatagaaggtggggagggcaacatccaaaggcaaacagaagtttgaatgaggtggctttccctgtaagtccttatgttcagccaccattttcacctctaaattctgggtgctaattcaggtttcagggaagaagctactgctgggtccagttgcaaaggcccgggatcccttgctttcaagttaatgttggattctgccgaggtccctaacttggtacctggtctcagcgtgtaaagagctgctgcagctacatgctgctccactagatggcggtcacagtccagttctttccttggagttcaagtcagaaattccgccatccttaaagagccccttctgtgggcctgcagcccgcagggctcctatatgaggggacgatgcctgggcagtggaatggaaagcacaggctcctcagataatgtatacaaagatgtcatcacagcctaacacggtgaaaacccgtctctactaaaaatacaaaaaattagctgggcctggtggcgggtgcctgtagtcccagctacttgggaggctgaggcaggagaatggtgtgaacccgggaggcggagcttgcagtgagccaagatcgtgccactgcactccagcccgggcgaccgaacaagactctgtctcaaaaaaaaaaaaaaaaaccatcacaaaattatctgcaacttggaaacaatctgcatgttcatgagttggggagtgaactgtatggttggataattcataaaatggaattaacatgcagttaaaatgaatgaactatatttttgtatattaacatggatagaccttgaaaaacacaatattatgtaaaaaactgtatgtacagtataatatcatttatgtaaatcttgaaaacacataaacccagatacatatttaagaatccaaaaccatgaactggaaggatagcttccaaattcatgtgattgcttctgtggagggcaggaaaggaatggaacagggcaggagatgaaagatcttcaacattaagtgtcgagtctttattttattctttaaatgatcagatgcaaaaagaattatactcgtgcttattctgagcttatttgatagcacagataagccaattttaaaaatgaaaatccatctataatctcatcgtgcagcgataatcactaatggcttagtctcccagcgttaccatgtaagtctcatgaagacaaggaccttcttgatcttgctcatcctgtacaatgcctagcacagccctgatgtacagcaaatgcccagcaaatattcctagcaggcaaattaatattcttccatgttttataatacaaaaattagaattgtatacagcatactatttgtcatctgatttttacaattatcaatgcaatatgggctttttcctatgctcagtaaatatatttcttcaataacattttccatggtgatctaattttgaaaaatcttatcagtaaacaaacataaatgttcccaccttcgttcttgaaagagtatattactatgtacattaagaacttaattasatttatttaacctgtcaggttgctagaatgtcttgattaactcactaagatcccaaagtagaaactttatttggcttctttatggaacagaggggacaatgtatacttctaagccctacgtttctgaattatcataagagttctagaaaacagcagtattgaaggtcttgtcttttgattaagtattgggggtgttatttttaaatgaaaagtttattctagcaaaactatctttatgctgatattggacatatgaatcataaatttaaacaagtgttgaccctgaactttgttttcaacaaaataaaatgaactccagtggagctctgaaatgactgatgcctttatttttgaatgaataatacacttttaagttcagccctgtcaaagacaagagacttggctggacgggcaattcccaaagccagttctaggagccttggctgggtgggaaatcagtagcagggactcatggctctggcaggagctgctttcatgaggcagcacacttgaggcaggactgtgttgctttgggcactgtctgcctctgtcttgctcccaggagctcacatccagttcctgaacttctccaccgagcccaaccacgactacatagaaatccggaatggcccctatgagaccagccgcatgatgggaagattcagtggaagcragcttccaagctccctcctctccacgtcccacgagaccaccgtgtatttccacagcgaccactcccagaatcggccaggattcaagctggagtatcagggtaaggacaaggagcaccgcctttgcttctctgtctatctccatctcttgccccagccacccaccttcccagccttccatgtgggggaaarcagaacaccataaggggtgggttgcggtggcaggcccagtcagggaagcttccttttggtggcagatctctccggaccccatttgtcagcttaagttctcccacagccttttcaagagtggcaggcccaacagcaccctctgaggctcccactctgtacagctgtccctgggcaagtggcccatctgtgccttctcaggtgtcccaaactgtccagccagtcacttcccctcgggcttgataaactgaattacttccccagggtccttccctgcacatcaagcccaattactctcagcaaagctcttcctatgacaggatggaggattctagtaacagtcccaagggcayctctaagccttgcacaaggagcaggttttcctgtgaggcccaaccacactcaccacagctccacctctctgaagtgggatcccgtgaccggccccactcattctgggacattccctggaaagagccccatctacactcaggttcccctgtgttgtagaccatccatcacctgtggatgtggagattgtgcccaacctgtgcagctgtacatggtcctgagtaagcccaacctcgcccttggatgcttcccttattgtgactgaccgaagcatttgttctaatccctttcccagattcttccactgaatttttaaaaatatttttagattttttttccaatactaattcatgtttgtaaaaaaaaaaaaaaaaatctaaacactgtagataattttgtgagcacattgtgttagctcaggctgctgtaacaaaataccataagccaagtgccttacaaacagcagaaatttatttctcacagttctgagggctaggaagtccaagatcacagtgccagcagattccgtgtctggtgaagacccactttctagttcatagacagtatcttctcactgcgtcctcacatggtggaaggggcaaaagagctctctcaggcctcttttataagggaactaatcccatttaggagggtgggccaccaaatgccctgcctccaaataccctcacatgagggattaggtttcaacatagggatttgatgggacagaaatattcaggccctaacacccgtcacaggaagtcaaaatcctcccataatcccatcctgtcactaccctatgcagagatacacactttcaacaattcaatatgtattccccgcttttctcggtatatatattgctgtagctatatttttagccaaaattggatcgtactatagttttccaattttgttttttaaagttaatttttaattacacaaacaatttacaaacatatttatcttttaaaaaaagaaaaatacaagaaagaaattaaaaccttacaagtaaggccaaagctctctttgtctatagcctccaaacccaggattattctccagaaacggctactattgtttagttgtgacctttccaggcctggatatatgtatgctacatgtacctgtgaaaaatatgtaacattttataaaattttttgaccacgttttctatataaatagtaccatcctatatgcagctttctgagagttgacttctttattctggaaataatatggtggggatggagctcctcccttgccagagaagaatactgagggggtactgggcttctcatttagggaaagccttaaagggcatcccacgaggtgggtgcaactgaatcagttctgcaggagacttcagggttccggggtccatctcagggaaagctttggtaagtgcggctgggcttgtcatctagagggagcctcaggagaagctgggccttgcacccagacagagccacttcactggtgttagcacagctgccacacccagggaaggtgtgtgcaggctcatcacagaggccagccttgcccaaggatgtctgtgcctattatctgggaggtgtgtacctgtcaaacaggtcatgacgcgtcggatggccgtgatgtcacaggagggacttggtcccaaatatgtcctctcagagacagatgcaacgccttcccccaaggctttcctgtgtcttagtttgttagggctgccataagaaagtaccacaaactgggtggcttaaacaacggaaacttactgtccaatggctctggggctggatggtcaagatcaaggtgtcagcagagttggttccttctgaggcccatgagggagactctgtccgggcccctcccctggcttctggtagttcatgacaatcttggcattctcagctcttagaagtatcaccccgacctctggcttcatcttcacatggtgctcttcatgtgcctctgtctccaaattcccaccttctataaagacaccagtcatattggatcagagcccaccctagtgacctcattttaatttccataagtttggtaaagatcctgtctatttcccataaggtcatattcacaaggagtgaagtcttcagcatatgaattttgggagacatatttcagccccttgcacccctcccaggcccaagtgctctctccctgagaccttccttctcggataaatataaggaatggcagtgccaccattgtgccagggacagctgccctgggcccaccccgtgcactgtgccttcaccctagacaatrggcacggtcctgccactgaatccctgtgatgggaccagccactcgctgtgctccccgtgtgatgagcccacttgtccttgyaaaggttgtgcctgtgtgaccgcctcagattctccattgactcccycgacagaagaggcctaactacccccacagagccctggccttgggctcactcgcccctgattccccagcccccatctttggaaatgctcccactatggccaccctgcacaaggggccccgctgtccccctgaggtttcctggacgacaagccaacattcgggactagtgtccctccctgggatgggcctgtctctcccactgaggtttgcagcctccacaggcccagtcctcctctgataactttccctgcgtagggaggccagggggcagcgagttgccttcagacacccagctcctccaccaggagttggcccaacatgtgagaggcacagcgacatccaatggggcttccaccctataatgggccccctcctcccacaagcatgtgaccttcaggacttgcctggatgttccccttcagtcccaggcacagccactccctcagcgttcacctgtctgccacagtcccaaggactcctgtggagccacacatggtgccggggcacctgctcccctcagacttgggctccacccctattaaggcttctcgtttggggcgatcccaacctcttgggctaggttgcctctagggccagaggcctaagtattcccacagaggcctcatcatttgtgataggcccaaataaytctccctgaccataagcccacactctctgtttacaccttcctccgccgtacggagcrgcacctcgtaagcaagctctgaccactctccccaggtttttcctctggggaaaaacccagcttcaatgaacgagccatttgtccccactgaggctgtttctgtcagacccagctctctatggcccctcgactttccttagaagtccaactctttactctttctcaaaattcctccaactgatactctgcacttcccatgctagggtcttcttttctcttctttaagtaaagattcccatcaagttcttagtagcagcataagcaactcctagccaggcctcccggtccgacatgcttaatgtgttccatgacaatttctcaggagggttctgtttataaagaacttagcaaaatggctaagatgtacaattgtccccaaatgctaggcatcatcattattaatgttttaaaataatggcattttgcttgaaattgtatctacctgattatggcactttgtttggaagtgtgttcccactgtcaccaggtgtgtccctttagaacaaacccacttgctttcctgaggagtccttctttggggaagttcatccttcctcctcttagggtttatttctgccttatrtggccaacctctccctttgaagcttcttgcaggggaacaggctctgaggtttctctcagtgttgaggtactctcactgaagtttctgtctttttgaagagcctagatccttccactggagatgattcctgtaggagaggcccagctgctctcatcaaggctgctcctggcttcccacacacagccactcccttccttctctccccgtctctgagtccacgtggctaccctgagcctttctgtaaagacccaacccatcccattgggttgcctccctgggcaaaaggccccctgcttccgctgagactttcgttgccaaacggcccaaacccccgtgctgcagggccaggcctgtcctggggctaagcagccaccccacccatgtggttgctcagtttttggcacacccaattacctcaatgatttcccagggaaacctgcccagttcctccccctgagacttccctgtgaggtactgaatggaaacataacacagccacgtgagtgctcaggaaatgttatcttcaagatccgcgttattgatgttgttattacgtatgagaaacacatgtacttctaagaagcatctatccagtcccaactacttccactgagkattcccactgtaggaacgttctgtctcctcccrctgccaatttcctgagtggagtgggcgcaattactgccacgaaggctgttctgtgtcctgtggacccaattcatcaaaggccttgctcaggaatccctcagcagcctctccccaatggactggcctcagctgcttccatggaggcatctcctgtggagtcaggccacccactctcatggaaacagcttccctgccctttggagggacttgctttgtgacagccacacgtcccttagcccagctactccctctgaaaagcttctctccttgccacagatttgacttactcccaccagatttcttccttcctgagaggttttgatctctcggagttggaaaraaccaactcaactcctcccgtcgccgcttcctatgtctgggatcttgatcctggttgtgaaggttcaatgagataagcaacatgaaaggarttaggctggtgcctggcccccagtggcactcagtgaatagaggttcaattgagcaatgtcttccttgagcctccttttcctacggaattactaataatagatactatttactgagctttcaccatgtgccagtactgtggaaagagctatgtatgtgttatcctacttagtcctcaaaataatcattctatacacaggaaaactgaggcgtacacaagttaaattacttacccaaagccaatgacttgtacatgacaaaggtccatctgagtccaaatcttgaggcttcaccactatgctttctgccgctcctattttctggtcagagagaataaagtgaccttttctccggatcttttccagcctatgaacttcaagagtgcccagacccagagccctttgccaatggcattgtgaggggagctggctacaacgtgggacaatcagtgaccttcgagtgcctcccggggtatcaattgactggccaccctgtcctcacgtgtcaacatggcaccaaccggaactgggaccaccccctgcccaagtgtgaaggtatgtcgctccctcatccccagcagttcttcctggggtactcgtggagactggtycagagcaatcccatgttccacctacctgctctgtgggatctccagggctggaggtccaggcaaactgtggtccatcctgttttcacatggtgtggcccagcctctccagggagagggtcctggtgacagggctccgggccagcactagggaggacctggaggagatgtgggccacagccaagaggaagacacacccagcccttgggaagatccaccctgacagactggaggactcccattggaagggaaggctccatgtgagggagtgggagcccagtggtatgctgagagctagagaggtagagttaatccaggcacctgcccaaagggagaagagcatgaagcctctttataagaactctcttgctcccctcttcatcttccccctccctgctccattatactctcytacacagggctggagagacctgagttgatctatcagggagcyggaggtggcactttcttgggtcttcttccttacccagaaccaggaaggaaggtgaccaagagcttgtgctgcctccaccctcatctgcacacttcagttccatttgccttccctcttcattctggcatcccatcattttcctggaggagtggcagaaatttgtcttgaaaaaggaagccttagcaagggcagtaatccaggaaagagtgccccagctctaggatcagatcaccccaggctccaactcaaacccctttgcctctctaagcttcaggttcttcctcagtaaagtgggacttctcatctttatttcacaagagctggaggacttcacagatggctcactctcagactcaaactctcagtttaactctcgatggaaagaggaccttgtttgcgaaactgagccgttctggtgttggaatgtaaaaccatgatttctaaaactattatagcctcagttagtttttcagattttcagagctctgctctgcgtaaccagttggtcattccgcaattgttggcccatcacgtgctgtgcaacaagcctcatcctgggctttcttccattctcacaccttgtttgtctttttgtggcatcacaggagagagaaaagagcagcgctttctcagtctgctagcttgagccagaagctgttcttcctcctcagaagccttcttcccttggcttctctgacaccatactctcttgctttctcccatgtccctaatggcaaattttaagccccttaatatagcacacatgacccttaggttagggcctagtccctgctgacctcccatattctccagtcttgcagattttatgttccagcctaagctgaaatactttgttttccaatgtgccatgttttcttgcctctgggtcttagcatatgttgttcctttcccatacagcattcctctctcttaccttgcctacttaaccctagtcatcccttaggtctgagtataaatatgaattctagaaggagtcctttcttactctcacaaaaccagatgcagggctcccccaaacacccccgtggcattcatgatgatgacatggtccagcctgtgctacagatgctggtgtgtttggctgtgtcccagtggtgtgtgtgcctgggacagaactagagtaccttgttccccactgtctcccaggccatggctggcacccaggagatattcagcttatgtagcagggatggcgtgtacctgtgcaccactttcaggatgtacgtgcattcacaggacccctggcctctgcttggaatctgttgggattctctctcctcagtctggtctgccccaaccagatgtctgcttgatgccccatgtcagctacaacactcattattctggaccatggtgtttggggatttttgtccaccatccccatctattttcctccatggtgactgattctgaataccatgaagatgtcaaagtcttttcatcctcctgcctgaggcctaaatcagtgagactaaaattgagtattgcttttggggaacaggaagataaggagagaggatcttatctacatagcaaatgcgtcctcttccagggcctgggctgaacattttgcctgcatcgtttcacctcatcaccaccacaatcctatgggggaggtattcttagtyccattttacaggtgaggaaatggagactcagggaggctaaactacttatctaagactatctgctcaatacatcgttcagctatgatttgaacccaaccttagcctcaccccaggaaccctcaactcgaagtctagaccacaagtaccactctagaaagagcagatcaaagaggaagaaagaaagactttcctaatttcttagctcttcccagcaaaagcactgcagctctgaccctaacgtctgctccctcccattcctgggaagggagaggggacagcttcagggcatcctttcttcttggcagttctcttcataagaaagagaaagagggaggctgaggcagacccacagaggggcmtgcagtgatgattgagagccagccagggtgttctgtgtggggactggtgggtagaaccaggtgcagccatcctcagcttggcctccccttccgcatcccacccaacctccctgacaggatrattagttctgggagctgggatttcctcaggaaggcatctgaattctcaggtgkgtaccgaggccctgcacttacgtttgtgttccctccctggcagtcccttgtggcgggaacatcacttcttccaacggcactgtgtactccccggggttccctagcccgtactccagctcccaggactgtgtctggctgatcaccgtgcccattggccatggcgtccgcctcaacctcagcctgctgcagacagagccctctggagatttcatcaccatctggtaggccaggtgccatgtcaacagccaattagaaaggagcattactggggttctacactgggttaccagtcagttacctattggtttagaaaaaccaagaggtgaatggtttttaaaggctgtcagcctcctgggtttcaaataaacatagtggaatggggctcagctccaactggccattatggctccttaaagggagaggaatgggagggcagtggctcccagcctgcaaccctgccagggccagggaaagtaccagtgggtgtgttaatgggagtaggtgtgggtacacagactttcctcggtatttccagagttcaaaccaacattctacatgtacctgggctaagccacccagactaatggaagagatttgaggtggaattttgtgatgtcccgttggtcatctggtgctgagccagcactttccagcagaactttctgcagtgatggaactgttctatgtctatgctgcccaatatggtagccactggctacagagtacttggatatgactgagggtctgatttttaaatgtyatttaatcttgataatttaaatgtaaatagccatgtgtggctggcagtggctgaattggacagctcagctctgagttatgtagttatatacaacaagagttaattttacattgggaatacaaattagcatttgatatgtgcagtttcctggacagtttcttcccaaaccactggatctttggaagagcaaataattttaaaattcctttgtttggtggttactgccattctgagaatcatcggggttaggggaattctcttccaaaattcccagggcttggataactgtaaccagactgccctgggttaatttccagcatgatttccaagcaatggctaggaacagacaggaggggttagataaggtttcagggaagaaatcttttgtcccaaaaggcattgtgggtatactctttgcttggaagacaaggcaatggagcatggagccgatatgcatagcagcaggttttcacaccagctcctcagccctgtcctagtgctgccccagactgagaggacctgtggtaagacccacacccctgctccatggagcctaaatttgcccaggagcccattgggctggtgaagaatcaggtggatgaggaatcagtgtgagcttcaccaattctatcaactatgttgggagaccaagttgggaacggttgggagaggtatttagggcatggtgtggggaagtgttggtacaaaaagaatcatagcctcccactccaggtctgtcttaaggccactgatggcaccaagtggagcaggcagccatggtgactagtgacatgccaggaccttgtttcctgtgtacagggatgggccacagcaaacagcaccacggctcggcgtcttcacccggagcatggccaagaaaacagtgcagagttcatccaaccaggtcctgctcaagttccaccgtgatgcagccacaggggggatcttcgccatagctttctccggtcagtatggaagcctggcctggtgggaagggccaggctttcaagtcaaggctgagcttgactcccgtctccaccatttgcggatcatgtgaccttgagtgagttgtataacctcttggagcctcagtgtcttcagagttatgagaattaaatgtattagcctatgtgagagctctcagtgcagggttctgtaaatgcaagttttcctcctattccacactgccagggcagagaggcacagaagcccaaaccttggtgccaagtccactcattcacatcaactcactggctggatcatccctatacctgtgccccagcttatcccttagcactttctagcgggttctccttctccaaagggatctagggcttctgctgacctctcaaggagcactgtgtttttgtgcacaaatgaagatattgtgattttgagtaggaagagtatgaacaattcagagtaggtatgcctttattggcagcctgttttcttctacaagtcccaagttagggatctggatatttcctcatttttattatagtggaattgcctagagaaacttatagaatgttctctgtggacttgtgcctatctatggaatgatgcacatatttgcaatttacagatcactgcagatattttaaccagaaatcaggaaagctggattttactcccagctccaccttgggccagctgtgtaaaaccttgcacaggtcccttccccacttgagacttcagtttcttcacctgtagaattaccggcttggagtttgtgacctgtaagaattctgtgaggtagtaaggcaaatattctaacccccactttacaaatgaagaaatagggcaaaggaaggctcaagtacttgcccaaaaccatgtggatagaactggaaacagaacccagcctccgcagtatctgctgcagtatctgctacagtatctgctctggtgtgactatacagtgttattacatcatgcgtgcacttgcagaaacacactaagactgtgaaagaggtagtgaaagaaacagraagcaacagagagaaacaaggatgtaaagaacctaagcagctgtgactgccattcccaggagctatcgtccagggtgagtgcaatgtgggaatgagactccgccctctccatctgctcagttcccatgcccctctcattgggcacacctgtcgctccactaatgaaatccaggctttaaggctctgtcattttgacttgtgactttcccatagagtgataagagtatggacttcagagtcacagacgggttcaaaccttggctctgacacatgcaagctatgtaactttgtctgtcatttcacccttctgagcctcaatgttattatgcacaaaataggaatcatataagtacctaacctcctaaagttaaatgaaacaatgcttggaaatccttagctccaggcacagagtataaaaggtgatcaataaattatagttctaatagtcatcattgtcatgattatttttattatatctagatattgacaggcttggtgtaaagttaccttggtggtaggccaggtctcttgttcctgttcctgagccttcacctgtaccagaaccaggcaaaggaggctcagcacagccccaggccatccttatttccaagttcttctcagcaaggtctttcattgagagtgcttgcctaagggcacaatgctccttctgcctctcagatgagacacaaggcccttgctatggtgtaaatgcttaggcccccctagaattcatatgctgacatcctaacccccaaggtgatggtattaggaggtggggccttgggaggcaattaggtcagacaacagagccctcatgaatgggattagtgcctttataaaagagacccacagaatcaccacactgaagccttctcagtggaaagagctaagaagcacaggaaacacagaggccgaggtgggcggatcgcctgaggtgaggagttcaagaccagcctgaccaacatggagaaaccctgtctctactaaaaatacaaaattagatgggcgtggtggcgcatgcctgtaatcccagctactcaggaggctgaggcagaagaatcggttgaacctgggaggcggaggttgcagtgagccaagatcacgccattgcactccagcctgggcaacaagtgtgaaactccatctcaaaaaaaaaaaaaaaaaaaaaacacaggaaactcatttgctgcttttaccacatgaggacacagcataaagacagctgtccatgaaccagtaagaaggcccataccagacatcaaaattgccagtcccttgaacttggacttcccagcctctaraactgtgataaataaatttctgttgtttagaagtcacccagtctatggtaatttgttacagcagcctgaatggattaagacagccattcagtcccagctcagaccagagcccaaggcttcactgaccacaggagcaggcaagggtctggggcaagagaggaggaactgctgtgcccagatcggcaggctcaagtgggagaggcactggactaggggatgagtgagcaagagaggcacattccatgcctcatagaacttttggtaagttgtggaatatatcctacatataaaaatgtatgtaacatgtatgtgcagtttaaagagtaataaaatgaacaccatcattgagcctaagaaaaagaacacctaagcctttgaagctctgttccttcctcagcacattcccctaccctaccctgagagttaaccatgatcctgtacttttggttaatattcattgcttttctttttattttactccatatgtgagtctccaaaaatatgttgtttaattttgcatgttatttctgttatgtaaagacaatcattctataaatgttcttctgtgacctgctcttctcactcaaaattaagtttttgaaattcatgttgatgcaygtgactgcacttaactcatttttcaatgctgtatgatttcattgcatgaaaatatagcaatttatttagtctactgttaacacttaagttgtttcatttcaagcaataagaacattgttgcttattccttattgtgaacatgtacaagggtttctcttgagtacatgtctgtgtggagttgtgaggttgtaaatatccacatatttagtttcactaggtaatgctcaatttatcttagaagcagttataaccatttacactcttcccagcaactgaagtagagttccttttgctgtacatccttgcaaacactgggttttagcagactttacatttctaccagtctggtaggtgcatgagatggcatttcacttgtatgcttgtgatgaggcagagcatcctttcctgtgttactgagtgttcatgcttcctgctctgtgaaatgtctgctccccagacagctttcctgctccaaggagaaagagataatgagtaaccaagaggacaaaatttttgcaaattgtaacaaatgcttcgaaagacataaaaggataagatagcaaacaaaaagttgtagaattccatgcaaagtaattgtggaaaacctaagagaggatattcaagataagaactaaagaaaaaaaaaggagctagacttgcaaaaagtggacagtggaagggagtgggggaaagaatttttgcctttctccaggcaagcagccctaaggaactttcttttcatatgaggatcaataagaaaaaggaaaaataccttaaggagacctgtgaaagattttataacattaaaagttagaacatgaagtttgaattacagagaaaaatgcccttgaaaaaaaaacatggtttaggaactagaagtaatagaaataaattttgggaagcatcttcttctaatataagtctagataacatggactccaaataacaggtgaaatgttcagacagcacacaaatgaaaagaaagatctggccaagagataaataaaacgaaagctaaatctcttcccttccccacttgaataattcagtcctaaagctgtgagatgggacaaagcaaagacatctgatatggtttggctgtgtccccacccaaatctcatcttgaattgtagttcccataatccccatatgtcatgggagggaccaggtggagataattgaatcatgggggccagtttcctccatcctgttctcatgatagtgagttagttctcacgagatctggtggttttataaggggcttccctcttcactgggctctcattcttctccttcttgytgccatgtgaagaaagacgtgtttgcttccccttctcccatgattgtaaatttcctaaggcctccccagccatgctgaactgtgagtcaactaaacctctttcctttataaaatacccaatctcaggtatgtttttattagcagtgtgagaacagactaatacagcatccatacctgtcaggcaagagggagtgtgaaccattgtagcccaggccggggtgtcagggggagccacactgatgggctgcctggcatgggcagctggagcttaggtatctgtacagggatggagctggcacagggtgtcagagctctgcrcaggatgagcagacacccatgtagggtattggagcccaagcagaggaaggcggacagccacacagagaaggttcagcccaggaaaggaagtcagagcccaagtagggtgaggagggaggggtcagcagaaatgaaaccttggttccagatgggtgactgatcgaatacgttaatacgtcaaggacaatagaaggcaggtgtctcactgtsagagaagagggttagaactatggatagagcaaaaattataatatacccaatggtgttaaatttgaattggatgtatcagtgtgagcttatggttttcaatatgtagagatatggaagaaaatagtgtgtgagtggggcatgtttgagtacatgtgtgtttgcacatacatttcttagctctttctactgagaaggcttcagagcagtgattcttcaatagtaatgagcacatctagcaccagatattggttcctaaataacattttccactaaaatggaccagggctccttgaagaaatggctaatcccaagcctggggcagagaaagtagaagacaagccaggaatatcttatggcagaaactaaggaaatgcccaaggcatgatggagacatgtcaaagggacatagaatctggcttggaggggttctcattgaccatattggggataatttgagaatcaaagttgtttaaaatagtaacaaatggtggtgacctattgaatcaaacagaacactatgtatatccacgcagacattaaataattacaagtttttataaggaaggggatatttacataacttcaaactaccccttcccccaccccactccacacacaataataacaaagggaaaaagaagtggagaagactggaagacacgcccacctcatcaataatgggacaaattgaaatcatactccaggtgagaggatgcagtgagaagaagccagcatcacttccatgattatccagttgcagaagacargctgaacataatcaggaggaaacaccaggcaaacctaacttgagggacggactgtcaactccctggcaggcagtcttcaaaaatataaaagttctgaaggtcaagtaaagacactggaaccattccagactaaaggagaccaaagagacatgacaatgaaatgcaacatgtgattytgaactggatcaataaattatcaaggaatttatcggaaaaacaggtgaaacttgaatgagatgtgaagattcgatggcagtaatgtgtcagtgttaatttcccaatgttgatggttgttttgtggttatgtgagagaatgtgctagtttgtaggaaatacactaagatattctggggttacagggcaacatgttggcgacttacttgcaaacggttcatggaaaaagatttttgtactatacttccaacttctcctakacctttgtggctgctccaaattaaaacttttatttccaagggaagctagatactaaaaaatagcaagactgaaaagaaacaaaatagcgtaattttcatcatcacaagaatcagcgagagcagaagcaacactgtagaaaaacaatgcaaagatgaggaggacaaacctgaaaatctcaacccaaatagggagaagggcagaggcgtgaaaatggtagagagaagatagaagataagaaataaggagacccagtggacaaagagccaagacactgataacaagcattcaggaagaaaggaaccaaatggaaatgataaaacttttctgagatgaaagaaaacctgtgtatataaaggagctctctggataccaagagaaataaaaaagaggctggcaattttttcaacttgtaagggtgaggagtaggggaaatctacaagaatccaggctgagaaagttaccttaaatgaaccaaaatcagacaattctcaggctaatttttgacgttagattacagaaaatgaaggaggtgatgtttaaggaggagaaaaagttaggggcttcatgtgtgaatgcaagaaattgttatttgcagggattcaagaatttacaattattgccactctatctcaagcggggctgtaactccaggtggctgtaactccggatgaactccagatgaaccagtaactcaaaatagagaagatgtatgaaagaaaagataaaaatggagtgttgatactagttaagcacagacttaaagctaaataataatggaacatatggattcaaagcagtgcaaatacaataattcttaaaagactacaaataattattttatattaataaatgtgcaagaaggtggaaaagggataagagaatgtccttatcttttgtgacggtggaatcaatatatattatccaattgttgactttgatcactagagaaataaggattttgaacatatactttagtcactaatatatttaaaataaagtatagtacttctaaatcactaaaagaaaaaacatgtaaaacataatycaaatataaaaggcagagaacaaaggaaactatgtagggacaaagatacagcaagcacaaaataagatacagcagtagaataaaatcattcaattgtaatgaaaaatgcaaatttactaaaattcaatttcctgttaaaaaacaaagactcttaatgatctggtttggctgtatctccacccaaatctcatcttgaattgtaactcccacaattcccatgttgtgggaagaacctgaattatgggggtgggtctttcctgtgctagtctcatgatagtcagtaagtctcacaagatctgatggttttaaaaaatgggagtttccctgcacaagctctgtcttgtcttgtctgccaccatgtgagacatgcctttcaacttccaccatgattatgaggcctccccagccacgtggaattgtaagtccaataaacctctttcttttgtaaattgcccagtctcaggtttgtttttatcagcagcatgaaaatggactaatatatttagattaacctaaataacattcaactatattttctataccaggaacataactaagacaatgtgacacagtttaaagataaaagggtggccagagattatattgggcaaacataaacaacaacagtaacaatcaaagaaaaatgcagaattcataatgtcttcaaggttccatgttatagcatgtgtcagagtttccttcctttttaaggctgaataacattccacacatgtggtatatatttattaataacgttagtacagaccacattttgtttatctgttcatccctctatggacatttgtgtggcttctaccttttagcttttgtgaataatgctgctaagatcatgagtgtacacatatgtcatgataattttttttttttttttgagacagagtcttgctctgttgcccaggctggagtgcagtggcgtgatcttggttcactgcaagctccgcctcccaggttggcaccattctcctgcctcagcctcccgagtagctgggactacaggcacccaccacctcgcccagctaattttttgtacattcagtagagacggggtttcaccgtgttagccaggatggtctcgatmtcctgaccttgtgatccgcccacctcggcctccaaaactgctgggattataggtgtgagccaccgcgcccggccgtcatgataatttttaaagtgattatccaattaggaaggttgcagaaagatgcccacttagtgataggtagtttgagaattgcagatccaaaaccttaacacaatatgattagctacacattccaatcactttgtggtgcctgtgccactcataatgttctctttaactgctcctcagggcacttggcagctgtttgtacattgtgacacccctccacgcacacatctgccccccagccacagaagcttggaccagaggtggacacctgagctgactgcagcaggggcaatcagatgttctctcttgggaagttgaaataggacccaagagattctacttttgcctggacccatctcctgaaaagataaaaatccaagtgcaatggattgctgctcttctactttccatgtggaccaaaaagtagaacaatcctatgtgcagaaagagaatgattgagaagtggaaaaatttccttggtttctgatggcccttcagttcctcgtcctctacctttgtgaagtctggctgcaaacccacccttgggttctctcttctctgagaggcttttttgcttattctagcctgaattgatttatttacatccaaaggttcccaaggaatacaacaacctaggacccagcaatcctacttctgggaattatgcaaagatatgtgcatgaagatattgcttgatatgttataacagggaaattagaaataatctaaatgtaaaaatagtaagagattaggtattataaatttaaagtgtatactcagagagagagagatagggaaagatacagtcattacaaakcattcatgtatgaacctgggcaacatagtgagactctgcctctaccaaaaaaaaaaaaaaattagctgggtgtggtggtgcatgcctgtagtcccagatactcagaaggttaatgtgggaggatcagttgagcccaagagtttgaggttacagtgagagctatgattgtggtactgcactccagcctgggtgacagaatgagaacctgtctctaaaaagaaaataaaaagaatcactcatgtagaatacaattcactgatttaggaaaatgtttattttatattgttcagtgcaaaaaaagcaggtgattttaaaaactcaggtgatggtatcacaagaaaatgcagtgattatggactcccaccctagaccacactcaccactccttgtgatgttctgaaaaagagatacagacaagaaacaaaggcaaaggaaggcatttcaatattagctgggcatggaccccagattcaaaagcagagcctgagtcctttggtaagctcaaatgaaccaygtgagctcacatttttttctaagctaatttggttttaaaggctgcaaatgaggccgagcatggtggctcacgcctataatcccagcactttgggaggccaaggtgggcggatcacctgaggttggcagttctagaccagcctgaccaacatggagaaaccccgtctctattaaaaatacaaaattagccagacgtggtggcgcatgcctgtaatcccagctactcgggagggtgaggcaggagaatcacttgaaaccaggaggtggaggttgccatgagccgagatcgcaccattgtgatccagcctgggcaacaagagcaaaactccatctcaaaaaaaaaaaaaaaaaaaaaaaagataawtaaaagcttcaaatgaaaggccaattcagcacacccagcagcttgaggaataacattcccaggaagacgacagggaccattgctcacaatggctgctgctgagccaactgctgcttaacattaataaagcaattgcccccaccgttcacgagttaacatgttcacacacaccagaatctggctatgctctctcaacacctcaccctcttcccctcaggggaagaagaagggtattcacaaaatgaaatggaagagtctgccttgaatgtcccctgccctagagttctgtagcaataacatggtggatacagtgggataccatcaatgtggtaagagtatatgtgtgtgtgtgtgtgtgtgtgtgtgtgtgtgtgtgtgtgtgtgatgggaaatagggagggcgtgtctgtaaaagacccaagatcctacagcaaaatcttcacaatgcttatgcctagatggtgagatttgggaaatttttgttttgttgctttttagtatcccatgagcttcccgcattaaacagaaatttgtaattttatggccaggcacagtgactcacacctgtaatcccagcactttgggaggtcaaggtgggaggatcacttgagcccmggagtttgagaccagcctgagcaatatcttgaaacccgatctctacaaaaaaaaaaaaaaaaaaaaaattttaattagccaggtgtggtggcatgagtctgtagtcccagctacttgggaggcagaggtgagaggatagcttaagcccaggaggtcaaggctgcagtgaaccatgattgtgccactgtactccagtctgggtgacagagcaagaccctgaaaaaaaaaaacctagttttaaaatgtaatggaaaatcaccccaatcaaaacagtaatcacaaaatataaagtacccaggctgtatttaagtggggatttgtttttattcatttttttttcctggaaaagtttagtatgccttagaagttttgaagataagtatgacactgagaatggaaggcaccaatttttttaacttattaagaaaaattataattggctacataaaaacttaatacttctacaaatcaaaagtgccataaataaaactaagcaaatgataaactgggaaaatataattaacggctaaggtcaaccttgaatattcagagttcttcaaatttataagaaaaataggggcaaagaaagtctttcatagctagaccttctttctgcctagagttttataatgtgtcaagctgcggggtttcaccgtgcactggatgtggatggtacagtatgcaatgcacagaggcactgttttgtcacgccatattgttgggtgatcatgaagtgatgttttaagtatttaaacttctaacatattggttcatcacaactcttttaatagacagttaaaaagagaaatgcaaataggccattaacgtgaaaaatgcttagcctaattagttatcaaatgccaattaaaataaaataaatgctgcttttttgtttagcaagttaacaaagattaaaacagacgactatctctcccagtggggcctaagttctgtgagggcaagggatgtatttgttttggttgttcttgtaacctcatcacctgacacagtgcctgacccagggtgagccctccatagacaatcattacatgaactgggtgaaagaagaatgatggcacccagtgctggaggaacagtcrctctgttgacagtatcaatgggaaccattttcctggagggcaaagtggaagcatgcagcaagtgtggacrtggccttcccaggcttatgttaaatcaaaggtaaacccacttggttacctcaagagtgcctcttagttttaacacccacatttcatagagcttacgtatctctcagtacgatacatttcagcgagtgcgtctatagaaaacrtttacagttagatcccccaaaacatagtacaccattttcaataaatctatatgcagggaaagtctcaagctgcattccaactacagttggtaaaatgtcagaatcccatgcggacttttggaaaggggctccaattccatggcggggatgtgtgtctcagaggctgctggctctgaggtgtcactccatgctgttcattgtaaactgtactctaccacctagtgccagtcctgaatgcattcccactgagtctttcatagctagaccttctttctgcctagagttttataatgtctcaagctgcaagatttcatggcgcactggatgtggatggtacagtatgcaatgcacagaggcgctgttttgtcacaccatgttgttgggtgatcgtgatgttttaagtatttaacttctctaacayaatggtttgttgcatatatttaggtattttattttgtcttaattactttttggattttgggttgaagtacaacacagtataattttttcccacttaaaataatgggatataggctcctagttaatatctttacacagaacatttgatttccaggaaaggattactgacattcagcaggagatatctgtactttcaaaagggtcatgtacttgaatcttcctagttaaaaaagaaaaagaaaaaaaacgtaaaagatgcrtatataaaaaaagatttcattgcagctttattttaaattgcaaaactttggaaacctaaatggttaacagagtatctgttaaatacattctagtaaatctgtatgattaaatcctatgaagttatttcaatcatattttctaagaaatgtaattatatgggaaattcttgcaatataataataagtgtgcaaggatcaacacaagctatataacatataatgcaagttgtataaaacaaaaatatttatatttgcagagaataaacactccaggaacgtactrtaattggttaacagtcgttatctctgagagggcaatggataagtttgatttcttcctactgttccatagaatacctcaaattttctttaatgataatgtactatatttgtatttattaaagaacacttttttaatatagcaaggattggggtgattggaaatagtaacgataacagcagcagtggcagcaggagcagctaacacttgtatagcacttgactctgtgttagtaataaaagccaggttatgagcccacactgaacttagcctcagtaaatagcatcctgcctctagcatcatccagtctctgcccatagggatgaattccagcctagaaaatttgtgaatccagaagtatctggtcaaagatcagaagggtcagcttgtcagctgacttcagtaggtactcgcaaaagccacatgcagcatgtagatgctcagtggtgggaagaatacagggtttgggaacagccagacctgcattcaaatcctacctgtgccacctaattcctgtgtgaccttgaggaacttacttcacctttctgaatctcacttgctcacgagtagagtaagagcacctcacagcatggtcagatgttgtgagggttagagtggcagcctataaaacgcctaatatccacgaggcactcagaaaacgctcctctcccacccttcagtgctggtgatggtgtcactgactccttagattgcccctcttttgttattattaatttcaataaggatgacagaagataagcaaaaaggacttggctaaacttgccctgtttacagataagtactcatgaatatctgtgtgtgaataaatgagggatgagaaagtgaagaattgaacaaatgaatgacggtgtacctggagaatgatgatcttaccctgacttgcctgcttttatcttttcagcttatccactcaccaaatgccctcctcccaccatcctccccaacgccgaagtcgtcacagagaatgaagaattcaatataggtaccacctcccaagccagcaaggactgtgaacccaggactggggaaggaagggaaggtggcggggggagctgtcgggccagcggaccttatcccctgctcctgtctgtggagagagaaacagtaggccctgtgccagagggttctgcccactgagtttacacccaaaataaaatcaaaaggggaggcagaaaaatagttttctttttttggttcaagtcagcatctttttgagaaataaatccatgcaagacagtataaaatgtcctggaatatgaaacattcygaggctcacacaaggctgagttgtgagaggggagcagtcgtctgggccatttgatgggagctgagctagttatttaagtctgarcagaacatgacccrcctctgattatctcacctggaagtgggttcaargtactaatgactggacttcttaagagggtctacatgttggtctttctttgacaggtgacatcgtacgctacagatgcctccctggctttaccttagtggggaatgaaattctgacctgcaaacttggaacctacctgcagtttgaaggaccacccccgatatgtgaaggtaattgcatggagccgcatctgtatggggcctagaagttcctcctgaacaaagctcttgttttgctcctctttctattcccagttctcagctcagtcactgccccataacatgaaaggtcacttggtaaatgttgtctgatggatgagtaagtgcatgaggaatgagtgagtgatcactctagataggttctctgccctgttctgatatctgaacctgtgaattggccacagtggccacatttattttcatctgcctttttttcattcctgggaatttcttggaattgcatactgagtactggaaggaggaagtccctccctggtgtgggcgtgggctcacacaccatccctgctttactgatgcgcggatgcactcaaggtgctgtgtgccaaaccaggcaactgagagaccacagcagtctttattccagtgtacmatgccttgacagaaatgaattcgcttcagcgagtcaccccaattaagatcaaaaaatagtctccactcatcaggcatctgacctaagtaaggcaaggtacctgattgtcctgccctcagccttcccttctataaactgaggataatgatagtacttatgccatggcggtattaaatgggttaataacataaaccagtttagaatgatgcctggcatgcagtaattgctccatrtttgtgttaatattatcattagtgcgactactgtttctagaactactgctacctgcaaatattcagtagcctatggggaaacaggycagcctttcccccacttctgggaaagcaagagtaggaagaacctgcaatatggactgtcagtaaggaatagcagacctggtagaggcaggagaggaccacgaggcctragagaacttaagtatcaccacatctcagtgccctgtgctggtcatcggattagtgaaatcaggaacatgtcaaagctaagcgagtttcctcttagaagacattagttttccttctcctcttaaaattaaaaaggaagctctattgggaaaagtcagtgagtacctttcaaagctactcaggcagaatcctggatgcgtcctgtgaaattctgggccacagcaagactctaggagcccagcccccgtgctgattaccaagccccacttctctgaaggcagaggtgagatgggtgaacagcccatggcaaagtcttgtacccaaaatagcattacctgaaattgtaatcctgggattaatttttggtcttgcagttccmgttccagaacctcccttttascagtgtcccagaatccagcagacccaggaagcctgtctaaaggcacatctactgcaaaacactgatttctccgtgtgcagtgataagaatacttacaactattgtcaatgcacacctttgtactgaaagaacaatgtactgaagaagttgatttagtcctcagaactttgctttggcgtccgcaacccaaacaaatggaggtggatggtcctgaaattgctttcatgctgtgatgcttgcctgtgccccaggacacagcatctcctcagtgctggggaagggcctctctgaaccagcagcttccctcccactcatggtgatgacgaaataacgaatcctgctcctccagctcctccttttctaagttccaagctcaatgtcttccttagaatgacatttttttctttagctatataaatagtactaattaagccacagccaagttctgagacytttctgttcaagatgcagttttcatcattccctctacaatttattgaagcactatgttgcatgctttacatatattatttcataatatatatatatacatatatgtatatagatatatttttttttgagatggagtctcactctgtcgccaggctggagggcagtggtgcaatctcagctcactgcaacctccgcctcctgggaagcaattctcctgcctcagcctcctgagtagctgggactacaggcacatgccaccacacccagctaatttttgtatttttagtagaaatggggcttcaccatgttggccaggatggtcttgagttcttgacctcatgattcacccgccccggcctcccacagcgctgggattacaggcatgagcctccgcacccagcatgtaatattttatataatgctcacaacagccctgtaaggtctgtgttatctctgtgttggagatagagaagccatcacacagagaggagataacttgttcaagaccacaccattagtaagtggcagaggtgggctatgaatccaggtgtatttgactcaaaatcccatgtacttacctctgccctatacagtacaatctttgttcaaataaaacccattttatagattatctcctttggatctggggaagccttactgttgtctgtatgtatgttccatcctcccctactcaaagccaggtagtagaacccacaacttatctaggaagtgattccaaccaactggcaaagctcaagtcccagaaatactgcaatattgacacaggatctaagcccacctcatgtcatggagcagcacagtgatggatgtgggatcttatctgaatgtgctcaaatactgattttctaggggttgtctttagtattgggaaaagcaaatgtattggccgtagttccatctccacccccacgtacttggtgtttctctttctttctccaagtgcactgtccaacaaatgagcttctgacagactccacaggcgtgatcctgagccagagctaccctggaagctatccccagttccagacctgctcttggctggtgagagtggagcccgactataacatctccctcacagtggagtacttcctcagcgagaagcaatatgatgagtttgagatttttgatggtaagtcagtcaaatgcctcacagttctctgctgcagaagacatggacttgctccagaacccgaggagtctgtgctgcagttttcctatcagggcttgccagaagctccacaggatgtccttccctaccacagcaaccccaaggccatgggacctgaggggtggcatggcccaagcagcagagctgcttgtactgcaacttgaacctgttaccgaaccttttcttactctagctcccactcaaagccattcctgttcatgtcagcagataaatgggtcaaacagtattcccaagtgaagagtgtgcttcctccaaaacccagagatctaccaaacattgtgctgcctctttggctttaagagggaaaatgtgcaataatttgctctttaatttggagggcatgtctcagcatgcttcagaccactggaccctaaaaattcatagcagaactttgtaggatttacctcttaccctctggagcacatgcatcttgaaaagkcatcttgccaaagcactaattgtcccttctcactcatcaggtctaattaatatgatgtcctcaatagagtgaaccaatatgttatattctgcaagatgtccagatggtccacatccctttatactcggttatgacagagagcaggagaagtaacatagctctgggggaaaccatgaatgtatactgttgtctacctcatgtgaatgcaaagtgcttctgatcctcatttctgaagggtatggaaaagactacatggccagatcaacagctacattctatgtaaccaaggctgtgttaatctgttctaataaagatatgcgcctcacacagctgctacaattgaggctcctactttgttaagtgtgtactgtgagacggacctgggccaggactccatttattcccaaaaccacccttcatacaccactcctctggcagagtagctatgatagtgctttggayccccagtcatcarcatcaattaacatcctgtatccagaagtctttgatatatctgaacattccattttctataatattctgttttctgagtaaacagtagtaggtcttttgggggaagaacggtaggaacaactactatatacaattattgtcattgtgcggggtcttttttcatagggacccagcctcttgggaaatgaaacctggctcaagtctgcaaactgggcaaaggattgcacctttctgctgggggcagcttttctcatcctgcagttagctactaatgatctrttttgttcatatagttatacttgttttggctgctcttcttggcttcctatttaccttgcccttaggaacatcatgctctatgagccatcttcgtagatcccgtaggccaggctctcccagctgccattccagccttgcttcccattttagtaattatgccaactttgcttctgactgttaagtaattccacctggcctctgtgttctaggaccttctcatccccattactgctagggagcccagtgtctctccccatcagttttgacccacagaggatagccattagttactcaggttttcagcaatgctggtgctcacccgctccaggaaggctggagctcctcacctcctgattgctttagtaaatggagtgtcctccaggtcttcctgagaactrtggtcaacttttacacagcagacctagcccagcatgccacttctcccagcctttcccttcacagtttgcatggcagttctggtgactctactttgtttaatatgatccattaatttttccaagcttctaagagctgtctcagtggcatagtagagccatcattcagggccttttcmagagtgataaatcctgtgttatgggttatccagctttatattctgcgccccttcaaccagccccctcgggatgcaatytcagacatttaaggtaggacaaaagaagagggaggtytttytcaaagagctttcaaaagcagtattagggagctctgttacttatgaccccgagacatgacattttcctctagctttattgctatgtattcattccawaaatatttttttctatatggcaggcactgagctttttttcttttctttttttttttttttttttttttttgagactgagtctttctctgtcacccaggctggagcacagtggtgcgatcttggctcaccacctcctgggttcaagcgattctcgtgccttagcctccccagtagctgggactacaggcatgcaccaccatgaccagataawttttgtatttttttttttttttttttttttttttagtaaagatggggtcttgcttgccaagctggtctcaaactcctgggctcaagtgatccacctgcctcaccttcccaaaatgctgggattacagacatgagcttaaatacacacaagagaagtagggtggccaagtggaagaagttcccagtttgaaaaccagctcttccattaaccagctacttgaccttgtcaagtctcaaaatgcaaatcaatttcatcttacctgccagcccctagaggtaggcagggacttcctagagcactgctttagagctgggcttaggagaaaagagcaccttgagcaatkcctgtggatgcagagagaggagtgcaagtacaaatgattttgctgactctgaacaagtcaccccaccctctgagccctgaggtcttccctggaggctccctgtgatggctcccatggtctgtaatcctgcgtccttctcaccccaggtccatcaggacagagtcctctgctgaaagccctcagtgggaattactcagctcccctgattgtcaccagctcaagcaactctgtgtacctgcgttggtcatctgatcacgcctacaatcggaagggcttcaagatccgctattcaggtgagtgaaaaaaacacaaataagccacaggccctctcctcatcgaagcctcaagctcctctgtggagaccgggcggccattcccctcctaaatctgcctcacctgaagctaagtggtctttgccattcccctacctcctatttttctattccattcccctcttgaacctcttccctcttttctcatactgccagcctttgtcttcaggataagtttaacaattttatatgatctgataatgcctaacagtgatcctgtccctttaggaaagttaggaaatgctaayaaaagtttcttaaaactaaaaagccctaaggyatagatctctgactggcagatgttaagcatgcagcaaaggatgggctatatttcaaggccaggtgcctttcttctgctctgcaagccatatcttataaacagagtcagatcaaaaggccaaagactgacccaggcaacaatctataaggactgaaaaaaataatcctgggaatataatgagatggagaaaattgaatttatctgatctctcgtcatggggattactgtctgtggttggaagaaaacttcacaaggtgcttgatgcccactttgaagagaggtgggttcagtgaactgctgactgggctccgcaagcttggaggcagaaatgaattacttaagaccatggggggttccatcacacaccagttccctttcagcactctttcccctggctacctttggcctacattccaggcaaacaatgaacaaatttctaaagaatattggttgggggctaggtgcagtggctcacgcctgtaatctcagcactttgggatgccaaggcgggcagatcacctgaggtcaggagtttgagaccagcctgaccaacatagtgaaaccccatctctactaaaaatacaaaaattagccaggcatgrtggcatgcacctgtaatttcagctacttgggaggctgaggcaggagaatcacttgaacctgggaggtggaggttgcagtgagccgagatcacgctactgcactccagcctgggcaacaagagtgaaactctgtctcaaaaaaaaaaaaaattaaaaaaaaagaatcttggttggaaggaatgtcaaattcagtgcctgaagtcccacttgccacagtccatctcttctcatgggtctcctacttgcaagaccagcccatactcagtgggtggacagtcttaaagaatccctgggtgtagctttcaggggagagccaaccagaggaagctgagggcccctgggagaaggtgggtcttgactgtctcagagcccatatcctctgcaaagtccatccaacctctcctttccctggtgcacacggagaggggtctgggtggctgcaatgactgagtgccccaatgtcagtsaccagctctctcacctactagctgtgggattattaggcaaggtacttaaccacttcagscttcagtgtccgcatgatggaaaagaaactttaaggtgcctcttagggctgagttcctggcagctgctcactcaaacaggaaatatagcagtttggtagcatttcactatgctggttgctaaattaggaactgaacgttattaaggagttaccctttccttgatgttctaacgtgtttggggataatgagtcagttgtaattacaatacatatgccacgtagaaagtgagttaattacatggcgcaacaattagtacttaataattcagatcgagtagatgagtgtaatytgcacctgcgtctgtcactgtgactaagtatattttacaaccgagattcttgttcctgagggaggtaaccatgtggatacagcacacatargacacagcgggcaaagcaggagtagggaaacaaattcggcttggaaggcagctatttaaaacaaccatttcaccggcagasggatatgatcaccaagaaagaggccggggacctcaccaggggtggctgtaagggccccacacgcgcatcctgccttatccatctctgcctggaagaccccaccagggactcctagggcaaacaaagagaattatctgcstgctcctttggtcatccctctttcstggcctcacagaactccccctgaggatccstggcaggctttataatgtgagtcctttcaggctgggattttttgttytgttttttttgtttgcttgttttttgagacagagtctcactctgtcacccacgctggagtgcaatggcrtgagctcatctccctgcagcctccacctcctgggttcaagtgattctcctgccttagcctcccgagtagctgggactacgggcacgcaccaccacgcctggccaatttttatattgttagtagagatgaggtttcaccattttggccaggttggtcttgaactcctggcctcaagtgatccactggcctcagcctcacaaagtgctgggattactggcgtgagcccaggccagggttttggtctgttktcttcactgttgtattgcaagcacttagaacaatatctggaagataatagatacttgatgtctatttgttgaataaatgaatgaaataagttgaagccatatgtggaggggaaatgagcactgtagggaaatgtgtgtcccaggttgccacaggtcagtctcagcacattcccccacacagcacaaagaaggacaatgaccacttactgagcattgaacagtgagtgccccatgctgtgctgggggctttatgtacgcaatctacatatacagcttaaattgcccaaaaatctgtgaggtgggtattaccagtcccaatttacaggcgaggaaattggagctgaagtgatttgccccaagttacagaaactggtcagatcagaaacgggactggagcccagccctcactaaggtcaaagtccacacccccgcagtcgcagctttctggaaccaaccccattgggttctactttctaagtctgtttcggagctgaagggatttgagagcctgaacttagccatacaccagatctacctttggaccgcaaaagggacccagtgcttcatgaagctggttttttttgttttgttttgttttktttccgttgttttgtttcggctttaccaacctgactgggtgtttttcaatatccaccattcagactttcctcaacagcagaggatgtggcagtggcaaagacaaggggatggggggagacgaaagggaaaggggcctgcmtgaaagaccatgtctgtcttcctgctggtgccagttccctgaacctcatcttgttgttcagccccttactgcagcctgcccagggctccactccatggcttcatcctaggccagaccagcacccagcccgggggctccatccactttggctgcaacgccggctaccgcctggtgggacacagcatggccatctgtacccggcacccccagggctaccacctgtggagcgaagccatccctctctgtcaaggtgagaagcaggtggaaagggggtcacaaggtagctcrgatccaactcatatcttgggtttktcccaggactagtcacttccaaaygtgggtttcctctttgataattatttcattctttccacaagcatttacaagatctgtagtgcrtagcaatctcagtgttttgagatccatgggggagatgggtatgtgagcacatcaatgcaaagtggcagaggaaggaagtgtcgtgtcaggagcataatcagtgttgtgggagyccagaggtgagaaaggatctgcttcctcctggccagctggggagggctcccagcagaggggatgcttgggttcyggctcatagagcaagtgggttgatcaaacacttgaaatgtgtcagtcaatttgcatgcattaccttttatgatttatgattttatgatttatgacagttttttcccttcaagtaatatacattcaaactaaaaatctgaagaagaaaaaaaaaaacggtagataatgcaaaagaaaaaaagtgaaaatgaacaataaacctgagatcaccactgttaacatttcagcacatttcctttggtcttttatgtattgattataaaaataggatcatccgtgtacaaagctcttatagattttgtttcccataatgctgtgcaaccactgaaaatcatggkgaggaagtatatttaactatatactattttttgagacagagtctccctctgtcgcccaggctggagtccagtggcatgatctcagctcactgcaacctctgcctcctgggttcaagcaattctcctgtctcagcctcccgagtagctgggattacagtcacccgccaccatgcctggctaatttttgtacttttagtagagacagggtttcaccatattggtccggctggtctcaaactgctgacctcaggtgatccgcccacctcggtctcccagagtgctgtgattacaggtgtgagccaccgcgcctggmctctattgttaatattatacttcstcaccattattttcaatagttgcacagcattatgagaaaattgtcattcatttaagtatcattctcttsttggtcatttggatttctatattctttgtgacgataaacttataattccatctttatgaatattacatatttccttaaggcaaattctcagaaatgagattctcgcatcataacgtatgcgattgacagctgtcgatactgattgcctcccagaaagtttgtcctcatgtatagcagcatgtgagaactgtcttttctcccacagtctcaacgttaggcactgcatttaaaaaaagaagaaaacattgccaactacatagacaaaaacaggaaatcacattgctatttgatttttcctttggttcccagtagtggtgaagtactttttaatgacatctctcatctctaatcctcacaaccttctcgcctgtgcctgtgctttctcaaagaacaaaaacaatgtgctattaataatctactctacccctaagcaaaggtcacagtgaactggctgtccacaaatggcaaatggcatttggctttggtctctgcgtctctaactgcattaacaaggacaagtcttttttccggagcgccagttggaacctactaagcctctcatttctgttaccttacatcaccacccaaaattaagcctccaccagacttcagttgacccatccccatactactgtgcatgtcttctccccactgcaccccttgcctcccactgatgcccttcctctaagcctcccactgygttctctggaatcctagttccgtggccagcaagcgtacaccctcagtccctaccyagctggctgtcttcacttcctccctccatggagaccatggctgtcctctgagagcacgtatgctgtggccctttcaagtggattgttaatccccctccacccacctcctacttcccacagaattctgggccaggaagggcctggcattattccacttctctactgctgtttccaaaccatgacttttccactcttcctttagagactctatgcctcctaatgccttctctctccttccccagcccactctctcacctgtgtctctctccctcagagatctcattccaccacaagcctcaaatactttgtgattgtatcccctccycctcctacccacaggaagtgtccctcttaccaccgggttttggggactgcattttggcatggagatcatgagacacaggcttttagtatctcaggctggagtattatcttctgtccccttagttatctacaagagcaaggccaggccagggcctgtgagaagtggctgccrcccacttccttcactgccctccctggattgrctctccatgcaagacaccagtggagatccaagtatttcttcccaaaggattyaaggaagctgggcaggtagttgatgtaatatgacagcttagctaacctagttccactgaaggagctcatagcctttctgattagtcattaagagtctcatgtttaaacactctcttatttctcattccttctgtgttcctgatcctcctcttctggaaagtcccacacttagatccttcttccatcttggtattccaacttctctccctctgaacagtctaccctcctccattcataatggagccccagcctgatgcctcttattggttctggaaattcttatagcatcaagcatcttgttaggcaatctcaatgggactctgcccaagcttattctggctctaagcgaaaaagttctgagctctagactagtagccagaggggatagtggatggaggcagtagtgggtactttgacggattaatctttccatctgtaataccccctgagctgtcaaagrgcaaggatgatttataagtattactttctttcaaagaccaaacagtctactcttgcctaagtaattcctattcctcctataaacataatgtcgaccctactccttataaaataataatcctggccatgttgctgcaaacatttctctcctgagttgtccctttgagattccttttcttygtattcttgagttagttctgtcatttttcatatctcatatmttgtcctttcctggttttcaccctctttttcatggggtatatcyttaagtaaattcctcagaaagggttcacaagaggtgcattttctgagactttacatgtctgaaagtgtctatctttttgccctcacacatgyttggtcagttgactgggtaaaattctagtttataaatcattttcttcagaggtttaaagctttgttccattatctttgaacactcactgctgatgggaagtcttatgccagtttgattctcgttccttcacagttatgtcatttttttttycctctttctagtaatttggaggaatgcctgtgtgtctctggacttcttagatacacaaaattccgtgatggtgaatctaagagkgattctctttgcattcctttggctccctttccatctgaagacttgygtctctcttcagctctgagaaattttcatctatgataattccatcccatccactttttgygttctctctttttggagctctgaacagttggatgctggaccttctgtattgrggattgatccgtgttttctgtcattttctctcattttcggtctcttttttttctatattctgagaaatttacttttcatctctaatcctataatgcttatttcggcaatcatatttttcatttcaaagagtttgtccttgttttttttttgtttgtttktttttccttcagagcacactgattttattttatgagtaccgtatgtcaccttgactttctcaagatactactgatcagaagtttaaagattgtgtatcttctgttttctaaattagctctgtttcctaaggggacatttattttaaactttatcttggtttgtcttgttcgcactgctgattttcttcacatgtataatgatccttgatcgtattttaaaagtaagggccaggttgatttttccagctatgagatgtggattacgtttgttatttttatatacagatatcttggtccacaaagtctctcctatcagtgagaggttgagttgagtatgtggcagacctgagtaggcaatggggcagcctttaggccaagagaccataaatcctagaattaaaagagctttcctctgggatgccaactcccaccataacagccctaattcwtcctaagagagwtccccctcagtggaaaagaaaattctctctttygtttggagagtagatacttgaatgtgtctacactgtgtttgtgggaacagatggcggagaactggtttcaccctgaggctccctcccatatattttgagctacagcttctttgcacttctatctttattccttcttccaaacttaaaaaaaraagaagaaaaaactcttctgctgatgatcctcccattttcttttttattatgakactttaccctttaattagtttttactaataaaaggaccttgggaggggaggaaggataaaaatagtttctcagaataccatcytaaaacaaatgctcatgacattgttttccttttgctagctctttcctgtgggcttcctgaggcccccaagaatggaatggtgtttggcaaggagtacacagtgggaaccaaggccrtgtacagctgcagtgaaggctaccacctccaggcaggcgctgaggccactgcagagtgtctggacacaggcctatggagcaaccgcaatgtcccaccacagtgtgtccgtgagtcctcgggcaatggaggcgggtgtaaggaagggctaggtaggcagctggaaagattcctgcaaggagtgagctaaaagcaaagtaatgagggggraaaaaaaaaaacatggacatggaggttggrggatttcagaagaggaggcaggtgctgaaactgctctcagcattgataaccattgtgccctaagatgtttccacaaaccaccatggaacttaggaatggcctggtccactcccttttagatggaaaacctgtcagaaagtttgcatgaatgtcccttgattccaaagctctaaaaacaacaacttttaggccagatcacaaaatggcaacctcctcgactatgtcccatccaaagacagaggtttttgttttgttttgttttttggcctacacggtgctttataacaaattttgaattactccrcaatcttttaaaatcaagaaattttacattaaaatccagatttctgtcttctcttgaaaaatgaaaatctaatcaaatgcaactcaaacattcaatagtcaaccttgactgagtactatttcccttttttaatttttaattttttagcagaactgtactccccagtttgccacatcccccacccaacccacctgttcatttaccaaacctgcctgagaactgaagattcctggattcttcattattgcattaaggtctccaagtccctagatctgggctcttacaaggtcttccagaattaatcaagtaattaatcctyctttcttttcctcatttccccagctgtgacttgtcctgatgtcagtagcatcagcgtggagcatggccgatggaggcttatctttgagacacagtatcagttccaggcccagctgatgctcatctgtgaccctggctactactatactggccaaagggtcatccgctgtcaggccaatggcaaatggagcctcggggactctacgcccacctgccgaagtaagcccaggaagggagggtgggcaagtttagcagggtccctcctacctaagctgtctcatgcatggagtgaactggggtgggggaaaaaggggtatcaccagggattgcagtgtactgctttttaaactctcatctagtagaatcaggagctgggaaaatgcctactcctttactcctttaaggaagtatttcttagcatcttctcatcttatcaaaagctgcttttgtccagatgagcatgcactaattcatttctttaatattcttaggctcttactatatgccagacactgtagaggtttgaagataaaagattttggttcctgcccacaaggactttatagtctactggagaggcagacacataaagaagtgatgataatgtggtgcgataagacctgaaatgggagtgtatataggaggaatgagggtagcacaggcgacaggtcacctaaacctgcctgccttctccattgtcaattgtttttctttggttctttaatacactttcaaaggtcggaatctctgggaagacactctgagacagaggcttattagggggtgctcttgagaacaccacctacagaagggaaaggagggaaggaagcaggactgggcagaaggagaattgagctctgatgcagtatccatgaaagccttagctcaccccccagggagctctggatggcccttcagaattgtcacaagttggagcaagggaactgttatactgccacactgaccagccactggatgcaggctggcctaggaatgggacatgaccttcctaggtgggaggactcctcaaccacagcaatctgaaaagggctgccagccaagggttgttttccagcagctggggaaataagtccctcggtcctaaaaggggctctgagtagctcatcgcagcatgcactacgatagggatatgctcatcatatttatgtgaccaatgcagatgtcacagaggaggcaagtgattgtaaagaggtagaaggaagtggtcagtgaraagtgggagtttgaaactgggaaggaggagaaatggtgtcttccaatgcctgtgatccaggttgggcatagatcccagcatttgagaggctgaagtgggtggatcacttgaggtcaggagttcgagaccagcctggccgacatggtgaaaccctgtctctactaaaaaaaaaaaaaaaaaattagccagcatggtggtgcccacctgtaatcccagctacttgggaggctgaggcaaaagaattgtttgaacctaggaggcagaggttgcagggagccaagactgtgccactgcactccagcctggacgactgtgcaagactccgtctcaaaaaaaaaaaaaaaaaaagccaatgtccgtgattcatgacactgttgtctttgcacactgtggtgcagactgcacagtgggatgtaaccacatatgtggcagagtagtcccaagcgtttggcagcctcactacaatgcagccactcacatttcagtgcagccttggcgattaggcctcacctcatacatcagccagaggctctcagcagtgctctgttgacaamgagtgtgaggctgctgggctcagaaaagaagggcaaggaaattgawtagcagtgtctgcccagggcactcaggagcataccacagaatcgccatctcttcctaaccacagtgcacatctcagccacctgaggaggattaaaaaaatacacaggccagggcsctatctgcaaagctggtgagtcaggcacctgcagtggagccgggcattttaaataaccttcaggggcttctggagacacctccagttgaggtgccacatcacacaagtcagcaacacaacccatattctggtcaggaattccagcagagtaaggttaaacaggtcttatttttgtcacagttcttgctaagcagaagcagccatgtccctcctcttggggctggcttactgagcatcttgtgatcattttagtcatctcctgtggagagskcccgattccccccartggccaccgcatcggaacactgtctgtctacggggcaacagccatcttctcctgcaattccggatacacactggtgggctccagggtgcgtgagtgcatggccaatgggctctggagtggctctgaagtccgctgccttggtaagtgacctctgcaggcctatcctgcccagtttttctccttgagatagattagatctttccaaagctgagatccagtctttaaacagtatcatttcacctattgacataaaatgcttaatccaaacaccaactattggccatcaggcatgactaaaaccctggaacagcttctcctgggccacccaaaagaaggagaagaacctcagatctaaagagacaagcttttgaggggttctcattctggttagaaagacaatcccttcctattggcctttgtataatgagtgaagccccagtctccatttttggcaaatttgcagaygcattcctgtaacacacctaaaataccttttatattatctattagcaaattttacayacaacatatagatctatacatatatactaagcaaattacagaaacataaaacaacctggcttccaaaggacaaagttatcatttcctccatggctaatccactccctggttctatggttctgtctcctctcacacctttcttggacccctggagtctaaaagagggccccagccacataaacctaataggatagattgaatggtctgycctggggtgaacagtgctgtcttgccactgtctcaggcccattaaggacacagtcacaggttatttccacagagagccaaaggaagctggtagaaatgccaggaatatattctacccaaatcccatataataaaaagaattcacctaggtgctactcaaggagaaggaaggaaagatgaatttagccaaaccatctgtttttacatagttgtttcaacacagccaggttttgactgccttaatgtagacaatggtgccctccatgcagcagatgctcggtgaaaaacaagatgcccaggctaggtgtggtggctcacgcctgtaatcccagcactttgggaagcaaaggcgggtggatcatttgaggccaggagttcgagaccagcctggccaacatggtgaaatccatctctactaaaaatacaaaaattagctgggtatggtggtggatgcctgtagtcccagctacttgggaggctaaggcaggagaatcccttgaacctaggaggtggacattgcagtgagccaagatcgtgccactgcagtccagcctggcagacagagcaagatcttgtctcaaaaaaaaaaaaaaaaaagatgctcctgagtttgagtttttgggggcgtttcttgtttgtttgtttgtttttttatagaaggcttttttgtatctggttggtaagaaaaagtgggggatgatcctggggacagtgaggtaactgatcattttgcacacatctgtgtagagacacagaaactgaagctcagaagtgagtggccatttggggtacaaccttgggatttggggtgccaagtcctcaacactatttttgtcatgctgagggttcctgaagtcactcctagattgctactstcagggagaggtgggaaaagtaatgagttgtgggatagttggtccttttccccaccatccctgtctctagccactcagaccaagctccactccattttctataagctcctcttcgatgtactctcttccccatccctcaccaaagctggacactgtgggactcctgagcccattgtcaacggacacatcaatggggagaactacagctaccggggcagtgtggtgtaccaatgcaatgstggcttccgcctgatcggcatgtctgtgcgcatctgccagcaggatcatcactggtcgggcaagacccctttctgtgtgcgtaagtatgtcatccactctccctagtcatggggctcagattcaacatggactttctccctgtctcttaattagattagctagaggtttgttttaaatatatatatatatatatgattgctattttttttttcaaaactgaaagcattgttgatctaatgttttcagttctctgcatcattaatcactgttttcacctttattatttccttccttgtgatttcttttggtttacatttttgttcattttctagcttttgagtaggaatttaattcatttattttcattctttcatttctattgagttttattgctataagtgcttaagactatgaaatttcctctgatcactgctttaattgtatcctatagagtctaataataaatgtttattatttattagaaattctgtaattttggtattgatttccccttttacatagaaaatttttaatagaaggatttgtttctaggtggaaggcccttttttttcattrtgttattcatttctaattttattgcattgtatgtaatatttctacttcatggaattgactgaagctttctttgtgacctaatagttggtcagttgttatgaatgtcccatgtgcacttgagaagaaaggatattaggatgtcatgttttatttatatattcatgagatatatctgattgattatgttgtctatgtcctttacattcttacttttcacccactcaatctgttttattctgagagatgtgtttaaagttttctattattagtgtgtttctrtttttccttgcacttcctgtagtttctgttctataaagatggttgctgtcttatttggtgcatagatattcataactagtatctccattgcacattgtggtttttagcctttaaagattacttttttgtcacttttaacattttttagctagaattgtactttgcttgatattaggcttacaacccctgctttaattcttttgcctgatgcacctttgaccattctattttagccttctgcttctcttaggtgtgattcttgtatgcagtataaattgccttataagctaacttaaccatctttttcttttagttggttagttaaactcattcacatatattaatatgactgatatgttcggtcttaattttgccgtctcccatttcccccacttctccacccatggtaaccaccattctgctctctgtttctacgtatttgacttttggaattataatattagtttaattctatttttcttataggttatttggttgtttttttttttgaggttccygattatttttccctttatcctaaagtctaatatttttactaggacatgcttcagagttaattattccaagacaatttccttaggtattctatgggtctttgaatatatagattcaggtctttctttatttccaaagacttttcttggattatggttttaaacactgatattgctttgtttcccactgttttttttttcttcttcatcagctctgattatgtgtatgttgaatcttctttgcctatcttctctctcagcctctctctcattattttcacctctttatctcattttaattcccttggttttttgcctgactttcttgagtaactcttattaaattatcatttgagaatattctttcttgggcctcttataatttagtcttcatttctcagatggttttgtctttttcttttatctctttaaagcatacaatcagttatcttttatattcttccaccttttgtccatttgtgctgtttagtttttgattttctgattttcatggtggtttttaaaatatctccagatgcttatttgagaatatttagttcagtttagaatgctgctacatttttcttacgcttcacatgttttgtttttggtgaggaggttttcatcagatgaaattcttgaattcttttctatttttttcttaaagtagcttcgtatacatttaggttgatgtcttctattcattttatggctttagtgtggtttagtagtaccctcttctgtcagtgttacaaagtctttctctctgattgtttttacttctttatctcattttgattatcttggatgtttgcctttgttttgtttatttattttttttaatataaggttttgtgtgtggtaaggaagaggttgtgtgtccttcatttttgtttgtttgcgtgtttttcttttgtcttgcagaaccccaggttttcccatcattgcttcttattccctttatcactcagaggatgtcactttcttttcttccagaagcaatgagggagaatcacacacacttttatgtcccttttctgtggttgtacattgacataccaagatttgttttcagtatattcatatatgagatggattttctccttctggcagtgattttagatcagtgttaagcccttcacctgctcctctcttctctttctcatacagtcttgctctccacaaaagcttgcaacagaaccatgagaagtaactctgcctgggcttagtgtatatttctcttacatgtaatttaaagtttgtagcactctctggcttctagttaggctgcaggcctgggttttctattatttattcttctggttaatctgcatttttttgatttaggcaatcactgttatgcttagctgcctggaagtaatttggrtaattcttcactttttaaatttccctaaagtgagcctttatgtaaagtgcaagttttccttcttaatttttgtaaggcagtttttttattttaattcttcttttggctttttatatatgggatggggccataaaataatgagaacttctcaaaaaacaatgcctgaaattagtcttaataacttcttaagggttacagaaagcaagacccaagccagatattgtagcttgtgcttgtagtcccagctattcaggaggctgaggtcggaggatccattgagcctgggaatttgaaacaagcctgggcaacataatgagatcccatctcaaaaataataaaaaataaagwtccatctgtattcagtcactctttcagatgtgtctaaataaaacatgtttagtttcacccagaagaacatgcagatgccctcaggaaattggtgcacgatgtatacaaagagatttaggtaataaataatagagactgtcggggtctgggtggagaatgtctgcctggcctaaagacattgaacgttagactggaccatattcaaaggcagtgagtgaagtagttaggcactcaggtgtggacccagattgcctgggtttacatctcagctctaccatcagatctgctgtggctatgtaactctaggtaggtcgatttacctcattaggtctcagtcttgtcacctgtaaaaagcaggcacctcaaagactactgggagcattaaataaattaatacacataagatagttagaccggtgtctgatccagatgttaagcagcagttgctgctgctgctgctgctgttgtgtgatgatgatgatgatgaagatgatggtagtggtggtagtaatgctgccaccatcacattacagaatccaggatctcttacactaaggcccattctctcttggagcacagaggtttgggaattatctggaggaggaaagcaagaataaaagaacaaatatttgtaagtgtttactctgtgctaagcactgtgttagctgccagtacatacaaagtcaaggtttccaatgtcaacmagactctcaaaattttccagctgtcctcttcatttcctcagtcagttcccttgccctttctccatacagctgtttgacaattctgcctcctttctgaagacttatattccatygcccctacctacgttctcagcaaataactaagttaaacagttaagatggcctggaatcagagaagctgggttcaaaattcagatgagacatttagaaactgtgacccttgaacaaatatcttgagtcctctgaaattctgttttctgtgggtatagtggtggtgcctacctcatagggttgtgaggattaagtgagacaatgactgcgagccccaacaattgttagctaatcatataatatcactttctattctgcagagatgatagaagccatcagamaatagcttctcctactttcagcttccccacccacacatctgctctgtgtacatccatccttgccccttctctcccacctcagtagaagaatctctctcccagcccatggttaatccctccaccagtctctggatctccttccctcctgcctccttagtgaggttagtctattcttaatcctctcctatgttaccatggaccttccctttctgtttccctcagcttctaagaccatattcaataaagattcccttagcatctactatatgccagaccctgtgttaggtgctgaggatcaacatgaattgaatgtgtcatacatcatctctgcccttaggaaactaggtctagttgtcctgaaatgtgctcaaaagcccattaagtgctcaagcctcatcaggacctctactttcctcctaatgatgccttattcttctgcccatggcagcctgtattagttcagagtcctccagagaaacagaacaaataggaggtgtgtatagagagagagtgcaatttattttaaggaactggctcacacaattgtggaggctggcaagtccaaaatcaccagcataggctggcagggtagagacccaggaaagaatcacagttcaagtctgaaggcaggctgctagcygaattccctcttcttccagggatagcaggctgccttttctctcaaggccttcaactgattggatgaggcccacccacattatggagggcctcataatctatttcactcaaagcctcctgattgaaatgttatctcatctaaaacataccccttcacagaaacatctagaataatgtggactaatgtttggccatatgtctaggtatcacggcctaaccaagctgacacgtgaagttaaccatcacatggccatgctgcttgagacggttgcctacactaattgcctccacctctcccctctcattagcagcaaaggccacttctctgctctagccagaaagaacttccatcccagtcaacagtatctctggtcctaggccatgttctagaatgctcagagcctctgctacccaagagctgcagagcaggaatctgagaagtgccagccaaagcttccaagcagccagaaagcctgggacctaaagagagcaagaagaacttatatgggggcaccagagatgacacctggtcgcagcagcttcttctcctgctgatcctggtccagggcctgtggcttgggaatatgtgggaagcagtgggtaagagcctgaaccaggcaggggacacttgcaagtcaccagtggtcctattgatgaatccgatgaacacattttcatctttatcttatttgatctatcagggatatctgacaattcttgaggctcttggctctgtgacaactaccccctcctgtagagctttttgctttactacttttttgatcactcctcagtttcctataggttttttcttttttaacatctgcccttcaaaaagtggtattcccaagggttttaatcctcaacattcttctctctctttatatgagtgatttccgccttcagggaaggggcatcacgaccttttccaaatccggtgaaagtaatggaccctctcccgagctggctgcaaacacccagtgccttgcatataatttcaggggtttacagatgctgcgatgcttatccctgctctcccaccaccttcttgacctggcgaagccctactcacccttgagacctagatcagacctcatgccactccctgtgggaccctctttgacccactctctccccagaggagggtaaaagccacggtccactgcgctgggctctatctcagcaccagcccactgggtttaacagccgcttccctgcctgccctcctacaagtctgtaaaatgagcttcctgaggtcagagaacattttatattcttctttgtatattccactccatagcagagtacctagctcataaaaggcactcagtagacatttgattataaataattatgtgaattgaatctattttcaaagcaaccctgtgaaatgcatatcaaaattcttactttgcagctatagaaaccaaggctcaaagtgaattatccttagacccaaagtcaggaaggggcagagctgagccgaaatcctggtctgctggccttcatagctcattctcatctcactatgccaggctgctttgaacccctgtggtccactaacagcatgtcccctgctcttcctggctccctccactggagtcagggttgctactactgagatttacagaagagaactagcccagaaaacaccagatctggccacascaaggactgggtgcttcctcwtcttacacccccgtccccattatcaccatttgggtcttaggtgggatcctcatggatttargtattggrcaaagagaacatcccttatagttcctaatcttcccacaaattaaaacccagaacaaagcgagaggcctggcaaaagcatcaggtgggagttcaactccatgagaccagggtgccaggctgggacgaaatagaactaaggactaaggatcaaagcagaagcctaggcatccatccattcatgcacttactcattygctgattcactcagcaaatatttatcacactcctgctgaatgtcaggcactggtacatacaccaaggatgcagcaataagcaaaaccaagtccctgacctcaaggagcttgcattcagctgaagggtgataagcaataaacaaatacagaagtgctgtggtgtgttggttgctgacagtgctatggagagaggttgagcagagcaagggacctggcagtactggccatgctggccaactagggactaagggaaggcctcactgacatggttaatttgaggagagacctgagaagaagagggcaggagttaagggatatctgcaggaacaatgtcctaagtagagaaaaaagcaagtgcaaaggccctgaggcaggaacttgctttgtatattcatgaaacctccaagaggccagtgcagccaaatagagtgagctataccactgggagaaagggggaatcagagggatgcagggataagcatggtggcctgcaaataccacatcccttttctcttccctgctcatgtctgaacaaaatagtaaaacagactggtaggtggaggcccaaatattacctcgcttactaataaaggctaagttggaaaatggagcttaatgtgacagtcagatggaggctgctacatgaacccagaatgagatggattcacccacccacagaggcaacactgcagtggggcatgcagccctgcaatgttggggatagcctccctcctcaacagctgagagcagccgagaacattgctccctgcagacarctaggtccctagaaaaagaagggatgctgagccaaacatgccagctcattactcccaagttgcacagatcaaagtgcactaactgaactcccttgccatggaaggaattggaggtagtgggttctctccaaacagcagctctgcttccccagtttacctgggctattgatctagcagagtgactgaactctgcaccagtcttggttagtattcactctggttctacaaggttggctcaggaatgaggatgggcctaaaccagctgacagttggccatcagtatacccagcaattaagaatggatctggggagccgagggcatcagaggcaaggaaagtaagatagcactgaccgctcagaccacagagaaccacagtccagtcctaacaccctatgggaagtcatagaatgattgatctcaagttgtccaagctacagacatatcttcaaggcagacagaatgttcccctgacaatttcagtttataaaggttttacagcaaaagagattgaagttagacttagggctgaacttcactgatggcctaagagatgccaggtgagaggtggataaattctgaggggtgtggaatagtaggagggcttacctatcttctgttttggttacagcaattacctgtggacacccaggcaaccctgtcaacggcctcacycagggtaaccagtttaacctcaacgatgtggtcaagtttgtttgcaaccctgggtatatggctgagggggctgctaggtcccaatgcctggccagcgggcartggagtgacatgctgcccacctgcagaagtgagtcaccctttctctcccaatccagtccccaccatctctgctatatgtggttctgtagctcagaaaaagaagccagtgaattcattctggcatcattctgatccasatagggaagatggagcagagaagggtcataaatgaggactttctcaacccttagataaagagccacataaaatttcatcatcatgggttatataaggaaagcaaaacttaagttttatctttcaagtcgtcttttttacctttcattgaacaaataatgtatcattatcttataaagccccgttattttttaacagaggtttatttttctcacataaacaagaratctagaagtaatattatttctgcagctgctccacgagatcaggagcaatatcttggtctttccttgtggttgcaaaatggctgctgcagctcctttggaaccactcttaagagatccccattcttgatgaaaaagcagagggttaaaaagcagagagcctaagagttgagataaagggggtgagggctgggggaaaacacacagagaggaagccaaagactcaaaaggcagagagaatacagaatgtcctggctctatttggagtatttaggaaatagcttctaacgcttttagaggcttttgacagcagtgaagcctcagagagcctcatcaaaagtaaaaatccttaaaggcttatcaaagatttttaaaaaataccttcctgcccacttcatatgataagtttgagactcaggtaagataatggatttgaagatgtttggaaagaaaagtatagtcatgggttatgaataatgttgtcattattctaaaatcttatcctgattttgagttaagctgctttggaaacacttttaagattttaaagtcaaatatatcccccaggatattaatatgtccctgaaatactcataaaagtgattaaaaccattttcaaaagagcccaaccctgttcaagtcagttcaaatgcgtcagttttacaattgacaagctttgctgtgggaggcacattgtgctasgatcagatatatggagactagacattcatgccctcaagggactcgtgtgttcaaacaagtcacagcacaggctggtaaagtcagcaayagcgatttgtgcaagggagtaccagaaagrgagtaatcaatctgggaagaggtgggaggagttctctaaggaggtgatgtctagctggacatggaaggatgactcttctgaccaggtaaccaaggtgaggggagaagtccagcaaccttgggaccagctcaccctcccgacagggtctgcttcattgcctagttttgctcggargattttactatactgggaatccatgcctgtttggacttctgttcaattgcagtcatcaactgtacagatcctggacaccaagaaaatagtgttcgtcaggtccacgccagcggcccgcacaggttcagcttcggcaccactgtgtcttaccggtgcaaccacggcttctacctcctgggcaccccagtgctcagctgccagggagatggcacatgggaccgtccccgcccccagtgtctctgtaagtagatgtcacctgctcaaaatgactgatggggtggcccgtgtcaaagaacagtcctcccctctgtgcatgtgtgtrtgtgtgtgtgtgtgtgtgtgtgtgtgtgtctgcacatgtatgagttgccttatggtgacagtcactctggctactcctgggatttcagattccttcttgagcctctgttgggtgacttccataccaatttttgtgttctcactttcctagctagaggcctggtccctttcctctctagttaccaccctcttcagcttacagagttcccttttttcagaactggctgcctcgcgggacatcatctcccaactttaccttttccttgcccttccagaaacacagcacatgaaccccttccctttaaaggactgaagcagagaggtcacagactctggaggcagaccaacttggactggaattctggctttgctactgaacaagtagtgtggtttgggaaaaattcactaacctctcagagcgtcagtttcttcatctataaaaatgatgccagtacctattccatagggttattagaggattaaaggggaaacaaaatctattaaaagtcccagcatagtatctggtacatagtagctactcaataaacaatgaccacattaattattgttaggaaaagaattggggacaactggttttttaaaaggggttggggaggtgctcagaatcctgatgtattagtctgttctcccactgctataaagaactgcccaagactgggtaatttataaaggaaagaggtttaattgactcacagtttcacagggctggggaggcctcaggaaacttacaatcatggtggaaggagaagcaaacatgtccttcttcacatggtggcaggggagagaagaatgagcaaagttggggaaaagccccgtataaaaccatcagatcttatgaaaactcactcactatcatgagaatagcatgaaggtaactgcccccatgattcaattacctcccaccgggtctctcccacaacacgtggagattatgggaactacaattcaagatgtggtttgggtggggacacagccaaaccatatcacctgacatctggtccctggccttacacgtccttaagagaagagcaaccccttggtttcctgctctcccctctgtttcctaaaggtgaatccacatagatttctctctcccccatcttccaagaagcaaaggtgaagatgcactcaagagggagtaatagatatgcagttaaggccatgcagcagtccacctacctttggcagattatatacattttgtaggccctccagtctggacaactgcatttttttacgccctcgtggctgtaggtctaacaggagcctggtatagctgctcactgcttgtattttcctcgcttgagaactctggcctggccatccaatcccatttatgaccagcaaatagtttggggtcagaaatggacaccacctgtgtacagtggtgccagctgagagtcacagcccctagtggactcaaattgttttttcttctagtaaaatgcagcttttatcataataaagtgaccctatccatattaactttttgtcccaatgcttgttttctctaaagttaattcagtcacatattcaggctcctcttctaattctggttctcttgctgctctaattctggttctcttgatgctgcttcagtggaggagwgagatcctccaatgaagtcttgaacccatcaaagtcatgcatgagggttagaatcagcttactccaaactcctgtkaatgtkgctgtkgatattactaataggtatatatattaatatagaggcatacattggagatattgcaagtccagtcccagactactgcaataaagcamaaatcgcaataaaataagtcacacamattttttagttttccagtataatctaagtgtgcagtagtatcatgtcaaaaaatatgcacaccttaattaaaaatactttattgctaaaaaatactaacaatcatctgagcccttagcaagtcatactcttcrctggtggagactttgcctcaatgttgatgactgcaaactgatcggggtggtgaaggctggtgtggctgtggcaatttcttgaaataagacaacagtgaagtctgccacatggattgactcttcctttcatgaaaggtttctctgtagcgtatgctgctgtttgatagcattttacctacacagtataatgcctttcaaaattgcagtcagtcttctcaaatcctgctgccactttatcaactaacttcatgtgaagttctaaatcctttattgctgtttcaacaatgttcacagcattttcaccaaaagtagtttcctgattcttctcaggaaaccactttctttgctcatccacaagaagcagcttctcatctgtttgagattggtcatgagatttcagtaattcagtcacatcttcaggctccacttctaattctagttctcttgctacttttaccacatctgcagtgrcctcctccactgaagtcttgaacccctccaagtcatgtgtgaggggtgcaatcagctttttccaaactcctgttaatgttgatatttggacctcctcccatgaatcacaaatcttcttaatggcatctagaatgattaatcctttccagaaggttttcaatatactctgcccagatccatcagaggaatacactatctgtggaagctatagccttatgaaatgtatttcttacataataagacttgaaagtcaaaattatttcttgatccatgggctgcagaatggatgttgtgttagcagacatggaaacaacattcaattcctgtacatctccagttctgatgtacaggagctcttcatcatttagcacttggctgaccaggtgcattgtcaatgagcagtattattttgaaaggaatctcttttttctgagcagtaggtctcaacagcgggcttaaaatgttcaataaaccatgctataaacagatgcgctgtcatccaggctttgttgttccatttatagagcacaagcagagcagatttggaataattcttaagggccctaggattttcagaatgggtaaatgagcattggctcccagttaaaatcaccagctgcattcatccctaacaagagagtcattcagtcttttgaaattttgaagccaggcattgacttctctctagctatgaaagtcctggatggcatcttcttcaaatagaaggctgtcggtggctcatgcgtgtaatcccagcactttgggaggccgaggcaggtggatcacaagatcaggagattcagaccatcctggccaacatggtgaaaccccatctctactaaaatacaaaaaaattagccaggcgtggtggtgtgcacctgtagtcccagctactcgggaggctgaggcaggggaattgcttgaacctgggaggtggaggaggttgcagtgagctgagatggtgccactgtactccagcctggtgacagagcaagactctgtctcaaaaaaaaaaaaaaaaaaaaaaaaaggctgttttttctacctttaaaatctgttgtttagagtagccaccttcatcaattagcttagctagatcttctggataacttgctatagcttccacatcagcacttgctgcttcaccttgtacttttatgttatagaaatggcctctttccttaaacgtcataagccaacctctgcttgcttgtacttttcttctgcagcttcctcaactctctcagccttcatagaattgaagagggtcagggccttgctctggattaggctttggcttaagggaatattgtggctggtttgatcttctgtccagatctacctacctyccatggtaggtggatgccaaggacgatgctaaacgtcctacaatgcacaggacagccccctacaataaagacttactcaaactttctccatgttggcaataaggctgtttcattttcttattcatgtattcacggaagcagcccttctaatttcctgcaggaacttttcctttgcattcacaatttcactaattgtttgattcaagaggcttagctttagggctgtctcagcttccgacatgccttcctcactaagcttttaatcattcctagcttttgatttaaagtgagagacacaactcttcatttcacttgaacacttagaggacatcatagggctattaactggcctaatttcaatattggtgggtctcagggaataggggcactcaaggagagggagatagacaaggaatggccagttggtgtagcagtcagaacacacacaacatttatcaattaagttctccattttatgtgtgcatgrttcatggcgccccaaaacaattacaatagtgacatcaaagatcactgatcacagatcaccataacagatgtaacaataatgaaaacgtttgaaatattgtgagaattaccaaaatgtgatgcagagacatgaagtgagcacgtattattgggaaaatggtgctgttaggcttgctcaacacagggttacyaaaaacctttcatttgtaaaaaaaacaacatctgtaaagcacactaaagcaagacacaataaaactaggtgtacctgtaacttataaccagcttccttcttttagtattggcatgatttttttatcattttatttttaactgctctctatgtaaaaagcatgtaattgtgatttttaaaccctatctgacaatcttttctttcaagtggaggatttwatccatttgcattttttctttctttttcttagtgaaatataattcacacaccataaaatgcattcttttaatgtatacaattcagtgattttagtgtattcgcaaagttgtacaagtatcatcactgtctaattccagaacactttcatcattcccaagcagcccttaaaagtcactccccattgcccaccccaccccagcttctggcaacctctaatgtacttttctgtctctgtggatttacctattctggacatttcatataaatggaattatatgtgtgtcttttgtgtctggctacttccacttaacataaaattttcaaagttcatccacgttttagcatatatcaatactttattccttttggccaaatactatttcatggyatgaatataccacatcttgtttatgcattcgacaattgatagatgaactgggactattatgaacatttccactttgggactattatgtttccattttttagctattatgaattatgctggtttgaacatttgtgtataagtttttgtgtgaacacgttgtcaattctcttgggcatataccttggagagaaattgccaagtcacataggaactctatatttaactttttgaggaactgccaaactgttttccaaagtggttgcaccattttccgtttctaccagcagtgtataaggattacaatttctccatattctttcctatgcttgttattgttcatcatttttattataaccatcctagtggatgcaaagtgctatctcattgtagtttacatttgcatttctctaatgacgaatcgtgttaagcatatttttatgtgtttactgtgtaacaaatcatagtgacttaatgcaacagccattttcttgcttatgattggcaattctggcagggtttagtagagacagctcatctctgccccacatgttattggctgttgtggctcaggtgggcctagaagatccgagatggcctcactcatatcttggcactggctgtcagctggggcattgtgattgtccatggtccctcccctcatatgagttcttgtcattccgtagtctctgccaaacttccttacatggtggcatagtactccaaacagggaaggtagaagctgccaagcctcttaggatgtaacctggctcaacatcacttccaccatgttttgttattcaaagcaagtcacaaggccagcctgattcaaggggaggggaaaggggaaaaagactccactccttgatgggaggaattgttagtagcagcagtctttgcagataatctaccataagcatttagaacaatgtttgacccatattaagaccacattgagaagtgaagatacctaagacccattcttaccatcccagtacctaccaaaattcatcatcagggtcagcactggcccaacccaggttttaccacttggtcacctgttgtggtctgcctgtatgctatgccctgtgggctttctgggtatgatgtctacagggatctcctaccagactccaagacattatcatctctccttgaactactgcaacagctccctctttcttgtaccacctggtcctttctctacacagtagccagtataatcttgttaaaatgtaaatccgatcatataactccagtggcttcccaagatgctcataataaaatccaattttcatgccatgatctggctcatagtgacctctccacccttgtcttcttccattctgtcctggctcattccagtcccagcatccttggcttccttgctgtctctcaaacacagcaaactcactctggcctctggcccgttatacctgatgttccatccccaacaatactcttctccaaaattttgcatggctggcctcttcacatcattcaagtaacttctcaaagtcacttgatcttcccaaacacacggagtgtctagcacatgacagggactcaataaatgtgtgttgagtaaatgagagaatcttaggatcaacctgtgatcctgtgacaagaccaatgggaagaccagccccagtaatgttgaaagcattacccttgcctagacatctcaattctggtgttctatcttctcacttgttttcacagctatacttcagtattttagtaaagggaacttgcatactgagagggacaggttggggacaactgatgaggcaactgtaagatgcagatggaaaagggctataattggctttcattctggaatccttggccaatgaagacaatctgagggtgacagagctcccatttttgtcttgtgtatactctgcrtaccaccttcctgcccagagacatcatgagtatgaggaaatagggagaggtaagcataasaggcaagagagaaaacaatctaatgttattgtatatctgctacatgctgagaaggtattattcctcatttcatagatatggaaaactgtcccctgagtggacattgtctgccaacgccaggtgggcatgccagcaggaagtttgcttcaacagatacccttgggtttctcttcttcccagcctcttgcttaaagaagcctagcatggattgtgtgatggtgagccatccctgtgcagagtcattgagatgtttgcttttcccccacagtggtgtcctgtggccatccgggctccccgcctcactcccagatgtctggagacagttatactgtgggagcagtggtgcggtacagctgcatcggcaagcgtactctggtgggaaacagcacccgcatgtgtgggctggatggacactggactggstccctccctcactgctcaggtatggtgcatggcattgaggaaagagctccagtggaatgcttgactgatgggaggtagacgagcccccaaggtgtgagtgtgattgatggatgggagggaatcagacctcagaacccttatatctaccctaacaggtagaaagcacagcaagacaaggtcccaatggagcttcagcttctggtgggctgagcccygccttatcccctcagtcagccctgaccatgcccagggattgcaaaactaggaggggcacaactttttaggtcaacctatggccagagtcctgtccagacacttgattttatgagttcctggggacagttcaagtcttcctgttgatcagctcaggtccaagcccactcctgtgttcttttcttctctgtttcagactcgtgctcaggtccaagcccactcctgtgttcttttcttctctgtttcagactcgtaggccccagcctccttccctttcttatcactgcccctcaacttgtcctatgtcctggctacctagtggggtacagtcttcttctctactgccttgaaacgccagtccccagacttttcctgttaagttccttttactgctaatgaggacactgacagatgctatcaaaatcgcaaatgtagagaactgccaaaggtcctatgtccacagtatccaaaccagaaatgaatgtgtaatgccatatagcagaacaaaattttgcaagtgaattgtcctgccaatagcagaaaccaccaagctaaaatattagtgccttgcagctttgtcttctttgagggggacctgcctggccctaggaagggattccatgttgcctgcaagagggagctgcttgtgcagcttgatgttcctcggagggcccaccttggcattgaaattaacccgtaacccttcccatgccagatcccttcagaggaaaggatcatgacctcctcctaatacagaagccttctccttgatgtaggaccttacccataagatgtgccactgttcttgcagtttgacattcccagatgagcctgcctcccaaaagttaggtcactgccagaatatttaatgagatattcattagatctctccagaaagaaaagagtcccaaagccactatttcaaagggctgttggttgcccaggaaatcccagacacatcactctatatgaccacccaggactttggcctctcacccctattaatctcattaaacacctaattaaggaacygggcaggactatataggagccatgatgactcatttagctgggctagaggaaggcctattaactgtgccctggcttctttctgtttggacatctggtagaagtgataggcaatacagcatgagaggacaagggtcatgtacattgcctctccagcctccctggagctctctgaaaacagaattagaaggaattcaatgtacgcaaaggctagacaatgagtgaaccttaaatcccttggatgagaacataagggatgagaagaataggcaattaggaagtaacattaggtatataccacagatatagagatagttcctcccttcctgaaacaatgtcgtcttttgcagtggcatctcctgccagtcctatgaaatacacattcatgaattccaggtcaaagtttttagtctcattgtktgcaagcagtggacccaactgttgcacaacaaaacctcttaagtccttgagtcatacaccactgggccaccaaggctatggagagatttctggagtttgagacctacttcaagargttcaccacccacatctccactgtcattctctttgcctcttcggtaaatagttgccatctatctactctgcccccatggtgcaatatcctgtccagactcccttccatcactgaactagaagcctccaatactgtagtgggggccattctttcagaaaaagcccctaggactgaacaccattgtattagtctgttctcatactgccaaaagacatacctgagcctggtaatttataaacaacagaggtttgatcaactcacagttctgcaggctgtacaggcttctgcctctgggaaggtctcaggaaacttacaatcatggcagaaggggaagcaggcacatcttcacacggctgtcaggagagggagagcaaagtgcaacacactttcaaacaaccagatctcatgagaactcactcactatcacgagaacagcaagggggaaatccaccccatgatccaatcacctctcaccaggtctcttccccaacctggggattacaattcaacatgagatttgaatggggacacagagccaaaccacgttaaccatcttgtgcctattttacaatagtgctagctccagctgaggttagctagccagtgtgtgggttagagctgctcaccatcaagattgtttccagggagacccagttctgcctgttgtgtgaattacatcctggcaaccttcaaaagataagaaaacctagccaaatgcgatragctctcttttattaatgtttacattgaaggttgaaaatgaatccctcttccacrgtgggaaacagaatggagaacatgtggttaggtagtgtctcacagtctgagtcgagactaggaaagggaataatcccaaggttgagaagtggaaragacataaatggcaagtggtggggtacacatgacttaaacatttattggctccagccaactagatgtggtcactcagatgttaccatttgatgcccacacatggttacatgaggagatagattccatgatagttgtaactttatcttttcatgcagttgtcatttattcggtaattgttctcctctttcctcatgtttaccatggcctggtctgatctaaggacatctcctacacatttctgtatcatgaaatgtgttggccctgcaggggaccatagatcttgtggctttgtctcctgttctctacctttcttcgccccttgggtccttggaggtctcttgagtgggtttgcacaataccagaagccagagaaatgtaggaatgtagcaagaggaagggggtgaagcaaaaatgaaatgagagggtctgagatgtttattctagagctcacttgtatggcataatttgtgagtagggaatccttaatgaaaggcccagcatcgatcaccttgaatatttatcatttctttgtggtgagaacatttaaaattctctcctacagctacttggaaatatacaatacatgcatcaaaacatcacttcctaccccataaatatgtrcaatgattatttgtcaattaaagataaaatgaaactttttaaaaagtaataaataaataaataaatgcccaagatcaagattcaagctaggcggttaagaaatgaagctatgctaagcagtttggactttatcctatggcatcggggagccagtaaagatgtttctgcaggaaaaaattttttgaaaaaaaaaaaggtcagatggttagtgattgttaagattagaggacaaagtagaagatggattagagggagagtttacaaggaggggacattagtcgggaggctcttgcaagagttcaggcaaaagaatgttgaatgtctaagctaagacagtggcacaggagaggagatgggactacagaatcagcaggtgtttgtagagaagaggggaaggggagaaggaggacctgtggccagtttggatcactgaaattccagactggcacgggccacagagcctttcctctgccttcttgcttcccctccctgtgtggttcccagggacttacccatggcctcagatctttgtgttcttccaccattgcatatggaggcaggagcrtgtgcaggtaacttgtgctaggcctcattcgtgggacccactgcatccccttagtcccatcccagtatctttctcccctgcttctccactcccttttcttccctgaaaaataatgggatttgtgtggttctggtccataggaaccagcgtgggagtttgcggtgaccctgggatcccggctcatggcatccgtttgggggacagctttgatccaggcactgtgatgcgcttcagctgtgaagctggccacgtgctccggggatcgtcmgagcgcacctgtcaagccaatggctcgtggagcggctcgcagcctgagtgtggaggtaatgtatgtgaccattctgcttctcccctttgcccagccccagagctcgcccctgctcctgctsttattcccaggcacctgcgctcacagaaaaaaaccgtrgccccatttgaaccctcagcctggctgataggactgcaacagataattcatgtgcattttcattagtaatcaaaagacaaacatattcccactctcacctcaaaagggaagaaatcaaaaaagactgaatttgacccactatttcattcatttcccatatagtttcattcagcatctatgtgccaagtgctgtggaatgtgctggggacacaatggtgaccaagacggacactgccatggtctggatatttgtgacctcccaaaaatcatatgttgaaacctggtcacccagtgatagtattaggaagtggggtcttgggaagttgttaggtcatggaatgggattaatgctcttatagagaaaagaaaataccttagaaygctccctttcccttgtgccatgtgaagacacagcaagaaggcaccatgtccaagcctgaacagacggagacacacatcttgatctcctggggcttacagtctaagggaagagactacgtgaaacaaatattcaatgtgccaaaagatatacaaatccaattttagaaaactctcaaagtaatctaggccctcagtgatgttgcctgaggtagcaccaatgggagaaattatcatttttccatatattcctaagtttctggggaaaatgtatatttttaaatctctctctcctcttgcagttggtccccaaatctctctgtctctctctttctaaaatacagcttgcatagtactctcctaggcaggaagcaggcttaacagatgagagtaagtttgagtgagaagatctggaagaggaaggagataatcatttagcaagatacaagtggaatggaattgggaagtgtgtaatggccaggcagcactgagcgctcacttaaggtggggggatcattaatttaaagtgagagcagtcagcatgggaccatgtttttgttcaagctcattttgctacctagttgtgggcacagagcagacagtgcattgggtacagagctggagatttgacaggcaactaagacattggcagaagtggcaagggaaaagagggtgaatgtgaggcagagattatatgtgtatatatatatatatatatataaatgcacagtggtcaagtcagggcatttacagtgtccatcactcaagtacaatacatttttgactatagtctccctactctgctatcaagcattgaacttattttttctttctaactgcatgtccatgccctttaacccacttctcttcatcctccccctcccctgactcacccttcccaggctctattatctgtttttccactctctacctccacgtgawccccatgtattttcaatttaagaagttattttcacagctctaactctaaaagtctagaatcaatgaccagatcagtggcaatgagtactcttactgcctggattgtggtccattctccattaaaagaaactagactctctggagaaatggctaattcccgggctggtgcaggaaatatacaagacaaatatggaggccgggcgcggtggctcacgcctgtaatcccagcactttgggaggccgaggcgggtggatcacgaggtcaggaggtcgagaccatcctggctaatacggtgaaaccccgtctctactaaaaatacaaaaaaaaaaaaaaaaaattagccggtcgtggtagcaggcgcctgtagtcccaggtactcgggaggttgaggcaggacaatggcatgaaccygggaggcggagcttgcagtgagccaagatagcgccactgcagttcagcctgggcgaaagagcgagactccgtctcaaaaaaaaaaaaaaaaaaaaagacaaatwtggaacatcttgtcactccagcgaggattccaccaaagataactgaggtcatgttaactggactcaggagccaactagaagaggctcctattggctaaagatggagaatctgagcatcaataagaataataatggcaatggatgggaacataaaaaatatctttagatccatgagttcaaaatgattcttaaataaacacattggtcacctttggagtttgctaggaaaccaactcattattctgacatttgatttaaaataaaaaccacacacaaaaaatcaagcattatctggcgttcctatatgaacagtatttcagggtaagcaaatatttgatgatagaaaatgtctttcctaaagaactctagctaatgcagaaagaaggatagaattagaatatcaccactttccaatccctaatgaaataatgaatctggtcaatgactgctaaaactattaaatgaaaaacttcataatggaaacttcataatgccacattaggcaggcatgcccgaaatcactgatgagcctcaacatcatgaacaagaaaacacccagacattctttgcttcttatccaatgcaataggagaggcccaaaaccacctatgaataccattgccaaaaggcggaacttgattacaggaaggaactacaggggatagaggaatatgttaaactatatctcattgatgcagttagcaaaatccagaaagtgtgaagttctataggacagatgttctggtttctgtaacaaataaattatagaagcagaaataatcatctctgggttcaaagtcttagagacgtgtcaaccaaatgtcatgtgtggaccctatttggatcctgattcaaacaaatcaactgttaaaaaaagagaaaaacaactgaggaaaatcaagcactgattggatatttggtgatattaagcaattgtgtttaaaattttaaggacgataatagaatagatcatcttttttctgtaaaaaactggaatttgctcagaaatttcaaaagattcataggggtstctccttcctgtctaggggcaagataattcgatacaaaagcagcatgagaggcatttctatccacgaggtcccgaggtagcatgtggcttccactctgggcagttatcagtcccctaggtgatacccaccattgttctggtgaataatgtgtatttttgtcttcctagtgatctcttgtgggaaccctgggactccaagtaatgcccgagttgtgttcagtgatggcctggttttctccagctctatcgtctatgagtgccgggaaggatactacgccacaggcctgctcagccgtcactgctcggtcaatggtacctggacaggcagtgaccctgagtgcctcggtgagagctcaggccctacgggytccatggccaacagtggcccagatcctgcatgccagaggagaaggctatccatggaagatggtgcagaatggttgggatggtcggacttgaacctgaacgataatcatatgaatagcctctgttgagcatatgctatgtggcagccactgagcgaagtactttatttcatatgcacatttcatttgatcttcaccataactccgtaactccgtgaagtagctactattatccccattttgtatatgagatggctgaggctcagagaggcagagaatatatgttggccatttctcaggctctagccaattccttgggctttcccttttatctcttagaatcaaaccccagagctcaacctgattctcttttcacttcaaagatgcagctatctgccatctttgttgcttcgytctgtccttgtacccgaccccacccagtacgggttcctgagcacggtgtagcctcacagctccaatttcttgcttctctcaagggtagtcccagttcttttctgggaaaagtgagtcactgtgggatccagatggagggaagagataggatgaggaaatgtgacaagattctccctgtcaaagtcctagtctgtgatttcgactccctctgaaatcccgtgtcaagttcactttggttttgagaccagagctcaccaagccccaccctcaatgatatgatgacataggcatgaccctttcatgggccataagaccctgcttccaggctgttgtccctaggagtcctgtgtaggtgctgttgggcctacagaggcctcstaggtacaacagcaggtgataagatgtacccctcagcagacaaatcaattgtctcatgtggttcattaatataccttaggttcttcaaacagaaaactccctttccctgggtcctagcctcatttaggaactgagccctctggatacttcctcttasagggggcactttgaataaggtgaatcttcatagcccaagttgcagcggtgcataagsacagtgtgggcaagsacaggactgatgccaggkatttgacmaaacaaaatttaaaatgggcaagctgggtgtggtggctcatgcctgtagtcccagctactcagaaggctgaggtgggaggattgcatgagcccasgagttcgaggctgcagtgagccatgactgtgcctctgcactccagcctgggtgacagagtragaccctgacttaaaaaaaaagaaatttagaatgggtaatgtccaactgggatcctgtgaggagacagggcatccctgatctgacagtttcccttcttggatgcatgcasggagtgatagggatggtattggaggagaagtggggtcctggccaggagtgaacaatgctatatctctcttatcctagtcataaactgtggtgaccctgggattccagccaatggccttcggctgggcaatgacttcaggtacaacaaaactgtgacatatcagtgtgtccctggctatatgatggagtcacatagagtatctgtgctgagctgcaccaaggaccggacatggaatggaaccaagcccgtctgcaaaggtgtgtctggggctgcaaatgtggacagagagccaaagaagatacaaaagtgagatgtaggccctgagcatctctctagaagggagaggggtgaaaggccagccctaacatcttatcaggggatgtgcaagstgagaaaactggcccctgaacatctgccaggagtgaatcagaagtaccaaaataaggcctgggccatgaacattgaggggagggtcccgcaaacagaggactgggttgtcacacttgagagagggcattgtaaggtgcaaaaagatcagaactcccacagtaagagggccccattctggttcttcctgtttagcccaggctctaggtgggtgcagggtagtcggtgatatcaatgatggtgacgggggctggtttcccaggacagcatcagaactcagcctgctttggtctccctccagctctcatgtgcaagccacctccgctcatccccaatgggaaggtggtggggtctgacttcatgtggggctcaagtgtgacttatgcctgcctggaggggtaccagctctccctgcccgcrgtgttcacctgtgagggaaatgggtcctggaccggagagctgcctcagtgtttccgtaagttgcttacaagggcctttggtgcatcctcttcaatagctccttccccttgcctcctcggagctttgtggctggaaggcccagaataggtagtcccctccccaaaaccagggaggagcttcatcaaagacactattaaagagggaaggaagtggaaaggaagaaaatgaggatcccttaattgagccctggtgtcagatactgtctatggtaacagaaggaaattaagctagagatattgggggtgtttttttttttacctgaagggttgttaactgtatggaatagtactccaagatctgagggttcccagtgctatatacatgtctgttttcatgaaaaatgacctgcacagaaaagacttctgggaaacctgtgattttctggtgagttgctttattttttatmcacctggcccagttgtatcctgaggagccccaaatctattccagggcttactctttactgagatccccagtaagcaggttctgggtcacttattcttgtcacaccctgtgaatgggctctggaaggttttctccatgcccgtgctttgggcaaacagtaggacgtatttttctaattgccatttatctaattctgcagaaaactatccacatactcatgatactgttttgggttcctctgaaaatttgcttccatctggggatttcctcagagattagggccagcagctcaaaactggacacaggtatttggtgcaatgttaccctttccaaccttcacatactaccagggtcaagtctggactcagccaccttgcttttcctctggagaaatagctgaagtgccttttaacaatgaattatggtcatcatgaaaaaaattttacccattagaaaatacaaaaaagaaagtaaaagtcatctgaactcacactttccaatgataaccacagttcagcttttgatggtgtcccgtgtgaatcactgtgcatttttgaatagatagtgatatgtatacattttctagaactggtattggctcatgctgtrcatactgtttcataacttgtattcactgataggccaccaaaacctttccatcaatacctttctacctttctttatcaatatttactgatctatgcatcatcatttttaatggctttaaagaatttccttgtagatacaagttatttaatctttttgcactggtgatgaatttagattatctccaacttaatcaygttagaagcagttctgcaatatgtattcctgaaaattgcctttcttggccgggtgaggtgactcatgcccataatctcagcactttgggaggccgaggtgggtggatcacgaggtcaggagattgagaccgtcctggctaacaaggtgaaaccctgtctgtaataaaaatacaaaaattagccgggcgtggtggcgggcgcctgtagtcccacctactcgggaggttggggcaggagaatggcgtgaacccaggaggcggagcttgcagtgagccaagatcgcacccctgcactccagcctgggcgacagagtgagactccatctcaaaaaaaaaaatgcctttctttactcctgcagcaaagccctakgcatgagaatgctgggccgagggcagtcatgcctcccttcttgacatatgttgtcaaactgtcttctagaaactgtcccaatttacattccccacagcagttaatgagaatgtttctggatgcacaccctcatcaataatggattgtgccagtatttttaaatatttaccagcctgaggagctttaaaagatcgctcattactttaattggcatcacattgcttatgagaaaggccacgctggttgctcttcacttgtcagccgtttgtgtttctggttctttcagttgcctccttctggatacagtaacttcccatcaatcgattcttaaactgacttctaattggtcagcatagacaccccaaccttcagggcagaggatgcaggtccagcttcattttattttgcatgtggttatgtatctcatgactccatatacacatacacacagacacacacacacacacgcacacgcacacacatttgcatcatagcataaagcaatgcttgaagtgacatcgtggtgagctttgcctttggtagtcaatttttaatggcactgcctgatgttaacatggcctgaatgaaatgggtacacccatgcactacccaccgcagtgtaaatgtgtaccctttggggaaagacatttgacactacccatcaagagctgtggatgtgttcagccctttaaaaataataagttcactcctagagaattctcctaagaaagtaatacatgtgaaaagaaaaaacaaaaaagaaaacaaaacaggtgaaagaagagttatatataactgtataatagaaaatgcccaatataaggattatgataaaatataattatggtacaaccacctgttgctaattgtgtagccaataagcgatgatgatgtcataaacataggaaatatttacaagataatgctaagtgaatgaaacaagatttacgatcacataggcttgggtttgccgctccgcacaagtttccatacaactgaacaaagattggaaaagaatgtgcgtgaaaatggaaaaaaagttttgaatagtgggattttcgtttatttctctttcatgttctaaacttcctgtaatgttactccattacttggatcattattaataggcactttgaatgtagaagggagaggaagcccccatcagcagcagcacygcagcaggtggaagcacctacctggggctgccccggttcccagagttcaagctcaaccaggaagggagcagtgcaaagaacaaagatgggggtgtgggactggaagattgggttctggaaagcaacttagacctgcctttctcccttcgtcttcccagctgtgttctgcggggatcctggtgtcccgtcccgtgggaggagagaggaccgaggcttctcctacaggtcatctgtctccttctcctgccatccccctctggtgctggtgggctctccacgcaggttttgccagtcagatgggacatggagtggcacccagcccagctgcataggtgagaggtcatctggagcagggagcgtcttggctggggttgcgggagaccttcttttgggcctgagatgattactttccttccctgtcttcagtggtctcatctgcaaaagggaacatctcatcctctgagcttctgcagcaggatgtaaaatagccagagctagtgtgcttcgaggagtcaaatagacagccagggccaaggctcaggtggggatctcagtgggcagggaagtcaggatgtggccgcattttcttttctacacctatttcccagagtgagatgaggccgtgaaggcttccatgaccatgtgatctgtgtctttgttttggccatccagatccgaccctgaccacgtgtgcggaccctggtgtgccacagtttgggatacagaacaattctcagggctaccaggtaaggaggtcagccaagatagggtcttcctacatcctatcccttcttgtcactgtcaacataagaggacccagagaccttcctcaggacagcactcagggaggacaagagcttggaaagcgcagaaagaaagccctctgcctctttgaacagtgctccrtgggagcaccctgcagagacagcaggaccctaacatccgtcagagaaactgatgaggaaggacagatggcgtgcagttccatgaacacttcccggcaaccccaggcagggtggttgtggaaatacggaaatgagtgagacctctgtcctcacggtgcccaccccacccacagacactgggctcatgcacagtggcaacgagcatgtgccacacaggaggcaggcctgttggcatgcctggcccaccaggacacaggccctgcggacacacctcagatgagctttgggaggagagaacctggacagtctgggttgtgacacattgaacagagaaaaggatggccgggtgcggtggctcacgcctgtaatcccagcactttgggaagccaaggcgggtggatcatgaggtcaggagatcgaggccatcctggctaatatggtgaaaccccgtctctactaaaaatacaaaacattagccgggcatggtggcgggcgcctgtagtcccagctactcgggaggctgaggcaggagaatggcgtggacccaggaggcggagcttgcagtgagccaagatcgcaccactgcactccagcctgggcaacagagcgagactcggtctcagaaaaaaaagaagagaaaagaaaaggaagaatgggtgtgttcaaggcaggacaattaggtggagtccaggacttgcccaggaaaatatcggactcacctggacatgacaggctgggatctagtcaagtaatgtgacttattcacttagtctgtactcactcggcacatgcttatggccctgaactgttctaggagctaggaatacagtgggaacaggacagactgggtgcctgtttgaagggagctgcctggctgaagatgataaataaataaacgagctagcttctgagagcagtagacacgacacggtgattgatataaaggggtgtgaacggggtgggttaccattttaggaaaggtggttagggaagggtgacatttgaactacggcctccatgatgaraagggctagccctgtgcagagcagggtgacattcctggctgaacgaagggctggtgcaaaggagtgctgagggaagtgcttagcagcctgggggcctggaaartaggccagctagcaagtctgcagccccgtgagggaggayaaggaaatgtagtcaagagtgaggctaggttggaaaacagcttggtcctggtgtgtaaagttaaacattcacacactctatgacccaaaagttccacctctgcaaacatatcccagaggcactcttgcacatgtcaccaagaaacaggaaatttgtgggtatagtcacgtgatggattattatacagcaaagaaaatgaatgaattacagctctgcatgacatggatgaatcttagaaacatactatcaagtgacaaaggtggcatgacactacttttacaaatattaaaaccagcaaaaacttactaaattgtttagaggtatgtatgcacatatgtgataggattgttttttaacaaggcaaggaaattaacacaaatttcaagacagccattactacggaggggtgttgaggaacacagcagggaaagagcccctagaacattacaaccatgtccatagctcttaagttgcatggtggattcaatctaaaatatccattttattattatactttatatgtgttccatatattattttgtgtatgtcggatatcacataatttttgcaaaggcggcagcatgggacaggtcatgcagggccttgaagccatgataagtattttggattttatctaaaatgccatttgaaggtgacacaatctgattcttcatttgaaatattactcaggctgctgagtagagaatgaatatcagggagttgagaatagatgcacttaggcaaggaggacactgttgtcatgactccagggaaaaagaaggtgagaagtgatcctgaacgcttgttcrggatacattttgtaggcagaaccaagaggactcattgatgggttggattgtggggtcgaagggatcaaagatgacttgaggttttttatttgcacaactgcatggataaaggtgccatttgctaagtcaaatgatgaaatccaagacaaaaaagtgttcagcatggaagaagggagtggaatttaagagttacacattgcatttgcacatgctccagtaggtaatagggacacataagtgtttgaactgggaagtagtataatccgagttgcagtataggaaacagatctagccgcattmcaccaagtggattgggtagggagagatggagcccgtggttgcggggtgtcgagttgtacagtgaggggctggtggagggttaaggtagggaacataactgagcagagcagggagggagggtggcagttcgttcaacagattctatgggggccatatctgtaaagacaagtctcccatccttaaagaatttgcaatttcattgaggaaaggaacacacacacaatatttaatttgcactcttcttcacattttgtaaaatgytgtcaaatccgccatcacatttgagtgtcacaacattccagtgtgattgtggcaaggatggtcatccccactgtatccttaggaagactaaggttwacagagttccatgcagcctgycctgagtaaatgcagaagccagaactcggatccagggtcttctgaytctgaatcagccaccgtgtccacaacagagtgtaatattacaactttgttcagggtattagatgaggccttgtggaggaggcatcctatcaactgcctcaaaggargaagaaaatttaaccaggcggagaatcagaaaaagagttttgcaggcaacagtgcggkaggagttgggccatgtgaaagtggtcaagggacagacgtaggaagcaccgctgaaaggaaggggctgatgggactttgtatcttgccgcaggttggaagcacagtcctcttccgttgtcaaaaaggctacctgcttcagggctccaccaccaggacctgcctcccaaacctgacctggagtggaaccccacctgactgtgtccgtgagtgcagacttcacccacatcccaagaaaattcctcttgccccagctgggcatctgggtcatgtttgaatgctctgaatgacagggagttcacaactccccatgcgaaccgacatcggtctctttgtagtccttacactttggggcctcacagaagacttccacacaaaagcctttctgatattggaaggcaatccctatgccttagcaaagaaaaaactatccagtggcagcagcaaaaactaacaactgcaaggccaggcctcaggatggagatatcaagcttttgacccagttactcctttacccctcaggaagtgctgcaggcttaagttcccccaactcagagtcaaccaagccgatatccacatgatctccatcttggccattcctctagacacagagcttgggttagggtggaggattagggagggggatgcttggcatgaaagggactggaagggaaaggaagaggatattctatctaggaacaggggaatggtcgaaagggcccctgaagcccctaatctcctccagtccaacagggyctttcctctcatccagcccaccactgcaggcagccakagacgccaacgcatgccaacgtcggggccctggatttgccctccatgggctacacgctcatctactcctgccaggagggcttctccctcaagggtggctccgagcaccgcacctgcaaggcggatggcagctggacaggcaagccgcccatctgcctgggtgagtgtgcctgctcggggaagctctccagggcgggaggctgaaagtgctggctgaacttgagctgaaagagggcaaaagagaaggaaggaattgcgtttcaaggagctggatcccgcttctgattttctaaggttttgagtmtagaagagcaaagcagagcggtctaaaaaggtgcatactcaacccaccccaagggttgccccttttgcctgggctgaaacactcacaggatcacatttcatcatcaggcagaggaaagtgctttcttccaccaaactggagtgacgcattacacatattgcacccttgataaaacagcacccgcctgtaggtcccttggggttaccaggatgtcccagacctcccttcccctcttcttcattcactcgttctctatttattgagagttcatgtggccccatgcttgcgctaggcatgagggattcagaggggaaagacacaaccctgccatgtggaagacagacacgttatcagattttatatttggagtacttggaggaacatggagatgtgccaaatgctgtaggaatgaggaggaagggcactaaagtgggggaaaggagaagtcagggaggacttcctggagaaggtgatgtctgagtccagtcttgagggaaaggattaaggttaaacgattagttcagtgctggaatagcattaaactctctgataggcactcacctcaccagataccaggcattgtgctaartgctttgtatgtttcaactcatttaatcttcacaagatcctatgaggctatttaatatatgaggaaactagggcatagagaagttaattaatgtgtccaaggtccccagctgagaaaggttaagtgctgaagatctataccctgatggtctaactttaggatctatgactattttgctatcctgccactcagagggaagccttcagggtcagagactatatcagagctagaacttactaacggtgttttattttcatggtatcacttggaaatttcttttgttttccacatacagtagtgatataaagtacatttattaaagtacatttaagtttttattgtgatagaatatacataatatacaattttaagtgtacaattcagtggcattagttatgtttatgatattgcacagccatcaccactatccatttccagaattttttcattatctcgaacagaaactccatacccattaaacaataactgcccatttcccccttctcttagcccatagtaactgctatcatacttcctgcttctgtaaatttgcctattctaagtacctcatgttagtggaatcatacaatatttgttcttttgtgtctggcttatttcccttagcataatgttttcaagatttaaccatgttgtggcatctgtcggaatttctttccttcttatgcgtgaatcatatctcatcatatggacatcactttttgtttatccattcacctgttgatggctgtttaggctgtttccactttttggctattacaaataatacttctgtgaacatacatgtacatgttttgttttaatatgttttcagttctcctggggacatatctaggaaaacagtaactctatgtgtaatattttgaggaattgccaaagttttccaaaactcttgcaccatgttattcccaccagcaatgcatcagggtccaatttctcgacatccttccccacacttgtccatcctgttttagtgtatccatgatcagtgggtataaagtggtatctcattgtggtgttttttattgtttgtttgaattttcatccaattattttttaattgacaaataaaagttgtatatatgtagagtgtacagcatgatgttttgatatatgtatacattgtggagtggcaaagtcatgttaattaacatatccattaacttcatatacttgccattttttgtggtaagaacacaaaatctactctcagtaattttcaagtacacagtgcattgttattaactatggtcaccatgatgtacaagagatcttgaacttattccctgtctaactgaaattctgtgccctttggccaacatctttccaattccaaccccccagtaccaccccaccctagcccctggtatccactattctactctctacttctattaattagttcaattactttagattccacagataagtgagattgtgcagtatttgtcttaccgtacctggcttatttcacttaacataatgtcctccaggttatccctgtggtcacaaatggcagaatttctttcttttttaaggctgcatagtattccattgtgtatatattccatgttttctttatccattcatccactgatggacacttaggttgtttccgtatcttggctattatgaataatgcctcaataaacatgagagtgcagatatctctttgacttactgattttgtttcctttggatatatactccataatggtattgctgtatcatatggtagttctatttttaattttttgaggaaccttcatacgttttccataatggttacattaacttaaattcccactaacaatgtgcaagagtttccttttctccacctccttaccaacacttgttatctttaatcwtatttataatagtccttctaacaggtaggaggtgatatctcattgtgggtttcacttgcatttccctgatggttagtgatgctgagcatttttcatatacctgttggccatttgtatgtcttcttttcagaaatgtctattcaggtcctttgcctgtttttaaatcaggttatctattttcttgctatcgagttgttttagttccttctatatgttccttagatgttaatctcttaccagatgtgtggtttgcaaacaatttctcccattccayaggttgcctcttcactctgttgattgtttcctttgctgtgcagaagcttttcagtttgatgtaatctcatttgtctacttttgcttttgttgcctgtatcattgtgcaaaaatgatttatatttccttaatggctaatggtgctcagcacttttttatgtgtatgtcttccttagagaaatgtctattcaaatcctttgtccattttttactgacttatctttttattgttgagttgaaagtgttctttctctatctaaaatacaaggcctttataaggtacatgatttgcaaattttttcccatttcacggggtgtcttttcgctctcttgttggtgttctctgaagcaccagtgtctttaattttgataaaatctaacttttctattttgggggttgcatatgcttttgttgtcatatctaagaaactgtgatacatccaaggtcacaaagatttatgcctatgttttattcttagagttttctagttttacttcttagatttatgtctttgatccattttgaattaattttttatgatattaggttagaatccaaactcattcttttttatgtggctatccagttgttccagcaccatttgttggcaagactattctttccctgttgaattgtcttgacactcccgtcaaaaatcatttgaccataaatgtatgagtttatatctggattctctattctattccattgatctctatgactctctttatgccattaccacccagccctgattactttagctttgtagtaggttttcaaattggcaagtgtcccagtctgggcaccctagggagactacatgtctacaaaaaaataaaagtaaagaaattagccaggagtggtggtgtatgcctgtagtcttagctattcagaaggctgaggtaggaggttcacttgagcccaggatttggaggttacagtgagctatgattacaccactgcactccagcctgrataacagagcaagactttgtctctaaataaaaataaattgttttaaatgaaagaaaacaaaaaatattgggacgtatcaattatccaactttgttcttttttaagactgtttgcctattgttttgccttttgtttctatacagattttaagattggcttgtcaatttctgcaaactagagagctggaattttggcagaaattgcattgaacctgtagatcaatttggggagtattgccatctgaacaatattaaggtttccaaaccatgaacatgtgatgtctttccatttatttagataattaatttctttcaatgatgctttatatttttcagtgtacaagtcttgcatttctttggttacatttattcttaaatatttttatctgttattatagctacttttatttaaaaatatataatgttttagaggcagctgaattcaacccattactgtatgatcttgagcaagccctttcatttctctgcctctcaaaaagtttctgtgctataaaatggggaaaataatctctacttcagagtttcaagagcaggaggaaatgaagaagtgcctatcacagyacctcgcacataagatgctttctccttctttgctccattcatcttatgaaacctaagacgataaagcattttgttcagaagtacacttgcattgagtcactgcagaaactttctccacagcattctgtgtactgaggcataggctgacctccagagttgaaggagatttgctaaagctgtgctccccgccaaggcagacagtggggagtctgcccttaatggcgacaaggcagattttctattgtttctctgcaaaagaagaaaagacattaatacttactggtcatgactttcctgttcataacctcatttattcagcatagacctgtgaggtatgtttcagttttttccaggtttcaaatgaggaggcaaagactctgagtggtgaagttactagtcaagstcacgcagtcattaagtggcactgctgggacctgaaccttggccgtctggcccaggcccaaagcttttgcctttgctttgcctgtgagggcttcttggtcttaatctcatcattccaagggaggaaggygctcctctgcaacccccaccaggactcacagagttcaccgttgatgggtagaagttcttccttcatgcgaggcatctggaagaaaagcaaagtcgagggcaggactttttttttttttttttttgagacagagtctcactccgtcacccaggctggagtgcagtggcrtgatcttggctcactgcaagctccgcctcscaggttcacaccattctcctgcctcagcctccgcaaagttttcaatgaggacattcagggagtctgtgcacttggatgggaaaatatacaccttttattcctttacttcttactgaaatgtagcctctcctttaatttggaatgtagacaacaacccttaggagtgttagcacctgtgactttgtcaccagtagaaattgaaaagacttttgtatatattccagttgctaccaatatcatgaatattgttcatgttcctgactacttcaagattatggttatttcttgactcactgctagatcctgttatttaatgcagtaataaagaatcatatataccactatatcctaatgtcttgtctaatattgtaagaactccaactaataaaatggacttcctctgtaattctttgtattttttattctgagagggatccatagcatcattagagcatcaaagcagtctacctcctggtctaaaaaaaataaggggaaagcaagatctcaaagaacccattgacctaaggtcagacaggtggtcattatttttccaacagagtgtgaaccagaagctgaacctgttttcttccactctttttccccagcagaggtccggcccagtgggagacccatcaacactgcccgggagccaccgctcacccaagccttgagtacgtatggtccagatcattggctcaagaaactggtgttacttttttcacacagttagccagaaaactcgtgttgctgagagttgctgagtgcctagaggaagggcatgaaaactatctataaatctggatggctttccctacccacctccccagcccaggcagacttcagaagaaagtgagcctgaaggaagcagaaacttcatctggaagaaagagccagcaacttccaactggaagctctggaactgttgattactacagcccctcctggcataggactggccagtgtgtggtcatacaaacacattgacccaggccatacccagggagcttcctggaaatggttacagtttaagataggtctggggtctttccaagtatcacatccagaactggacacagactgcagatgtggcctgaccmataccaaattcttagagactatcacatcctttcatgaaccttctacttttatttaccacattaacatgtgtattatgcaggaaacgaggctagatttggcatcagaaactcaatttgagtaccattttggtcactgaccagctgtgtccttggacgaatgagcttcgcctcttaagcttcagtaaaatagagatcataataattgccatagagaatgattacaaggataaatgacaattttagtagctatcactgattaggtgcttttacacatgcaacatcatgtaacatacaatttacaacattagtcatttaacccctagaataaccctgataaggtagatgggatggccaccatgtataggaatacaggcatagcctatacagggagaaagtcaaggcttttgcacatgatcagacaactgataagtgacagagctaagattagactctgggtctgtctgacttcatttgcccatgttccaattcaccatgctatactgacatgtcagttttctctctcttctcccctcttccatttctccatcttttaaacacctttccttttctcctcccttcttctgtcactcctttctagttccctctctatatctttttaaatattttaattttaattgacaaataataaacatatttatagagtacaatgtgatrttattctatatgtatacattatggaataaataaatcaagctaattaacatacccatcatctcacctaattatcatttttttgtgatgagaacatttaaaatctactcttttggccgggtgtggtggctcacacctgtaatcccagcrctttgggaggccaaggtgggcggatcacctgaggtcaggagttcgagaccagcctgaccaacatggtgaaacctcatctctactaaaaatacaaaattagccrggcatggtggtgcatgcctgtaatcccagctacttgggaggctaaggcaggagaattgcttgaacctgggaggcagaggttgcagtgagccgagatcacaccattgcactccagcctgggcaacaatagcaaaactccatctcaacgaaaaaactactctttcagcaattttgaaatgtacaatacattcttattaactatagtcactatgccatgcagtagatcaccaaaactcatatctccagtctaatggaaactttgtaccctttgaccatctccccatcaccctccactctgccccagcctctgtaaccatcattctactctctactccaatgagttcaacttttttagattccatatataagtgagatcatatgatatttatctttgtgtgcctggcttattccacttaayataatgtcctccagttcatacatgttgctgcaaatgaaagaatttccttctttttaaaagctgtctagtattccatagtgtatgtatatataccctttwctttatttgttcattcattcacggacacttgggttgtttccctatcttggacattgtgaatgatgctgcgatgaacatgggagtggatatttatcagttccctctatccatccactctgagacacaagacgagaagaggccagagcattctaccaccttcctcacatggtagacattggggaaaggaaacaatcccagtgagtgggctgggatcagtcatcaggctaccccaattctggcagcacacacaaagtccctctcacatctatttctcaattcctctagttcctggggatgtttttgccaagaattccctgtggaaaggggcctatgaataccaggggaagaagcagccagccatgctcagagtgactggcttccaagttgccaacagcaaggtcaatgccaccatgatcgaccacagtggcgtggagctgcacttggctggtaaggagcaggcccctctatgaaagccgggaggatggatgggcacacacccttggcaaggatgagcctaatggcattgcatcatactgtcatgcaaggctcagacttgtctggtsgtcagggaagaggaagtgtctattcatctttacatgataaagcactgtggactaaagggaaatgtttaaatggcaaatattaataacctgaatacataaagaactcttatgaacaaagagaaaagactgatatccctaaactgaaccaaaaataggggcagagacttcccaggatcccaagtacaatcagtcaacaaacaaaagaaaaaatatttttcagcaatcatcaaaaaaaaagtaaactcaaaatgtcattttccacttacaccatcaactcagagtgtttttaaacaataacacttagtgcaggtcgggttcagccatgaacgccaaattctaaaatggtaccattctgggaaaacaatttggcgatttgtgtcaagatccttgaaaatgattggacccattaattacatttctaacaatttttatcataagaagatacggagggagtcaaacatttatgaataaaggctgttcccattacaaggccatttgtagtatataaaaactggaactagaaaatttccctaaaatagagaaatggatattttaatgatagtatatctactagatgaaatattatgccagtgttgagggaaatgcattcattataatgtatttaaaatatgactccagtgttttaaaggaaaatattacattcataagaaagaaaacaggaataatttacagtaacgtggttatttcttagtaagatcaggagagatcattttttcttcatgcatctcagcattttctaaaattttcccaattttcaatctttctataatcagaaaaagtaagtaccttagaaaataagtgtttgttgaatagatggatagataagcaaatgtgtgagtgaatgaacatattaatgcacaaccccacataaaatcctatctacgcattcatacgtgcacacacctacgcaactgcaggatgacatttgctcatttcacacatgataatagacatgttcacatgctcccatgcccaggacctcatgaactattgcacccattgaactatctatgcattagtggacagattaaaagacaaaatcatattctcacacatgcctgtgtcaatagcatcacaacctcaacccggtaatccaattattaacatacatatgcatatattaataattcttgcatataaccacgttcagcctacacaaacccacactcaacactacacttacgacttaaagggatgtggagaatgtttatatcaacatctacacatgaaattccatccagaaacttacacccacaaacccacaaatttgagttttgaaattttcccatatctttcatgtgtaacacctgaactttatttcccaggaacttacaagaaagaagattttcatctcctactccaggtgtaccagattacagggcctgtggagatctttatgaataagttcaaagatgatcactgggctttagatggccatgtaagttcagcaaactcacctcctcccctgactcccagatcactggcagggaagaggaggacaaaagggtgtgcaaacccctaggatcaatctggcaacttgggaggaggttttctgtggggccctgcctaggagcagcaagaggatcctcatctgctaatgaaataggcaaaggaaaagattttaaaagacagaagactcagagtccagaggttcaccacattcaagagagttggagtaagttctgttgtttgaacagaaagcaagggatggaggttgggggcagagggaattcaggctagttgaaggtattaatgtggtgggtgggagctggaagaaggcagtgagtctcacatgactacattgaacttctcctcacacttgaggatgcagattgtgagtgattaacacagcttgagagaccaggacatggcagagggataggactttcttgcattcccttgtggaaaagacattctattctagggctttcttgaggtggaagctggatctccagtgacacttctctggccataccttcctatttcacacatagtggagttgagcatagcatcccctaccacgtcctccacttctctgtcttggattgctggagctagaagagaaaggatagaatgaagcgagaggtcatggtagaccagagtagcagagagctagggagtcacagtgcattctcatggacaggaccagctggtggaggactgtggcatagttgactttgctttataaacacatcaggagaaccaagtggcttctccaggggctggcacatacaggtagttccttggtaggcccaagggtatctgtaggtccccttcataatccaagtatgggccagcttcaatcatcgtggcccaaaagctgtgcaggaacaatagactccaccatccaggagggtcaaagttgggacatggagctagcagtgcaggccaggggaagatgaggatggggatccagagggccaggaacagctggagctactgcctaggacgccagacaagcgtsgagccttttgatagccagcaaggtgtgtttgcggggacagctgcggagggcagacagaggctgctcctagccatggagcataggttgggagtacccaggagcrcaggcatcctcacagcatgccctcagccgctgcggccccagactgcacatttgggggtctgcatctgtcacatgagcatcagtagcaggagttatgtccccagctacgccccctaaaaaattaatagctcttagaactgtgacgaactctccaatacctttaatctgcaagggacattttcagcatggttctgtgtgttccataatgctccaaaaggcggtttttcatcacagtaataacagctaccatgcatgtaaggcctataaattaagtgttctgaagtatttcatctttattaactcatttaatccttacagccaccctatgacataggtactgttactattctcattttgcacatgacaaactgaggcacagagagattaagtgatttgaccagtagaaaataaaatcttcctcctacctcatacatgtagctggtgcccctgccccaccccgggctccccggtcacacccacccttgcctaggtgtgggcagagaacaaaccctgtgtgtcagagcagcaggtcagtgggtgacctgctgggcagcgtgtatgatgagagaggagttmtagatccttccagcagcctcccacstgctctctgtgctccccaccatcacaggtctcgtcagagtcctccggagccacyttcatctaccaaggctctgtcaagggccaaggctttgggcagttcggctttcaaagactgggtaamtagtgcttgtcccccgraagtgtgggcccgggtgggtgggagagaaaccgtgtgtgccgtggtcaggtagaggactggggaagttgaacagtctgaggcgggggtgctttggcctctttgggatcagggatgcctcttgagattctgacaaaagccatggaatatctctccaaaagcaaacacatgtgcataacccactcaacctttgwcaaagtttcctgttcagacctggagaggagagcccccaactccagggacattggctcttagatacagcccccagccacaccctccagccagccctgkgtgtsacccctgcctcaacaaacaacgacactgtggagtgtcttagagctctcagggtgccttgactgtgatgtcgtttctgccctagcccagccctagaagactggttttgtgcccattttacagataagaaaactgagcattaaggccacttccctccctggtccttccctggcctctttacctagcgtgcttcctgtcatccatgtcaaacatccacaccttggagccttgtcctggcccagagcctctgggtgcccagcctcagactctggtggggggaggggtctggtttctcagaagcaggggagggggaaacaggaggcagccgcaggtgcgtgacagcctctstgtaccccaggcactgacacctcccatcgccggggcccttgcctgccaaggcagtccactccatgtcctctggctccaagctcctgaaagcttctctggactgagccacggtstgctcccaccctttcccacccacastgctcctcccccggagttgtcccagctctgccctcatgagstgcatggactgagaccactgtyttccacacagcacccttcacctactgcaagatggccaggcaygctgcaaaggccttagaaaatcacagtttttgttctggctccacagcagacatcctgtcccctctcagagccccagcccctcagttagcagggtgcctactggggccacagtktctacttgtgttcttctgagccttcccagtctgcaggggagggtgaggaaggaggagaggcagcctttcagaaggagatgcttcagcttcaaccagaacagtttcaccttcatctgtcttatattttgttgtgcctgtaaggtttcatctgataaaaggctgctacagccaaaagaactttagagacttctaaagggctgcacccttgtaaragtttstgttgagccatggtttcaggctcctctgcggatggtcctctgggtgccatctgagcagcacaaggtagatgcatgcaggaccctgcccccaaggactgagtgtgcacgtggaggcaggcgggcagccctgggcacacctgcctcccgtgmtgagcaggagtgaggagcaccmtgagtggcagccctgcttcccaagagtgtatagtcggggagggtagccaacggagcctcagactgtgtctcgtgacttgacttttctgctttgggactttacagacctcaggctgctggagtcagaccccgagtccattggccgccactttgcttycaacagcagctcagtggcagccgcgatcctggtgcctttcatcgccctcattattgcgggctycgtgctctatctctacaagcacaggtaccgtgcaggaaggaggcagggcgggcatcaggcaggcctccctctctccctccagsgccccccgcaccagacccctaagcctctctgtgtcgctcttttcatgccgtgggcacttcctcttttatcgccaggagaagacccaaagttcctttcaatggctatgctggccacgagaacaccaatgttcgggccacatttgagaacccaatgtacgaccgcaacatccagcccacagacatcatggccagcgaggcggagttcacagtcagcacagtgtgcacagcagtatagccacccggcctggccgccaccaccgccaccgagagccccgcctccagcagccggtgagcaggggtgtgggaggaagacaggccatgacaagcacagacagggacctatgcgtgccaggggctccacccaayggagtcgcacacaccamatagacacacccagtaagaggagagctgtgcattgagcatcattgtgtaacaggcactgaaccaggccctttgtggatctaatatattgaatccctgcacgccctgtgaggtagaagcttgtgggagccccattacagatgagaaaactgagctgcatagaaactaacttgagcaaggtcacacagctcagaaggggtggggtcgaaatccaatcccaggctgactggctccagaaactgctcctcacccctgggcttggcagaacatcggcatgtactagtctgtttctctctagagaaacagaaccaactggatatatacatcctctgggtcgaagtcaagccctggagatctgtagagctatacagagatgcacatatatctgtgtatataggtatattgtgtatatatatacattcatacactataaacgcaatacatataccccatatcaagatatatccatacctatccatctatatatagatacgcatctccgtagagctatatgtaaatgttatatagagatagaaatataaataaatatatatttagagagagagattcatctaaggaattggctggcaaggtggaaatctaaagggcaggccagcaggctagaaattccagcaggagttgatgctgtcatcttgagtccaaaagcagtcagagacggaattccttcctctttggagcacctcagtctttttcttaaggccttcagctgattgaacgaggcccacacacattatggagactcaaagtctactgatttcaaagttaattttatctaaaaagataccttcacagcaatatccagattggtgtttgacccatcaactgagcaccatagcctaggcaggtttacttacaaaattccccacattgagcacaacagaggggaggagctcccggaaatatagacagggggcagacacacccacacgtgtacacggtcatgmacacacacacacacatacgcatacatgcacacaggcatgcatctgacaggcccactgggaaggaactgatgaatctaaaaggcactgcctcttcctcactgtgtcctccttcgatgacaccctcacctctgggacctatgacccttcaggagttgccccaacacgatgtccaagctgcacccctctgagaactgtcttctcccacacatcccgctttctggggataggcaggtgccccctctcaggtcctgtgctgaaggactctggggagaagagtcacagagccagccaggtagggattcccagtgagggcggtggaaaatccgccaagtgggccaccagccaaacccagggctagtgttgcgctccctccccacgctcctgtgcatggccgctcacgtggcagattctcccagccacacacaaatggcagtgcagcgaggaaacaggcttttatgagggtgcctgcaaaggccaccaacagagatggtggggacagttcctgcggagggggttacaagagcagcaaatgtcattatcactgcccagcccctgacgtgctttactccctttctgcctcacaactcctggaggatttcacagtttcagcctgagtcccagatggtgagtgagtcagggactcagcagatgcagctcctgaatacaaacaatttatggaaagagcttttccccatctttttacgtctctccaaaacaaacatttaaataagggttcccccttattccagtgggattgttttagcatgccaaaattactcctcaagtttcatctgtatgcccaatctttattttttccttctcagaactcttatcaatagaaggcaaaagagaaaaagaaaaatcccctctgatgatgtaaatcggggcttggagatgatcagtgatgaatctgattcactgcatgaattattgaacagtgtaagaaagaaacaagaatgccrctgacctccacacagtcactcttrctccacacctgggttctgctgggttccaggtgctggtgtgcgccatgctgtcacctccrggtcggctggggttggtggctccacatctggccagccctcagcattggccccttgccagcaggctctgaacccactgcccagcccacaggtctccagcagggcccctctgaccacttctgcccacagctggagcataaagaaagcaagagccaccctgaacagwcacacacacattgcaaatgagtgactagatggtaatttttttttaaataatgccaaggagaaaagctgaaattaaaataaacaccctactaaggaagcaacgaggcctgtgcggtcagtgagtaacagggcgggggaacagggctgtgtgatgatgtttgccaacccttcctccattaaaaaaaagtatcaaaaatgagatttcacaactgtgtcactacaaaaatgaatataatccagcctggattctttattacagagccattattatcctagtcatttttttttttcatctgattttgaaagaaactaaaattagaatgttttcctgggttcctaaaagtatggtggcccccaagcactgggcctccaggtctaatggcgaagttggccctgcaagggaaaaagacagaaaaatacatgttctgctgcacgtattccctacctacccccatccccaacctgggaagattaaaaatcaaagtgaagattgaggtgactcatctctttcccgcttgtgccttcttttctttgccgctttgcttttcctcctctgctcccggcccctcccctcccactgcctcttttttctttgcaaactcaggtgtgatctgtttgttcccagttccccagggggcaggaagtaggctcccctgagcacagtgcccagtgcccatcttcgttcgtctccttgcctgtgtctgctactgctgggactcaggccctcgccctgccgccatctatgccagttaccctggagaggactcctgccgtgtcctgaaaaggcagaaaaggaagaggggctgcagacagaggaagaaagtttatggatttaaaatagcaaagcaacttgtggatctgtgtgtgtgtgtgnnnnnnnnnnnnnnnnnnnnacacaccacctctccttcattcacgtcctatggaagagaccataaaggcttcaaaactagaagtgcgcatgaaggatgcttcatgccctgttccccacacagagaagagatgaagagggggaggtacrgtcagctttcaaaacaatatgccccccgcccatcccatgtgtgaggacatggtgactcggtgactgtaacagtaggacacatcccatcatgcggtcagagtgcagaaacccggtcagcgtgcagaaaccagctgtctgctgatgaacggcccatctgcacagcggcagcaaggattaccccaagggcaggaaaaaagtctttggaaatagattgaaaatcagtttctttatttttttcaaacactgttttattgagttctaaacccagtggattaaaaagtcatttgggtcctgggaagcactgggaaagaagggagagccggggaggatagggcaggagtctggccaggagcccaaggtcaagtctggctgtcaactgacaaagagaagagaagacaagtctgtggcccagacaggrtgccaagtctgggggcagcagcagggtccttgagagaacaggggagcaagcctgccccagtacccaaaaaacaatggctatcatgtactggggttattctctgtgcctgacactttacctrtagtatttctagtctgcacaataacaccaaaatgtaggatttgttattcccctttgacagatgagaaaacagaagcctgcaaaggtaaagacagagttaggaagtgtggagtcagaatgcaaacccagatcagtctgccccaaagtccactacaccagctgccagaaaccctgttctagaaggggcagctaagaagggaggagccgatgaawctctacagtagcactgtggccaggtctggaaagccaggcaagacacctgtgtgtcctatctgggttctgctgtctccgcgtaggcagcttcggggcaaggattcaactccccaggcctcccacggttggtgctggctccttggctcccagcagccgctgaccatagccagcaaaagacctggcaggtcctgaatcaaaacaacagagtggctgaaagtcacacctctccagctccttgcgagtgggtttgattgattttgacagctatatcatgcttgggtcgttcatgaattccatgagaattgttgggaagttcatgagtttaggaatcaaagtatagcatttagggccactttctctgtcctcgggaaggcccccacaagcttaagcccctgtatacgtgtgacatgctggcctcagagattcatgtcacatattgaaatagcaaatagaaatgtgcaggagcggagggacagcgacacctggttcttaagcaaattctagattggaacaattagaagatctgactgatgttaagagtggccagaggaaagtgagaggcgtccatttycagcagacacaatggaggctgacagaggcaggagcctacccctggccacaccacctctgggacacggcacccccctgggcctggagggagagggccaatccagacacactcacactctcatctctttccttggctggaaacaagtgcaggaagctcccctcccaatttcttatgctcccttcccccttacactcctctccttcgactgctcccttcccccttcttatgcccctctcagaccacccagcggatgcctattcccgccccccacccctcccctgcgtctccttgtaaagttccatgagatgctcgaggagcacctgctggtggggcacccagcactctgctgggcatcaccctccrcacccctgacatttctctccacctccagaggcttggaagggaacagggcagatgaggcccttcacccaccatctacgccatatacccatcaccatcccatgaggaaaaaaaaaaaagtaaaacaaagacaaaaaaaatcttttgtacagagatatatttttattatacaaagtttgtacagtaccaaaaaagaaaaaaaaaaggtgtaaatttttttttcattattgtaggtaaacggtagtggaagccttttttgtaaatgtaataaaatgtataaatatggttttcagaaaacatcaagtgctgtaaatatgtaatctacacaccttcttggcttgtctgcagtatatacatttaatttatctgtctctgtatatgaggcttccccctggggtcctgcattatggtactttcctgaatttgaaagcaattttaaattttttgaattcaaataaaatataaatttttgcattggttttcttacatttttatggcctctttcatgactaggggcaagtgtttgttgggaaagggaaagaaggacatattttcgcctaaaatccaagggtagaaatatgggagtccatttcttaactgcattgtgttatcactgctacatgttggaaactctgagcaaaaatgatagtgcataccccacataaaaaaagttaactcaaaatggatcaaagacctaaacataagccctaaaattataaaatgcttacaagaaaacgtacgtggaaaacttcatgacattagatttggcagtgatctcctgcatatgacatcaaacgtataggcaacaaaagaaaaaacagataaactggactacatcaaaattcacaacttctgtatatcaaaagatacaatcaacagagtgaaaaggcaagctatagaatgggagaaaatatttgcacatcatatatctgataaggggttaatattgagactctataaagaactcttatgaaagacttgaacagtcatttctccaaagaaaatatacaaatggccaacaagcacacgaaaaaatgctcaacgttactaatcattagggaaataatcaaagccacaatgagatgccatctcacacccattagaatggctactatcaaaaaataataagtgttggtgaggatgtggagaaattggaaccctggtgccccattggtgggaatgtaaaaaggtgcagtcactatggaaaacagtatggcgatttctcaaaacatcaaaaatagaattaccatattgtctagcagttctacttctgaatatatacccaaaagagttgaaagcagggtcacaaaaagatatgttaatagcggcatttattaacaaatgccaaaaagtagaaggaacccaaatgtccatcaacagatgaatggataaacaaaatgtggtacatatgtacaatggaatattattcagccttaaaaaagaaggaaactctgacccatactgcaacatggatgaaccttgaggatgttatgctaagtgaaataagccagtcccaaaaaaaaaaaaaaaaaaaaaaaaaaaaaaaaaaccagatactatgtgattctatttataaaagctaccttgagtcatcaaattcatacagaaagtagaatggtggttgccagggactagggggaggaaaggatggggagttactgtttaattagtataaagtttcagttttataagatgaaaagtttctggaggcctggaagccctacgcgttctactggttttaaaacaaagagctcaattgacaccaggtatgacttgtcagtctctacattctctcctgatggaagagttttttgagttgaatatgctgtgaaggctgtggaaaatagtacagccactggactcagatgtaaagatggtggtggctttggggtagaaaagggagtcttcctaaactttatgaagaaggctccaacaaaagactttttaatattgattggcatgttggaatggtggtagcaggtttgttgacagatgccccttctttggcagatataacaagagaagacgcttccaactttagatctagctttggctataccattccacaaaaacatcttgcagacacagttgccatgcatatacactctgcagtgctgttagaccttttggctgcagttttacagtagggtcttacagcgtgaacaacagggcacaattctgcaagatgtttcgtatggttattggggctgtacccttggcaaagccaggcacgctgcaaagatagaaaatagaaaagcttcaggtgaaagaaatgacctgccatgttattgttaagaagttgcaaaaatatttacatagtatatgatgaagttaagaataaaccttttaaattagaactcagcagggttggtgaattaactaaaggaagaagacatgaaattattccaaaagatataagggaagaagaagagaaacatgccaaggaatctttgaaggaagaagatgaatcagatgatgacaatatataacatttactccagcatctattctattttaaatttctgctacagtcccaggttaacatttagccccctgtggattatacacactcactaaccaattttcattaaatgtttgtattgtgaaaaaggagaaagaaaagttctggagattgcacaattacgtgaatatacttaatgtacttgatgccacttaacaatggttaagatgatcaattttatgttatatatattttaccacaatacaattttttttaatttatagtggaggccacatcagctcagaccaagaacctggggacaaagaagttgctcccctcagggttggagtttggcttggactgaggagctcaggatctgaggaccgcggtctaagggcaggtgggcttaggcagtagaaactccatagcagagaaaagccaaatcaaggagggtcatccaggcaagacagtcatgagaggagtggtgaggaagaagaggaaagaactggcaagagctagtaggagcctatcctttcttaaatgtactatgcatttgttagcagtcatcattttaggtggaaaattcatccagactaccttcagttttctgactcccactacccttcacttttgcactgtacctcggctccarctgccccccttgtcacctcaataacctgatttagaccaacattcccagttttttgtttttgttttttttgagacacagtctcactctgtcgcccaggctagagtgcagtggcacaatctcggcccactgcaacctccacctcccgggttcaagtgattttcctgcctcagccaccggagtaggtgggattacaggcacgcgccaccatgcctggctaatttttgtattttttttttttttgtagaaacggggtttcagcatgttggccaggctggtctcgaactcctaacctcaggtgatccacccgcctcagcctcccaaagtgctgggattacaggcgtgagccaccgcgcctggcccccagttttaataaaggcattccatcttggacacgctgcctggcatttctctcctggacacagggaatcagcagggtgggtgtagtcctcccactggaacctcaggtagcttggcagggattcagggtcaggaattggactgttgtccaacacaagctccggttggattgggaatcaagagagcaagggagcaaatattaagtctaagttcagaagacaagttcataccagcatgcaaatatgcaaacactttataagaaaatagcagatgggctgggcacagtggctcatgcctgtaatcccagcactttgggaggccaaggctggtggatcacttgaggccaggagttcgagaccatcctggccaaccatggcaaaactctgtccctactaaaaataaaggagaaaaaagaaaggaagaaaagagcagattgctggacaccacatagagtggggaaagacttccaaacatcaggccaggacaagttttcataagccgtagggcatagatagagggggcaagcccaaactacaatgcctgtgagacaagctgcaccccacaagatctacctataccaagagaacagagtgtccctgaactaagaaatcaaataaacactaacaccactccattccctcactccagcagaagcacctgttattgctggtctaggaaaatcctacacatttcttttctcacggacaaaaagggttcatggacatatcttcaaagcttctataagaataaaacagctctccctctccctctccctctccctctctctctccctctccctctccctctctctctccctctccctctccccacggtctcccactccctctctttccacggtctccctctgatgcccagccgaagctggactgtactgctgccatctcagctcactgcaacctccctgcctgattcccctgcctcagcctgccgagtgcctgcgattgcaggcgcgcaccgccacgcctgactggttttcgtatttttttggtggagacggggtttcgctgtgttggccgggctggtctccagctcctaaccgcgagtgatccgccagcctcggcctcccgaggtgccgggattgcagacagagtctcgttcactcagtgctcaatggtgcccaggctggagtgcagtggcgtgatctcggctcgctacaacctccacctcccagcagcctgtcttggcctcccaaagtgccgagattgcagcctctgcccggctgccaccccgtctgggaagtgaggagcgtctctgcctggccgtccatcgtctgggatgtgagaagcccctctgcctggctgcccagtctgggaagtgaggagcgcctcttcccggcgccatcccatctaggaagtgaggagcgtctctgcctggccgcccatcgtctgagatgtggggagtgcctctgccccgccgccctgtctgggatgtgaggagcgcctctgcccggccgcgaccccgtctaggaggtgaggagcatctccacctggccgccccgtctgagaagtgaggagcccctctgcccagcagctgccccgtctgagaagtgaggagcccctccgcccggcagccaccccatctgggaagtgaggaatgtctccgcccggcagccaccccgtctgggagggaggtgagggtcagcccccgcccagccagccgccccgtcccggagggaggttggggggggggggtcagcccctgcccggccagccgccccgtccgggaggtggggggcgcctctgcccggccgccccttctgggaagtgaggagcccctctgcccggccaccaccccgtctgggaggtgtacccaacagctcattgagaacgggccatgatgacaatggtggttttgtggaatagaaaagggggaaaggtggggaaaagattgagaaatcagatggttgctgtgtctgtgtagaaagaagtagacatgggagacttttcattttgttctgtactaagaaaaattcttctgccttgggatcctgttgatctatgaccttactccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccacctctgcgagaaacacccaagaatgatcaataaaaaaaaaaaaaaaaaaaaaaaaaaggattaaaacagaaaatgagtagtaaagacattgtaacttgggtatatatctaagagtggaaaagagaaaaaaagcaaag

SEQ ID NO: 12290 - DNA, 28338 bp, Homo sapiens
  misc_feature (1)...(28338): n = A,T,C or G, or insertion/deletion polymorphism (see Tables 1-2)
cgtcagcacgctagtgacatggcaggtgaggaccacggcaccgcccctgcgatctggcagtcagagcccacctgtgtgtctgcaggagcatccctgactacacaccacgggacggcagggaagggtccctcgggccccacccctttgttctttcaatggtaaaggttcaggtcggtggacagactggacttggaaacaccttcttgcgtcctcgaaacgacgtggcacgcagccagctcacagcacccaaaggcacgggcaagttgcatcacggcagcccctcctgtctgaccaggagcaggtgcgttcctgaggtcctggccacttctgcaggagcgtccgagggagcccagctgatataccacagcccctgacctcccaggttagcctttccatccaacagcaccaggactggacaggccaccttggctgaggatcacgtgtgcctgggtctgggcggtgctgatgcccacaggccctgagtctgtgttgcgcacaggccttggaaagcagtgcacatcctgtctgcaccggtgtctatagtgaagccatctttgtccgtgtggccatgggagggtctgtctgtgctgtgtgtgtgtcctgcgcgcgtcgggagctgctgcgccacacacaggcacgcagggtgtgggcacacctgtgctkctgagcccrcgtgcccttgccggtggccaggcacacacacagctgtgcatccttggcccaagatcagctgtgccacacctgcaggctgcaggatcttttctgtatatctccctccatcaccagaagtaagctcaggactgaggctgacaggctggtctgagcgctgctcacctgcacctcctggctgcacctgtggccccggactcagcttccccatctctctcctccccaccccacctctgggtcatctccggctggggctgtaccacatctgggctcaataaatggttgattgattgatgaggggatggatgagaagggctctaagagaaatgctggggagcctgggcaggcactcccggatggcggaggcggcrtgcgggctggggcagcggcccctggcgcccccacactcccccaggacgtctggggtcaccgtctgctccatggcagccccagggttatttatgacctcctccctctggcggcgggaggcaggctccagcctcagcccagcggcggaggggccccagcagggggacccggagcagcgacagaggcaccaaggcccaggcaggcggggctcggtgggccggaggaggggcggtggagtccacaccgccaggtccctgcctcgctcaggatgattccagcgccagaactccgttcctctggcctctgccgccagcctgaggagtgcaggggagagtggggcccaggtgtcccagaccaagacaggtgtgtgagtggacatgggacacaggtgtggtagtggaggacacgtgtgagcaagtgaacacatcacacagatgtgcgagcagacacaagacatgggacacaggtgcgccagtgaacacgggactggtgtaagccagcgggcatgagacacgggtgtgagcgagtggacacgggacacgtgtgagtgggcacggacagtacaggtgtgagcgagtggacacgagacacaggtgtgggagtggacacaggtgtgtgggagtggacacagaacaggtgtgaacatggacacggacacgggtgtgtgtgagtggacaggaccaaggaaggggcacaaccccgtggaaaagggtgatgctgggggtgaggagcctggtcctgtgggaacgtggcctctgaacgggtgcctgcttcccaggaagacaaggaggtggtggggaaggcctcctcacccagcccctggagggacctccagaacatcagggagtggacagtgaggatagaggggtgcctccagctttggacccagtcagggtcttttctggaagacaccatgggccccgggtaggcccccacacccagccagaaacccagggccagccccatgcccctccttaaccacactgtgggcctgagcatgatgagatgctggtgaacaggggagggctcttggaagggaaaggaggcccctctgctggcccaggtcagaggagaggcctggcccaagggcctcagaccctgagaggcactgccatgcagacctgcgcctccccagcctccctctccaaatcactgtgtgaacatcagggagtcaggtgcaggcgaacctagaaggagggtcaggtgcaggtgaacctagtagcccacacacgggcagtagggtcagggctgcagccagacagtgggcactcagggccagtccacatggcctccagctggccccaggagcagactttccacatggtatcagacctgggagaagacacagacttcaggagaggaaggcacaggaactcactggcagccacagctggggtcagggatgtgctggtgtcctggatgcagacaggttgatagggccaagggtggccacataaggaagggtcaccgacactcacacccacactcctacctggccccccagaccccaacagaccaacgagcccccacagaacagggccaggatagcgggggaggcttctgggcatgttccttgcctgagcagagcactcctggcccagacctcactccgcgggttggctgtgggaccagcagaagcctctggtgagataaggtgaaggagcccagcgtggtcacccagggtcaggtttatgctcaaggaagctggtctggcaggaggtggtggtgggctgttccctccctcgaagaaggcacctgtgcaaacaggcctgtggcccactcacccctggacctgctctgggagatgcccacagggacatgccagctgcatctcaagggcaggggccagggtcagaacaggaggcccctttctagtggatgcaacaccgcacagcagcgcaggacaaggctgtctcacctgctgttaccaacgcccccaggttgtgtttctcttcggaacgctccagatgcaatgccgatctgggcacgcagggaggtggggggtgatgggaagctcaccaggaaccagggactggggcccagactgacctgtcagaaggcaccaaggtggacgtggtgtggccggtcctgcttcactagccttgctcctcctagtgggaggccgtgcactctgccaacccgctatcccccaccctcaccctgcctcggatccacaccaccttcctgctgggaggtgtggggtgacaggaagctcttgccccacaccatggtcctggcgcggtcctggtgtgagacatcctgcatttgaaacagctgtgtgacttcaggagagttacttgacctttctgtctcagcgtcttctgcaaaagactgaacaggaactccgtggctcgggcgaactcactcctgtcaagtgcataggaaggggcacgagtgggcggggaggtgctgccctgttattcacagaacactttgcccaggcaacacactacaaatccacaacctcgctccctgcaggtgcactgagaccacccacgccctcccggacaccaacgcccaccatcagattcgctgcgcaaagtcccagagccgccggcgcacgctcacaccccggcgagcagcccccagctccctccctccgagaggagcccggtccgcgaccagcccagcccatcccagtcccgcgcggagtcctggattccagccgctcgcagtgactcggtactcgggatagtgccgggggccgcagccctgtcccgctgccgccgccggatgccccgagtcggccgtcacgcaccccccgcgggagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcccgagcggcggcgccaggtcacacaacgtgttttggcgcatgcgggcgcttgggcccaagggtgcgacgcgggggcgcatgagccgggacacagggggtgcggtgagcgccaggcgccgcggggagttaaaaagttcgggacctgagcggtgcgtggttccgcggtggccgcctcttcctgccgcgcaggccgagggtcccgacggcgccgctcaccgctccgggactcagcctttctgggcccggcgtgcggttccctcggggccggggagagggtggagcgcgggaggaggggcgccgggtggggacgcccaggcccttcgtcgggggagggcgctccacccgggctggagttgcagagcccagcagatccctgcggcgttcgcgagggtgggacgggaagcgggctgggaagtcgggccgaggtgggtgtggggttcggggtgtatttcgtccacgagccggggagggggtactggccctgccgctgactgcgcgcagaagcgtgccgctccctcacagggtctgcctcggctctgctcgcagggaaaagtctgaagacgcttatgtccaaggggatcctgcaggtgcatcctccgatctgcgactgcccgggctgccgaatatcctccccggtggtgagatgcggggctcggttggggctgggagttactctcccctgcggagcttgtccctgcggttttcagggttttcaggatcgagagtcctaacctcacccctgcgggtgtgctggagggagcctccgaagggcagggggaagcggctttacctcgtgctctcccagcccttctacctggacgggggaggagtcctcgggcacccgagcgccctccccggtggagacaggggggccrcgcttgtcttagagcctccccttgggtgccttttagctgcttatcctcgagtcctgggtcagggtcttctccctgggaggagtaattcaacgtgggcctggcactgtgccctgtcaccgcttgggggtcaccgtgttctctggcccagctggtgaggtgtgattctgggacgacagcattttggggagctacaggcttgggtgtgagtgacttgtgtctctgggtgctgaaggccagagggtgcaagggcctggacgtcgaagtgtgtcctagggacgcagaggctagccaggggcagagtctttgcagtgtgggcctttggtgtccagggaactggagtcggaggctggttcaaggccccaacccagggtagacagctatggacaccctcactgagggagcaggcaggagagacggggatgctgggagctgccttctgctcagggaggcacctgcaccccccacccagtctccagccccctagttgggcagcgagggttagaggattgatctgaaaaggaagaatgcctgttgggaaggactagtttggagccaattagggccatggctgctgggggtgggggctgcaattcctgacacactcaggaaccccttcttccaggaaagggtaggagaggcagaggtgcaaaatgggcctgagggtcccgggcgtacctccgcttgcctgctttgggcctgaggtaggatgggggaggggatgcccaggggcctgtgagccatgagtgccgtagtcagggggctgggcggctgcagacacacctgtgaagacggctggtccctcagacatacagcatgttgggcaggggaaggggacacagccgcacctcacccatgtgcccacctgacacacaatccgacatggacctgcacgcacaggcaggcagctcacagagttcccaggcaggtgtgcagacagccggcagccccctgtctgctgtcacagacctacccggggcaagaggcccagttccctcctttcaagcagctggtgctggagagggctcctctgggcagcccgctgcctagccttgggtctctgtttggatttgagcggcccccttgagggctcccccaggagtggggagcacacagcctgagcccagcgtcagtctcttccgacagtgcttccgtgagcatctcctccccaccccgtggccacagccaggagatgcccccccacctggggctcccaggtccctgccctgcgtgagggayggctcagatccaggcctgcctctgccagtccctcccaggcctgtcccacacccttcccctaggaagcaactccaggggccccttctttccagcccccatgtttcttactcagaggctgtctcccccaagccccatgccaaatccgcaggcatgtgcacctcatggtcacagatgctccggggcagaatatgagtgtgtatgtgccttggggaccctgcacaggggccctgcaggccaagcaccttccaagaggaggtmctgtcaggggccgagttttcagatctgtgtgctgtggccgaggtctctagtgtggaggaggtgtgttctgtccttgggcagggtgggtggcagggaagctgtcctggtcctcagcacccccatcagccactccagacctgccctccaggtgccttggggcgtggctggggtgccggtgtgtccccacgcccgactctgcgcatcacggggctgaggctggtatacagcctgggctccattcccagccagccctggcctccttccaaggggcagtcttctggtccttgcttccctctcttccccatcccacagacaagaagcagagagcaaagcattgtgtcttctcctcaaaagaagggaggtgggaggccgggtgtggtggcgcatgcctgtaatcccagcactttgggaggccgaggcgggcggatcacaaggtcaggagatcgagaccatcctgactaacacggtgaaacccgtctctactaaaaatacaaaaaattagccgggcgtggtggcgggtgcctgtagtcccagctacttgggaggctgaggcaggagaatggcgtgaacccgggaggcggagcttgcagtgagcccagattgtgccaccgcactccagcctgggcaacagagtgagactccgtctcaaaaaactaaaaaagaagagaggtgggagaggagaggctgtcagagcctctaagccctggtgcttgggctgcagaagggcagagctaagcgggacttcccagcacagcacactccggacaggctgtggctgttgaagggacccccgagctccagctgacacgcggaggcccgggcacagacaggcatcataccttcggccttggccgcactctgtggtcattggtgttggsggcagcccagggtcagggcagggtctcagcctcggaccccaggccccaccccttgcccagcagtgctgcgttttcccagtgagctgtcgtggagagagcagaggggacccagcgcaggcccagtggccggtgaggggagacgtggctctgggacgggggcctccacctgggtggggggatgctccagcttccagacccttggggagggggcactgcccaaactaagctggcactggggctgtgcatttgaaggtgatggtggttctaggtctgaggaggacaccctcctaacagcctcatccccaagctccgggctgtgttgtggcaatgggagggaggaagtctgaggagaccctggtgactgaacggaggagggagtgagttagacgctctcaagggctctgccacctcccggagccagcggcctgttactacatttaaaaaagcctcccgcccactggaaaataatcaataactttcctttatccctgggggtggcaggacctagaaacactggaggagtccggaagtgcctggggctgggccggcgctggtgtgctgtgcagggtgccgcgggcacgtccgccgcgtgtgtgcgtcagctcggggctcggctgtgctctgcagggaccacagcgggcgtgtctgtgctcccacccgaggcacccacagctccacacgctcgttccgtgggtgcaaaggagatgggagaaagaagccctgwgagaaatgcggggcagggtttgcggaacrgrggacctgggctggtgagggctcctcgtctggtgacctgtgagccccggggcctgcagtctgcgagggttcagctcagacagttgccagtggccttgcaccaggctgcagctgcccctgagccgggctgtgcgtggcgctgatgaaatagaaaagggsattcgcttgtcaacgttggcatcrgtggcagggtgtggtgggcagaagggtcacaaagtacgggtgggattggcaggcagatacacggagggaacgtgcgcatttgagtgcacgtccaccagcaccagccccaggccacaggcagatcccaggagacacgcaggggccctaagaagggagctgggaatgaggggccacacaagcccgggacggaggcctgtcgcacatggggtggccccgactcaggccctggagttggccaggaccctctagcatcctcaagggctgggccaaccaggctggcgtggggtggggcaggggagggctgagccagtgggcgtcgtctgtagggggatgcccaactgcggccccgtctctcggctctcctctgggtctctggccagctgtggctcctgctggccccaggcgcatcccagaggcaggtagagggaggatggctgctctgagggcacctctgccgtgcttggggctcggcctggggtgcgagaccagggcagacccccgggagatggaacggcccggtccagccccaccttcctctcctcctgccccaccttcctctcctcctgccccaccttcctctcctcctgccccaccagaaccgggggcggctggcagacaagaggacagtcgccctgcctgccgcccggaacctgaagaaggagcgaactcccagcttctctgccagcgatggtgacagcgacgggagtggccccacctgtgggcggcggccaggcttgaagcaggaggatggtccgcacatccgtatcatgaagagaaggtacttggaccagggccggacaggaaggcgcaaggctcagatggggctggagcttcaggccttcagctgctcagatgagagtgtccacaccggcctcccacaccttccctcagatgctggtctttttggggtcctgtgtgggtcgcaggcaggagctgtttcctcatctgccccctgtctggcgtcccctcccacctctgctctgcggcgctcactggcagaggcaggttggcagcagttgggacccagaggtctgcaccttcctgggccgacgctccagctacccttgctgaccgggtcccagtctggccagagagcagctctagcaacagggagctccattcaggctcgtgactggctgtgcagaagcagcctcggcccccacctgcggtacaacaggagggctcctctgagtgcacggcaacaagcaagagggagaaggggcctcggtcctgttcttcctgatgcgtgtctgctgaggccaggagctggctttggcccatgggcctgtcctagtgggaggccccagcatgttgagccagtagcaggtggtgctgggcatggcagccgccctcgttcactgcccagggctgtggcccagcagggcactgacccgagacaggtctgcgcacgccctgctatcctgaggctggggtcaggggcctccagagcaacatggaccttctgcttcccttcctgcagagtccacacccactgggacgtgaacatctctttccgagaggcgtcctgcaggtaggagccgtgctgtgcgtgcataagagggggccgtgactcccctccctccctcccacccctgaccgtgccctgctgtctgctgtccgctgtctcagcgtgagctgatgctgtgatgctggctgagtgtctgccaggtttgacatgtgctgcaaggttgtcccccatcccgggaggcagacagtgttgcacccagttgggactgagggaccccagacccagtcagatgcagctctcggcagcagctcaggtgtgagttctgggcagcccggccctggagttagagtgcacttcctcccatgtgagactggccatttgagcccaaaaatgaggctgtcacctcccccttcccaccctcctagagacccacaaggaggtgagaatgctgatgtgtgagtggggccctgaagggtgtgtaggagcyctaaggcgaggggatgtctgcagagtrgaggaacagggaagggcgtgtaggagggacgaggagtgaacctggcagctctggttcagttggatgctgaagagtcatggatgctgggcctgtgggcaccgtcctccaggcgggagccaccgaaagttcttgagcagggcagtgaccaggtgtatgtttggagaaggtccctctggaggccttcctggcagacaggggattggattcaggctgtggaagcaggacggtagggggtgtgattccaggatgtggaaaggagataaaaatgaagagccccggggaagaggtcaagggagttgggggacccgagttcctggctccagggggaagcgagtggtaagtctgtgaacagagcccagctgtggattctgtcaatggggtcaggtctcaccctgtggcttccagggcagcaaggcaggaaggaggcgtctgccacaaggccagcttcctggggccagagccgtgaaggcccaggggacctgcgtgtcttggctccacgccagatgtgttattatttatgtctctgagaatgtctggatctcagagccgaattacaataaaaacatctttaaacttatttctacctcattttggggttgccagctcacctgatcatttttatgaactgtcatgaacactgatgacattttatgagccttttacwtgggacactacagaatacatttgtcagcgaggcctgtagggaaacccagccgcggtccccccgaccccgctccagtaacggctcctcctgcctgcagccccctcctccgtctgcctggcctcgggaatgcagcgtccctcggcagcactgacggcagacagcctggggtgccctaggaagaggccaggtcttccatcctgcacgggccctagaaggggctaggatgagtttctgaatctcccaagggcgagatttcggtcagaggggagggcgtgctggggtccccggaggagaaggcccagcacacgcctgagtggactgaagcctccgcctgttgacctgaccctggtgtccggtcagagcgggtggtggtccctgaacccacacgggctcccagaccatgtctgtgtttcagcctgtccctgggtccttctgcctctgcaggctcccacagaacacactgccaggccacctccatctgtgtgttcatttgctcccgtccagtggyctccacccatctgtccrtctgtccttccatccccttcgccctgtctggctggctctgcagtgaccacctgccttttggagccagcggagccccaggccgtcctcctctgcctcaggaacccggggtggcagatgctcctcgagccattgtttgcaggcgggggcttggcccctctctcctgggcccctgagctggtgggaaaatgggcaagggctaggccgtgtggtcatcamtgaggggcggtggcgggaggcccatgcgtgggcagctggggtcacacctgccaggctctggcctccccctccccttctccttcctgcgcctcctgccccagccctgactgcttctcccagcttccccacctcctgacctgcagcccggccccaccacagagactnnnnnnnnnnnnnnnnnnnnaggctcacggaaccgggaaggggtggagggccgtgctccacacagttcgtctcattgctctctgggactctgtggatgtgggattgggctgaattagcaagaagaggagaaatgagggaagaaaagagttaaatgcatgttgattccaagcccccgcctgccggggggacagcgggaggttggagcacgcagccctggtgcctggtgcgagctgcacgtgtctgccggtgccgtgtgtgcgtggggcgcgtctcatcagctgcaggactgtggtctgggcctcagtttcctcgtgtgcagaaatcgggggtcaggggatggttcacatgtggcacattctctcctggggcctgtcctgcaggactgcccctgagcagatcggcctcttccygggcgcccrgtgggcccctcgaccccctttgaggcagggagtgagataactgtgattccctgtggagggcrtgaaggcagagccggctggctgctccacayagaccctccctggagcagccgtrgggtcccaggtcccagtgccaggttctgtgtcgctttgactcgggtgctgcgtgggtgtgcacacagtggcgtcacgggccacatgccgaggcgtgggcacagcaacgtggcactcagaggtcatccccacgctcacacacagagctaggcactccctgtgcccaggctgggctccagcctcgcagctgcccacggggtcagcttttcccggtctcgttctgcagccaggacggcaaccttcccaccctcatatccagcgtccaccgcagccgccacctcgttatgccsgagcatcagagccgctgtgaattccagagaggcagcctggagattggcctgcgacccgccggtgaggagcacagggggcctgagggcggggtcggggctgtggggccagaggacggtgkcgtctccactcagcaccagcagccttggcaggcagccagagaggcaggaggagcggcctgtcccccaggggctgcatgggatggtaattgtgttaatcccagccagcggggcagacaggaggcagaggcggtggctccgctgtggctgccgctggggtgggcttggagtagccggggccctgccaccccctttccacagggcagacgtaggcgtggcctcagaggttcagaaacgcacaccctggaggaacgcacgcactcccgcagcgcacgcatgactggtcccgcctcctagggctcctggacggaaggggtccccggtcccgcctcctagggctcctggacggarggggtccccggtcccgcctcctagggctcctggacggaaggggtccccgtcccgcctcctagggctcctggacggaaggggtccccggtcccgcctcctagggctcctggacggaaggggtccccggtcccgcctcctagggctcctggacggagggggtccccggtcggtcccgccttctagggctccgggaaggatggggttctcgggagggaagggatccggcgcctgagggaggtgctgctgcctggtcacagttgtggggggaccaggcccccctcagagggcactgctgtagagaggggcacagcagagcctcagccccagggcaggccgtgaaaggaggcgggggcgccccgaggccctgtggaccccaggcaggggtgttcccagcagggcctgcatctcttgggaaggaggggtgggggaggcccacccccatctgtgtcccccatccatggcccccatccgcgtcctcgtgcacctaggaaggcccttgtggggctgggtgggggcagcttctgatgccgcgttggagacagctgagaggcggttgataaaatctaattgccccatcgatccagcagagcggagggagccccacaatgattgagatattctgagccagcaggccctcccctgtgccttcacacagggagacctcctcaggtacacgcgtgtgcgtgtgccggcatgtctgtgtctgsggtcctgtggggtgcacgtgatgggggttgcccggcagctctcacccatggagtcaggacgtgttcgtgcacttccgggctcacaggctctacggggcctcacgtgtcctggacccgtgtccaggtctcccatacgcactccgtgtcagggtctggcccgctccccggagcctcctcttggaggggcattcaccctggggggcgttcacctcttctcccttcctgtgaccccaggaaccacacatccatcctgttcccagcccgggccctcccgctaagccgcacctccctgggccctgggctgtgagggactcagagcaggtcctgcatctgcctctgtgagacccgctggggtccatgagtgaggagtgagcatggcctcatcggccttcctgcggtctcattgcaggcccccttccacctgcccccccccacccagtcacctcccccaggctaggaggaggccttagccccccacagaacggagagggtagtttccactgtgtacaatggaaaagtgattgccaggaggtgagaggccttgctaaccctgagggcatgtgcatggtgggccaggtggcaggtgtggaaaagagccaggttcccccagccttggcccaccccctcccagcccaccgagctctggcacgggaggctgtgggggagacgatggcttctcaggggcctgagcagtggtgcctggatccgtgtgtggccaggtgccccccgccgcccgccgggcccagccacccgatctgtcaccgaggtggggaccctggaccagaccgtgggactgaccctctctctggggccgggcctgacagcagccgggccaggatcaataagttattagcaccactctgtcagctgtaatgtgggattgatcggtgtggccgccgcacttccccagcctgataaaaatgacagattaagggaataagaaaaaggaattaggcctggagctgacggcagggcttgtggggggacgggcttgggagccccactgcctaggcctcatggaggtcttgggtcacaggggrgtggcccctcactccacccagctagagccctcatgaggatgaggaagggccagagtcggaggcactggctggcctgggagacccccagggcgtggagtcaggggcttcggaggagctcggggtgggtcggagatgggtacatggatggtgtggtctggaatggktgcggtcggcaggacccaagggaggacctcaggagagtgagctgggcctggcctgggcctcccctctgccacctgctgggctgtgtttggggctgaagctggacctggcctgggcctcccctctgccacctgctgggctgtgtttggggctagggctgggctggcctcgtggctgaggaggtgggtgaagctactgggaggtgcaccccagaagcccagagcctggctgggctggtggacaagggcatgacagccacgccagggtgctagctcaggcaggactgggccagagaggaggacgtgggccttctgggggcagggatgggtatgaccaagtaggaggcctgggagtggaggcgcctcgaggcggcctggggggcccacagcccagtgactcacagagcagcaagaggtcaggtgtgaggtccttcccggcttgtctcaccccacgctggcatgtgaccctgcacagcccgccctcactcctgtccaggaggggaaggtggtgcctggtcaaaccaaaagctttttattctcctctagggggatgagaggggggctcgttaacttgcacaagaggctagatggcgggtggggcagctgggtgcctgctgtggatctcttctgcacacacgcaccagggccagtgtcagagctcccctgtgcccctgtcccgccacagccaggcgtgatgtcctctgcgctgaaggctggggctgccagggctgggcaaggcctgtactcaccaggaccaagggccccctgagagatggtgggtgcggtccaggctgagctggagcaggggctgggttccccttccattccttgagatgcaggtgggcactcactaccctcccgcaggtgacctgttgggcaagaggctgggccgctccccccgtatcagcagcgactgcttttcagagaagagggcacgaagcgaatcgcctcaaggtaagagcgtggctgggacgagagacaggtcaccaggggagggggcagtccctgagggtcccctggacctcgagcaggcactctagaggggcgtggtcctcggcagtgcctggagaaacctctcaccccgggtcctccccagcagaggcgctgctgctgccgcgggagctggggcccagcatggccccggaggaccattaccgccggcttgtgtcagcactgagcgaggccagcacctttgaggaccctcagcgcctctaccacctgggcctccccagccacggtgaggacccaccctggcatgatccccctcatcacctccccagccacggtgaggacccaccctggcatgatctcccctcatcacctccccagccacatgtactcggccattcctgttgctgaggccctgctgacaccaaggccaggctggatgcaggtccctctgccacacgtcctgccccatgccccctggggcgggccacacctccatgtcccctaggtccccagggtcatgactagctcacattttatatagagagaaatggagtctggggtggacccaggtgagggtgggcagtgggcatgtcagcagcaccccccgaggagagcaagctcctggaccctgtggtctgtgagtcgtctatgcagccagacgcctgccccaggagcctggggaggggcagtgagcagaaaggccgggctgggtgcagtgggcacttggccaccaggactccccaggtgctgaagagacgccagctggaggggctgccccttcccccgggtcggccctgaccctgtccaccccacctcaggacgttctccaggggtccctccgggatgcactcggaccccctgcccgctgcactcagcctcccaggccccagccgcccgcctggcaggggagattggctttcgggctagaggtgggtgggggcgccgggaaaggaggcaggattcctcacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgggcacaagatggctcggaagacgagccccccaaagactcggacggagaggaccccgagacggcagctgttgggtgcagggggcccactccgggccaagctccagctggaggggccggcgccgaggggaaggggcttttcccagggtccacactgcccctgggcttcccttatgccgtcagcccctacttccacacaggtgggcacccccacactctagatccttccagagggcacaggactggcaggccgcctgtggaagggtcttggggggaggaaaaattccccttaggcacccatcccccacctcagcaattggggcacacgacggtcaggagacgggcgggtatgggaaagccagccagagccctagtaacacgccccacaactcaggcgcggtagggggactctccatggatggggaggaggccccagcccctgaggacgtcaccaagtggaccgtggatgacgtctgcagcttcgtggggggcctgtctggctgtggagagtacactcgggtaagggggggccccagttcctggggcggggctggagctggctggcagtcactacctccctggaaaggatggtggggtagggccattccccaacgccctctccctccccaaaagcagtgcgcagcagggactggactgtgcaccccacctttttttttttttttttttgccaggtgttttctgcctgacactcaaacccaacagatcactgtttttaaaaaatttccgtgagctgcacaaacagctcctcttggctctgctgggctggaggatggagcagcacccgggtcctgaccctccctccctcccccttccaggtcttcagggagcaggggatcgacggggagaccctgccactgctgacggaggagcacctgctgaccaacatggggctgaagctggggcccgccctcaagatccgggcccaggtgagacgctggggagtgaggtcagggtctccagaccacagctgggcagaaagctctgggtgggtgtgcgacagcccccaccaggccatctctctgcaggtggccaggcgcctgggccgagttttctacgtggccagcttccccgtggctctgccactgcagccaccaaccctgcgggccccggagcgagaactcggcacaggagagcagcccttgtcccccacracggccacgtccccctatggagggggccacgcccttgccggtcaaacttcacccaagcaggagaatgggaccttggctctacttccaggggcccccgacccttcccagcctctgtgttgaggttgccgggggtaggggtggggccacacaaatctccaggagycaycactcaacacaatggccctgcctcccaccgctttatttytttcggtttcggatgcaaaacaaaaaattttaaaagaaaatgtgacttcaaaggaaargaacaaatttycaaagacttgggggagtgaaggcagagcctggtgcaratggacgaggtctgcagacggagggcaraggtggtggaaggggccaggggcctgcaggcctccccctggaactgggactggtctcggtctgctgacgtcagggtcagctcccccgcggagctgacttcagcagcccacagctgtggggcttcagcagccacaccagcccagcccagcccagctctcgatacgtttggtctttcatgctgaaaaataaataataaagcctgtcccgtgtctactgcctcccccaactgcacagacgccagcctctaggcctgactgccagggaggtggaaacactggccaccagcccggcagcccctacaggccccccagatgggctgcctcagtcgtcctctgagagctgcagatcctccagctcgtcctccggcccctgggccagctgctgcagctccccaggggccagccccgcctctgcgtctgggtctccatctgcggggagagatggaggctacataaattttgctttatcaggaagaagccagccttrgaggttactcatcactaattaatcacggcactaattaatttatccctgttgctggctgccagagaacagagcatttggcctggccttcccagggagggaaaagcctggcccagagccccacgccccccgcccacgtggctctgccctcccgmcagatgggctcacagggccacaccctctcaccccaagaccattcaccctccgagttgctgctgtcctcctcgccctcctcctcgtcctcttcatcgtcttccaccccatgccgagtgctcaggggcctcagtatccctgaggaacaagaagcagagtccatatgactcccacccacagggtccaccagcaaagtcacagtgggggcaggagggtggccaggctcccaacacccttccctccgctgacttccagcaggtggagaggagccctggggaggaactgggaggtcacaggcctggggacagagttaccaatcccagtaggccttcacttcaaggagggaaggcgctggcaccagaagcctggcaacactgaggttggccccagctgggccagagactggtgagccccctgcaggatgggtacaggtggccctcgtggctctgggaagtccagcagagccctccaggcccacccttcccctgggagcaccacgcaggccccacctctctccgagaatccctcggtgtcgtcctcttcagagctgttcaggtcaaagaggtctttaaattgcttcctgtcctcatccttcctgtcagccatcttccttcgtttgatctcagggaagttcaggtcttccagctggaaggccaaagaaccaggggctcaggtgagagarggcaggggctggcggccacagcagggccaggcatcgccagacccaccaccagggccccatgtggccaatttctagtcccctctgttcccaaatcacaaagccatcctccaagttgtccatcccatgtccaaggtcaaaggcagagcccttcctgcttctcctcacgggcccctggtgcccacatactggcctgggtgacgaggtcagtccagccactccacctgcccggagcctccagcccatcaggcctgagggggcatggcctccccaacctagtgcagcctggggcttcccctccctggaaacgcctggttctggccagttctccaacacctaccccctctccaagtcgaatcatccgggcacggccctggccgcctggcactgtttccaaaccctcgccctggtctcaagtcatagtgcgctagatctgaaacccaggaagtcacaacacacccccaggtcccctcgccgagccgcacccgctctttgccactgatctccagctggatctcccggtcacgcagcttgcgccagtggctgtagtacaaggtcargggtgtcccctcttcccgggtcagcttctcccaggcttcctggggggttgggggagttcagggtcatgcctcaccctgggcaaacccccacatgtagctggggctataccctggcaggtgccctcaggtggcactacccccagggcccactaaccactgcctgctgctcagagacgccgaaggaaaccctctggcggcggctgcagatgtatgccgagttctcctgaaccttcccaagcagctgctgcacctgccggcagtagttggccaccttgcactcccggaggaacracttcagctgcggaagggaggggtcagccactgaagcccaggaccgctccatgtgcacagctggcccaggtcctgtgcaaaaccacgcgtggtggccacggggataccccaggaggggacatggatcccatctcagggctcaagtgcatagctgttgcagctgggatggcagaggcagaatcagcccaccctctgggccaaccctgcccactactcacctctggaaataaagttttatgccaggcgtggtggctctcgcctgtaatcccagcactttgggaggctgaggcgggtggatcacctgaggtcaggagttcaagaccagcctggccaacgtggcaaaaccccgtctctactaaaataccaaaattagctgggtgtggtggtgggcgcctgtaaacccagctccttgggaggctgaggctggagaatcgcttgagcccaggagatggagattgcagtgagccgagatcgcaccattgcactccagcctgggcaacacagcgagactccatctcaaacaatactactactactaataaaatacagtctcgctgacgtgcagccacacgtgtgcattgcatggttctgcagttgcctgtgcagctgaacatccgtaggaagccacgtttaccatttggcccctcaccaaaaacattttctgacccctaccccagaccccgaccctgggcccttgagtccagaagcagagatgccccaatgccaggtatcaccacccaagaggacatgggaggaacagaggctgtggcccctgctgtgagtgccccccagaaagggggtcccggctctgtgcatgtgacatgtgtggccgtgtgtgagtacacacacatgcacacacctctatctggataagcctctgaccagttgtggctcatgtgagcagatccctcctccccacactgcacagacctatagtcggcacatctgattccagccaccagggccagacagcagggcccccaccccttccactaggcacaggcctccctgaggctggaaacatcacggctgagagcaaacagacctcccgtgggggcccagaaggaccttctgaggataaggagaaccccctcctccaccccactcctgcctaagatgaggctgacgtggggtatttagcggggcaggctgggccttcctatgaggctgatgtggggtatttggcggggcaggccaggccttcctgccacctgagaagccactccacccactccccacacccgggatggcctggggaagtgtgcgatcagcgtaccagcctgagccagggtcggcatgctcagtcccaaccccgaagcaaagatcagccttgtggttcccacctggggaggaggctgttgtgctcccagggtcctcagcccactgcccaggcctgcccccaaacctcctgaatggcttagaacccctcatcagcccctccaagggggcctcacggggcgcgttgccagcagtcaggttccaccccagtcccaggtacccgggacaagggcacctcctaccagcctggggcagccaagcccgttataagacagtctgagtcggccacgagccggtgtgggcaggacacacacctgcaggaccacaggcagcaccagctccgggaagccgatgcagtgtgcctggctgtgcaggtactccagggtgaggtcgtacagctgctccaccaggccgtcctgaagagcaggagagagggccgagtgcatcagggagaggctggggctgggcactcaggccccttcccctcaggctgtcagggcagcgccatctccagggcacggactgcaaggaaggggctcctgggccccagccctgggagaccatgaaggtccatgcttgaacttggaggatgccagccccctcccatccacctcagcacccccaaccccaccctgggaactgcccaggcccctccccaggaggccagcctcacccggtacgccttctcctgcaggttgacattggacagcttcaggatcacggagaagttgatgggcttggagctcatgcgccctggcttcctgttgaagtcgacctgctggaacatctgccccaagggccgtgtcaggctctctcggccccatgcctggtcaccctggcttcaccctggctgcaccctggtccccctggtccctttggccctgcacctggctgsaccctggtcmccctggtcctcaggcttcagcacgaggagacccaacccgaaacaagagataagcagctaggcacggtcccagccccatggccccacacagcctggcgtgtccccgagtggggctctgatcagcagggaaggatcaggaacacgggccctctcccaaaatcctgggaagcactaaggacccacgtctggagacctagaggtccctgccacacagagtaccaggacagcccccattcctgacaacatggcactgaggcccatcctggccctcagcacagcaatgccacatggggctccgtcccgagcaaccagaagacgcagcagcaacagcaaagaagagtgccagacacaggacgggacagatggaggtcacgggaggcctggggggcccctcccacaccctccacagaagccacaggccatgcacctccgtaggacatgccaggaggagcagagaaagagtcagcctggcctctcagtcttgtgacccctccccaaccactaggagccctcaggctgtgaaccagagagatccagggtacatgctggggcaccagaggacagaagcagattatggggggcccaagggtggaggccccagcaagacaccccactcagcaggggtggctgccagacagctgagctcaggtccagatgggaaaacgccctggtactgatgaacctctgggaggacactgcccttctctagcctgggccgaaagtatgggcaggcgactggcttcctgtccaggcaccggggaagggcaggcacggcctacagctgagggctttgttttagcttttagggtttgctttttccggagaggagaggcctgcatccctgcgtgagaggggcctacagggtgcggctgcagtgaaccagggcagtgcacaagtgaagaaacagacactgcaagagagtaagaaagcacgtagccaaggagattggacaagggaaacagacacaaagcatgcctggagctgggcagcagagctggaggcccacagacacaggggccaggccaagggctgggcaatcagagaccactgctggctgccatgggagtgaacatggcttcctaaagatgttcagcatccctgcctcagtggaaggggaatcagaacgtgcctggggcttccataccttctggacccagcaacctggggacccagccccaaggacagctgtgacacgactctgggccttcatgaggctgagaactcattagataaacagggtggagatcgtgaattcctaaatttacagcggggtggggcctaacccacccactgaaagttgaaacttcggactccaatctttccctacctgagtggcatgtgcacgtgcaaagatgcatacacacaggtacacacaggcgcacacatgcacaggcacacacgtagacgcacgtacatgcacacaggtgcacacacgcacaggcacacacaagcagacgtgcatgcatgcacccaagtgtacaggtacacgcacaggtacacacgcacagtacacacatgcagatgcaaatgcatgcacacaagtgcacacagacacgtgtgtatgcacataggtgcacaaaggtacatagatacacgcagacgcacatgcatgcacacagatgcacacatgcaaaggttcatgcatgcacaggtagacacatgcagacgcaaatgcatgcacacaggtgcacacacgcacaggtacacacatgcagacaggtgcacacaggtacacacgcatgtgcatgcatacaggtacacacaggtacacactggtatacaaagacacatgcacaggtgcacacacgcaaaggtacacgcaaaggtacacacatgcatacacacaggtgtacacacgca

SEQ ID NO: 12291 - DNA, 45835 bp, Homo sapiens
cagctggcttctttgttaatcgtcaacaaagctcatgaccccaaacgctgacgaagctctagctgggcattgaagggcacactgtggtggctgaactcatgtcttttgtgtctgggttttttttctttttttttctatttttattttttgggacagagtttcgctcttgttgcccaggctggagtgcaatggtgcaaccttggctcactgcaacctccacctcctgggttcaagtgattctcctgcctcagcctcccaagtagctgggattacaggcatgcgccaccacgcctggctactttttgtatttttagtacagatggggtttttccatgttggccagcctggtctcaaactcccgacctcaggtgatccaccgtctcggatcggcctcccaacatgctgggactataggcgtgagccaccacgctcagccaggttttgttttttctttcaccaccttaagtggtatttgtttatttaaggtaatttaatttttttaagtaaaccttttattttagaataattttttgtaggtgattttgacttaaaaggctccaggggtggggcttagaaatgcccggcccacctggctcatgagggaagcgtgggtggtctctctgtttgagattcgaactgtgtcctgccagagatgggccggcaatggggctggttttggggagaagtggtcagttgcacaggtctccaatgagcagaatcagaccaggatttctactttggtgcttgcaagaaaaggaggtggctgggcgccgtggctcacacctgtaatcccagcactttgggaggctgaggtgggaggatcgcttgagcccaggtattcaagaccagcctgggcaacatcgtgagaccccgtctgtacaaaatattttaaaactagctgggcgtggtggcatgtacctgtggtcccagctactcaagaggctgaagaaggagaatcccttaagcccaggaggtcaaggcttcagtgagccgtgatcacaccactgcactccagcctgagtgacagatcaagactatctcaaaaaaagaaaaaaaaaaaaaaaagaaggaggcctcttgcagatccaggagtgcaactcttactgaacactgttagttcctattagaaacctctggacagaccccttaacctggccactgaccactgatcctgaccccaagtcctgggtgcacagtaggctctgtcacctgctgatcccgatcagactctaaccatcagctaatcccaaccaatagctgaacccagaccacagccaccaactgccccccagtcctgcccacttacctccaaccctaccactcacctctcaccctgacaactgacctctaacctctgttctctaatcctgagaaaataggcgtcatggtcacggctgacctgaattcttaccctgaccttacactgacctcaaacatcaactgacccctacaatgccactgctgcctcaatcctggccactgggctctgcaggctcttaacctggtcaagctacccacagcccgggccggccagccccagcctagaattctgagcacacagtaaccctaaccaggcccccactggagaccaacgccagcccccatagatgccaggctctggccttggctggctctttttttttttctgagatagagtctcactctgttgcccaggctacagtgcagtggcagtcttggctcactgcaacctctgcctcctgggtttaagtgattctcctacctcagccttctgagtagctaggattgcaggtgtgcaccaccacacccggggaatttttgtatttttagtagagatggggtttcgccgtgttggccaggttggtcttgaactactgacctcaggtgatccacctgccttggcctcccaaagtgctgggattgtaggattgtaggcgagagccactgtgcctggcccctggctggcttttgatcacagagggtcccaggcgatgcctccccagcccctacccctacttctacccccgccaaccaccacagccccaggagttgcctcccttgcctcctgagtctctgcttggactctgcccttaccaaggagctgggctcagcacaacagcagagctgagccagcaaccactgctgtcacccccagcactgccatgaaggctcaggtttgccatctgtaagatgggagtgacaacagcgtgtgccccacagaggcactgtgggacaggccgagaatgtgcagcccagggcctggcacgcagcgagtggtggctgtaccctgacttgactccactccacccgtgagctgggcaggacaggccgattctcctcatttcacagatgaggcagggacagtcacatgtcccaggtccactccagaggagggggcagcgtctttgctcttgggggtgactctcgtgcctgagcccaggcctctrtcccgtgtccctgcaggaggccgggtcctgcagatccccctggtgcgggcagagaacgccgggaggtactcgtgcaaggcctccaacgaggtgggcgaggactggctgcactacgagctgctggtgctgagtgagtggcggggcctgcaggtggggattcccgggactgcaagcgccgtaagggcctccctcagaaggggccgaggcaaagtgcacacagtcttgctgtactcagaggttgaaattggagttacatgctcggcctcaaagaatcatgcaggactgggcgcaggttccaagtcagaagcttcctagctgtgtgacattgagcaaatcacaaccctttctgtgcccccgattccttagctgcatcagggattgggagggcttggagagaagggcatgaggatcccgaccagcacctgacaccaagtgccactctcgcctccacggccacccccgcccccagggacctgtgccagcccctcagccccctctcccccacccccagccccacctgtgatcctgggtgacacagaggagctggtggaagaggtgacagtcaatgccagcagcaccgtcagcctgcagtgcccggccctgggaaaccccgtgcccaccatctcatggctccagaatgggctgcctttctccccgagcccacggctgcaggtcctggaggacgggcaagtcttgcaggtcagggcagccccctgcacgggctaggggcagtggctgctgaggcccagcaccacttgtctgggagccagggaggggtcattatctgcaaatgaggctctttgctgggaaccatgctggagcccagccaagaatcacctgtgaggaggcatgctgggccagcacaggcctgtgcacggcatccagagcttcaggagacacctagcaaaggatgcacatgggtgcgggacccagagcccagcaccgcacacagcagccttccgcgggatcaccagctggcgcgtgcagagccgtgcccagcactcagacatcaggcagccccctgagtcaccccatgtgcagacacagagctgcggggaccctgggagcccaacacacacagcacggccctccacaggggtggggggggctcttgtcacatctggtttgctacagagaaccacccaacaccaacctcacacgcccgctcctgagcgccacacaaggccctggatggaggaggttccagrtctccatgagctgcctggtgcctgcttccctggcatgggatgggagggattcctcgcagtcattcctgggggtggtggtgtccaaggggtctcaggtatctcccaggcatggctccctgcacccacaggtttccacggcagaggtggccgacgcygccagctacatgtgtgtggccgagaaccaggcgggctccgctgagaagctcttcaccctcagggttcaaggtgagctgggctgagcaggcagcccctgtgggttccttttcccttcccagggggcactgccttggggcttccagtatcctgggctctgggtcctgcaatcagagttcagggatcccagctggccccagccacatcccgagacagagagcatttggggggccctgatcactactgggccaaccccaggtggttttaagcaactttggagatggccaggcattaccaccaccattactgagcacttactgtgtacctgacacgaggctgagcactttccctgggctgactccttccagcagagctaggttagcccacccagctttgcagctgtgggaggagactcagggaggtcgccctcagagaggagtgggattgggggggtctcactgccccggagcctgcactcctaacctctgcaactcatgacgtacaccgcactgcagtggctgtgagttctgtctccagatggtcttggagatggaggaagatagtgttgagccctcaaggtcatgggctcaaacctgaattgatatcttagctctgccactgaccagctgtgtggccttggaacagtgactctccctctctgatcccctacccagtgtccttctgtgtaagagagtcatggcaaatggaggtttctgaattatttgaagttgtgccgaggtgaagccccaggagctgggtgaggctcagggtttctcttgggctccgtgctcccctgctggtgtgattctcatgcctttctctaccgtggtggctgtggggatagtcccgccacgaatcgcaggcctggacttggagcaggtcactgccatcctcaacagcagcgtctccctcccttgcgacgtccacgctcacccaaaccccgaggtcacgtggtacaaggacagccaggccctctccctgggtgaagaggtcttcctcctgcctggtgggtaaactgaggtgtccggcccagctctaaggttacatggggagagagttgctcccccgacctgggacagggccgtcagtcgtgcagggatttaggactgggggctgggctggaatgctggtgtgaggggctggcttcccccggcaggcacccacacrctgcagctggggagagcacggctgtsggactccgggatgtacacatgcgaagccctcaatgctgcyggccgagaccagaagctggtgcagctcagtgttctgggtatgtccatgtctgtccccaacttgtactgtccccactccttcagtcacccctcagcccatactcccccagagaacatagacaggagagggccaggaggcacagggggaggctgggacgcccgcacagagcagctctgaggagggggagcagtgggacgggccccaagagcctggctggggaaggggcctccccaagccttgtgtggtgggggaagcctgtttcacagtggagcctgtttcaaggctcgtggtcttcagaatcctcttggggaaaagctggcccaaggtgtctttagcaaggactcgctggaaggttctttctagccccggggctggtccattcacttgcacgaacaccagccagacactgcgctaggcctgtgggctcacagccatggggaaggagggcttctacattggttcactggagccacaggggctgaacgggcctcgacagagggctgtaacccagctggggcctgcccctgtaggaaaaagcctgggtgggggcgggcgacagcatctcccccatctaggaggctgaggctcagagaggcaggaggctgtccctggtcactcagtgggtccttggcgtgctggcctggttctcttcctccacctcccctgggtctgcgccagcccccggggctgggtctgctgtgtgaccctggtgggtttccactggcattttccctgtggctgagtggggagggcgcagggacagctgcagcacctcactctgctatctcctgcccccagttcccccggccttcaggcaggctcccagaggtccccaggatgcggtcctggtgagggtyggggacaaagctgtcctgagctgcgagacagatgcgctccctgagccaactgtgacctggtacaaggatgggcagcccctggtcctggcacagcggacccaggctctgcggggtgggcagaggctggagatccaggaagcccaggtgagcaaccctgggggcacgggcagccatgagcgctgcaggaaagtcgcctcccagccctggsgagctgcggggaggaaggtgggcaggatgtgagttgctgcctccttggcctgtcagaccccaaaccgagtggattagcagcttccagggtggaagacatgggcrgagctcagggctctggagtcacgttccagacccagccctgcagtcatggcatgagcccttcctgcctyggtttcctcagcatctagatgcttttatctggtccgctccggctgaccatctgagactcctgggagtctgccctgccctccctccctccttccgtggagtggattagatgctcacagtgtttgttggatgaatgtttgctgtccccctcgaaatccattcctggccaggctccatccccacagcaagggggacctcttcctgccagcttggcccagggagggaggtccccagagcctgtgtattcactgttgargggcccttctgcttcttgaggctcttggaaaaggccagagcgtcctgattccctttggctccccagtcaggaccagcatatttgggaggcccctgctctggaagttttgggggcctagatgcttttggggagccctagcaccccacttccagctccagcacacagccactgtgtgctcttcctctttcaggtatcggataaaggtttatacagctgtaaagtcagcaacgtggctggggaggccgtgcggaccttcaccctcaccgtccagggtaagccagggrccagcctagccaacgtgactgtggagcccctagcaacacccagggctgccaaggaggacaaagacaatagctgggcagaggcagtgctgccaagtgctgaaggcacaatgactagaatttgtgtacctatctatatctacatctctttctttttgtagagatggggcctcattatgttgcccaggctggtttcgaacccctgggctcaagcaaacctcctgcctcagcctcccaaagtgctgacattacaggcgtgagccactgcacccagctaatttctagaatttaaaaaactaaggttagcagrctccaaatagaactctgccagtgacctgcttcatggagcttagtagagtgactttgtccctcagagcctaaggtttaccttcagtgaatgagtctaaaagcagtagctgcctgccaggcacagtggacctgccatggatcccatggaccgccatgacagtgtctataaagtgctgggcacagggcctggcatgtgggcactaagatgaaggagccctatgagatcagacacacaggaggccacgttacctgcatcttgatccccaggggggcctgtcccatccacccaaggatggagcacagatgctgtttgattggacatgtggctccagctggggtgaggaggagcctatttacactgtccaggaaacttggccagattttctggtgctcagatgtcatgttagttagaatagagacttagccgtgccacaaaaagaccccaaaatatagttgagtaaatgagagagtttaactcttattcaaaagcccagaggtgggtgtctaggctggtgggtagctcggctccatgcggtagttaagggacccgggttccttccctcctgttgatcttccatttcttagggtgttrttcttgtgcatatggttgaaactgggacacggcatcrtgtcctggcccacaggaagcagaaaagagcagaagtggtgggcaagcatttatttcatacagaagttgcacctgtcccttctgcgtgtattccattagtgagcgctcaggcagctggctgcaggggacactgggaaatgtagtttctgctagagtgatcgtgggctcagctaaaactctgctatgcacagtgggaagaacgggctgakgggacaccagccatctgccacagatgccaaagccagtagcctcccaaccaggtgagcggtgggcacatgcaaccctgagccatacacaacacaatcgttgaaaaggactgacaagatggagtgcaggggctcatgcctgtaatcccagcactttgaaaggctgaggcagggatgatcacttgagcccaggagtttgagatcagactgggcgacatagtgagaagcttgaatctacaaaaaataaaaaataaagtaacaagaaagggactgacaccaggcttgctgctcaaagctcccagccctttctgatggctacattgatgaacagtggaaagggsgaatatctggtccctgagggcaaaggcatttcatcttgagcctggttgactctgttccgctggtggtgtctgcctggggtgtgtgacttcatcctggcggagcaggagagagtgttgggatcgattagtgatgtctgccctggcacaggttaaggactgtgggtgagtgagcctcccatttaccatccktgggctaaggagaccccgctggagctttgctttgtatgctttaaaatagccaggcactggttctatttacatttgtgaataaaacatagaatgggaactcctaactaccaggaagggcttcttaggcctccctgatctgcctgaggggaaggaaatyggggaagagtctcagaattctgacagtctggctttcttcctgcagtgcccccaacatttgagaaccccaagacagagacagtgagccaggtggctgggagccccctggtcctgacctgtgatgtgtccggggtccctgcacccacggtcacttggctgaaggacaggatgccygtgggtgagcacatctgtccttgtctgtttcgcgtaaagcattcctttctttaataagatgacagcagaagcggacgaaggaagttattggttgttgatgatcttggcaaaaccagagactggcagtgccgtgttgccccccccccaccatttgtgtttgagtgaagcgttrtttattggcccttggaatccaaacataaagagcgtctcctgtgagggtttggaagctcctttgcatccacgtcmtcagtcagctcccatgagacagcagacgtgggctctccattgygcagggcaggtgctgagggccatggaaagcccactggctgacactgggytcagcattggcccccagagctgctccttggtggtgactcagctcggtcctagctgggccgttggtcaaccccatsccccatccaggcctccccattctggccgctgctgtgcccaccgttcctccgcatgacggcagaagccccacatggtctcctgggcccactgtgcctctcacgcaggctccacgtggggcagaaaggtctgaaggtacagctcggagctggtcccttgtctggtggaaatccgtccacagcaggggccggcactgccagccacctctccctgcccctccatgcgctaaacgtggctgtgctggctcctcgaacctgcccctctctctcagtaacagctttattgggatataattcacacactatataattcacccactgaaaacatccaattcagtgatttgtagtacagtcacagagttgtgtgaccatcaccacaatcaaatttagaacatttttatcaccaaaaggacacccgtatccattagcaatcactccccgttttccccccatttcttcttcccccagacccaggaaaccacaaatctgctttctgtctctgtggattggcctgttctgggcatttcacattaatggcatcatagagtgtgtggccttttgtgtctggcttcttccacttagcgtgttttcaagtttcatccgtgttgtagcatggatcagtacttcattcttttttttttttttgagacggggtctcgctctgttacccaggctggggtgcagtgccacaatctcggctcactgcaacctctgcctcctgggttgaagcgattctcctgcctcagcctcccgagtagctgggattacaggctcgcaccaccacgcccagctaatgtttgtatttttagtagagatggggttccaccatgttggtcaggctggtcttgaactcctgacctcaggtgatccacctgcctcggcctcccacagtgctgggattataggcatgagccaccgtgcccagccagtgcttccttatttttaaaaattaaatttttctcttcattcccttctgtggctgaatattccattgtgtggctgtgtcgcgtgttgtgcatccactggtcagttgatgggcatttggggtggctgcatcttttggctgagatgctcagtgctgctgtgaacctccgtgttcgtgtttctgtgtggacctgtgtcatcgcctctcgcgggtcaggtggctgcaggccccacctccctttgcgtccagctcttggcacatgtgttccctgcctggaatacccacccaggctcccgtggtcacctctgctccccccggctgactactgctcaacattcacgtctcagcggagattcaccacctctggaagccctcccccacccttcctgtcccccaagttccccggctccatcaggggctcacagggcttgtcagcactgggtccccttgtttcatggcccccaccccygatacattgtgaactccttgaggacagggactgagctgccctcatcttgattcccaggctctgcgctggacatggggcagttgctcgtgtctttgtgttgagaggctggctggatccatgaggatctgggcaaggagatcgtcctgggctggggccgtgagagatggctttgggcaggggtgtggctggagagaatgaagggggaggcctgaaggccgggagtgggaggagcccgagcagaggcccagggggaagccccagtgtgacctgtgtagggtcagtgaggggctggtttgacttgagcagaaaccttgatagacaggggtagaggggcagggcatggagggagaaagcaaaagcagaaaccttgattgatgggggtagaggggcagggcggggagggagaggatgggagctgagagctgggcctgagagcaaatcctggacactgaagggagggggtcccttgggaagagctgtctcaagtggaaggaaatgaggaaggcttctaaggaacagagactgggctggggaaggtggggacatataagaaggcgcctctgcctctgtggggctcagtttcctatgagcacaagaaggggctgggggattcaggggacccctctgtcccacagagagcagcgcggtgcacggtgtggtctcccgggggggccgcctccagctgagccgcctgcaaccggcccaggcgggcacctacacgtgcgtggctgagaacacccaggctgaggcccgcaaggacttcgtggtagcagtgctgggtaggtctgcgcctgcaccctcctgtcccactcccatggcagcccctgccatcacccagggcctcactgcacccctgcctcagtggccccccggatccggagctcgggcgtggcgcgggagcaccatgtcttggaagggcaggaggtgcggctggactgtgaggccgatgggcagccgccgccggacgtggcctggctgaaggacggcagcccgctgggccaggacatgggcccccacctccggtaagacttggcccatgccctccccagaggcggtagggcccatgttcccttacgcctctgccctgggccctccttccctgtggcaggttctacctggacggcggctccctggtgctaaaaggcctgagggcctcggacgcgggtgcctacacctgcgtggcccacaacccagccggggaggacgccaggctgcacacggtgaatgtgctgggtgaggagccccagggcatctggagggtgatgcgtgggcctgggcacgggagataaggcgacatgtgagcaaagcccacactgtgtcctgggccacgggtctyacttccctgggcctccatggcccatcctcaaactagaggacaatagtgccagcccagggtatagcggagattcgggaggtgagaagagagtcagggagtggctgtgtcccccatgcagcgggcctcatccttcacaagggaccactgtggttgctggcggcagaagtccaggtctccacttctgggatttccctgggaggagcccaccttcctcccaagacctccgcactacccctcttttttctacccaccctcagttcctcccaccatcaagcagggagcagacggctcggggaccctggtgagcaggcctggggagctggtgaccatggtgtgccctgtgcggggctccccgcccatccacgtgagctggctcaaggacggcctgcccctcccgctctcccagcgcaccctcctccacggctctggccacaccctcaggtaggggagacggtggacaggccttggctattccactcagagtggacatgtggggattgtcagcaaatgggaggtgctggaagccaggactggctgcaacacccactccccaccccacagcgagtgtggactgcgccccagatgctaatgctaggatgggtctcagggacccagggaaggggaggtggtsggggtaggaggagatgcaggagaagtcaggtttcagggaaggagagaccaactgggccacaggagacgaggcctgaggacggactgttggctttggtgctgtgcctgtcactggggactgggcaagagcagctcaggaggagtggttggggcgaaaggggctgagagaaagtgggaggacagagagtgaagccagtgagctgagatgactccagtgagctctgagggcaaagagggctgcgtagaggaaggggagccaagctgtccatatgggacgtggagcttcccgaatttgggaggcaggaggtctggcttcagaatgagattggttggagcaggcagcaggggtggaggcagctggaggctttatcctgggggcaccgggaacccaggtaaagagtttaagcaggccgggtgcggtggctcacgcctgtaatccagcactttgggaggccaaggcgggcagattacaaggtcaggagatcgagaccatcctggctaacacggtgaaaccctgtctctactaaaaatacaaaaagttagccgggcgtagtggcgggcgcctgtagtcccagctactcgggaggctgaggcaggagaatggcgtgaacccgggaggcggagcttgcagtgagccgagatcgtgccactgcactccagcctgggtgacagagtgagacaccatctcaccatctcaaaaaaaaaaaagaaaaagagagagtttaagcaaaggctgggctcagtcaccccgccccctctggccagcaagctcttgggagacaaaggttggaaaagggaggaagtctttccacgcagccagcctctcctgtctctctccctttctcttcctctctctctctccctttctcttgtctccttctccctctcctctcgggggattcaggatttccaaggtgcaattggcagacgctggcatcttcacctgtgtggccgcaagcccagctggcgtggcggacaggaacttcaccttgcaggtgcagggtatggagcagggggtggggcaagggggtctctggccttggtgggtgagaatcaaggcccttggcccccctgcccttctgggtggaaccaaggatgggccctgggggcgtcgaggagagcggacactgcggctcagtctctgactcactgtattgctcgtttgtacctcacaagtggctgtgggcactctggtatgcccaggataggcgggggcagagaggcaggaagcagctcagtaaagagacaatcacaattccagggaactagtgacaccaggggatggagaggatgctgtgggagcacagaggagggcacctcacctggccttgggggaccagggcggcttcctggaagaggtgatgtctaagctgagtactggagatgagagtcctggaataaaatggttcctgcccacctttctgccctccatagtgccccctgtcctggagccggtggagttccagaatgacgtggtggtggttcgtggctccctggtggaactcccgtgcgaggcccggggcgttcccctgcctctcgtgtcgtggatgaaggatggggaacccttgttgtcccagagcctcgagcaggggcccagcctgcagctggaggcagtgggagctggtgactcggggacctactcctgtgtggccgtgagcgaggcgggggaagccaggaggcatttccagctgaccgtcatgggtgggtcctctggcctctggccagcttctctgggctcgggggagagggtgggactctaggggcaatgggaaggacagtgagggaggtgagtcccctggagacctgggactgccacctgggagcagaactcagggaacttggttctggctgggatgcctctctcaccttccttgcctgcggggagtgggtggccgggctttgattctcccagggctgtgctcctggtttctttccaccaaaccttggtggcagatgcaagaacaagggccaccaaaatgtgggagcagagcccctggactcagcacagtgttttcaagtgcggtgctgtcccggaaatgtgtgtcaattgtgtgttcccctccatggtggcttgcagagccccctcacattgaggactcaggccagcctacagagctgtcgctgacccccggcgcccccatggagctcctctgtgatgcccagggcaccccccagcccaacatcacctggcataaggacgggcaggccctgaccaggctggagaacaacagcagagccacacgggtgctccgggtggagaatgtgcaggtaccagtgccgccgccatggggcgaggctgggggttgggggagaggggagggactgcaggttccccagacccagtgggcagttgacaaagttgggctgaagcacctcctctgtgtggggtgtgagggtgtggaggtgacccaccttggccgtgcccttgggagctgccagcagggtcagggcccaggctgatgccaaaaccaggtgaccccatctaggccagaggagggctggtgcagttaagggggacttctgggaagaggcaggcatcacaccagccctaaagcaacagtgagatggagggagagggcgtgggttggctgggaggtggatggcagacctcgcagggctgagtttgaatcctgggtccctcgwtgcatgagaaagaaaccagattgggaggcgggcagagaggggccaggggcagctgctcaacccgctccatccccaggttagggatgctgggctgtacacttgtctggctgaaagccctgcaggtgcaattgagaagagcttccgggtcagggttcaaggtargtggtgggggtggggtgggggcagggccgggaggcaggacgggctcgcggcaggggtgagtccccctctcatatcctcttgtgccacccccttcccagcccctccaaacattgttgggccccgaggcccccgctttgtggtcggcctggccccagggcagctggtcctggagtgttcggtggaggcagagccagcgcccaagatcacgtggcaccgagacggcattgtgctgcaggtgggygccaggcagggccccagggtgctgccttctgtcccgctcaggcctcagacctgacctggccggatccaagatccagagcgggtgccaagggcccgctctgagctgcactttgcaccctgttccccgggtgtcatacccccygccattgtcattgtcactcccattttatggatggggacactgaggcaaggctcaggtcactcagggcttccgaggcccacccagtattctccccctggctccttcaagctatgcttagcagctgtgtggcctggaccggtgaccaaggctctccgtgcccacccctcaaatggggtcagtttgcggctgtggattcagggttgtggatgttctgacaggaactccagagaaaggggatgcatttcctcccagaggagtgcatttccttagagggtcctcggcggggcacagtcagggcctgcggtcagcctggaagtacagagccactgtccagcttcaccagttcctcagtcttccacatctgctgccgggtggcctgacgcagctgggcactgataagggtctgtccaccctggcggggctctccaggaggacgcccacacacaattcccggagcggggcaggttcctccagctgcaggccctgagcacggctgacagcggcgactacagctgcacagcccgcaacgccgcaggcagcactagtgtcgccttccgcgtggagatccacagtgagtagggcccgccccaccccaccctgcccaccttaccccaccctgcccacccccttagagccacagctcccagcaccactccctctgtgcccctccccagcggtgcccaccatccggtcaggaccacctgcagtgaacgtctcagtgaaccagacagccctgctgccttgccaggccgacggcgtgcccgcacccctcgtgagctggcggaaggacagggtccccctggatcccaggagccccaggtgggagagggaaggggtgggcctcagggaggctctcaggtgccactttgtgggttgcaaatcaaactcacttgggcaattggagcagaaaagtgactttatcatcaggacgtggggtgtctcagaacacaaggacaggcccaccactcatgaaggtctcttgcttgtttaacttgatcagaagccttgatagatggggcggggtagaggggcatgaatggatctcaygagatctgatggttttaaagcttctctcagcttctctctgtgtaggcttcatctctttctctctcttaccttcttccttggtgaacatgggagaaacacaccccctgacaaccccgtggcccccagccccaggtttacagctcctcagctcactagcaagttgtctgtgaatcccaactctaaattcccagggcacagaatgccattggcccagcctgagtgatgtgtccatcccccatccaatcaactgtggccaggggcgggattgcacagtacagacatggcccttggaaagggcatttttcagatctaggggctgctctcaggaagagcagggtgctgcgccttctgcgtctcaggagaggtcaagcccaggagggtgctggagatgcccaaagcagcccttctctccatctttccaatgttggcttgggctgtggggagctgctcatggctctgaccccctgaccttggcctcacagatgcaagactctgacctccaaagttagcatctgtattaggccattttcacgttgctgataaagacatacctgagactgggcaatttacaaaagaaagaggtttattggacttgcagttccacatggctggggaggcctcacaatcatggtggaaggaaaggaggaacaagttacatcttacgtggatggcagcaggcaaagagagagcttatgcagagaaacttacgtttttaaaaccatcagatctcgtgagacccattcactatcacgagatcagcacgggaaagacccgccccccaattcaatcatctcctaccaggtccctcccacaacatgtgggaattatgggagctacaagatgagatttgggtggagacagagccaaaccatatcagcatcctctcactgggaaagtgggggcagagggaagggtcttgctagagacagccttgctccagaccccactggcttgctcatctccagggcaacccccatccattctaggtttgaaattctgcctgagggttccctgagaatccagccagtccttgcccaggacgccggccactacctctgcctggcatccaactctgctggctccgatcgtcaaggccgtgacctacgggtcttgggtaggtggcctggggaaggccttcagtgtccagtccctgtcggggtccagtccttcttagtttctgagtcaccccagctgtaggggccaagagccaatggtcttcaaatgtttttgaccatgaagcccattagtaaaaagttgtgatcatgcacactcaaaggacacagatgtattttagtgcatatattacgtaacagaacagcgattcgattaagtaagaaaccatgtacaaaaggtaaaacaagtctgagaggccgaggcaggaggatcacttgatcccaggagtttgagaccaacctgggcaacatagtgagaccccatctctacaaaaaaaaaaatgtttaaattagccaagcatggtggcacgtgcctgtagtcccagctacttgggaggctgaggtgggaggatcacttgagcccgggagtttcaggctatagtgagccatgatcacgccactgcactccagcctgggtgacagagtaagactccgtctacaaaaaaaaaaaaaaaaaaaaaaaagtaaaacatgtgaaaggataaaattcaaaatcactagaatcagatgccccagtctcctccccctccaacagatcagcttgtgagaggttgctgtggtgggccctggcctcaggtgggggctgatgggagtggaggcctggaggcttcagtcaaggaaaggcactgagggggtgccaggctcagggatggggaaagcccaaaacaccctgctggaagcgctgtctcggggctttctcctgccctctccctctgtgctccctcagggatgggtggaagacagtaggcagtggctttgcccctgggcacagcctcagagagcccccagcccctgtgccccctgcacctgtctcctgaccactgtgctctccccagagcctccagccatcgcccccagcccctccaacctgaccctgaccgcccacaccccagccttgctgccctgcgaggccagcggctcccctaagcccctggtggtctggtggaaggacggacagaagctggacttccgcctgcagcagggcgcctaccggtaacgagctggactttgcggtggcttcctgagacgcacagggcggggaggcactctcttctcacgggggcatggggcagggacggggcggggtgtgctcaggtctcaccggagtcaggaccagaacttgtgtctcaactttggggatcagagagtcttcacactgagatmggggtgagggcactggggatatacagctaaacagagacatctgggctttatttatatccaccagagtcactcttgtctaaaaacaaaacatgaactgggtgtggtagctcacacctgtagtcccagcactttgggaggctgaggtgggaggattgcttgaggccaggagttcaagaccagactgggcaacatagtgagaccccatctctacagaaaatttaaaaattagtagagtatggtggtgggtgtctgtggtcccagctacctgggaggctgagatgggaggatcccctgagcctgggaggttgaggctgcagtgagctgtgattgtgccactgcactccagcctgggcaacagaacgagactgtctcaaaaaaaaaaaaaaaaaaaagaatgtccatttttaaaaattggaaaaccaatgtacagagaaacagggatgaaaacgaaaatcactcaaaaatccaccagctagacctgtggggcagaaacttctagaagacatttctagagtcagggctggaggtcagatacaggaaggggaaatgggcgtgagacccccacagccagaaagccacagctggtctctgtcagcccagcagccacttggccgtctgtctgtccaccccaggctcctgccctccaacgccctgctcctcacggcccccggcccccaggactcagcccagtttgaatgcgtggtgagcaatgaggtgggcgaggcccacaggctctaccaggtgaccgtccatggtgagtcggggcagaggtggagggggacacctggggtgggggcagcgccttcccgctcttgggtgctctccctgccagcagggaattgtgtggctttttcctgtgctgcactggacacctcctccaggaaggyctctcagatcctgctgggccacactggcataaccccagctccrgcacagttcctggcacacgggagctcacaggagaggcccctcgcaaatccagaatgttctaaactcaaatctgaccttgtcatcacccccgttaaaaatccctccctccacagctgcccgctgcccccaggatagaatgcaacaattcagctggacacaccaggtcctgtgtggtctggccctgccagattcagctcacgccagacctgcctcattccagggtctaatcaagctgctcagcttcttgtttcttgcctcaaggggtttgcacacgctgttgcctttgccgggaacactcttcccctcactcagcaaacacctgctttcccttcagatcgcaggttaaatgccacttcccctggaggtctcctctggcctcccctrctccaagtgggaaacccacgagtaaccccctgtgaagttactaggccagggtctctatagaaagctgtatcccactgggtgcagtggcatgtgcctatggtcccagctactcaggaggctgagacgggagggtcgcttgagcccagggagtcctgagctatagtgcactatgctgattgggtgttcgcactaagttcagcatcaatatggtgacctcccgggagcgggggaccaccaggctgcctaaggaagggtgaacctgcccaggtcagaaacagagcagatcaaggctctcatgttgatcagcagtaggatcacacttgtgattagccactgcattccagcctgggcaacatactgagaccccatctctgaaaaaatacacttttttttttaaagaaaaaaaactatagccccgtgcccagaaggatgtgctgagygggcaaatgtgacttctccctctgttgccacctccctccttggccctttgtcactratgtcaccttgtgtactagctttaccccctggccctgtggccgtgagtgccctgtgcccgccggcagggcctcaagccttgtcttgggttttagtgcctcccaccattgccgatgaccagacagacttcaccgtgaccatgatggcacctgtggtcctcacatgtcacagcacgggtataccagctccgaccgtgtcctggagcaaggcaggcgcccagctaggagctcgggggagtggctatcgtgtctcaccrtcgggtaagtaagggtaagccacagagagaggcagctgaggggagactgggagagcaggcagagggggtgaaaggtcacatggcggaataggatggaactatctggcctggcactgcctctcctggctgtgtgacctgggaggaccctctcgccctctctgagctccatattctcctccatgctctgcagtgttgagacccatcagtggttccccaaggccctctggcatacaagtgctatttcatggcaaaataagaaaaataatagctccctgggagtttttgtaaacctggtttaatcccatcagaaagatcctcctgtattctgaagttatctttggtgttgaaacttccttttcttgatgatattaagataatagtacatggtgattttttttaagatggagtctcgctctgttgcccaggctggagtgcaatggagctatctccgctcactgcagcctccacctcccaggttcaagggattctcctggctcagcttcccaggtagctgagattacaggcacctgccatcatgtaggcatgatttctgtatttttgtagagatggggtttcactatgttggccaggctggtcttgaactcctgacctcaggtgatctgcccttctcagcctcccaaagtgctggaattacaggtgtgagccaccatgcctggcctaacatggtgatttttaaaatgtctttgcctgtcaaaataaaacgttggaagctttatggagagtctccaaatttatttgttagttcgttagcgaaacactaaagtctaggaaccagtggccaaacctgtgattttcaaactcttctgaagcaatagaacttccttccaggccaggcgcagggactcacgcctgtaattccagcactttgggaggctgaggcaggaggattgtttgaagccaggagtttgagaccagcctgggcaacacagcaagaccccatgtctacaaacacatttttaaaaattagctgggtgcggtggtgcatgcctgtggtcccagctgcttgggaggctgaggtgggaggattgcttgagtgtaggagttcaaggatgcagtgagctatgattgcaccactgtactccagcctgggcaacagagtgagactctgtctcaaaacaaaatacaaaacaaaaacttctttccaataagtgtaataagtggtaacagcaaagtccaacaagtgaaacaaaccacagttctggttccatctggggctgggacaggggctgtgggtgggccagagtgccgtgggccttgcttccttcccccacccagcaggcccccaggggyccacggagcacaatttagaaccctcgtcacttgactgccaaggtgcagcctgcagtctgggaaggttaaaatggtgttcactgagtaaccaaggctaaggccaggaggataaagggaggagaggaggcagtaatcctgggaggcttcctagaggaggtgagtttttagcagagcaaggtgagaatgacaggatgtggaactgtgagtgggggattacaggcaggggagtggcagatcctggaacttcacagcctaaagggtctagagaccatcttgtctgattcttcattgtgcacatggggaaactgaggtccagagagtggaaggaactcgcccatgtctctgctttgggcagggcacagaggcaaacctagatgtcaggttcccatacagtcacatcccccagactgtttgtaaatgggcaaaggaggcaggttgagtgaccagagacagagtggggttgtgtaggagccctgcyacctccatccctggggacctctgtcctgatcccctcaccctgattcccaccaacaggcgccctggagatcgggcaggccctccccatccacgcaggccgctacacctgctcagcccgcaactctgccggcgtagcccacaagcacgtcttcctcactgtgcaaggtaagggtccgtggtccagaccccagagttcctagggccaggggagcaggtggagagccagaggcaggtggggctcaggatggaggtgaggccccgggtctcagaggccccgacctgtctcccatgggattctttggcaggaaaagaatcagccatggcgtccttgttgctgtggccgatgtttctagaacccccgttctccttagaggcctctctctctgatgctccgaggcccgctggttggaggagttgtgttaaggacattctcagggccctctgcacccccgtcctttgtagcctccccggtggtgaagccgctgcccagcgtggttcgggcagtggcagaggaggaggtgctgctgccctgcgaggcctcaggcatcccccggccgaccatcacctggcagaaggaagggctcaacgtcgctactggtgagggcccctggcagccagcctgggaagggaagagaagagcgtgggtctgggcagggggggagtcctgcttcctgccctgggagaccccgcagacctgctgagaggtcctggaaagcccctggcctgcccagatacgcccccacccttgctctggcctccccctccccaacccttctcctgtcaccatggcctgagatgccatccgagcactcggtggctgaggtgggaggtcgggagggggcagctgagctgggctcaggstcaggcttcttggctccttctgtcccttggtcattctgtgaccccagcaagtcatttgctgcctgtgagacagaatagcccaatctgcccacctcgggggtccccagtcccagttcccaggcccccgattttcttcttcctcgttcaggagtgagtacccaggtcctaccaggcggacagctgcggattgcccatgccagcccagaggatgctggaaactatctctgcatcgctaagaacagtgcgggcagtgccatggggaagacgcggctggtggtgcaaggtgggagtgaggacggggccgaggtgggccctggcaactgaggggctttgaggcttctgcaagcttctcccttctctgcctggcagggcacactgcttatagttctagaaggaattaaggggaaaacatctcycattgtgcgcctgagttctggtttcagacataaattcccatcccctctgccttctctctggccctgtggaacacaagtctagcatccctcattcattctggtttccagtagctgtagcctctctggccctgctctggcacacacacaattacatgtgcccttcccttagtttgatcaatcattggcttcaaagatcaggtggcatcactggccaaaaatctgcaaagtctgctgggaatattcagtatgggccggtcatgtcttggccccagtggcctgctttgtggtatctcagtggccatccccgcccgcagctatgtagggctggagtcagactctggctgtgaactcagaggggctcctggctccargawtcctccrcttcttgtccagcgtgctcctctcccctgggacctgtagcatcgctggtcaccagaccagccagacaccaagccagtgaccctcactctgcccagcatagctcctccgcagggatgctctgtgacagctgccctgcttttgttcctggaggtggcctagtacaaggtccaagtggaccctgcccaaggcctctgtcctgcggcttttagtcttctgtgtgtgtgcgtgtatatgtgcatgcatgtgtgtgtgtgtgtacacgtgtgcacaggtgcaatggaatcaccgtcacagctacaccaaactcagggagtccccaaatcatcctgagcacgggcaatggcctatgactagggagttggagggggcagctgatggccagggagggctgaagggctgggccaaaggccaagggccccaggatggtgtcagccgcctccctgagccccggttccgagtgggcctccctctgccygcagtcccaccagtgatcgagaatggcctcccagacctgtccaccaccgaaggctcccacgccttcttgccttgcaaggcgaggggcagtcctgagcccaacatcacctgggacaaagatggccagcctgtgtcgggcgccgaggggaagttcaccatccagccttctggggagttgctggtgaagaacttggaggtgaggcactgccccaaggggcacagcagggaataatggctgagacccctgtttgtcatgctctgcgctgagcactatgcagcctttaaccctgggagsctggggaaatcagtgtcaccatcccgggtacagasrgccagaactgaggctcaaagtgtacctagttgtccaccattgccaagaggcaraacccaaatttgaacctggacctcggtagccagctcctggggaagggagggaactcggactagggctcagggatacggtgatgactttgtgtcctgaaagtctacccagttgttgtcaaccatgcgtwggcattaaccgtcctctgggttttggggagtgttgagccaggggtrtgggtgggacccccaacctccttcccctcagcactcatcakattctgcaattttatgatgagaccctctccagatgggttcagtggacacacctagaggggtcagaggcattggacccggccacccagggagcctgggggtgcagtggtgagcgcaccggccctgcttgaatgcaccataaaactcctcctcttggagcccctgttgggccctctatcagggcaccaaaagcaaggcctgcagtgcaggtcaagttctgaggacagggcagcacacagtaggtgtttggtaaacactggctattgcgatcatgcagtcagggctggggttatgaagcagtagagcatgtgaatgctgcagggctgggcaggggcacggtggtgatgctgacccgtttgctagctgtgtgaccttgggcaagtcacttcccctctctgggctggatgctccatgagaaccttcaagggtcaggggcatcctgacctatgccgaggtggggcagttctccggccaacccctttctttgctcamagggccaggacgcaggcacctatacctgtaccgctgagaacgccgtgggccgggcccgccgccgcgtgcacctcaccatcctggtactgcctgtgttcaccaccctgcctggggaccgcagcctgcgccttggggacaggctgtggcttcgctgtgcagcccggggcagccccacccctcrcattggctggactgtcaacgaccggccagtcacaggtctgggtctgctgggcatgggtgggacagagagccaggacaccgggaggttaagaagggagggcaggtggggagacccaacctagtggaaaggaagaggttgtcagccagccctgttggttctgggtcttccaaygtggccctatgtagggggacagggcaaacccagctgtggccatatgtgacaagccatatatcagagctggcaagaggccacctgagaagactcaacccagagacctcagggccaggaaggggaggcctgtgttctagtccagagctgctgctcccattgtgggaccctcagcaaacccsttttgctgggggcccgtggggactctgtcctcctaccggaaacccaggtgatgtctagggagacacagggcctgtggagtacctgctgggtactcaatgtttgctgaattgataaattgctaagtcccctccactgcaaaatgatactttcctacattaggatatgacatcacacattcctaactctgagtccccaggtgtggaatacccgtgctcacctgtggtgaaggctttgctcggctccaccacttcctggggagggaccttgggcaggtataatagttcagcctgtctgagcgccgctctccatctgtcaaatggacataaccaggggtcctgaggacagaatgacaatggaggggccgtgctcggcacaggcctggcccggagtagatgcccaattgatggtactgcttgtctgtattcctctcctagaggtgatggcccaccccaaaggaaaagttcattattagaatccttctctcggctgggcgcggtggctcacgcctgtaatcccagcactttgggaggccaaggcaggtggatcacctgaggtcaggagttcgagaccagcctggccaacatggtgaaaccccatctctactaaaaatacacaattagctgagcgtggtggcacatgcctgtaatcccagctacatgggaggctaaggtaggagaatcggttgaacctgggaggtggaggttgcaatgagctgagattgcgtcattgcactccagcctgggcaacaagagtgaaactgtctcaaagaaaaaaaaaaaagaaaccttctctctagaaatcatggcagtgtttcagtaagtgtcctgtgctgagaggcccccaaaaacctgcccttgaccgtttatcaaacacacagtgtgcactggaagatggtagaaggcaggttcattaaccgcagcctccagtgtggcctgtgcctcccaggaacgtgtctgatttgatcaaccttcacccgggactcccatctgtttctgcatttttattaagttcctgcaggtacccaggcaccagggaagtgtttagggcaggagttccctgcacccgacttctctttctccaccacagaaggggtgtctgagcaggatggaggcagcacgctgcagcgggccgctgtctccagagaagacagcgggacctatgtctgctgggcggagaacagagtgggccgcacgcaggcggtcagcttygtccacgtgaagggtagggcacattccccaggtggcttctctctcaagacctccagtctattgggacccaatctattggtttcctaagaacccagcctcctgtcctctgaactagtggttccccaccctggctgcatgttagaatcccctgggggactttaaattctgaagtccaggttctacttccaactctgtaaaccagcctctctggggtgaggcctaggcatcggtatttttgacactcccaagacgaccctggctgcaggtagaattggaatctgaccaattgccctacagcactacctgcagctggatggtgccagggtaggaggagagcatggaggccagggcatcctggcagaaaaatgccagaagcttgccagccagccagttgtcccctatgacctactcatccaccaggagtagcacaggagccctcggtgacaacgtgtcttagtttgcacaacctcaggatgggtggggctggatgggggkaatgarcagccccaggcaccaaaagagaactgcagcttttggtagatccaacctcaggaaaccaggaaggatataagccagtccagagcatcgaagagtgttttgagattagcatgaatctcatagcrttgctttgtacaacagaggtgtctagggttcttgttttttyatagttattgatttccaaagtacctggcaggtactccgctgctagtgtaatccatctgtgaaagagagtatatgacacgcgtaacactgccttcctgcctgtgcccatctcaggcatcactaatcaatcacagcaccattctcattcagcttcaaatgcttctcagcacagttcttggaaagtctttgccagtctttgtgacttgacccatgacatgaacactgtttgctgtccctgatgcactgactaaacacaaccatgctgtgctagcagaagcctctggaggcccctggaggcaggagttgggcagtcctttggggtttatgggaggctgagccagcaggcaacctcttttctgacaacttgctcgatgtcaccccatgcagaggctcctgtcctacaaggggaggctttctcctacctggtggaacctgtaggaggcagcattcagctagactgtgtggtgygtggagacccagtgccggacatccactggatcaaagatggccttccactgcggggcagccacctccggcaccagctgcagaatggctcgctgaccatccacaggactgaggcaaggcggggcctggcaccttgggtggggccactgaggacaactctacgctttttcwgattgttcaagagggttcttcctattgcmccctctgcttctgcagtgtacaaagcacctccctgcccattcctcagatatcctcccactaccaccaatattgacctccagccaactgggcttttccattcctccgtcatccacccattcaatggagcgaattagttctacctcataggattgtaattagaaatcagtgagatgtctcatacccattatttaagagtgatctgtgggtaatgcctccaaaatgttgttattaacaacctcagggggtagggtaggcaggtaatagtgctccctatttacagacgaagacactgaagttcagagaggcccacaaccaataagtgcaggaggcagcgcccccacccccaggtctcctgcctcaggccccgtgctgtttccaaagccttgggccctggggcagcccctctcaacttcccttttgtgtctcaagttctggtgattgtgcagaaatccccaagtcagtcctgactcaagttcatcttaggggccttgatctcacccatttgggagcctttctctgggtagtaatgataataggactagtaataagagcagtagtaagagcagtggtaataatggctcctgttacccaagtactaactgtgggccaggcayggggccttgcacttagcaagcattatyccatgtgatgcttataagatcctagcagttatcactcccattttacagaaggggtaactgaggctccagaggcatgaaaatgtcctaagtaatgggctgagggcagtaagcagtggggctgggattcagtcccatgttggtctgayctccaaacctacactcttaactttgtgccatgctatccccccmagtcccttgggtgtggccccccagataccatcttctgggagtggacgtggcctcaggctgccccaggcccatctgatggtggcrctgccactcagaagtgatgtgagccagcgcgccacctgagttccatcacatatccatgggtcacctgttagggaaacgctgcaaacgatctcccttctggaagactcactttgcacactggcacaataaatgccctgagaggtcctgcagttcagactgccatcctgttcatacaacagaggtgtctcatgttcttgttttcctatagttattgatttccaaagtaccataacatgttgtcaactcaatgtctcccaaacttacttgaccatggaaccctgttctccaaggagtctcaaataatgtgccatgggacagtaagatttcaacgtacacagtttggaagaggtggatctacaccatgcttttccagcaagttgttccacctaaggcaacaaggaccgtagtcacagccccctgttttcgggtgtgaaaaggggctggattctctttgcatgtctgctgacaagtggtcacagaggcccttctgatgctctgygggggatcaggtgcccctggctggttcacagcctaagccccttgctggctggctgccctcagtcccctacccaactgtctgagccactcatcttcttctctgagcaccatgcctcctctcctgtgcccacttgcagagggacgatgcgggacggtaccagtgcctggcagagaatgagatgggcgtggcgaagaaagtggtgatcctcgtcctgcagagtgagtctcggcctcagcagagtggggacgtgggaagtgtgctcggggacagcggtggcgtgtgcagcctagagggcagacggcagggctgggacttggaattctttcattaatacttacttggaacacacaytgaatcctaccaaatgtttcccaaatgtggggtgactgagactcaggactgagctaaagaaaacctggcaacctgggcctgggggagctgggcatttaaaactcagaccagccgtcaagatcaccgcgacagctctckcatgtgccaagcagctcgtagtttaccaggcgctgtttgagcctcagaataacactgtgaagttgtctcaatagggattctgtagaaaatgttttattgaagatgaacacctgtggagaagagccaggatcctaagtgcagagctcatgaatttttacaatgcgaacccacccagttaaccagcaaccagatcaaagaaataggacagtgccggctcccagcctccagcatgcccacctctgcttactgccccctgccccaataatcactgtcctggattctgcctctttaaaaaaaaaaamaacaaactttattgagttataatttgcataccataaaattcacccgttcatgcaatgcaatattatttaaccttaaaaaggaaggaaattctagggctgggctcggtgactcacagctgtaatcccagcactttgggaggccaaggcgggtggatcacctggggtctggagttcaagaacagcctgaccagcatagtgaaaccctgtctctactaaaaatacaaaaattagctgggcgtggtggcacgcctgtaatcccagtcattcaggaggctgaggcaggaaaatcacttgaacccaggaggcagaggttgcagtgagccaagatcgtgccatcgcactccagcctggttgacaggcaagactcaatctcaaaaaaaaaaaaaaaaaaaaagaacaaaaggaatgcaaygcaattctgacacaggctacaacatagatgaaccttgaggtcattatgcgaagtggaaaaagccggtcacaaaaaaacaaacactgtatgattctgtttatatgaggggcctagagtggccaaaagcatagagacccaaagtagtatggagcttgccaggggctgcagggaggggagaagggggagttagaatttaatgagtccggagtttcagtttagcaagagaaaaaagttctggagattgtacaacaatgtcaaatactcaacactactgaagtgtacacttacaaatggttcaatgataaattttatgtaatgtttttttttacaactattattgttactaatattttttgagacagggtctggctctgttgctcaggctggagtgcagtggcgccatctctgctcactgcaacctccgcctcccgggttcaagcgtttctcctgcctcagcctcctgagtagctgggattataggcgcacgccaccacacccggctaatttttgtatttttagtagaaacggggtttcaccatgttggcyaggctgctcttgaacttctgacctcaggtgatccacctgccttggccccccaaagtgctgggattacaggagtgagccactgcacccagggcttgtgctcattcttaaatggagttgtttattttactagtgagtttctagagttctttacatagcatggatatagccctttatcagatacatgatttgcaaatatttctcccagtctgtggcttgtctttgcattttcttaatggtgactttgaagagcaaaagtgttaaaatttggtgaagtccaaatttatccattgtgtattttttgaatcatgtatttggggttacaccttttaaaaatctttgcctaatctaaggtcgtctttttcttttcttttcttttctttctttctctttttttttttttttgttttaatatttttgggrcagagtctcactctggtgccaaggctggagtgcagtggcaagatctcagctcactgcaacttccacctccaaggttcaagcaatccttgtgcctcagcctcccaagtagctgggattacaggcacgcaccaccacacccgactaatttttgtaattttagtagagacgaggtttcrtcgtgttgcccaggctggtctcgaactcctggcctcaagcaatccacctgcctcggcctcctaaagtgcggattacaggcakgagccactgggccctacattttcttataygatttttgtagttttagttctcacatttaggtcwgtgatccattttgagttaatctttgtgtggggtaagggtctaacttccttttytgcatacggatagccaattgttccagtaccatttatgttgatcttgaatttctttcagtgatgttttgtagttttgaatgtactggtcttatatttttgttaaattgattttaagtctttttattattgttgatgctattttgggtggaattgttttctttsatttttggatttgtaattgctaatatgtagagatacagttgaattgatatcatatcatctatgaatagggacagtttgactatctttctttcaaatctgcgtaccttgaagttttttgctttgccttattgccttggttggaccctctggtacacagttgaagcagcgagagcagccatccttgcctggttccctggtttaggtggaaagcagtcagtctctcaccatggggcgtgatgttagctgtgagtttttgtggatgccctttctcaggctgaggaagttccccttttgtacctagtgtgttgagagtttttgtcatgcatggaataggtttgtggtccagacaagatggtatagatgcacttctccctatttctcttgctaaggacagctaaacaccttggactttatatagaagcaaacataaagagcctctgaaaagtagagaaaagaaggaggatagactaccgatcttgggacctgaggagcagcatggtggtgaatgccctggtgtttctttttgtcccttatatcctgggccgcatacttgagaagccaacaacctggaaccaccagtgggctcagacacacgcatgtgcacrtgcgcacacacacgcacrcacacacacgggggcatgtgcacctcaacragagcctgtcctctcttgcaaaggactaggaaagggacagcatagtaagaaagaaaacttgtaaataacaacccctaactgggtgtggtggctcgtgtctgtaatcccagcactttgggagactgaggcagccagatcgcttgagctcaggaatttgatatcatcctgggcaatatggtgaaaccccatctctacgaaaaatacaaaaaaaaaaaaaatagctgggcatggtggcgcacacctgtaatcccagctacttgggaggcaaacaccatgaaaaacacccctgccccatcatcacaccaactgggagcctctaacttccaccctcgcccctgtaccgaggcactgctctccccacactggagcaggatgctgtcaggtgacacctaatgaggagacagaattgtcaccactgtcatctactgagtgggaagctcctcccccgtgtggccaggtgggcagcgarggtagtgccagcagaggcccggtgtgggcgtgcctccacccatccacccatgctcagcagtaatgaggcacccctccctgttccgggctgaccatggaagcctcatagggaacctgggcttccacgctgacctggcggaagtgagtggcaccactttttcttggcagttttatagctctgccaaaaacggaagatttaaataaaaatccgagtcttacaatactgaaactcacttacacaccaggaacaaggaaaagctcaacttacacaccaggaacaaggaaaatctcaatgaaagcagacaacagatgcctactgagatagtacagatatcaggtaatctgataaggacttttttttttttttttaagacaaggtctgactctgttgcccaggctggagtgcagtgacatgatcagggctcactgcagcctgggctcgggtgatcatcccatctcagcctcccaagtagctgggactgcaggcacgtgccaccacacccggctaatttttatttttatgtatttattttttgtagagacagggtctccttatgttgcctaagccagtctcaaactcctgggctcaaatgatccacctgcctcagcctcccaaagtggtgggattacaggcatgaaccactgtgcctgaccaagactgaactgtcaccactgtcaccactgagtgggaagcccctcgcctacacaggccgagtggggagcaataagcagtgcccctctccctcccagccaggatggtgccagcagagccccacttgaagcgccaactcccaccgatccccagcaataatgaggcaccctccctgttcccgggtgtccatggaggccacgtagggaacccggacttccactctcatctggcagaagtgagtggcacctccttcccctggcagtgttccaggtctgctaagatggaagatttaaataagagcccaaatcttatcatactgaaactcacttatcataccaggaacaaggaaaaatctcagcttgaatgagaactgatactcaacagacaccaactgagatagcacagatgtttgagtcatctgataaggatttcctttttattttttgatggggtcttgctctgtcacccagactggagtgcaatggcacaatcacagctcactgcagccttgacctcctgggctcaagcaatcctcccacttctcagcctcccaagtagctgggactgcaggtgcataccaccatgcccggctactttatttattttttgtagagatggggtcttgctatgttgcccaggctagctgacagggatgcttctgtgagcagttgtcaacatgcttgaaacaagtgaaaaaaacagaaaatctcagcaaaacgtggctgtggagtaatttgaagttcaggcagttttcaagttggcctcggtttactgtcctttgtacccctcaggtctcccctgcacaggtgcatatttcccacgatggccagggattgtggggagccaatccagcctgtccgtggctccttcatttccaggttctcsccgttcagttgctggctgggtccctgctcttctcagccagggccatgccgcaggccagcacagcagccatttcccttttggctcctaccagttttgccccttttcctgatgatatttctcagggcatactttcatcctctactgcacatcaaggcagcccccaggggtggcaaaagctgctgtttttcacagccatccctaataaaaccactgtgatggtcacggtggggtagggatgggcacagccccaggcaggaaggccaaaggcttccactgttcttatccaaagttctagaggctttatttwtttwtttttttttttggagacagagtctcactctgtcacccaggctggagtgcagtggcgcgatctcggctcactgcaacctccacctcccaggttcaagagattctcctgcctcagcctcccaaatagctgggattacaggcacccaccaccttgtccagctaatttttgtaattttagttgagacagggtttcaccatgttggcccggctggtctcaaactcctgacttaaggtgatccaccygcctcggcctcccaaagtgttgggcttacaggcgtgagtcactgcgcctggcctcgaccttcatttaagtggaatcaccccacacgtgctcttgcgtagactcttcttttgcacatcataatttgtggcattcgtccatattgttcacgtggaattagtttattggttctcattgctgtgtgtttttctgctacatggatgtaccacagtttattcatgtattccactctaggttagtttccagtgatgggcggttaagaacagggctgctgtgaccttacgcacgccctccagtgaacacgcacacacacctgtgctggggtattcgtccaggagcagaagcgctaggtctcacagtacacatgtgttccactttaggacacactggctgtggtagtatctgatgaatggcctccaaagatatgtccaggtcctagtccccagggcctgtgaatgtttccttacttggaaaaggaatctttgcaaatgtaattaagttaaggatcttaaagtgagcacattatctcggaggcccctaaatgctatcacaagtgttttatttatttatttatttatttagagatggattctcactctgttgcccaggctggagtgcagtggcgcaatctcggctactgtaacctctgcctcccaggttcaagcaattctcctgtgtcagcctctcaagtagctgggattacaggcacagaccaccacacctggctaatttttgtattttttagtagaaatagggtttcaccatgttggccaggctcttctcaaattcctaggttcaagcaatccacccacctcagcctcccaaagtgctagggttacaggcatgaaccaccatacccagctgcaagtattgttataaaagagagccggggccggacatggtcgctcatgactatmatcctagcactttgggaggccgaggagagtggatcaccagaggtcgggagtttgagaccagcatgatcaatatggcaaaaccccgtctctaccaaaaatacaaaaattagccaggcgtggtggcacacacctgtaatcccagctactcaggaggctgaggcaggagaatcacttgaagccgggaggcagaggttgcagtgagctgagatcgtaccactgcactccagcctaggtaacagagtgagactccgtctcaaaaaaaaaaaaaaaaaaaaaaaaygagagagacagagagctggggtggtgtggcaggggagagagagagagaagagaaggtaaagtggagacagaggcagaggatggattgttgcagcctcaggctaaggaatgctggtggggcagaagctggaagaggtgaggaatgggctctcccccagaacctctggaggaagcagggcaccttaactttggcccagtgaggctaatgtgggcctcctggcctccacagtttctcctgtgtttctgcagcttgctgcagcatctgcaggaagcgaacacacaggcacacagcgccccaccttggctgaagcacgttgcatttccacctcagtgtgtgcgagttctgcttgttccgcagcctcaccagcactgggcctttcccatcctttccatactagccttccaggagggtctataatagtaagtggacaggaagcatcatccccatatttcagaygggaacactgagggtcagggagtgacttggtgagagccacccacagtaggtgacagagcacgagtttgcccwtttcattggcatcaactagaggcagttctgacagatggccccccacttcattggaagcagtctaactgtcctataggagaggcttcatttagcyaatcccaatacagtcaggcaatagaagactacctagccactaacaacagatatgtaactgcatggaaaggtagttacgatctattgcagaggaaaaataaaagcagatggccgggcgtggtggctcatgcctgtaaccccagcactttgggagactgaggcgggtggatcacttgaggtcaggagttcaagaccaacctggccaatatgacgaaaccccatctctactaaaaatacaaaaatcagccaggtgtggtagcaggcgctcttgggaggctgagatgggaggatcgcttgaacccaggaggcagagattgcagtgagctgagatcgcaccactgcactccatcctgggggacagagtgagactccatctcaaaaaataaaataaaagcagatacggccatatgatcatattttcataaagaaacagtgtctagagggaaatattcaggaacgatgactgggtggaaggatcctatgcagttcttattttcttctttctgcttctctggatttcccagtgtgtctaaatgaacatatcccacttgaatatgcaaaaataattaaatgttcctaaaagccacctgggcctcccacaggtgctccggtgttccaggtggagccccaggacatgacagtgagatctggggatgacgtggccctgcggtgccaggccactggagarcccacacccaccattgaatggctacaggcgggtcaaccyttgcgggccagccggcggctccggaccctgcccgatgggagcctgtggctggagaacgtggagactggggatgcaggcacctacgactgcgtcgctcacaacctcctgggctctgccacagcccgggcgttcctggtcgtgagaggtatggggcatccctgtctggaccttcgtggacagaggcaggatctcttgccgatggggattgtgtggtgcttatgggagacctgtcccctgccttgccagctccccacctcttccctttgcttcatcacaagcccagaatgaacccctaccctgcccgtttacagttgggtaaactgaatcttggaggtgctgtttgctgctcatcttggacagggaacacaggttgttcctgcttaactggcacaaatgcatgtcctctgtctggacactgcacagcccctggaagcaggcagaggaagacaagggcatccccggtgccctcgggggctgctgtgaaaagtctgtgcatcagtgcatgtcccaggcatcacacattgcctggccgtggcaggtggttggaaaagaaatggcttcctggtgggatggacccctgccatctcgattcctcaatcagctcccttctaccttgggtcagaccaactttaaaattaagaaaagatctatcctgagaaaccacagtaaatggattcagacctgcataaaggcaagtcataagatattatttctgtggcctgtgcctctgaagggaacactccatatatgtggggatgtgtccccttccctgtacctggcagacatcactaatctatcaccacatgggaacactccctatgtgtggcgatgcatctccctcgctgtccctggcagacatcactaatctatcaccacatgcgttggcagaatctttctccaatgagccctcccaggcagcgcctctcagctaattggaattgggacttgacacttggccacctggaaatccacgtgaaacccactgccaaccaaatgtgggaccctttctggccgttgctctcattatctcccacaggccggggcagggtaccaacctatgcagctctgaaagttcagcggttctctgaccccccagccagagatgcagtctcagagttagccttgggtctaagcagacccccatgtatttcagggcttcgtcccacttcttttttttttttttttttttttttgagacggagtctctcactcttgttgcccaggctggagtgcagtggtgcaatctcggttcactgcaagctctgctccccgggttcacaccattctcctgcctcagcctcccaagtagctgggactacaggcacccgccaccatgcccggctagttttttgtatttttagtacagatggggtttcaccgcgttagccaggatggtgtctatctcctgacctcgtgatccgcccatctcggcctcccaaagtgctgggattacaggcgtgagccaccgcgcccggcccgtcccacttcttaccctctcctgttggcaggccccagtcccaaccacagagctatgtacatggcctttgtatttgttctgtagggctactggtaaaaaaacaaaacaaaacaaaacaaaacaaaacaccacaagctggaggcttaagccacactgattgtctcatagttctggaggctgcaaatccaggatcacactgtcagcagccctggtttcttctgaacactgtggggaggatctggtctgggtctctctcccagggtcttggtggtggtcctcggcattctgtggcttgtcgaaacatcacccccacctctgccttcatcttccctgtgtgtgtctacacttccctatttataaggacacagtcatgttggattaggcctgccctaatgacctcattctaacttgacttactctataaagaccctatcttcaaatagggtcacattctgaggtcctgggggttaagacttcaacgtatgaattttgggtggtgtggtagcattcaatccataacccagcctccttatttttttttaatagaaacaaatattcttcctttatatatgttaactgtagaaaggccagatactatagaaatctgtgaagaagaaggtaattctctcccataattcagtgacccaaagtagcttaagcaattatttggggagatacattcttccacactgttttctctggatagaggagatacacttttctttttacaaatgtcaaatttacaccctctataacctgccatttttacttcctctatcttggaagacatccaattatgatacacatcggtccacagctttttgattggcttcgtatcattccatgggaacgttttttatcttcgttcgtgttggctttgtcaaatgagcaacgtagtttattttcctagtttccattccccaaagccacaccgtgctgcgtatctttgtgtgtggccctgaagatttctgtgggacgatttccttaaggggcatgggtgggtgaagggagttcagggtttgggagcttctaaacctgttttccctcctgaaaacctgcttttcctccttccccatcagcctggcaggtcccaatcctggccttgtagggggacaagaggctgctacgtcactccatgtctgagagagctggcggtggcttgcctgccgtgcctgggttccatttcctgtccccttccaaagctgcgcgggtcacactccagccttctcatctgcagctcccgatctcttcttcactcccctattaaaaggccagggataggttcacggcccttctcctgtccctcccatgggccccagagcatcggatactgatgagaaacatcccagatgggcttcaaatctcatcaaaccccagctatgggctgcaggaaatggccctgcttcctagaaccccaaattaaccagccccttgattcatccatttaggatcctagcacttgagtgttttatgttattttttgacagatcatgggcaatttgttgctaatttcccctgagagctgctgagtggagaggcaggctaacttctgtctctcgccccctggaatgccatctgcctaaacaagacagctggcgcattagtcagaggaagcacccccctgtgcctgcatcatccgtttgattagcgctaaagagcatctgctcacagatggcctggcgggcagcggctaggaaaccagcccacccggccaggccagctgcagggcagccagggcyagcagcactgatggaatggggctgttcaggtgatggcacccggctctggctcggtgccctggctccttcagtgtgccagccacgccatcgtgggctcccggcatttcagagacccacaggtcttctgtgagtttgtggtcccgcctcctcattttacaggtgagccaactcaggtgtggcttgggggcctgaggtggccaggttttaaggaatggcagagccagaattagaagccagctccgccctgagcccagggttcctcctaacagcctcccttcccttttagagccaagatcccctgggcgttgagtccatgaccccttagctgtgtgtccttggacaagtggaggtgaactctccgagcctccatttactccttcacgaaatgggaatgacagcctgcttgtgctgtgggccccggggtggatagtcagtggcactgtcattctttcccttccttacaggggagccccaggggagctggggcagcatgactggggtgataaatggccggaaatttggcgtggccacactcaacaccagcgtgatgcaggaggcacactccggggtcagcagcatccacagcagcatccgccatgtcccagcaaacgtgggtgagtggaaggcagagcatcacctgcctctgggttattgtcacagcccagcgagcatcctccagaacatgctggacctaggaggcgcagagcctgtgccccgagacttgctcaaggcctgatgaccagagcacgtctgaccatctctcaaagctgagtgcaatccaaagtggactcagatgcaggcaacttcctgtccccctcacaacctcccaaaaacaaaggaactgcatttacagtcagaccaagagtgtgtgaaacggtcagtgttctgggggtgcgggcgctcagattgtggtttcccaagccaccgatggctccctgaggcttttccccatttaagttaaagctcaggctgatggaagtggagggatctccagtcatgagtgaggggtgcaggctggaggtgacgggaagcgggaaacatggagaattgaattgcctagaaaacctagaggactaagaagagtcacctgcacacagagctctcatgtacggtgtctgagcgatgaatgctctgagagacttgcagagcttgtgacagtggacgtcactgtctctcccttcccaaggaatccctggcccctcgtgggggtccaggaggggcagtattcatggagtcttcactgaaagtagctcctctgaagctgcccttggccatggtcccgcatgagcagtgtggggtcaggggattttgctggggaagtcactctgagctggctgtcagcagacagcagatgaagcgagacgctgcccagacatggctgcttattctagctgcaggagtgtgaggcctggagaagcatctggccccaagcccgtggaccaggctttgttccatgaaacagacgcacagagaggctgggaaggtggtgcccatgcacaggggcctggccagctcctgtgaaccttgcaaagctggcaccgtccctgactcagagcaagtggggagcgggtgtgttccccttgcccagtccatggccccacctggtcctgcgtggagggcggggcatcacatgaagaagatctgagaatccacgtccagggccattttttggttcttttttcaaacggtttggaacaaaccggggctggtccagaagggatctgcaagttagaaaagttggttcacttcaactcagcaaatatataatgacagtctgtggagtccctggctccgtggtgacccggggccctcaatcggtatttgttgaactgagttaaatatcaacaaggtacatgcatttatttcttcttttttttttctttttgagactgcttctcgctttgttgcccaggctggagtgcaagtggtgcagtcacagctcactgcagcctcaacctcccaggctcaagcgatcctcctaccttagcctccccagtagctaggactataggtgaatgccaccacacctggctaatgtccatatatatatatatatattttttttttttttaatttttttttttgagacggagtctcgctctgtcacccaggctagagtgcagtggcatgatcttggctcactgcaagctctgccttccgggttcacaccattatcctgcctcagcctcccaagtagctgggactacagacgcctgccacggcgcccggctaattttttttttttttgtatttttagtagagacagggtttcaccgtgttagccaggatggtctcgatctcctgacctcgtgatctgactgcctcggcctcccaaagtgctgggattacaggcatgagccaccgcgcccggcctgtccttaatatttttattttttgtagagacagagtctcactatgtcgcctagcatttccttgtataaatttattaatttcagttactccaggaagtagattatttgcctccaccagatccctgattctggttaaataattggcatggcagtcacaaggctgagtatggacatcaagggaaggggctgagctctcctgggggcagtggggagccatgacgggaccttgaacaggaggtggctgccctgaggatcagctctaacccggcctctatgccctgccccacccagggcctctgatgcgggtgctcgtggtcaccatcgcccccatctactgggccctggccagagagagtggggaagccctgaatggccactctctgactgggggcaggttccggcaggagtcacacgtggagtttgctacaggtaaacagggcctcccccaggtgggccaggtaggactaaagcctgcgcccaggacctcccgtggtgactctgggctgggtggggatggtttgcaggggagctgctcacgatgacccaggtggcccggggtctggatcccgatggcctcctgctcctcgacgtggtggtcaatggcgttgtccccgagagcctggctgacgcagatcttcaagtgcaggtcgggggtcaagccctggggtgtgcagacagggtaggtgagagagacgaaggtgcccggctctcaaccacccctgagcagccaggcccactctcccttctgacagcgctgcagggctgggtcacagtctagccttggacttagggtaggatgagcagttgtaacaggctcaagttcaagcgcttgaagggatgctctgagccctgcgacttcagatcagagtattcttgttcaaaagcacgagtcctgaagagaggtgagctgcctagagcagcccagctggttagaagaggctctgggaggctcaccccatctcctcccaaggctcaccccatctcctcccaaggctcaccccatctcttcccaaggctcaccccatctcttcccaaggctcaccccatcttctcccaagcctcctcaagcccctgagttggggtaagggtctcaggctg

SEQ ID NO: 12292 - DNA, 86141 bp, Homo sapiens
acacaaaaatcaactcaaaataggttaaagatatcagtataagaaactgtaaaacttaaaatgaaactgtaaaactcttagaagtaaacgtagtgggaaagcttcatgacattaagtttgacaattatttctcggatatgatgccaaaaacacaaacaacaaaagcaaaattaaataggtaggactacatcaaacaaaaagcctctgcaccacaagggaaataatcaacagaatgaaaaggtagcctacaaaaaggaaaaaaaaattggaaaccatatatctggtaagagattaatatctaaaatatataaggaactcctataactcaatagtaaaaaacaaaaataaagaataaataacctgatttaaaaataggccaggaagttgaaaagacatttctccaaaaaagacatacaaatggccaacaagtacgtgaaaagattcttgacatcactagttatcagggaaatgtaagtcaataccacaatgagatatctcacacctattaggatgactattgttaaaaaataaataaataaataagtgttggtgaggatgtggaaaaattggaacccttgtatatgactgatggaaagtaaaaagttgcagtctctatggaaaacagtatggaggttccagaaataattaaaaatagaattaccatgtgacccagcaattctactacacatacacacacacacacacacacacacacacacacatatgtataagaatacgcacattaattccaataatctggatatattaatatatattcaaaagaactgaagtcagtatctcgaagaggtatatacactcccatgctcattgcatcattatttctaatagccaagatatggaaacaacttaaatatttattggcagattaacagataaagaaaaatatgatacctacacaaggaaatattaataagcctttaaaaaggaggaagtccatatggaacaacatggatgaatctgaatgacattatgctaagtgaaataagccagtcgcagaaggacaaatactgcatgatttctcttaaatgaggtgtctaaaacagtcagacttgtagatgcagacaataggatggtggctgctagggactgagcagggagagaaacagggaattgctgttcagcgggaataaaatttcatttatgtaagacgaataagttctagacattaacactacaacattgtgcctatagttggcaatattgtattgtattgtacacttaaaattttaagaggatagatctcatgtgaagtgttcttaccacaaaaaatcaatctgcacaataactctaaaatagaggtagtgtaattttccctattatcaaatgaagaatataagacttagggggttaaaaaacttgtctaagtcctccaagacagaaattggcagaaacaagatccaaacccaggacttgcaactccagaaaacacaaatgatgaaattattgaatactagatttgtcattataaaagtcatacactataatctatatatactgcttgctgttttgtagttaattaccttgtaatgtattaattattatagttacatccatcatgatatttgtcagattaactgtattacgagtttttattgagacagtgtggacttcactcctatatcattagtcttcttagtctgttgttcataaaacttgttcagctattcatgcagtgtgataatttgcttttaaattaaaaatataaagggaaatttgatcccagtcatattatctcagtatatacttttagaaaagagctccgaagcacaggtagggctgctagaggggagcataactgtccattctacctactttttgtgacaggaaatggggattaaggatacagatttagaagctgaataataattatagtctgatttttagtatcagactaaaaatcagttatcaaagtcctgacatctgtcctgacttggataaatgtttaaccatcaaaaaatactgccctttgccagtaatccagcactttggcaggcagaggcaggtggatcacctgaggtcaggagttcaagaacagcttggccaacatggcaaaaccctgtctctactaaaaatacaaaaattaaccgggtgtggtggtgcacgcctgtaattccagctactcgggaggctgaggcaggagaatcgcttgaacccgggaggtggaggttgcagtgagctgagatcacaccactgcactccagcctgtgtgacagagcgagactctgtctcaataattaattaattaatttagtttataaaagtwccctttgcccctctttctacctagtcccgctgtttaaatgactcccttaatatctgttatgtgggaaaaaccagctgaagtagactcacattgaatcctttttacctctgtcaatgatcaagaccagctacatagtttgtggggtccagcacaaaatgaaaatgtagagcctcttcttcaaaaactattaagaactccagaatgacagcagcagagcattaagccaagagtcatgcccttctaaatctttcttacttttaaaccaaagtgcaatacatgcacattaaataaaattgggaaaactgagatgagaaaaatataatccatagatccaataagtaagaacaggtactattagtatattgatatatttctacataggtgtcttttttatgggaaatttttttaaaacataattataataggatacatatttttcctgcatttttacaggtagcattatatcatacatcttttccacattatcatttaatcttaatagccaatgctttgggaggttcccttctcttatagatttggaaaaaagtttgaaagaaattatcacctgcttcatcaagtttatctattgcaatgaagagaccttgtggagagaagagggaaaaccacactgggttttagtaccagtccttccagtgactggctgaggccctgaacaagcttcttaactttctgagttccattttcctgctctataatagataagaataagaaaagtaaatagcagtaacacagtaatagtatgaatagtaacaatactagctgtcgattgttgattccctggcaaatctgtagtgccagaagtgtcagttattgtgctaggcatttacaaaacaaaaacaaaaacaaaaacaaaaacaaaaaaaaacacattacctcaagaatagtccacaaaatctttcagaggaagaataagcttgaagaggtaaactaatagttttcaatacctgttttaagtctttagtagttaagacagcatagcattggtgcagtgacagacaagctgaccagcccaatagcaaatagaatacaaaaacagacacaaaacaattgtcacctgatttatggtaaaggcagttctgcagtatagtagggaaatgatggtcttcaaaatacgctgccgggacacctggttaactctatggggaaaatgtacattgacttctacttggcatcacatacaaaaactaatcccaggtgttacatatcacatccaaatatgaaaggcaaatgacaaagattgtaaggtaaaacatagaaaaacatctgtgtgaccttggagtaaagatttcttaaaactacacaaaaagcataaattgtaaaagaaaaaaaattgataaattggacttcattaaaattttgaaattctgttcatgaaaagacaccattaagagagtgaaaagaaagccaggcacggtggttcacgcctgtaatcccagcactttgggatgctgaggtgggtggatcacctgagatcaggagttcaagatcagcctggccaacatggtaaaaccccatctctgctaaaaatacaaaaaattagctgggcatggtggcaggtgcctgtaatgccagctactctggaggctgaggcaggagagaattgcttgaacctgggaggcagctgttgcagtgagctgagatcatgccattgcactcccgcctgggcaacaagagctaaactccatctcaaaaaaaaaaaaaaagagagagagagagaaagagagtgaaaagacaatcacataaactttcattgtaatacatggtatttaacaaagttctcacttctacagtatataaacaactcatgaaaattgaaaagaaaaatacagttctaatagaaaaatgagaaaaaatgtggacaattcacaagagagaatatccaaattgtcactaatcatttgaaaagttgttcaactttattagtcatcgagaaaatgcaaataaaaayatgatagttctcacccatcagacagaaagaaccaagtcttagtcagcatatagagcaaccatggctctcttgcactattggggggtttataaaatagggcaaccactttgaaaaactatttggcagaatctagtgaagcagagcatatacacactttacgactcagcaattcctctcctaggtgtaacactagaactgtgtacatatgttcatcaaataaacatttacagcaacctataaatagtagggggaaaaaaaaacttaaaaactatccaaatgtcaatcaggaatagaatggataaataagttgtggtatagtcacgcaatagaatactgtgtggcaataagaataaattatccgcaactctataaaaccaaatggatgaatctcaaaaacataatgttgagtgaaaagacccagatacagaagagtatacaatgcacaatctcatttatataaattaccagaaaatcaaaacaagttatgctgttagaaatcgggatagtggtgacccttggtataggtgagtgctaagagtgacttgaggccgagcgcggtggtcacgcctgtaatcccagcactttgggaggccgaggcgggtgcatcacaaggtcaggagatcgagaccatcctggctaacacggtgaaaccctgtctctactaaaaatgaaaataaaataaaacaaaataaatagccgggcgtggtggtgggcacctgtagtcccagctactcaggaggctgaggcagaatggcgtgaacccgggagacggagcttgcagtgagccgagattgcgccactgcactccagcctgggcgacagagccagactccgtctcaaaaaaaaaaaaaaaaaccgactgacttgaaaagagcatgagatggacttgtgggtgctggtaatgatgggattcttgacctggataccatgatacgggcaaattccgtttgaaatgcactgatctgtatgtacccttatgtgcatttttccatatattaatgatacttgtaaaaaagttaaaaatatatattacttttaatttgtacccaactagttaagtaatatccccattttaaagatgaaaacaattaactttctgactttctttttattctaatttctattggccttcttattctattaaagtttccaaatttctctgcccaaggataagatacttgaatatttaaaacaatactgcaacaaagatttcttctttccctccctccctcctttctttttctttctttctttctttctttctttctttctctttctttctttctttctctctctctctctctctttctttctttctttctttctttctttctttctttcctttctttctttttctttctctcttcttttttgagacggagtttcctgttgcccaggctggagtgaaatggcatgaccttggctcactgcaacctctgcctcctaggttcaagcgattctcctgcctcacccttccaagtagctaggattccaggtgcccgcaaccaagcctggctaattcttgtattttcagtagagatggagttttaccatgttggccaggctgatctctaactcgtgacctcaggtgatccaccctcctcggcctcccaaagtgctggaattacaggcatgagccaccatgccgggtcaacaaagatttcttaaacagtgcaaaggttgttatttctactaatgtctatttattttctatgcattttattctgtaggcgagcaaaggtcggactacaatcgtggtagcacaccgactttctactattcgaagtgcagatttgattgtgaccctaaaggatggaatgctggcrgagaaaggagcacatgctgaactaatggcaaaacgaggtctatattattcacttgtgatgtcacaggtaatgcttatgtgacataatgctatgtcagcagggtttaacgtttcagagatcataccacactagaaaacaaaagttgcaaattataatcttaaatttcaaaaagcaaccaaggtttatrgttcctcagtaaagaaatggagtgtttcaaatcctcagtgttgtgctcaataatatgatgaaagttgaagaactaatgggtacctggtacctaatatctgccaggcacacttcaaataggcttcaaaacttgtatgtgaccagaaagcgtggctcacacctgcaatcccagcaatttgggaggtcgaggcgggcggatcatgaggtcaggagatcgagaccatgctggccaacatggtgaaaccttgtctctcaaaaacacacaaaaattagctgggtgtggtggtgtgtgcctgcaatcccagctactcagaaggctgaggcaagcgaattgcttgaactagggagtcggaggttgcagtgagcccagattgcgccactgcactccagcctgccgacagagcgagactccatttcaaaaaaacgaacaaacaaacaaacaaaaacttgtatgtggaagatactgtgatgtttggttagaacacaaagaaatataacacacagtctttacttaaagacttaaaactcagctacagaggcaaattgcaaaattgtgcatatagatattattagttgtaaaaagaaaaagcaagattgatggggagagacagagctatattacccacaaaaggcttcatggaagaggtctttaaggttaaaaggtgggagttgggggtgaacataaaggacaaattcaggtaggcagaacaacagcatagaggtaagaaggaacttggtgtgcgactgaaacaaaaaggaggtagctttccttaagtacttatgagtgttgagggtataatggaaaagagttggaaaataaccatcagatcatggacgttctgagaagccaggcagaagggttgagacttaacgtatgtaggaagcacctaagacaatgcctggcacacagtgggcactcaataaacacttgctgaatgaagggatgcacacgtaaaaccttactatgtgcatgctaccacatcaccacagatggaccagaaagctcatactgggcaatcaagctggggcatgatgatgctggaggcacacggcaaattccccttctttaggatccatacttgcgtgtgtcatggatccaccctactggatttcacataactttctcattagggcacattaatwtgagtcatgggaattaggctctagctctcttctttgttctcgcccagctttcttctcttgacctggaaggcatccttttttcgaagggctcttctacagataactgatttcaaccctttttggtcttcttcagctttctgataatatctttgatgtcaatattattattttataaattaggaaatttagaaagttatgagcctccatctcctcatcaagtttataacttcaaatttcaaaccctaactttctccattgtgctaaaatgaaatatttctgaacataccctaagaagcaataacagtaaaataggtttgaaaatgtagtttttattaattgaaaaactgtctgattctcattttatttcatattagttcacattttgtgtctcaaaaataaaagtgaggtgttatttgataatcgaatttttattccacagtagacctaataatttacgaggtttaatattttgaaactaatatgagttggaataataggaaataactggtygaattaagcctattttaagattttttaaamactattaatactagtatagtcagatcttyctttggagtagtacatctttattttttattgtaattaaactaaaaatccattataggtcttaagttaaatgctttcacaatgtataaaaagcaaaaatggtgtgtttgtgggatgagtgtgtaaaaattttaaacaccttatttaaaatggattagtattctctggttacctaaaatgatgcccaatcagatataacaacaccgttttaaatattaatactaagtataatattctaagcatggtacagtaaatgtaacatacataatatctacacaaacacttttgaaatgtgaagatctgcacattcttatttgccaagattgactgcggtatcaaaatgtgtcaattttgataattcgtgattatcacaaatatcacagttaatgctgctaaaataatcccgagaagcaatatagcaatgtggttaagatgatgaactctgtggtcactacaagttgactctaccacttaatagttttaggtccttgagcaagttatttaaattctcagtgcatcaatttcctaacctttaacaagagggaaatggtaataacctattaataaattattgtgagtattaaacaggcaaaatcatgtgaagtacttagaattattgttagtgtaataaattttattatgttattgacattaacattattttatcaaactttttagaaaagttcaaactatggagactaatattataattatttatttagactgtccatggttatatacatgtatattgctttagtgagtttgtatgtgaaaatgaaatataaacatgtagagatatacacatatcaaaacttactgtcatcattattttgtccagcgaccttctcaagaaaagaaaatttccttgacttattaaagcaccttctcagaaaatgtattatgaagagaggtcaaagttctattttaaacttgccacaaagtgagaaactcctgggggcaggggagaaaagccaaacaaggcaggacatgacggctggttcctgtaatcccagctacttggaaggctgaggcaggaggactgcttgagctgaggagtttaacactagcttgggcaacacagtgagacctactctctaaataagtaaataaataaataaaaacaaaaaataaaaaatttcaaagccatataaaatatttctttcatggcagagacatttacaggaaaaaagagaaaatgatagcaaaaaggaatgcctgattaaagatgtttggatagtccggggctggttaaagttcattgtccctttaaatgactgattacagttgttaggcttatcaaagaatcaccgtgtccctggaaactcttccatgtgcacattctccttgtgcacctaaatcgacctacattttccatctcttccccacgttggccagacctgctggcaacttagctgggcttctcatttctcttgtccttctcctcccatctcctcctgggaaagtcattgatttactcaaaccacattcaaatgaacagagaatctgtagctcctttatttcactaaagtggtctttttagtagagacagggtgttaccatgttggccaggctggtctgaaactcctggcctgaagtgatccgcacgtctcggtttcccaaagtgctgggattacaggggtgacgactgcacctggtctttaatgttaatttgattgctttggaatttcttattgttgaggagtaggccctgttagttttgtgttttgttcacagttcagaatgggtagcaggggcaggcctggaaagcatgattgtctcccaaggtctctctcaggcccagcctcacatataagtacccaactaaatactacaaggtcataagccccagaaatggctaggaggaaggcgtcagaaacagtatcttctgtctcaaaaagctcctgttactaagatctctccttgttagtgatataattgcttggattaaggcattgttttctgcaggtgattatacatgtctttggaaaagaaaggacaatgagctattgtcagtcactaacattttagtatgagatagacttatcagctctctatcaagcctgaaagctgttcagcaagaactacattagaatatgccactttcaatagcaaaggcgataacagctttaaagagatgcttaataagtttccttgaatttttaaggcattcttataatgataacctatatattcttcctgtaaggatattaaaaaagctgatgaacagatggagtcaatgacatattctactgaaagaaagaccaactcacttcctctgcactctgtgaagagcatcaagtcagacttcattgacaaggctgaggaatccacccaatctaaagaggtaatggctcagcgatcaaccagtttttcctgcatgttttctaattttgatttaatccttacaaaatttaaaatttatttatagtaaaatattacttactgtagcactaagctcacaaaacatgtctttcccaaatttcactctagcatcagtgtgtcactctaggtaaggctgcctaataaggctgcatttatatcagaggcccttctttattggggaaaaaaaaatctcgtgagactgttacatgatgtttttcctatgaagcaaaccataggttaaaacagtgcctcggcaaatgtgatacagataccaatggtgatgctcaagattaatttgggtcaggtcagaggcataaatgcatgccactcccggaatgcagataggcccagcacatacaccacccaggcttgcagtcccagggcacaacctgagaagccttgctcacttggatgggagtatttgttcccatgcttactgtgcccactcctacccccaaagccccaggctctgcctgagccccacatcacctgctttgactctccttctgctgatacccctcatacctcccagcagttcccatctgcacctgaagtctcacttttctgtctcaattccactttccttctcttaacacgcccgacacctgctttgagcctccaccacacatcctgaacattctctgcagcacccttttacaacacacccttccatcttaatctcaccttaacccatgcttctcccagcctccgcattcactgagctccagccctcttcccaaacccagtcgacctttgctagcccctggtgctctgtaacctcacatgccttgaaatccctcacccttgcccctgtatctcagcttcagtcccctaacctccagcatccataccatctcacacctatccttggcccattgtttcctcccaaactagagtttccttcttctccttgggactgacagagacttgagattgaatctcctcttagcccgtcttcatgcccactttccttggtctcatctgtcaattatctgcctgaagcccctggattatctgccccaaaacccctcttgcccttctctggcattgctaatccattgcttttaattttagctacaactctttccttttaggtatgtggtcctctatagccatttacactcagacatttttccttttctgctaattttatttttttaagtctatttaaataaataagcatgcaaagaaaaataatggtatagatggtataccatatgacaaatgtatgttaagaatatagtacaagaaagtttgtactgagacactaggcaagagtggaggaaacactgtgttaaaacatctattgatagctgctggacctccctcagcaactgctgaaaacactatggaaatctgcctctaggtctaaaaattcaccgtatttatgaagtggattttcaaaacctaagaaagataaaaaacgaaaattaaaaaggaatttccagatttctggacaaaatgatataattggtttacaatctgatacaactacgtgctccacacatggaaactgataaaatataaaatgagaaaaaacaataaaatgtatctaggctctaaaacaggaggaatatctcttcacaccagaactagagcaaaagcacaaagtggtgagctggacaatagtcacagacctgctctgaaaagaaggctgaaaaacctggttagccaatgcctggagctaaagtttatagaaatccgtgagcctggggaagcaggaaacagagaaagtgtcctacaaccaagaaccgaaataagctaaggagtgactcaatggccatatttttaagggactctttcagactgtggtaatccagtgaaaaataarcaaggaagtgaagagactgtaataatcaataatgagctggggacagtgacaggtctataataatagctacaagagaggttaaggtaggaggattgcttgagcttaggagttcaaggctgcagtgagctatgatcatgccactgtaccccagcctgactgacagagcaagaacccatctctgaaataaataaaaataaaataaataggccaggtgagtggttcacgcctataatcccagcactttgggaggctgaggtgggtagatcactcgaggtcaggagttcaacaccagcctgaccaacatggtgaaaccctgcctctactaaaaatataaaaaattagctgggcgtgatggcacatgcctgtaatcctagctactcgggaggctgaggcaggagaattgcttgaatccgggaggcagaggttgcagtgagctaagatcatgccactgcactccagcctgggcaacagagtgagacccggtctcaaaaaacaaaccaaaaaacaaaataaaataaaataaaataaacaaagatcaataatgaaatgaaaaagaaatggagcagtattttagaacagagttaatgggagttctattagtctgggtccagtcaggagatagaaagcacacaatgaaagagaaagtttagtataatgaatcattaagaggggattgtagtatggggagttgggtagcgaaagttaagacatctctaccatctcacaccagttagaatggcgatcattaaaaagtcaggaaacaacaggtgctggagaggatgtggagaaataggaacacttttacactgctggtgggactgtaaactagttcaaccattgtggaagtcagtgtggcgattcctcaaggatcaagaactagaaataccatttgacccagccatcccattactgggtatataccccaargattataaatcatgctgctataaagacacatgcacacgtatgtttattgcagcactattcacaatagcaaagacttggaaccaacccaaatgcccatcaatgatagactggattaagaaaatgtggcacatatacaccatggaatactaggcagccataaaaaaggatgagttcatgtcctttgtaggggcatggatgaagctggaaaccatctttctcagcaaactaacaaggacagaaaascaaacacggcatgttctcactcataggtgggaattgaacaaygagaacacttggacacaggaaggggaacatcacacaccagggtctgtggtggggtggggagaggggggagggatagcattaggagatatacctaaggtaaatgaygagttaatgggtrcagcacaccaacatggcacatgtatacatatgtaacaaacctgcacgttgtgcacatgtaccctagaacttaaagtataataataaaataataataataataataaaagaaagttaagacacctctaaagaatacagaagtagcagataaaagtagcaccccactaccsctggagtgaaatacagcacccatcgatgatccctttcttctctcccagcaaggcggagaggcaggcctcaatggaaagggcacagctgtggttcactggatggcagagcagttgctgtggtrccttgctggtggggcttgctggaaatctgccctcaagggtggcaagggagaccttccacaggacggtgctgagcttcagaacctgtcaggtgctggggaaactactggccactgagcactactggaacaagaagctagccaagattgtcatctgcaggagtctagggcacttctgcatgtgggagggtgcaggcattagtgacctggctgagacataggactgtgctcatagttatgcctctgtaacctaagccaagagctagagaaagcacccagtggccacacagaagagaaagctgcattctgcaggcacctgcctctgaaaaactatgcaggcagaacagaggagaaaaaaaaccatcctgcaggagctttcccagggagcaccagaaagataaggaagaaaaacctcctcctgcaatgtctttgcggcaccctctactgacagggcttaacctcttgcccactggtaaaggagaaatatttattaggcaaaaaagtgaatttgaaccagagaggcaataagtcaataaccaggacaggggtggtaatatttcagacaggggcacagcaagcatgagggcctggatttgggggtcccaatgactaacgacaggggtaggcagagaggcgtgtgggacactgagggaccggttcatgcagggcctcttaggccatcatgacaagtttggattctattcttcctctaacaaaaaaccttcaggagtttttaaacagtggttcatgacctatagggaatttctgaatagatttcagagcccattaacctgaatgaataaaaaatcacaactttttccccccattaacccttgatagaaatgtaacatttactttgtgaatctaagcaacaaactacaatagtattaccagtatttgtgacatcacgaacggataccacagaaattttaatataacattgcccttatagataatttacaatatatttacactcatcattatyatatcttatgttctaataatgaaccacattcataactgtatcacaactttaggttacttgttaaatattttgaatacgatgtttcaatggaattggctttcttggagtcctatgtatcatttagtatatttacacatttcttcagggaaggattccatagacttcaccagtcttccaaaggagtccacgaaataaaacaggtgaagcactgctgcattagagggtcttattcagaagggcacatggtctgatctactccatgtggctacagtttggagaacagtgtgtgggggccagagtaagatgagggaaagcagaacggagaggaggtgatggaggctgaataatgaacttgattggtctcactaaagctgtcagcggagaaataaaatatagatggataaaagagtaggacaggggaatgagagtcaggaccctgcaccatttagattcggatagaaaaagtcactagtgaagggatcctaacaaatggctggcaaaataagaggaaacccaggagagtgttgtatcatagacaccaaaaaagaaatgtggtacagaagaaggaagagatcatttttgttaactgccgtgaagaatcacataaaattagagattttcactttcaaccaagatagattaacagggactagatttactttcctgcttgatagaactaagaaactgaacaaaatatgtgaaataatggcttctgacattggacatcatgcaaagtaggatagtgatctctgtggaaggagaaataaatgagatgaaacttgtcattgacccagtttaaggtctgagtagttttcaggcctcggagcctagagggaaaacacagacaaaacccagtggacttttttttttttttttttttttttttttgagacggagtttcactcttgttgctcaggctagagtgcaatggcgcagtctcggctcaccgcaaactccgcctcccgaaactcagtggactttgagttgaggagacagagctaagagttgaaggaggccaaagtagccagaggtttcagagcaaagaaccggagaggagagaacttctcagaaagagaaaagcccagagatctgcagaggttctcctttgagtcttcatccgactactgatcagtgtatttattgaggaaactaccagaggcagggtatatatctaccagaaaagattaaaaggagcaattcttagaagtcacacagggccaggaaaagttcttattaaactaactggagtagaaaatctttaaattcatttttatttatttatttatttatttatttatttatttatttatgattattatacttgaagttttagggtacatgtgcacaacgtgcaggtgagacactgggtaaagtgttaagaaagatattgcctcagaggggaagataattagtcctagactaaactctgcactaaacctaactaacaaatcctaatagcaagactcaaaaggattaaactgtttccaagtaatttaaatgtgttccagaacaaggctcartaacatttacgagaattcagaaatacctagtccccaaaagtttaaaatttacaatgtctggcatccattcaaaaatcaccaggcaagcaaaaaaggagaaaaaaaatgtacccaaaatgaagagaaaaatcagtcaataatagaaatagacccggaaatggcacacttagtagagttagtagagacattaagcatttattatatctatattccgtatgtacatatgtccccaaaggaagtccaaatcattgaagaaataatgctttaaaaatttgccaatttgatgaaaacttaaaatccacagattcaagaagctcaataaattctaagcataagaaacataagaaatcctacacctaggtatatcataatcaaactgcttaaaaccaatgttaaggagaaaactactaaagcatccagagaaattgacacaatatagatgaggaaaaagacaagaaagctacaaacttctcrtcagaaacaatgcaaacaagaagataatggagcaatattttcaaagcactgaaagaaaaagaaaacacctcaaatcagaatgctatttacagaaaaatgccyaataaaaaggaaggcaaagttcagacattttcagaaattaaaggttaaaataattaactaccagcacacctacactacaagaaatattaaaggaagtcctttgagcagaaggaaagtgatactagatggaaatctgaatatacacaaaggaatgaagagtatcagtaatagtaaatatacaagttactataaaagaatggtttgtatatttacatttttgatatgtttaaaagcatacttatttttcaaagaaaaaagaacattatattatgggtttttttaagacaagtattagtaaaatgtttgaaaacaatagccaaaacactgggaaaaagaaactaaagtattatattttaaggttcctaagtggtatataacattgtctgaaggtagattgtgatgttaaggacagccaaagtaattttcttagagcaaacaacattactagggataaagaagtttctttcaaaattaaaaaggaatcagtttatccagaactgcaaatagacaaatctccaattgtattcagagatttcaacacccttctactaaatcttagtagaacaagtaaatagaaattcggcagaaacatagatgactttaatagcactatcaacaaatttgacctaataaacatttgtagaagacttcacatattaacaacagagtatgtcttcttctcaaatgcacttgaaacatttaccaaaatagaccatattctggactataacacaagtctcaataaacttttaaaaattcacataataccagcctgggtaacatagggagaccctgtttctacaaaaaaaaataataataattaaccaggaatagtggcatgttcctgtagtcccagctactggaaggctgatgtaggaggattacttgaacccaagactttgaggctgcagtgagctatgattgcattaccgtaccccatgttgggtaacagaacaagaccctgtctcaaaaaaaagaaaaaaaatcaagaaatgcaaagtatattacctgaccaatatggaataaagtcagaagtcaataacagaaagtggtctgggaaaccttgaaatatttataaactacataactcacttctaaataatgcacaaatcaaaggaaaaatcaaaagagaaactcaaaagtgttttgaattgaacaaaaatgaacactgaacatatcaaaatgtataggaagcttaaagtgatactgagaaagaaacttgtaccactaaacacctatactatctaaaaatctcaaattaatatactaagcttccaccttaagataccagaaggaagaaaataacaaagaaaaatcaatcaaatacaaagctggttctctgggaacatcaatattgaactcactgagcaagaaaaaaaagaagatacaaactgccaacatcaagaatgaaagagctgacatcactacagattctacatatattaaaagactaataaaataatcttattaaaacatttatgcaaacaaatcctacaactcagatgaaatgagcaaattccctaaagtttacaaactaccaaagcccactcaagaataaattgatagtttgaatattcttacatttattttaaaaaattgaatctgtggttaaattcttttttccctaaaaaaaaaaacaaaaaaacaaaaaaactttaagccatatggctttactgatgacttctattaaaaaaaaaagtgataaggaagaagttcttattctatgagaccaacatcattactctgatatcaaaattagacaatgagattacaaaaaaaataaaattatagacaaatatcagccatgaacatagacgaaagaattcttaacaaaatgtaacaaatctaatccaaccatatagaaaaagaataatatatcatcaccaagtaggactgttctaaaaactgaaaagttggtttaacattcagaaattaatgtaattctcctaattaaaaaaattaaaaagaaaaaaccaattatctcaatcaatgcagaaaacccatttgataaaataccccatcattttttgataactctcagcaagcaacgaattaaaagaaattccttcaacctgataaaaggcagctacaaaaaacaacggctaacatcatactaaatggtgaaagactaagatcgagaacaaggcaagggcatacactacatctattgaacattgtactggaagttctggcctgttcaataaggcaagaaaataaaagcatccaggtaggaaaggaacatgtaggagtgtctttattcacagatggcatgattacttatgcaaacaatcttatggaatctacacatacacacacatacacgtactaaaactaataaagtttagcaaggttgtagaatatgtgacaatatactaaaatcaatcccaattctatatactacaagtgggaagtgggaaattaaaaataaaaaaataattttatgtacaatagtaccaaaatattaaattatagggaataaatgtgatcagagattgtaaaacccacacactgcaatctataaaatattacagagaaaaactactgagaaaaatagactaaataaattaaaagatattttcaatgtgagtgaataagaaaattcagtatagttaagatgttctttctcctccaattgaattcacatggaaatgcagaaagccaaaatagtcaaaataaattttttttaaaaagagcaaagttggaagagggatactacctgatttcaattctgtttcaactactatataaagctaattactaattctcatttcaattacctatagaactatagtaatcaaaacatttcaatggcatacaaatagacaaatagatcaatggaacagaaaagagagctgagaagtagtcccacacataaatggtcaattgcttttcaacacaagggcaaaggcaactcaattaacaattttttttttcaaaaaatgattctggatcaattatatatctatagacaaaataatcagccacaacccatacctcaaaccacagatgaaaattaactcaaaatggattaaagcccttacgtaaaacctaaaataataaaacttctataagaaaatgcaataaaaaaatcttcacgactttgtgttaagcaaagatctcctaaatataacaacaaatgcataatttataaacaaaaaaattgataagtcagacattaccaaaatcaagaacttcattatttgtaaaacacttcaaagaaaatgaaaaggatagaccataaactaggggaaaatgtttgtaaatcacatatctgatcaggacttgtatccaaaaaatataaagaactcccaaagcacaataataaaaatacaaacaacccaattaaatgtcagcaaaagatttgaaaaggcattttgctaaacaagatgagcacattggaaataagcacacaaaaagatgcccaacgtggttagtcatttcagaaatgcaaaaaaaaaatcacaatgagaaatcactatacacctgttagaatggttaaatctaaagagactgacagtaccaaatattggtgatggtggggtgcaactggagcttatttagctggtgggagtataaaatgctaaagctactttggaaaataatttgtcagtttcttaaaaagtgaaacattcacctactaaatgatccagccatttcatttctagatatttgctcaagagaaatgaaagtatatgtccacacaaagccttgtatatgaatgttcatagcagttttatgtgtaatagtctaaaagtgggaaccactcaaatttatatcaacaggtggatggataataatttgtgagatagctatacagtgaaatgctatgcagcaataaaaggaaatgatatgctgatttatgccrcagcatggataaatggcaaaataagtatgttgagcaaaacaagctatctgaaaaggagtagataatgtatgatttcatttatataatgttctaaaaatgcaaactaatctatagtgactgaaagcatatcagtagttgcaggaggaaggaaggaagaggactggcaactaagaagtgtggagagagggatgataaaaaagcaggagaaaacttctaggggtaatggatatgtttattatcttgacttttttgatgttttcctgagtctgtagcagtgttcaaatttatcaaattttacatttcaaatatgtgcactttgttatatgaaaactataactcaagaaagctctaagctgtatcaaatgaaatttagaatattttagatatcactttttaactttttaatactcgtcatatctctttatgtctataattttatgtttttgtatgagattattttaacgcatgtacaacctgtctcatatttaagtaacacagcctattttatgattttactgaaatttttgttttgtttttatcttatttacttcttttctatcttgacaacactatttaaatgataccattttaaatcttttattgtgtattttcccagaggcaaaagaacatctttaaattacctatgtaatgtagatcgttctataggaggaagatagccctcctaatttccyggctctgtaatttactggtgtcctggcacatgttaaaccttaatctccttaccaaataaggtaattttgtaatgcacttagtttcatgctcagtgcctgatagttagcgtgcaactttttaaatttttgtacattcttttgaacagtgacctagctgaaatgttgtgccctttttgatgatgagctttagaaaacttcagcaggaaaratgatggatacaatcaaattattaagtaatccaatataaatgtgggttagccaccctgaaaatggactttaaaggcatcagaatttcaaagttctgttgtccaaacaacagtccgcattatagtggccacactgagaatagaacgagaattataaactattttatagtcttacttgaagaattctctggttattaggtccataaatgtcattattttaagagtgaatgccatgaggaagttttaatgaatgaaataccaaagaattcactgtctactttcctactcagaataattactcaccacaaagctgttcagaagaatttttaagattctgaaatacactacttattgcagacaagagccaagagagatcgttatcgtattatttatcctctgaccactgtgaccactacctccccttgtcaccttccacgtctcctaggaagggctggcagacccagaatgactacttgcattgtsctttctctgtataaaacctgaaattttgtgtaayataatccttcctctgtaataacatcagaaacagcaatgactgctagcatttattgggtgtttattgtttgcaaatacagtgagttgcaaatgtactgaataaagcttaattgtataaacaatcctacaagataggaactgataccactccccttggaaaaatgaggagacagtcttggtgagtttaaataatgtgctcggatattgcaatattttgcttgtaaataagaactccaaaacaagccaaggtattaggaaaatgtttttgtaaatacatcttgaaactttccaactttcaagtttgagatcgtaatgaaacttttaccttccrcattttcttttcttagcttctgcctagatttttttcttatcctgtagtacaatattccatccagtttaacaagagtaaagaaaaatacacctgccatttcttttgtgacccttaacaattacatgtgagttaactgtactttttaaataatagcaactgagtgaaatgccaaaaagtgatattgcacaaatagtcacttgtggcaaatcttcttttattttatgctttagggtcatcgttaataatacgggcagtgaattttttaagaaaaatattttctaccctgctgtctgttatgtttgatgttatacattataattctgtttatgatgggctaacttcactagattctgttatgcacacaaactggcatttttaaccaacatattttatttttagataagtcttcctgaagtctctctattaaaaattttaaagttaaacaagcctgaatggccttttgtggttctggggacattggcttctgttctaaatggaactgttcatccagtattttccatcatctttgcaaaaattataaccgtaagtaaaataaatttgctaatactttcagcaatttaaagaaagtatgacctgagagaacaagcttgtatcagtctaaaccacaaggggaaaattgggacttttagtgggccgcccctagtgtggagtccgtgataggaaggttaattaatgttcccaggagataagccagcatctcttgtaaagtgtgtggccgggccttgttgactgggcaatcagtgaagaaattgctttgttttctaatttttactccagtgctggatcagcattccaaaacactgaagaaataaaataggcaaatacaactactttcctttcaattagtgggtatagttgcaatttcttttcttaccagccagctcagggagaagaaataacaagagtctgggattttgctaaaggactcagggcaattggtgtgtttaaggatcttacaagatccatgcttactcttcaatgttaactaaagttctagcctggaacttcagtctccctaatttgcacagctatactttatcagtataaatgcctgtgtatgtatgttactaatttttaagaaaaattctgggggcacattaaaaagcctcaccttgcaggtactacttaactagaagactactaagaaacttgagtgatcaaaaattattcaaaataataattcaagcaaactggtggtttcttgggaaatatactgtgataataatagcagatagatgactcattattcagatctcatatttacatagtttaagagaattaaaagcaagttattttttatcatagataatgtatgcagatgatagcatcatggtgcactttttcccacagaaatgtgtgtatagttttatttttatgttgaaatttattttaagctgggtgcaatggctcacgcctgtaatcccagcactttgggaggcggaggcagccggatcacttgaggtcaagagcttgagaccagcctgcccagtakagtgaaaccccatctctattaaaaacataaaaattagccgggtgtggtggtgcgcgcctgtaatcccagctactcgggaggctgaggcatgagaatcacttgaacctgggaggcagaggttgcattgagccaagactgagatcgcaacactgcactccagcctgggcgacagagcaagattctgtctcataaaagaaaaaaaaaaaagaaatgtattttaaaactcctgatatacagaaattttcactttttctgtttcttttatattttcccccaaacacctgataaaaatctgttccttttcagatgtttggaaataatgataaaaccacattaaagcatgatgcagaaatttattccatgatattcgtcattttgggtgttatttgctttgtcagttatttcatgcaggtaagcttttaataaacaagcctgagcatgattactttttgttgccattctttctatttgagttaaaaatatatcaactaaatgttacaaaggaaaagaacgtagatttttgtttgtttrcttttcagggattattttacggcagagcaggggaaattttaacgatgagattaagacacttggccttcaaagccatgttatatcaggtcagtgataagttgatttttttttattttatttaaaatttattgtaaaacattctagctttaattctgtctcaagtcamtttttgacataatctttctttgaaagcacactctttttgttctaagcagcaaaaatctgatgtcagaagtcttatatttttctaaaagaagcaagtccaaaagtgtgacgttaaaaaaatacagcttatagaaaagaatgtaggatctactcattgttccttgcattcatcttgacaaatctttcttttaatgaatgatgtagtgttctgggatcagaacggaaggccaaattaaaaaggagaagtaagagctaccatatcttgggaatgtatctgaaaagaagttgttaatttctstggttctaattcatgtgcatagcttaagttttttgactctacacttcttaaagcagccartctctctgcctttatcagaagagtcctgaactcagataacatcggtctagctgccaggtctgcctgcctcacgcagatgatcagtccccgctgtgaaataactaaaaataggtggatcaagtagtaatcttgagaagtgagtcttgggggcaaatggaaggaatgtctcagactggcacctctaaaattctttcacgaggctaaaatgtattgggttaccctgaaagccagtaatcattagtagcccttcacctcactttctgtcacaaaagctcaccaggcaggagcaaatagcttcctgccaaggtgatttcttttcagaaatagagttactgtcactccaactgagtcgtcaaaacccatttttaartcttatgacttttaggagcagtgctctgaaggctgccgtgcaacagctgtactcttagggagctacaagatacaaaacggaragaagcaagtcggaggtttcccacggcaacaccgtggtctaaagcaatgggtgaccttacaccttctgtkcaaaaaggtcccatttctgcttcttgttccacatttggagacactccttaatccagaaaaacaaaagtctacttgtaggatcataaatcaatttgatgccagcacatacctctcatgttaaagttgtacattattattttttaatttatgaatactttaggtctttactgcaaatattccaagaaataagttgagactttaattaactaatactgtatttcacatttgttgactatttctgctcatttttgtttttctttaaatttatctttttccctgttcaaataaatttattttaaatttctagaaacttttgaaaakgtttcctgaatgcctagatgtttgtttttatacagaagaatataaattttaatttttccaagcatactttgaacttcctttctgttcatggaatgcttttagtggaagaatttcaaagccatgagacygtttaatgagagaaactgtggttaatctagtattttgatggttaatactggacattaatcctctgtctagcattagccatgtgaatattaggactgtaacatttttagatacagtagcttctgctaataaggatgcttgaaactataagccataaactctgggttttaaaatatcwtgtacatactcacaaagacttgcacagaaagtctatgccacttagcacatgttattaaatatccccataagttaagttgtttgttttccttcttcatccttcagcactctttttgattcttagctttaccttttaaaattggagaaaaagaagactagtatatttagccctttctttgtaagcatcttcacagttttgctttgtctatagtaagggaagcccctagtgtgcagttttatctaactcttattacctgatttttgtcctaagataagactttttaaaatttaacaaccgtgctcagacttgcagtgctttttataamcattgtgaaacttcatttgaggtagaggtatgtaaagaaacaggtgtgtgtaggtataaaatccatattttatgtgattactttagattcttcctgttgaaaagaatgttctaagtgttgctgacttcagtcactgaataattcgtcgttcattgtgtttcaaagttaagtttacaattcttaatgataaataattacctatagagctattgagtttttgaacatgtaagaagtttatttttccccatttccctctaaattagattggctaaggcttcttggggttctttaaattatgatagcattgatggtgatcactaaggggcttcaaaatttacctaagctaattccaaaaggctttgaggtaatgagtcctggagcatgagaaacaggtcatgaaactcagctgtaattcttcagtcagatggcaggccgaacaaaataattgattaagaacttaaataatctgtacaacaaacccccatgacacaagtttacctgtatcacaaacctacacatgtactcttcaacttgaaagtttaaaaaacaaagtttttaacaaaaaatatccattgaggctaactaaacaattagtattacatataatggatttttttttttttttttttttcctgagacacagtctcgctctgtcgcccaggctggactgcaatggcgtgatctcggctcactgcaagctccgcctccagggttcacgccattctcatgcctcagcctcctgagtagctgggactacaggcgcccaccgccacgcctggctaatttttttttttttttttttttgtatttttagtggagatgggatttcaccatgttagccaagatggtctcgatctcctgacctcgtgatccacccatcttggcctccctaaatgttttcatatatrttgcctatgctggaaaacaatccctggagtacacaattgctgtcttgccaaaaagcaatttcagacatcttgccaactgaacatcagataatgactaagattaatcacatatgtacctattcatggtgttttacagcgagttactatagaatcaggaatgtaatattcaataataaattcttttcatattttttactttatactgtatctaaaaatgatctgtgcattccatgtcatgttgaaatctagaaccaattagaaaatacataaaatatcttaattttggagagagagaacacaataaaaagcaggtgatgtctttcagttcagcagtgctgtgtttattattgttgctgctgtgtattcacagtatgttaggctcttgcctgggattgtgctttcaaagtggctactgtccggtgcagactgtaatctccataggatgctctttgggcatctaggacccgaagctcatgcagacaccttcccaacacagtggctcagggtggtgctatcatgcctggctcctaccatattcctccataaaagttttcatctaacatatgatgtgcgtgattaaggcacagccctcaacctgctatgcctttgttttgcctgttacctgggcctcagagccctggctgggttgcagtaagccaagattttttttgttctttactcactaaaaataaaccatctttcagagacagtttccacatggttttaatctacaagagatacaagtggttccagtgagtgtgaggaaacattcaatagctataagaggaaatcagaattcctcaggctgagaagcactaagatgtgctgtctccatttgctgttgaaaataaaattggttattacattatacttttattgcttgtaattttgacctgactccttctttagattgcatacctcttaacttcaggagtttcacagccttctgcccttttagcttctcacaacgcccattgctgtaagttctaggaggtaatgtgaagcgtcagggaaaatctttattatatggcccctaaagagaaagagatagactttttatcattagttagtttaggtagaaagttttgaagatatttctaaattgtgttgtttattgccttcctttttttttttttttttttttgtgagacagggtctcactctggcatccgagctggagtgcagtggtgtaatctcagctcactgaaacctctgcctcccaggctcaagcaatcctccccacctcagcctcccaagtagctgggaccacaggtgcacaccaccatgcccagctaatgtttgtgttttttgtaaagacagagttttgccatgttggccaggctggtctcgaccccctagactcaatcctcccaccttggccttccaaagtgttggaattacaggtgtgagccaccgctctggccttcatcgccttacttttgaattatgtctgcttttcacaaatgacttatggaataaaattacaaatcacttgatggttgaaaatgaccattttaattcaacattgattattatactatatgtggtgatgagtaatgagtccaagctcttgggcttaagttcttcagtttatatataaatatagatcttcatgaaaaaataagcaacagtcattcaatccatagtattttataggaattaagtacctgtgagtgaggaggcaggtaaatgttttctgatttacagcagaaaaatcacaagtcagataaaaaaaatgatttttgacaaccatatgttaattctccttttctctaggatattgcctggtttgatgaaaaggaaaacagcacaggaggcttgacaacaatattagccatagatatagcacaaattcaaggagtatgtatattgtttttattgtaaatgatgtatgtatgtggtgtgcacacatgcaatgcacacatgtgtctgtgcatatatgtgagctgtgctgagatgacccacatcattamtgaggccaggtaagtctcayggttaacaggtaactctcagtgaaagatgaaaggaagactttccgttctggatatttttaaccaaaaatagagaatatttagtacctgtaataggataactagaggactaaagaagagaccaagaataagttagaaaaaagagctcagaattaaatagttagataaggaaaagtaacgaaatgaaaacacacacactttgagttttaatataagaaaaaggtttagtttttccttcccccagaaaataagattttagttaaaataatgtctaacaattcagagtcatgtgtgcatcagaaatgattctgtactacttgttatacaagttaaaaagaattgtgtaatcatgaccagtaatatgcataaccaagatatttgtatatattcataattagtgatggaatgaccagcataatatgtatcaaagtcatgcttaaacagctgtggggagtagaggagtatagaagaggtaagtaataatttgttagttttcttttaattattttaacaaaattcacctttgtacaacaaatgggatcttaactgagaaaagcagcagaaaacaaggtttcctactttaaactgaagtaaaataaagctttctatttctgttaaaataaaaattctagtagagttataggctttcctttttccttatcatgcatttgggagaaaaggaaaatgtcaataattcacttctgaataacagaaaaatcttacaagtatttattctgtttaggaatactgagatgttgcttgaagctttgttagcagagcaacaaactgtcaactaaagcaacccatcagaattgtatgtttcttttagagattatttccacaggatatggcaaccgttctaagttgttttttttttttaacttttgcaagacctctttgtttaatatacatcggcaagatcrgatttatattatcagaaaatagaataagtgggttacagttgtgaatattcacaagcattcattttggtttacaaagctaattttatgatggagaaagagctcgagaggaaagtgggcatcttcatctcttcctgaaattcattttgttaattttgaaggcaaggttctagaattttgttagatagtatttagattctaaaatagggctgaggagttcaattttattggcatacatgaaaagatggtggatagaatttcacttaataatcaartaatgggtatagcattaacctccgtagcacaatataattatctgattaacttctgagtttaggaattccatggtatactactccaggcagaaatatcaatccctataattccatttgaattcccactccacaaaatttgctattttttctttactgtgttaatgtttgtctcttactacttatatttcaaatcttttcggaatcttttgagtgaaacaggcattcttaccagcagctatattaatatgtgagacatttcttttagcagatatttgcttcaactgaaaaaccaaattatactgaaagacccaacattactgtccttacatttattaattgttactaataaatagtattgtccctgagggaaattacggggaatagttgtcaacctgaytataagcacctgactaatatcatttcatcacttgaaacttcattgttgcagttattaagtgctggtctcacaataacttctagacaagtcaaatctttttcattagaactagtagctagagaataaatggttggaatcctgatgaaagattttaaagttgccaaatttaaaaagtaaaacaaggggtaaactgtcccaggttgcaaatggagtcagtaaaactctcaggctgatcagtagtgggatagtacctgtgaagagccactgtactccagcctggacaacatagtgggactctatctctatattttaaaaaatctaattttaaaaattaaattaatgaataaaacaatcgaagaaagatttcaggagtgagactgtgtctaataaaatgtaatttataaaaattcttactttgccatataaagatggattcatattcaatttcaatggacagtttttctataaaaggaagagttgtttaccaatcttatttgtccacaaatgaattcttcctcacaaggacactgtagcataaagatgagctaggaaataataatttgggggtcatatttcctatcatattgacttaaataagtcatactcatctcaatttcttcatcatgtaatttcagttatattttattctatcaaatatattagaatgaatgttcataaaatagctccttaataataacaaatcttagtttgaaacctttaactcatgactgtaaaggtattcctctggccattttttaaagctttgatatttttgaaagtcatgataaaaacatgctagtgaaatagagtcataggacaacatgattcctagatagttgtctgaatacaaccaatttaactgatattgttttagcccaagggaatagcctattgccagtacatctgtcaacagactattttctgtgtaatatgtgctttaattaaagctaaaagccattttagattattttggaaactcaattctgtaaaattacaaggtattatttctgtacattttggcgatctcttttcatcaaccaaaagtcttatttcatttttgtccacaagaaagtgtgttattgacaccacagtgtgcatttgatataccacagacacatccaatgctagaacctagaactcttctcatcagagctgtaatatgttgcccaaataaatcgtaaacatttatttcacgtattaattccaaaaacccagtgagtttactagttagaactaagatattattacctggacaatggtaacctcatttcttttttttttttttttttttttttttttgagacggggtctcgctctcgcccaggctggaatgcagtggcgcgatctcggctcactgcaagctccgcctcccaggttcacgccattctcctgcctcagcctcccgagtagctgggactacaggtgcctgctactatgcccagctaattttttttgtatttttagtagagacgggttttcaccatgttagccaggatggtctcgatctcctgacctcgtgatccgcccgcctcggcctcccaaagtgctggattacaggcgtgagccaccgcgcccggcggtaacctcatttcttaatttaactttttgacatgggaagtgtgtaaaacaacttgacattacttttgattcaaacaatgttgccatggaaatgacttttccacagcataaggttggcgtataattgctgttttgtcttgcagttttaggttgaattaagaaagataatcaaatctacagcagaagctaatatccagaggcatttagtatttgataatagtggttaaggacggctcttttaaaaaaagttttcaagcaaggtgcagtggctcacatcagtaatcccagtaattcaggaggccaaggcaggaggatcgctcgagcctgggaggtcaaggctgcagtgagccataattgtcctactgcactgtagcctgggtgacaaagtgagatcttgtctgaaaaaaaattgtttttcaatcttggccttgaattcataatattgcaaaaaactttaccactgctaagccatcaaactgctgagtggtaaggtaagtcaaaaatttcccttgacaaaaactcacaaaaatgaagatggttacgtttacaagagcaaatgaacttaaccatttacactactggtccaataatgcatgataaattcaattacttcccataaaatatatgctgacaaataataataataaataaccgtaggccttaaacactttacattttcacaagctttgtaaatttgtccaaccaaggcttgttttctgctgtacaaatattttaaccatcagttgtaatgtatcttagtagattctactttggattgtacttattttttttcctcaacttctttgaaaatattctcagcagtacttgttccacagaaactatttatagtgcctaacttttcacttacttcaaattcaacgttggctcctcaaaaaaccagcaactgagcagtgtcagtaacatatgtcaactcatcaagatccaggaaaaactactcaaaataatctaccttattttttaattgactgtggatgttactctcaacgtctgtaactatgagcaactgttctcaccaaatggcagccttatataagttacgcagtctgaacacatttcttccactgctacaatcaaacatgatataattaactcacaatccataagtgcctttctttgcttggccaatgaataagccacttaaaaatttactttggtttcattctcattttcatattttagttttgcgaagaaattctgctaagacaagatattttgttttatattttctagttttctgaatgctgctttcctgtaagtggggaatattgcgatgagtgttcagtctgctaatgttgacatattttgtatttttcagcactatttagtgtcatagcataaaaaacacaatgctgtggcatctaatttgaatacaaaataactcacagcccaccgttccttaaaaacatggcattgaaagtccacatttctcttattttctgttttgagatgatgggtatgcaatggtatttttaaaaactaggataaagtgtaacagtacagcaaaactcaacatgctctcaaattctaaccacgtcactgagatgtgtagcatgctgagaagcagggtaaagtgatgagagtggcacatatggtttctctagcagctaccatcactataacctaagacagcctaaacaataggtaaacatgacagtcagccagttcgttaagataaggctgggcaaggtggctcacacctgtaatcgcagcactctgggaggacaaggtgggcggatcacctgaggtgttagacaccaggctgccaacatggtgaaaccctgtctctactcaaaccacaaaaattagctgggtgtggtggtggctgcctgtaatcacagccactcgggaggctgaaggaagagaatcgcttgaacccgggaggtggaggccaagaccatgccactgcactccatcctgggcgacagagcaagactctaaaaaaaaaaaagaaaaaaaataggtagccaggggyggtggctcacgcctgtaatcccagcacccagcactttgggagaccgaggcgggtggatcacctgaggtcgggagttcaagaccagcctggccaacatggtgagaccgtctctctactaaaaattaggtgggcgtggtggggggcatctataatcccagctactcggragsctgaggcaggaaaatcgtttgaacccgggaggcagaggttgaggtgagctgagatcgtgccattgcactccagcctgggcaacaagagtgaaactccacctcaaaaaaaaaaaaaarkggggggggggcatgactgtgtttcaataaaactttatttacagacactgaaatttgaattgcataccacttttacatgatgcaaaatattattcttctcttgattttttcctaaccattaaaaaaatataaaaaacattcttatcttatggacaatataaaagcagatagagggtcagatttggcctgtaatctatagtttgtcaacccacgcaataaaaaatccacaaaagaacttcaagtggcattttacaaaagaagaaatccatgtgaactatgcccttgtacttttattctatttgtgtgtctgtatttagagtgtgattctcacaggcagcatataagtctctttgaatatctgaatgggatattcagaccattttcatttaatgtggttatcaaaatgattaggtttaagtctctcattttgcaatttgctctttattccatatgttctttgcacagttttcctatttttctgccttcttttggattaaaattttttagtattctatttcatctctttttggaggagtaaggaaagtgatattgctaagtataatgttttgttttgttattctagtggttactttaggctttatagtacccatctttaacttatcacagtctaccttcaagcaatatggatgtcaacttacagcgtaagaaacttaaaatagtgcagtacttccattttcccctccaaatcttttgctattgttgtcatacagtctccttctatatatgtaataaacccatactacattgaattatttttgcttaacaatcatcttttattaaagaattttaaataaatatgtaaagtcctatgtatttactcatgtagctaacatttctggtctcttccttccttattctaggtacctatttccattggtatcattttccttctgcatccaggtctttttttcacctttcttaaagcgttaagcttgatagtgactaattatttcaggttttttatgcctgaaaagtctttatttcaccttaatttttttgaaatatatttccaccagttatgaaatttgaggttgacagttttttctttccattctttctttctttttttttttttgagacacggtctcactctgttatccaggctggagtgcagtggtgtgatcactactcattgcagccttgacctaccaggctcaggtgatcctcccacttcagcctcctgagtagctgggactctgagcacatgccaccatgtccagttagttgtttgtagatacagggtttcaccatgttgctcaagctagtcttgaactcctgggctcaagtgagctgcccacctcagcctcctgaagtgctgggattataggtgtgagccactgcacccagcccagcctgcctgcctttctttctttctctctctctttctttctctctctctttctttctttctttctttctttctttctttctttctttctttctttctttctttctttctttctttcctccctccctccctccctccctccttccttccttccttcctttctttctctctctttctttttctttctttctttcaagatattgctcagctgggcacagtggcttacgcctgtaatcccagcactttgggaggccgaggcgggtggaccacgaggtcaggagattgaaaccatcctggctaacacagtgaaaccccatctctactaaaaaatacaaaaacattagccgggcatgctggcaggcacctgtagtcccactccagcctgggtgacacagcaagacgccgtcaaaaaaaaaaaaaaaaaaaaaaaagatattgagatattgctctactgtcttctcgtttgatttttttcaaccaagaatttgtcattatccttatcttttttcctctgatcataatgtatatttcttcctttgcttttaagatgctctctttatcactgactttgaaatgtgattgtgatgggttttgaaatagcttcctacttgtttcttatgcttgaagttcactgaaattcttagatttatgggcttatagttttcaccaaattttaaaactctattgaccattatttatctaagtatttttttctgtctttctagtctcacctctccttcaaggactctaattctacatatattaggctgcctgaagttttaccacatctcagcaatgctttgttcatttttttctgcatttattttgaatagtttctatgccatgtcttcaaaaccaatgatcttttcttcttcaatatttaatctgctattgatcctatcatatatatttttcatctcagatattatattttttatttttagaattttaatatggacttttttatagcttccttatctcttaactattctaatatgtagtatatacattggtagtagctttttaaattgataagtaaaagttttatatatttagggtataaaaatgatgttttatatatgtagtcattatgaaatggataaattaagctatttaacatatgcattatttcacatacttattttttgtgtggtgagaacacttcaaatctattttcttggtaattttcaagtttacaatacattattattaactatagttaccacgatatacaacagatctcttaaacttattcctcctaattgaaattgtgtgtccttttaccaacatcttctcaaccccctgaatccccatctcctagaaaccatgattttactctctgtctctatgagtttggcttttttagattctacatataagtgagatcatgtggcatatctaacattttgtcaattctgggttggtgtccatggattcatttttatccttatcataggtcttattttgccactttgcatgcctgggaatttttttttttttccagacagggtctcattttgttacccaggctcaagtgcagtggcatgaacacagttcactgtatccttgacttgggagcaggctcaagcaatcctcctgcctcagctttccatgcagctgaaatgagaggtacatggtaccacactcagctaatttttttaattttgtagagacagggtctcactgtgttgtccaggctggtcttgaactcctgagttcacgtggtcctcccaccttagcctcccaaagtgctgggattacaggtgtgagccaccatgcctaaccccctgccaatttctgactggatgctacacattgtgaatttaaaatttttggtgctggatatttttacatttctataaatattctgggttttgttgtggaatacagttaagttacctgggaatagtttgatctttttgggtcttggttttaaggtttgtcaagcaggagtggagcctactacaaaggcaaaacccttccacatactctacctacgccctgtggctcagaaggttttccagtctggctgctgttaccaggcactaatcccagtcctgacatgtatgcactactcagctgaatactcaagaaggaccctctgcagatatctcgatttatcattctgtgaatctctctcttctctagtattctatgctgcaaactctagctgacttagattcctgagattctcagctttgtctgctcaactcagagtctattgggctctttgcactgccacctggaaactcttaaggtagtaagccacagcaaccacaggggkcaccttgtttgtttgccacctctgcccgtggttgccttatgttcagtgtcttgaaaaccactggttcatgtattttgtctattttttgtttggttttagatgagaggataaatccttgttactctgtcttggtgagaagcagaaatcctaccatatggcattttatttctacaattgcatactgagtttccttcctttcataattttcttatcaaagtgatatcccccacatctagcgtagtacctaagacatagtagacactccataaataacttatctcaagaattaaacaagactttttgttcttaatttcaaaaaaaaaacctgtatttttgtgcctcttgctaaagaatctaagaaagtttaattaaatttcttctgattccagttttaaattctttccagaggtacactatttttctgggtctttaagaccacattccrttttccttcaattcttgtagtactcctcgaggccaagagtctcttattttctgtttattcttcttggaacagaagaaatatattcagatctttctcattgtaccaccaacaccgaaaagcagggtttgtggcttgttctcggtygcactgactgaacatttcaataagtttgtggtaatttaaactaaaatgaactatagaaaggatataattctattttccagcagcagattaacacaagaatggaaaacccaagcttattaagcaagcaaagatatgcaagtacaagccacttcgtagaaagttcttgtgtcccaaacaaaaaactcaaatagagaagcctgtctcatcaaaaatctgtcaagttcactcttggatacttttagaaattaggttggtgtgtatagtccttagacaaactttaagtgacatgactctcaaatatttgtctagcgtggctctgtgaagtatttctacttctttccctaatacactacccaagcttatacatgaaaactacaatgctcagcatgctttttgtctttacttttcttattttctaccccttttatttatttattatgagacagagtctcattctgttgcccaagctggagtgcagtggcatgatctcaactcactgcaaccttcacctcctgggttcacccaattctcctgcctcagcctcttaagttgctggattacaggtgcctgccatcatgcccagttaatttttttgtatttttagcagaaatggagtttcaccacattggccaggctggttttgaactcctgacctcaggtgatccacccgcctcagcctcccaaagtgctaggattacaggtgtgagccgccacgcatggcctctactccttacttcatttccttttgctttaatgtctagagctggaatgcgtggtgtatgtgtgtgtgtgcgtgtgtgtgtgtgaaacagggtctcactctgtcacccaagttagagtgcagttgcatgatcctagttcactgcaacctcaaactcttgggctgaagggatgctcccacctcagcctcccaagtagctggaaccaggtgcacgccactgtgcctggctaattttttcatttttatgtagagacagagtcttgcatggttgcctaggctggtcttgaactcctgggctcaagtgatcctcccacttgggcctcccaaagtgctgggattataagtatgagccaccgcacccagcctagagcgagctataatctttttttttttttttgagacagtctctctgtcacccaggctggagtgcagtggcagtatctcatctcactgcaacctccgcctcccgggttcaagcgactctcctgcctcagcctctcaattagctgggactacaggtgcccaccaccacgcccagctaatttttgtatttttagtagagacgggstttcaccacgttggtcaggctggtatcgaactcctgacctctggtgatcctcccacctcggcctgtaatcccaaagtgctgggattacaggtgtgagccaccgtgcccagctgaactataatctttaaagttaatagaacacaaacaacagaaggtagtgaggaatcaggaactatattatggttacctaataggagatatccaaacagaaaagaataactgccccagtggatatgttttatcctttcgacaatatagatactgtgccaagaattgaaatccaaaaaagtaaaaatcattggcttcaaaatattaaaagaaacttccaagtggaaattaatacatgtatcaaggtctacaaaacataaccccctatcaagtaattgatgacaagtaattcttgataatatttagataaaataaattttatatttaaagaacaatgaatatcttattctcaacaacacataattataattttaaaaaatagctccaatgattgcacatcacaatatatataaattttatgtagctataggagcatttagtatttttttaggagcactttccaggaaccaagggcaaagaccaattttttttttattgtaccccagattttaaacacagtactttagtggacattttaagggataaacacaaaagcattaccatatagttttcatggacacacttatatgcattaataaacattaaagatgaattgtggggacatgtattcaattcaaaagaccatagtaaggagaggaatgggcctggaaaagaggaaaagttattcttaaggtcagctttacagtaaggaaaagcaacaaaatttgaaaacaggagcccttgtcatttccctagaagagaaactggacaatctaggagttcattcagaaaagcaaagtgggtgagggctgaaccctacagcctgttagcaatacagctttcccttaggaattctaaagcgtgccgaaccccagcgcagccttagggaatctcctttygccatctactcgattccccagcgatctcctccagtcccaaggcttagatggccaaacacctaccgacaaagcccaggcttrcaagcacttacccgacctgaacgccacactccagactggtcttcccatctggagcttgagatgaccccgcaccaggagcatttagtatttaaggaaagacatggaaggcctccaacaatgccaagaacttaaggtccacagcatctcaccggttgtctagtccatatgactctgaaacttatggtggggggtgggaggcagaggagcaaggacagtgtgttagtcagctcgggcttccataacaaaggaccacagactaggaggctgcaacaacagacattcatttccttacagttctggaagctagaagcccaagaacaagatgtccgcacgattgggttttactccgagggccttggcttgtagttggctgtcttctatgcgtcctcacaggatcttctctgtgtatgcagtgtctgctgtgtccagatttcctcttttttttttttttttttcttttgagacagacttttgctctgtctcccaggctggactgcagtggcgttatgttggctcactgcaacctccgcctcccgggttcaagcgattctcctgcctcagcgtcctgagtagctgggattacagacacgcaccaccatgcccggctaatttatttttagtagagatgaggtttcaccatgttgataaggctggtctcagactcctgacctcatgatctgcccgcctcggcctcccaaagtgctgggattacaggcgcgagccaccgcacctggcccaaatttcctcttcttacaagaatatctatcaggttagattagagcctaccttaaaaacttcactttaacttaattatccctgtatctataatttatttatttataattaccttatctccaaatacggtaacattcttgtaacattcttttttttttttttttttttttttttttttttttttgatacagagcctcgctctgtcgcccaggctggagtgcagkggcgcaatctcggctcattgcaagctccacctcccgagttaacgccattctcctgcctcagcctcctgagtagctgggactacaggcgcccgccaccacgcctggctaatttttttgkggtttttttttttagtagagacggggtttcaccgtgttagccaggatggtcttgatctccggacctcgtgaccagcccgcctcggcctcccaaagtcctgggattccaggcgtgagccacggcgcctggcccaaatacagtaacattctgataaactggaggttagacctaaacatataaatgtagggtcggagggacacaatgtagcctataacatacatcaccatttatctcttttatccttaaacttccaggggatgaactgtaagtcagcattatatgccaaatggcatccccatttaggcccatggttcttagagttagtgtatcatacccttaaacacttaaccaggctaccttgtcgatcttagttttcagtatttcatagttttttgagtgtttgctgttgtgtgtttttacttttttgaaatttccttagatgttttagtgagaaattggaaaatggttgagtcatcaccagatacagtcttgaaactgaaaccacaaagttttttaggaattaggcagagccctgggggggagggaggatttgttatggttattttttaatgaagatgctaatttttttatagtttggtgaaaattgatgtaatcttttagggaagcaatttggcaatacccatcaagaatgtaagagtatatacacctttttaaatttcttcagaggtttataacctgttactataatcatttattttgacycaaattatcccagattcagccagtggaagtcccttcaagttgggagaattacaccttttaaggtgtaattccagttagaaatttaacaatagggcatttgagtgtaagtaggtgtaaatgagaacaaagatttttcacaaagatgttcattacatctttatttttaataacgaaagcaacccaaattgaaggcaacccaaatatttttgragaatatttaataactgcagtataatgtacaaggaataaatcaggayacaaaactgcatgcacgtaataaaccaaatctgaatgtgtataagtatttatgtctagaagcatgtagattttaactttatctaagctttttctaatgatcctgttttcatgatcagagcaaaaaatatatttcaaactgtggtcaattctgtctttccaggtaaataggggccctcatttttttttaatcccagcactaaagaactttatgtttcagcttattgcttaagtatcatacatcccactgaaagatgatccataaaatgtgtagttcttataaaagttataaagataattctacatatttgaaggtattttaaaaatttattttacctcatactatgactccttttctatcttgatattgcctcttagatctttactgagtgaaaccaatttataatgtgcaaaaatgggaatgagagaaatcgtatccaaagtatacactttaatgaatatccataatcattcaactcaacactactatgatagagtggctaagagtgctggccttccgtcagtgtgggaaaggggtagggctggggtttgcagccccgatattatgacacccagtgtggtggcagccccgtgcagggaagcagagccagagcagggtgaggagggtgttcgtgcagggaagaggcaggagacatgagagcagatgggttacccatggagagattaatcacatagatcaatctattaaagacaatgggagccagttttctcccttgtgaagaggggtataacaaatatggaaaaggagaaaactggaaataaccttacaatgttgacttggaattggaggtattgatatgactcatgagtttcaagaaatatacagaaacaaatatagatgtaaatgtgtgtttgtacctatcaatacacacacacacacacacacacacacacacattctctagtctgaccactgaattctagtaataatgagtacaaccagcaccatatcttgactgctaaataaaattctccactaaaagaacccagggatctttggagaaatgactaattccaaaagtagggcagagacagtacaagatgaaactggaaaatcattttgtgtcagaaagtaaggacatattccaaaactgataggtatatgtcaaaggacaaagccaacgtgaagggacttccactggctacatctgggataatttgagtcaaaataaatgattatagtaacaggttataaacaactgaagaaatttaaaagtcattagttcatactacaataaataagttgaaagtttgatgagaaattggattttgacatagcttcaaagtgcttcaagacatttattaattacaaagggagaaagaacaacttcatagcggagaaacctggaagaaaccatcttaattaattattacaagtgaacaatgcctggaatgggaccaatcaaaactgcgtgccacttgataggatgcaatgagaagaacacagcatcacttctctaagattcttaccaaagatgcataatttgaatctaattgtgaggaaatatcagataagctaaaattgagaaatttctaccagatatctggctcgcgatcttcaaaaaagtcaaggtcatgaacatcaagttaagaatgaagaggccgggcgcggtggctcacgcctgtaatcccagcagtttgggaggccgagacgggcggatcacgaggtcaggagatcgagaccatcctggctaacacggtgaaaccccgtctctactaaaaatacaaaaattagccgggcatggtggtgcgcacctgtagtcccagctacacgggaggctgaggcaggagaatggcgtgaacccgggaggcggagcttgcagtgagtcgagatcgcgccactgcactccagcctgggcgacagagcgaaactctgcctcaaaaaaaaaaaaaaaaaaaaaaaaagaatgaagaattattccatattaaaggagactaaagaggcctgacacctaaatgaaatgtgtgattccaatgtagatatcctttcactataaaatacattattgagacaactgataaaacttgaaggaagtctaagcattaaacgatagttatgtagtttcctgattttgatcatggtattttggataagagagagaatgttcttgtttatgaaacatcatctctaagtatgcagggatgatagagtatcaggtcagccacttaatcccaagtgattcagggaacaaagagttctttatcctccagttacaagcgtatggctgtgggcaggttattttgtctgactacttttgtttcctcatctattgtacgggactagtgatagtatccatctctttgcattgttatgagattaaataagttggtaaaggtaaagaggttatttagtgcctagttaaagttggctagtttttgagtacctttatatattagctccaactataatatgagaattatggttactatttatttttgacctttctcctattttggcccacttttagtgtgtcttcccttctgccctactgtttcctgtccatgttggtttcctttccatagcaactcttgcctytccaacacaaagcttcatgctccaaaaagcactgagtcagacagcatgggttattccttgcatgattataatatcttcaccaatagaaagagataatttgtgtgaatggtaaatgtacaaaaaatatacaaaaatctcatttttacaggttccataatgcaaattttttccattcaaataggagttaagaattcactttagaacatttttgaaggtgatttagattctattgtagtaaatacctaagctaaagtatagcattctcttcctttttactctccgtgaaatagaatatgtaaaaccttctaaaagaatttatatgcataactcaagccatcttttccaaaaacttaaattttaagtacatgtcaattatgcatgtatgtaaaactggtactttgatgctagtatttattaaaatattgattttgtataaaattcctagcaaatgtgattacaactttataaataggaaatagtaaaaaatgcttaactaaagatagactctttctttagktttttgttaatagtaactatgattctgtcattttcaaacatcagctttattaccaagaacttatctgtaagttagggttgaagagrtggcagggtgttagtatctatgtttatgcacaaatgagttgttgtattattgctgggtgtttgggtgtaaagaaacaagaagaatgtgggtatgtacctatcattgagaagacaaaggaaatcctgtaacttcagctttcaacacactcaacttgcactgggctgtaaaatcctgctaaactatttaaggagaggtctcagagccacataaaagtctccctttaaggaggtagtatttaatttcagattgtctgttcctatcatgcttctatacagtcttctatggtattccactaaactaaaatccagttcatttggacatctcaatattggacatcaagacataaaaataaagtataatatttccttagtttagggcattttgaggcaggcagatcacctgaggtcaggagtttgagaccagcttggccaacatggcgaaaccccatctctactaaaaatataaaaaaattagctgggcttggtggcggttgcctgtaatcccagctgctccagaggctgaggcaagagaatcgcttgaacccaggagtcggaggttgcagtgagccgagattgcgccactgcactccagcctgggtgacagagtgggactccatcccggaaaaaaaaataaaataagtaaataaataaaaatatgtatcttatttaatctcaaagtataaattcaaggcataaatttaagtataaattcttttttaaaaaagtctaccttgttttgcaaggaactataataggaactcttgtaaatgtaaagttaattgagttttttcccccaaaatatgtctgattataggcaacaggttccaggattggcgtcttaacacaaaatgcaactaacatgggactttcagttatcatttcctttatatatggatgggagatgacattcctgattctgagtattgctccagtacttgccgtgacaggaatgattgaaaccgcagcaatgactggatttgccaacaaagataagcaagaacttaagcatgctggaaaggtaaaatgaagactgttatcaccatcgtaacatttaaagagaaaaacagtcagaactttatgatatgttaactatatgatgtgttaaccatctttatgatatattaacttcatctcttagggatctgtaaagtgatatgtatagagagagaaatgcatacagaccaatttaggatagaaggtagatatgttatagcaatagrgtacatgatttagagcacaggctctggagtctaattagctgagttagaatccagattctatgctaacaaaygtgtgatatgagcaggttatgtcaacctttgtagacttcaggtttctcatctgcaaagtgggaataatacgagtattcacttacaaatttttgtgaatattgcataaaacacaatgttattatacgcaaaacacttagaacagtgtctggaagacagtaagcacgtactaatgtcagccattattactggggaagttttcmaacatcatcattccccattttctggtcattgaataatcaaattttcttgagcaattcttctgaatattttatttttcaaaacaaacaggcaatgcagcagttactgaatgcaaggccatgcactgatattgataacatataaaacaaggctttagagacaggaccataaatgaccaatttatttaatcatttggaaaatgcctggacatacaggtatttaagcttcttaggatcaaccatattcatacaaataattaytatattagasactgaaggaaacattatggtggcatcataacacctaagaaytgaaagagacatcatctgacccaaccattaacctgaagtaggagtcccttgcacaacatccctgtcaagcgtccatccccatctcctaccaccttttcctccagtggcaggtagtacattactttcccaggctgcctgtacttggatagtcttgggtggtaggcagttcttttccttttctttctttttttcttgtcttatttatttatttatttatttattggtggacttctatcttactcttcttggctttcatcttggtagaggtccaaaatctgtttttcatgacagccctttagcagctgaatcgctgtaaacaaggagacttctgttgactctacttccaggtctttaagatgttcctcacacctgtaatcccagaactttgggaggccgagacgggcggatcttttgaggtcaggagtttgaaaccagcctggccaacataatgaaaccccatctctacgaaaaatacaaaaagttagccgggtatggtggtgcgtgcctgtaatcccagttacttgggaggctgaggcaggagartcacttgaacccaggaggtggaggttgcagtgagctgagattgcgccactgcactccaacttgggcgacagagcacagctctgtctcaaaaaaaaaaaaaaaaaaaggggtgttcctctcctaatactgttttagagctcttggctacactggtgtacatcctctgaatagcaaaatgatgttaatatcctttatagtctgtatcacgttgaatgtgtcacaattggcatagcataaatgtcatacatattcatgaatagggatgccaagcacataactcactgtaatctcgtttgcctgagccttagacctttccacctttttttgcacaagataaggacccttggattgtttgcttgtgctgtatagtctgaactacctagcaaatattcgcctcagagacagtaaacagttgtttagacctccttgtctaatttaaacattgcaataatttatacaatttctaaattaatgaggcctaattatgttttcctcatcttattttttatgtcatgagcttttgctgtatatgtgccctttgacttttcctttatgtatcattagagcaacctcagactatacaacaaacaactctaatcaaatagtcaattggaggcatttccctatggcttttaataagtcaatttactaaacatcaatttagaacatagactaataaaatgtatcggtccttcttcagttgcatgtgtagatttggaaaaattatcaaacgtttagtttttaagactttgaatgggccaggtgcgctggcttacgcctgtaatcccaacactttgggaggcygaggcaggtggatcacaaggtcaggagttcgagaccagcctgaccaacatggtgaaaccctgtctctactaaaaatacaaaaattaaccaggtatggtggcacacgcctgcaatcccagctactcaggaggctaaggcaggagaatcacttgaagccaggaggcagaggttgcagtgagccaagatcgcaccactgcactccagcctgggcaacagagcaagactccatctcaaaagaaaacaaaaaaagactttgaatagcttaattagttttcttaatgactattttctaagggtctgtaataatattcatcccttctccattgtgaaaaattggagatttttttaatgttcattcctttttttatcttcattccttttgtttttcctcaaaatttttttatattcattccttttgtttttcctcaaacaaggtttcagcattcttatccattttcttcatatactatggaatgttacaaatggaggtttctttaagtccatttttaaattaatgagaatttaaaacaaccaatatcaaaattgggagcagaatcctggtgtcctcacgacagtccagaaatctagttccctcctacaacccaagttattcttcagagaaggccaagtgtctacctggtcttctctgtcccacagtccaytctgccaatctggaaacagaatgtgaaaacaggaagtttctctttcaagccaacacatgttctcatgtccgaaaagctattctaaaccaaaactctcttccattttgaatcccatgtaattatgcattctctttataaactatataaatgtggagaagtattcatcacatttgaattaaatgtctttttacattcacagacgccaatatgagaaatggctttatctcataaagaattttataaccacatgccatgttactttcctgtaatgttcctgagtccttttaagttgctatttttaattctttgctagaataaaataattatgtgattactttatctctgctatcttttttttttttttttttttttttttgagacagagaagtctcactctgttgcccaggctggagtgcagtggatgatctcagctcactgcaacctccacctcccaggttcaagtgattctcgtgcctcagcttcctgagtagctgggattacagacatgtgccaccatacctggttaatttttgtatttttagtagagacagggttttaccatgttggccaggctggtttcgaactcctgggcctcaagtaatcggcccgccttggcctcccaaagtactgggattacaatcataagccattgtgcctagcatctgctatcttttacttgaattgtttcataatttgtaggaagctcctttgcatgtgaacataatgcttactaatgttttattcttctgtctatggaacaagtttaaattgaaattcagtataaacttgaatggggttaaacttagatcagtagrctaaatctcaataagacattttccttaagcttatyatccaaaagtgtcatttttctatcttattttctgggaggaaaggaagctaagaatatttgtcaggaaaacttactgacttgatatacttaatatgtccccagtgtgagtgactagaattcacaaatgggaaaagattaaccattactaattttatttctatattgtattgtcctgttttataagatagcaactgaagctttggagaatatacgtactatagtgtcattaacaagggaaaaagccttcgagcaaatgtatgaagagatgcttcakactcaacacaggtgattatagattcatactgacttcaaaaacttaattttgttctgtaaaggcagtactctcaaatgactccagtggtttgcctgctaattcatttgctcttgagcctttcctaataatgtcatgtcataatttctcatatgacttcaccaagagaaactagaagaggaattgagggcaascacaattagaataaatattttaggtcctctcacattaccattaactgtctgttactaagtatgcacatttttcttattttcctgaaagaatattaatgaaataacatacgcaagaaagaaaataaaattgcgggcagggcgctgtgtctcacacctgtaatcccagcactttgggaggctgaggtgggcggatcacttaaggtcaacagttagagaccagcctggacaacatgatgaaaccccatctctactaaaaatgcaaaaattagctgggtgtggtggtgcacacttgtagtcccagctacttggaggctgaggcaggagaatcacttgaacctgggaggcagaggttgcagtgagctgagatcatgccattacactccaactccagcctaggcgacacagcaagagaaaagagctcggccctttacattaaatccctaaaatagtttacattttaaatacgaatatatacataataaatgcacttrcacttttaattttaaactagtcctccttatcacattgacttagtgatgctttttatattactttaacagaaagatagctttttactcttttggactcatacttgtagttggcaccaccctttaatttcctctattctgttaatgaaagattgtaayggagacttagaaaatccttctaaatacctaaaccaaatctctaactcttacactagccatcctttcacgggctttgcccattcatttaacagtatataaagttaaatttgttatactgaactagagagtatatgactatagggaaaagaattataacattatctgtcttttctcaaagaattctcagtagtaaaaaaaaaaaaatcactttctctttcatcattygaaaaatgcctttccamcaaattataacatttcaaagtyctctctatttattactctacatgtattcaattgaccttgctataattcatgcctcattatttggtaaattttgtacattccagaaatacctcgaagaaarcacagattattggaagctgttatgcattcagccatgcctttatatattttgcctatgcrgcagggtttcgatttggagcctatttaattcaagctggacgaatgaccccagagggcatgttcatgtaagtcgtggaaatagtccggacctggtagctcacacctgtaattccaacactttgagaggctgaggcgggtggatcacttgaggtcaggagtttgagatcagcctgaccaacataataaaaccccatctctactaaaaatacaaaaattagctgggtgtggtggcaggctcctgtaatcccacctactcaggaggctgaggcaggagaatcgattgaacccaggaaatggaggctgcagtgagctgagatcacgccactgcactccagcctgggcaacaaagtgagactctgtctcaaaataaataaattaattaataagttgtggaaatacataaaccttgtaagggggtcatgtacttatttaccagaaagatgtctagtttatagtgagttatcatttaaatcacatwtgtggaaaaggtatgcttgaattttttttaagttggaatttttttaaatatacacatayttttaaattttgtattgatatataatagttacacatattttaggggtacacatgatattttgatatattcatatgatgtttaatgatcaaatcagggtaattgggatgaattttatttttaattgacagacaataattgtacatattatatatttatggggtacaatgggatgttctgatatatgttaacactgtgaaatgattaaatcgagctaagtgtttttgttatttagtctctataagyacagcataactggtaaaatactgatactgatataaggcataaaatctgaattaaattcccagatgaattgctctctgcttcagtttactggaacatgggaatgtrggggcaaaatatgccttcttgtcattcatcccttaggaaatttgtgagacattatgaaactctcagtgtggagatggcttcctaaagtaagactgtacatcagtgaggatgaattatttgctaagcaaataatccagaagaaacacatataaatgagtgtttcccttcaaaaatgtcacatttggaattgaatgtggtgtcccagtgaggctgcttcttcccaaagcattaggttggagctcctattttgaagttctggtcacataattatgaatttatttgttttaccggaacatctaatgcaactgctaaattagaaaaattaattttgagtattaattctgagctgagagcctaaaatatcagaaatgttgctaatccatcataaacgtcattgctaagcatttagaactggagaaatccatacaatacttgactcaaaaaagtaacattatgttatttttaacaagcccaccaaaaaatgcacatccatgcaagtatcagcctcttcacaataatgaattgggagattacacctgttacaaggatgctgctatttggcagaacacactgggcacttctctttgggttttgtttcccaagtctcaggacattactttgaatatccttattgtyggcatatttgtattttcaggataggttcaatttgaggaaatggccaaaagacatttaaacctaagtaatttcagaataacttggaataatttttagtttctattcacatgaaaatttatttatttattaagcattaagtgaagtcccaggaagtttctttgttaggcactgataagaaaacagtccagagttcaccaacccagtattcctaaatcttacctgacaccaaagccacttagaagtttcctggaagcagatttccttataaaatggaatatggaaatggaatatctgtatttaaaatttcaacagaagggctggatgtggtggctcatgcctctaatcccagcactttgggagtccaaggcaggtggatcaccaaaggtcaggatttcgagaccagcctggacaacctgtgaaatgctgtctgtagtcaaaatacaaaaattagccatgtatggcggtgcatgcctgtaatcccagctacttgggaggctgaggcatgagaatcacttgacccgaggaggcagaggttgcaatgagccaagatcacaccactgcactctagcctggatgacagagtgagactctgcctcaaaaaawttaaaataaaatttcaacagaaattgcaagttccctgtcctatgttctcctagcctctaaaatagtgtgcrctattgcccatgtgaatttataaaccacaattatatttaggcttgggtttcattctgattacataagactaattacttaggtagattaacaagaaacaaaatctgaaatcacataaataattcagctcaccagcccccgtgagccagtttttcctttgttctaatataatccaggcactyccaagcttgaaagttggttgtaatccaaaagtttgtttgcaagccaatagtttgaaactcaaaacatgttttcctcatgttgctctaaactttccacagacttctttaatccccagggccccgttccttctgtataactagttttgagtattagtagaaagcaagccaattaaacatattcatactaatgtacgaggtttgatgattttccaaattctcacagaagaattttcatctgttttcatcaatttctctgtcactactctttctttgctttgtaatcacacctataaaaaaaaataagaaggccaggcayggtggctcatgcctgtagtcccaacactttgggaggcagaggtgggtggatcacaaggtcaggagctcaagactagcctggccaacatggtgaaaccccgtctctactaaaaaatacaaaaattagctgggcatggtggtgggcgcctgtaatcccatctacttgggaggtgagggacaagaattgcttcaaccccggaggtggaggttgcagtgagccgagatcacaccactgcactccagcctgggcaacagagcaagactccaactcaggaaaaaaaaaaaawatatatatatatatatatacatataaaatttactggatcctgtttttcagccaggactctgtgtgttggagggctttaragctcccagacctttcatctattacactttcattagtgttctcatccaatctgwcagttttaaataccacctgtgtcctgataacttccttctgtatatttccaactctgaccctgccctgagcacaagacccttatccaattacttaggagacacctccacttggaggactaatatctcaatgtgttcaaaacagaatttaaggtgtttctccccaaaggttatcttccccaagactttcccatcttaactaataacaccaaccaccatccacacagttgtcagcccaaaaatgttggagtcatccctgttgcttctcttgccrttgtccaccacataaatcactgattcctcatgactctaattccaaaattcttctcatcctcttcacactcatccaagcccctccctgtcttgactggaccactgcaacaacctcaccaatgtccttgtgtccactcttgcttccctataatccattctccacactgcagccagactgatcatttaatgcacaaatccaatagcaccagtttattaaaattctgcaagatctagatcttcccactgaaatttgaataaagccaaagtccttaccatgacctgaaagaccttcatgatggggctgctgcgttgctttccaatttcatccacctctatctcccatgttaactactcatcagccccacacttgccatgtctgtccctggacctccccattgcagggtcttcacacttgctattctctgcctggaatggtcattccccagggctttgctaagctacctttttcttaccactcaggcttcccctgctaagtccactcctcagagggactttcaccgatggtccaaagtagttcccctaaccctccctcctcatcactctctttcccatcaccatattttgtttacaacacttatgacacttatgattctatgaaattatattttgtgtttccatatttatgagtgcatagactgagcacaagttgtaacctatcttgttcactgatgtttcccaaaagccaaaaacaagtgggtggcacataacagacacacaataaatatttattgaatgaatgactgaatcaaaattaagggggagatttggaatggtacataattaggcagtacagtcatttctggaaatgtgccttcggagtcaccttcacactttgaaaacaggagtctgtttttcacaaatttttctaattttcttcttttctacacccatatgtctaataccaggtgctttggcaggaggactggatctaaatcgagggcaaccattgatataaaatatgatgtgtggaattgagaatttacctgtacctactgagatttgtttagattaaagctaagaaaaaatttctcagtcgaagaatgatacaacctcaaaatcatgccagtcactttcatgcctgcaaatgacacccgttaggatgtttcctttaaggggctttccaagactgccaaccattccattacttatgaaaattgctataacggcaaatcttgattgaatctttactcagttttaagtatttgctgtatattatctgtttaatgctctaaactaccctgtgaaatactatggttcccattttacagatgagaacaattaagactcaaagaggttacctaacttgctcaaagttacataatcggtaagtagcagagcacagattcaagttcatggttccagattccagaggtttggtttactcaacgtacattattattattattattattattacaaattctgtggccaaacattcatagaatatttctgtgaaattattttttaaataattcttgcttagtttttcaaacattcgagtattcaaagttgggctgattcctcacatataaatggaacaggtgacctgcttagtgctattttatagccctaaaatatgagaatgaaaagtccccaatataaaatttcttccctgagctggcctaccatacttcctgaatttcttttaattaaattcattaaaagggggtctcttctagatacataagcattttaactatcagaacatatgaaggactgttaacataagagtaacaattaaagaatagtaccaccttggtatttcccagtgccccaagggaaggaagaaatagagagctatctgagctagagccactggtatcacttttcttctcttttcttttcttttctttttttttttttttaagttcgagtctcgctctgtcgcccatgctggagtgcagtggcacgatctcagctcgccgcaaactccgcttcctggattcaagcaattctcccacctcagcctcctgagtagttgggactacaggcacatgtcaccacacctggctaatttctgcatgttttggtggagaccagatttcaccatgttggccaggccggtctcaaactccggacctcaagtgatccacctcccttagcctcccaaagtgctaggattacaggtgtaagccaccacacccagcctcacgttttgagtttcatccagtcagaatacagacagaataagggtacccacacttttggagtatggacaaaagagagattctctagggattctcctccagtattaaatgtggttattgcccaaaagagcaacatagcactatgcataatgtcaatagatgagatttgtcttcaacaccaaagaggatttggtcctagagatcaaatgtggccccaactaccatgaatgtgtcacaagctccctttagacacactaaatgatacctggcctagaagactctgtaccttccagaatctaggatgacagacagctttcaatctcatcgactagctaaaccaaagaaatttacaaagaaaactccctcctactagaattcttcttagataaaaagcactttgagccattctctaaaccaatggttttccaactcascaatctaggagctggttaaaactgtagatacctagatctcatcctgcaaaatctgatttgtagatctagtatggggcaggaatcttcattttatcmaacattccagattactccaaggcataatttatagctacaaggatggattatctgtgtctctttcaaaaatgacattgtgtctcagaaagggagatacacaaagggagttttaacagcaaaattctttaatgtgctcataatattagtttgtcagcaaggctttttagaggaaaaagcctctaaaagaaaaaaaaagacaacacgcatgtcttatggtagaagccgtctctatttctactatcctagaagtttatctgaaatgagcatttaaaataaggtgataacattttcattctgccaccttacagacaaggcataggggcgtttagaaaatctcttgtttaggttctcatgcacccatgtgtagtaaaacactcacctctccctttgttagtcctggtaacacattctatttgttatttcactataaatgtgtagatttagatgtacaaaataagtttattttatcctatctctttgtgttagtccctttcggctrgtttccagctgacttgccttttgcaataccgaccaagaaccattcctaatcaggagaggtttctgtagccttcctttccccactgcaaagctttctctatctctgtgagtttcttccatattttctatccatattatcaagaagctaagcagagcatataggtaagaaagaatcaagatatggcagccctcaatacagtaataataaaagccacagctttgaaaactgcctgagaagcagaaccaggcagtttatgggtgtgtttcctagttctcttaaaaaccaaatgcagttcttgacaagaaaccacattgtatttccaataataatgtgattattggccaaaagagcaacataggtgggttttcaatgagtattaacagtgggtcgataccttaacataataaaggatggacagaagggagctaggcctgcaccatcatctttgccctaggaggctgggcagccagggaagaactgtgagtgttattgctgtgttaaggaaagcaacactggttacacaaaacaaagaaaacaggaaagacttctttccatgttggctgccatggcagccacctagctcttgcctggctcctccccagagattatccggaagagacagacaaggacaagataagaaggctaaatcaaccactgaagggacctaaagaagagaaatcaaaggacagttgatatctagggccttcagaagattctaaaatggaaagcaagtggtaacaaactccaacatgtaggaaaagaccattccagccagctttccactgcaaggaagaccatgtaggggaaaacacagagaggaaggcagctcacgttccaaccctacaatctcatgtcttctgggcaaattgcataatttttctgagctagagtctcctcattcattgactgataagtttccattctacttatctcctaggtgattagatggtatcttgtatatgaaaacattctataagatccaaagaaccaaataaatgttagttgcttattttctcctcctatctgttgagaaaaggatttagggcgggaagaggtctctgggttgtatatggatgatatacagatgagcatgggaataattttaatgactacctctatggggaaagatactctgccttctaatcaaagaaagaaacttactgagtaaggacttggaaagttgtgatttgacctgccgtgctaatctattgctacagaagtgtgagagctttttttttcttttttgttgttgttgttgctgtttttcttgagacggagtctcactctgtcaccaggctggagtgcagtgacgtgatctcagctcactgcaacctccacctcccgggttcaagcaattctcctgcctcagtctcctgagtagctagcattacaggtgtgtgccaacacacccagctaatttttgtatttttagtagagatggagtttcaccatgttggccaggctggtcttgaactcctgacctcgtgatccacccacctcggcctcccaaagtgctggaattacaggcatgaaccactgcacacagctcctgttagtgactttaaaatatttgtcatgataccaaattactcctcttcatatatcccaaatgggtgaaactcctcaagaccaacagtgacatgagagattgttggcctgtacatttctcccagttaggtgttcagttcaaatgcctccaggagcttaaaccagatttgaaggatatggtttaactatgttacggagttacagcacgggttattctacaataaatacttgttgagtggaactgaatttcagtttagctcaccctagctaattgggtctgattaggtaaggacaaattctgtagcagaccagttttttccatgtgtgggccttggcctacctttatacagaatccacctggagaaaaagcgtaaagaagattactgtccctaggccgggcgcagtggctcatgcctataatcccagcactttgggaggccgaggcaggcggatcactaggtcagcagttcgagaccagcctggtcaacacaaaaattagctaggcatggtggtgcatgcctgtaatcccagcttcaggaggtggaggcaggagaattgcttgaacccaggagatggaggttgcagtgagctgacatcatgccactgcactccagcctgaatgacaaagcaagactctgtcttaaaaaaaaaaaaagatgaagaagattagtgtccctcactcaaccccagatagtccaacacctcaaagtccacacttcccctccagggtcttcaacataaccctcatcggcatcagcccccatcccacttacgtttctctcagcactcactcattaaagacggtatcagggcttttgcttgtactctcccttctctaactgaaccctttcttccggctccattctccatcctttgggtcatttacctcccacaaacacaagttctgagttgaaggcccttctccctttctcattaatatttccattttcagagggacctaacaaggatgtctgcctctagacatttatgtctaatgcttaccattactgttatagtgggaatgttaggacaggtagagattttagcatatctcaaatcatgggaagaagctattttctcagttattgatttcagagaagcctctacccctttgggactagaaaccaggtctcctaactcataatccaattatcttcccagctcacctgctgattcttggatcagactgaggcttaagtctgacagtctgatttttccttgcattaaaaacacatttaaaaaaaaaaaccttctgatttggttacctaaactcagtgaccatttctgatgtttatagctgggtatcaaataattcaaatggcattttgagctttaaacactttctgtaaatatcagtactaaaaaatgccttgacatcactgaactaaataacaattattttagtgttatttttgtttttatattttatactgtgtttgatctttgtaaagccaacaggattcaggatctgaggtctaggtcactgaagagattgcatcagcatcaacatctaccctttgataggccccattgagggagaaattcacaaggagcccagacgtgtttactttgctgttatccagcactgcaaacaagcaactgggttctgtgatgaccctttactgcctaatgtttaaatattgccagcgacactggtccagttttagcctgattgtgccgttagctttgttactaagatgcattgttttgcattctagtacactactttcatatctaaaatgaaatcgaaaatgagaggaaaatatttaaccgtggtcaggtcctgtgccacagtcgagtaaatattctgtgtgcttccaaacatcatttgcacacttaccattttataattaacatgttttgaaactgagatcataatcaataacaaacctaaaagatcaaagttcttctttcagtctttttagtcagattttgctttgggaacctgaggaaaatacgatccccatgatttgctctctaaataatgtagcatatcagacagataaccagtcatttagcttcagttatctgtcctaactacattatatgcaaaacaaacaaacaaaaaatcatatctactgtgtaaatccagatctcactactggagattcattcttcctattgtcagttgaattctctgtcaaatctccaagcaagcaagcctcatatcaagatgactaagaagttttatattcactagttgggacctttgatctgtggctctaattggaagagacatttttaagattacccaagctccaaagttcattttggtgtacagagcaaggaatgattactacatggtagaaattttttaaagagataacttggtgggtcttcagcgttaggggtgccgtctacatcaaaagattatattcctgtgcctgcttttttctttacttttagagttctactgttttacaaaggatcgatggacctaagattcaaatgctttatcttttgatagagtttttactgcaattgcatatggagctatggccatcggaraaacgctcgttttggctcctgaatattccaaagccaaatcgggggctgcgcatctgtttgccttgttggaaaagaaaccaaatatagacagccgcagtcaagaagggaaaaagccagtaagcacaagtgtgatcttaaatgtccaaataaagatggcaacagtaggaactgggggccactgaagatgggagggagagaggggcaagggctgaaaaactaaccattgggtgctatactcagtacctgtgtgacaagatcattcataccccaaacatcagcattacgcaatatacccagacaacaaacctgcgcatatactcctggatctaaaataaaagttgaaaaaataaaatgtaacataaatgaaaaataaaaataaaaaataaatgtccacttattaaatgaaggctgtctttggaaaactctgcaaaagataatgtcatagtaacataaagagttaaaagtttgtgcaaaataattttatggctgcaaacggggaaaaggggtcttgtcttaatcaaatttttacctctacaactaaaatttatatttcatattttaaaatatatgcttttaatttatatgcctgatgctatgagaatgttcttgaaaaaaaagattgattcttatactgaatkctactgagaaactaaagttttgatcttggatgaagattcgtattaaggtttatttgtttttttttctctgataatatatgcaaagtaaataatattctgctgcttcagacaccatttttcatgggaaatatatttacaaacaaaggggaaaaaaaggaaagtatacctattaaattgatgcacacaaacaaatttagcctcaaactctaaaagactgtgaatattaaaagagaaataataggtagggtgtataatttcaaaataaatctctcaataatagtcttatacagctgggcgtggtggctcacgcctgtaatcccagcactttgggaggccgaggtgggtggatcacgaggtcaggagatcgagtccatcctggctaacatggtgaaaccccgtctctactaaaaataaaaaaattaaaaaaattcagccgggtgtggtggcacgcacctgtagtcccagctactcgggagggcgagacaggagaatcgcttgaacccgggaggcggaggttgcagtgagccgagatcacgccactgcaccccagcttgggcgacagagcgagacttgctctcaaaaataaataaataaatacaaaataaataatagtcttatacattaaatatacattcaattttagtacttttctagacattttaatttttaaaataaaaatagtccattaggtatatacttaaatgtttttaacttataattatttccctctagaattttaatagatttatatgtatgacagcttaaaatacagcattactagagctacacaatggttaagaagaatgcctgttagtgacagaaataagactatctggaaattctcaaaatagaatgcttcaaagatacatcacagtcaaaataagattttgttcttgtattttggaaagtaaaggatgtaagaagcttttttttaattttaagatttatatgtataacagtattgctactcctatttctttctgcagattataacagaggaattgagtatctcactgatctatgtccttacagaaccataggcatggcatagactatggaagtgtttcttataaaggctataaaattaatgaatttaatccttattttatttagtatgtaaatgtttctgaatatcactctacgcttttaaaaattaaaatctgggcagggtgtggtggcttacacctgtaatcccaggactttgggaggctgagacgggcggatcacctaaggtcaggagttcaagttcagcctggttaacatggcaaagccccatcgctaacaaaaacacaaaaattagggtgtgggggcaatgcctgtcaccccagctgctcgggaggccgaggcaggaggatcgcttgaacctgggaggcagagattgcagtgagccgagatcacaccactgtactccagcctgggtgacagagcgagactccttctcaaaaaaaaaaaaaaaaaaytaaartctggtcaaacaaaattggcaaatattgaaattccagctgggtgataggtatgtgggccatttattaaatttttctctctatttttatacttttggagtttttcatattaaatagaattaaaaatcgtaagaataaattttaaatgtattaaatttagaagttttctagaatacctctgtgagctattatacaaaatacttacaagagcatacataaaaataattgaattcttcatgtttctgcggtattctgtttttttaaaaccttttttatacaaatgcagagagggaagtacaccaaaaaaaatttaaaaaataaaacaaaaagaaattttttatacaaataatattcataggttgtagggggcaaatggaaaatactcactacactaaaataaacgactactacactacttttaaattttggcaaatatccttccagattttttttttctatttctagatctcttaaccacatcttaacatcaaattcttttaacaagaaaataatatcataaaattttttttgtttactcctcacccctacctgcccttgcttcttacctataatatgatgggctcagaatgggtcaaacatgactagtaaacctgactgtaaggatgtgttttaaaatccagccatcactaccaccacacacacatgcacacacacacacaaatccactactccttagttgtttagtctaacaacaaaaattaataagacttaaaatgcaattgagaagaacacaaagatcaaaagaacttaaaatcttatgaaccaaatatataaagggaaagttaatcatttagtgatagttctggaaagtcttttttaaacatcctggtgtagatgagtattggtttagaaatcattaaccagtaaagagattgatgcacagagagaaactaaatgtttaggcaactgtcactgccaaataatggtcaattgaaaataaagatagggctgggtgtggtggctcacgcctgtaatcccagcacttcgggaggccaaggtgggcagattgcttgagtccaggagtttggaaccagcctgggcaacatagtgaaaacccatctctactaaaaatacaaaaattggctgggtgtggtggcgcacgctggtggtcccagctactcaggaggctgaggtgggaggatggcttgagcctgggaagtggaagttgcagtgagccgagatcacaccactgccttccagcctgggtgacagagctagaccctttctcaaataaaataaaataaaataagaaagataaatcagaattcaaaacatactgtaccttcactataaaacatggcccaatttagagaaataaccytcatacatatagtttatgagaaccccagctcttctgaattaagcaataaaggtttgtaaagcacaaaccacattaaaaagaaaaacgtattacccagataagctggtcaaacaaccaactgcggaatggaactgtctgtgcagcaaagctgaaggaagcaagtggtttttagaaactcagtgaagtcagtagtgaagataacaagaaacacagacacaaaaaaacataaacaaaagtgacagaaacccacttgcagtcaacagctctacagagatgcatacatgtttaaaattaaaagggctctggaaacatgcacaattttcaaaatgaacttggccagtatgctacagtgtgttacaaccttcccaagtcattcttcycaactctgtcaacttcctttcacaggacacatgtgaagggaatttagagtttcgagaagtctctttcttctatccatgtcgcccagatgttttcatcctccgtggcttatccctcagtattgagcgaggaaagacagtagcatttgtggggagcagcggctgtgggaaaagcacttctgttcaacttctgcagagactttatgaccccgtgcaaggacaagtggtaagacagaactgaaacacacctaatctgggggttagcagtcctattcttaaacattcactagggcttaagcatccccactggtttgggtggggcaaacaatgcagaagttaaaaagaaaaaaaatctctgtgtcaacccttaactaagaggacaagcaaaccatcacaaaaatgatggttasgactctgaagtgaagcacaaaggtccaaagattcttcaaccattctggcagcagaaatgttgatcttagccatggaattactttagaacatgggtgctggagatctggtctaatgttcacatcgtggctccgtattctgttgtggtttaagacagagagaacactgtcctccacctccttagttcaggcttctgctttcccaccactcatccccacctcccaactgtcaaaactttatgcacggttaaggcttattggaatcagctccatgaagtcatgcctctaatatctaaaataatgtaatctccccatccttcgaaactaaggattgtttttcttacctggcacttgtcttactataccttatattgtggtttttccattaccttgtcctccccccaccacccaccaccacatcagcacacccacacaaagcttcctgtcctgcctcctgcccgtacaaaaaagttcctaaaactcagactgccatgttagtcctcattctcctgcaacgtacagtcttttcgcccttacagattctcaatgagtgtttgcaaaacagagtttagggactcaagggagtcctaaagggctcccttgaactatgagacactcatctattcgcacatagcatagcacactccctcttctaaaccttccacagttagaacataccagtctatgccatcaatcaggtccttcatgccctggcccctgcctcccactccaagctcctctcatatcactccccacgtcatcatgcactgtgctttttctgttttttggggggcttttgtacrttttttgttttgttttgtttttttgagacagagtcttgctctgtggcccaggctggagtacagtggcgtgatctctgctcactgcaacccccgcctctagggttcatgcgattctcatgcctcagcctcccaagtagtagctgagattacaggggtgtgccaccatgtccagttagtttttgtattttttgtagaaacggggtttcaccatgttaaccagggtggtcttgaactcctagcctcaagtcatctgcccacctcagcctcccagtctcctcatgttctttaaacacacctatgaacctttcttttgctattgccctgaccagaatgtcccctttgcaggctccttctcactgttcatgtcttagtctgaacgtcctttccttaaggccttcttgtacaacccccttctcatgcctctccataccctccccactgcctcagtcgctgtaccctgttaccctgtctttagggtactttcctcccctgagtttattgagttatttgttcatgtgtttattgcatgcctctctgctaaaatataagctacatccatggggggaggggggagggacagcattaggagatatacctaatgctaaaccatgagttaatgggtgcagcacaccaacatggcacatgtatacatatgtaacaaacctgtacgttgtgcacatgtaccctaaaacttaaagtataataataataaaattaaaaaaatatatatatataagctacaaaagggaaagagctttctcttattgaccactatttccctggtactggaagagtccccctcacgtagtgagcatgctcatcaaatatgagatggtgttgttaagagtgttgttatytatttatgtgaataaacatggctgtgtgcaagatgacacagctttacatgtggagtactgtatcatctccacctactttttactgggctttcagaaagtcaggtcctgttacagtggagggggcagtagtgagttacaygctgtttgcttctatacaacgtatgatttatgagccttccttgggtaactttatactttgaaatagcttgaattcctatccttcttgttatgatttgtgtgtgtttgaatacagtgaactgtaacatgatacagttgtgtgatcttaacacaccattctccaatctgcttttggcagctgtttgatggtgtggatgcaaaagaattgaatgtacagtggctccgttcccaaayagcaatcgttcctcaagagcctgtgctcttcaactgcagcattgctgagaacatcgcctatggtgacaacagccgtgtggtgccattagatragatcaaagaagccgcaaatgcagcaaatatccattcttttattgaaggtctccctgaggtaagaaaatttctgaaatcttgaattataaagctgccaagtaaggctaagtagctactgggcctatgcagttgtttttatgtattccttggattatacaatgtatttattgccagaatctaaagttagatgtaaaacatgaagtcagatgcgaaaaaccaagtttgagattttcgtgtgacgattttcctacgaccaaaatgtattaatattcactggattaactttcacattttgttatttgccttccatccatctacactgtggctggtccacactatgacctccccgccacggcggtagcctcttcatctgccttccagtcttgctcctttatcatttttcttcctcacagtaatcagagggatcttttaaaaacaaattagatcctatccctcccctgctcacaactgcctcatggctcccctgtgcgcttagaataaagcccacacaccccatggggaggggctgctgaagcctctgtaatctggccctgctgtttccccagcaacaacctcaccacacagtcgctttgctgcagctgagctggtctctcctgtctcaagaacatgccaacttgctccccaccttaggacatttgcgtttgctgtttctccagcctagacctcccttaggttggcttttggcatagtagcgccttaactttcttttttttttttgacagagtttcgctcttgttgcccaggctagagttccatggtgcaatctcagctcactcagctccacctcccgtgttcaagcaattctcctgcctcagcctcccaagtagctgggattacaggcatgtgccatcacgcccggctaattttttgtatttttagtagagaaggggtttctccatgttggacaggctggtctcaaactcccgacctcaggtgatccaccgccttggcctcccaaagtgctgggattacaggcgtgagccatcgcgcccggcaagtagcaccttaactttcaagccctttcaaatgttacctttgcagaggctttccctaaacatcctatttttaaaagtcctcaccagtcctatcccctatcactttgtcttcagggcatgtatcacagtctgaaaattaccctgagcacttagttatttgtttagtgtttcccttccccactagagtgtaagatccttttttatcaccttgatgtctgtattggctgtggcaattggcacaaaatctcagaaaagtcaaaaatcttggctaactgtagagaagcctttggtagtgcaagcattgatacaaatccaaaaacagtgcacagagagggataattgtaactttaagtgtttataatatctgagtgtttgcaacacacatacacacacataaaataaattaaatgaaataaaaatagagatattttcatgtaggggcgaatttctacatgtgatttttataaactaagtttctatctcactttaaagggagatagttaaatttaacaaccaatatatcaaacaactaataatctagagccctgttctttggtgaaggccaatagccatcatactctctaacttttatactctttccctcaccagctcttctccatactacatagtgcctacatgtacaaacaggatttcccttactctggtaagggtttgcagtactaaagacataggaaggattcacatattttttataaatatagagacactgtgaatgtcttttaatggcaacttcctttttaaccatgacactcactgcattgttaatttgtggtcagattgttatctgcataatctcgatagtttgttttatgtattgtgaaatgctgcccaattgatatttgtaccatttaacttttattctttttcctttgagacaaggcctcactctgtcacccaggctgcagtgcagtggtgtgttcttggttcactgcagcctcgacctcccaggctcacctgagtctcccgaataggtgggatcacaggcacatgccaccatgcctggctaatttttgtattttttgtagagatggggtttcatcatgttgcttaggctggactcaagctcctgggctcaagcaatttcacccacctcggtctcccaaagttctggaattacaggcataagccaccacatctggcctaacttttattcttaaattgtttattatcttctattctttttattgtaccagttctcacatttactcaaaactatatgctgcaaaaatccaytgtgctaactttttacaacagactttgaaaactaagatgttatttcctttaacattttttctaaaagactagcttatttttcagtgttttaaattttaactttaatttaccttcatgtcattgttcccccaaaaacacgtagaaaaataaggaaacctgataccaaaataaaatagttwaaaaaaaatcaaatcagataattcctagaaaagctgcatattactaaatgccytcggttagtaccctggggagaataaggctgccctcttatgctcagttggctgggaaaaacgaagagaggaaaccagccacgcattccccagcccttctgggaaccaagaactaagctaaatttccaccatagtacagcaaggatgctgtaactaccgcattttacagataaagaagttcaataactttcttaaagttgtatagaaactcagcatttgaacctggattctttgtgctatcctgaagggacggaaagggttcgtaaccatggtggtcctagggtttcagagatgggaacaaaggtgcccttgctcctcccttcagaagagcagtccaaagcaaccaccacaactgtggataatggcactggtatactcagagtgacacttagaaacatgttacagctcacacgtaggtttttagggaagaaaagtgaacatgaatcttgtaatttgttgtacttccttcagatagaattaattttagactgggtgtagtggctcacacctgtaatcctagcactttgggaggccaaggagggtggattaccttggtcaggagttcaagaccagcctggccaacttggtgaaaccctgtctttactaataatacaaaaattagctgggcatggtggcacacgcctgtattcccagctacttgggaggctgaggcaggagaatcacttgaacccgggagatggaggttgcagtgagccaagatcatgccattgcactccagcctgggcaacaagagtgagactccatctcaaaaaaaaaaaaaaaaaaaaaaaagggaattaattttttcttgagcaaataagtggagcccagcactccctccaaatacatggccacagtggcagtgtgaaaatggtgaagcaaaagtctgaaagagttcaggtcttccagtaacatgcagtaagcataaaatatatacccatatgtaaaacaggcataggaagaaagtcggcttcacataagacacattaatgtattattcattttaattctctccaagaattatttagcaaattgaattgtgtcacactttgctttctgaggatttcttttacttttactacaaactttgtggattgaccaatctgccatgtcctgcttcctcaaaatttactttccctgtcttccttcctttctttgtctctccctttctttstctctccctttctttctctttctttcttgcttgcttttcttgtattttcttcctttctctctctctttccctttcttttcctccctccctccctctctctctccttccttccctctctacttccttccttcctcccttcccctccctccctccctccccctctctctctttctttcttttctttcttcacagggtcttgctctgtcgcctaggctgaaatacagtggcaggatctcagctcactgcagccttgacctcctgggctcaagtgttcctcccacctcaccctccccgggagctgcgaccataggtgcctgccacctatgcctgcctaatttttttttttttttttttttttgcaaagatggggtttcaccatgttgcccaggctggtctcaaactcccggcttcaagtgatccacccgcctcggcttcccaaagacactgtgtccagccccatgtcttcattcctctatcccaacatccatgcatttagtcactcaacacacagctactgagcatttctttgcaaaccactgggcttttatttagggaagataggacaaatatagtcctacttttaggaatatgaagcccaatagttaagatgaacacagatcaacacatacaaataattatagtgcacagaaggtaaacaaacttccatctgagcctagaggggagtagaatcacttctggctgggggttcagaggagacctttggagaattaagaggtgatctgagtattgatcaagtagaatttcagtagtcaaggctttaaaagggcattctctataatgaggcaatgggcatagcctgagcaaaaacatggagacagaaactatggcaatgttttcatggaactgtaagccaattgacaaagaatagagtatataaagctatggtatttgataagcatgtaaaggtaaaaagctggcacttaaatcacaaggaaagaaatgtttaagtttggtagttactaaggagtcactgaagatttttaaatagggaacatgttgggaattggatattggaattactcatctagcagcaatgtaaatgacggtagagagtgacaaagacacaggcagcttgagagatcagttcagagctatttccagggataggttttgaaggcctacaataacaattacaaagtgaactaaaacaagaaaattgatttaaaagatattttaaaagtggaatcaacaggacttggctcaagattgtttctggaaagtgagcaaggaaatgtacaatgcactgccagcagcctcatggaataaaacacggagcagtgatgagagtccaaaggcttccccctacacacacacacacacacacacacacacacacacacatatacacacaagccacacacaaattgtgtatgtttgatgaaaattcatttggtggcaaaatgatgtgaggatataatatagtcctttatttatatttatcccacttagaataaataatcaaatacatctgcacaaaattcatgtatttgattaccattgcttccccagatccttctgggggtgttaaataatatattatctattaaatatagataacatatcgtatatgtataatacgtagacttttttcttctaaggttgaaaaaaaatcagaattcttaaatacagataactccaasggtttcggtaagggagtgtggatctgtgtaacggctcaaaccagaagggtgcagagcaaggagtcaattagaacatgctgagtgtaatgtaatgcatctaccacttatctcatagaaatatcccacaggcatttggaaatacaggcctggggcataggacagaagtggaagcaacaccgccttgacctcaaggatcctctgagacacacaccaggtgtggttctctactaatcttcacagtatcacccagtggcagctctcrgtcragccacatccttaagtaggactttgaccactgtaaccaccctgaaaatccaacccagtgcctgcagggattctccagaatgcagttgctttaggattagactctggtgttccctctgggacacaactgacttttagctccggttcatattaaggagccrttaccccttgagtttctcataaaagaggtgatttcggggcactcaccatcccagtgattgccagaaaatggattcaaattttcggctaaagagaaactctgtggttctttgttaaaaaacaaataaaaccatcctggctaacatggtgaaaccccgtctctactgaaaatacaaaaaattagccaggcgtggtggcgggcgcctgtagttgcagctactgggaggctgaggcaggagaatggcgtgaacccgggaagcggagcttgcagtgagcygagatcgcgtcactgcactccagcctgggctacagagcgagactccgtaaaaaaataaataaataaataaaatttaaaaaaattaaaaaaccttcatccaatatgttctttaaacttacactctcctacaatccagggaaggccaaaractgcaaagtgattcctagttttgtatgttcttcagctgccctagaagaattcatgtacaatttaagctaggctggcagaaagggctacgagctcattatcattcccacctcccttcccaatttttagtttaagattgaatcccctcatttaaatatgaactttgcagtgtttggaaatgaacggcagacacagttttatctatggttccaaatttaacaaaatgcattttaggaggaaggggcccaaggcctgctagtagtcccagataaatgacagagaaaacagcgaaagtctgtattctttgtagagcattcacgtcagagaagatatttttactaggctttagtaattcagacacccgtcctttgctacaaagcatgcacctatgcatgttaaattgaaaagtaagctttgagatgacgtagacacattttgttataaggttataccacaggttcgtgacaccaactctgtccaaaatgcacttcctgaaggcagtcagatgtggagagaaaggcaattccctcaagcttctctagattaccaacacaaaatgaacagctaggaatcacaagctacatgtgaaatgctgctacaggattaatcttyctggctatacccttggaccagctttctcaatggaactgatccatctacacattcttgtctaggtaccaagggcttatgtttcttacaaaagtgccaagggccactagaaagcaatgtgaagccttgaaaggaagcaaagtcaatgggacaatctaaaaagcaggcaagaacctgcttaccccaactgtactgaccarttgtgattcagaggaccatgatggcttcaagatttgtgtgaaattttctttacccttccatgaagggaaacactggagaaattgggttattagtaagtaggggaactawgaaaacactgtgaagtgctaaatgtcaccattactacttagtggcctgaaaaggtgaatagactgtttcaagacgccaacctggccaggcgcggtagctcacgcctgcaatcccaacactttgggaggctgaggagggtggatcacgaggtcaggaattcatgaccagcctggccaacgtggtgaaacctcatctctactaaaaatacaaaaattagccaggcatggtggtgggcacctgtaatcccagctacttgggaggctgaggcagagaatcgcttgaagccgggaggcggaggttgcagtgagccaagattgcgccactgcactctagactgggtaacagagcgagacacggtctcaaaaaaacaaaaaagtcaacctaacttatttccaggaagatgcatgtaccactgagactcctatcccagcatctgtaaggatgtgcccacagaggctcagcaagagccaaagtgaagaaacttcataatttccttgttgtttttactactgcgaatcattttaacctgaaaatagtaggtagtataacttaatggaaaaggatttgtgtttactgtgaacttgtttcttgccagtaatttttttcttatgctttaatttgaaaaatttctttgtggaagcataatggcagaggtctgctgtctgatcagattggatatgtaaatgagatggtagtgtttactgcggctttagcatttatttgcaacaaagcccaagaatagatttcaacatttgttgggacacaaattttcaagagtagcaaaatttgaaatatttagatggttctcgcccacagttgccatgctaatttaaataaccaagacttgctttcttaattgcatgctcctgtgatagaaatacaacacacaagttggactgaaaggagcacagctttctggcggccagaaacaaagactagctattgcaagggctcttctccaaaaacccaaaattttattgttggatgaggccacttcagccctcgrtaatgacagtgagaaggtaacatcattttcttttatctcagaatataataccaaatataagcatccaataacatggaggaaaccaaggtaagtttggaaaaacaaaggcctggaaagaattgtagttctaaggtcaccagttccaattaaggctttggacctttacaaaaaggtcagtaggtggtggggaggtgggagacagttgagacagagggaatctcatgttccagaaaggttttctcactcaaatttgtctcattatcaaaagtggaccaattttcaaaatgttttttcattcaaggaaagagcccaagaaaawtaacttttcaattttattattattccagtgatgccaaacaaactaataaggtaattagtatgggtaaaagagtaatctacactgcagggtcagagcctgagagttattctaccttctacagactcagcctagtttgagcgggaaacaaggaggcaaagtgacacatgagaaaatacttgcacagcaagcttctccagctgtttgattttgctatgtccttatcccttaggagtttcttgcacatgtaggcacttatttagtaaatgaacattggttaaatgaatggtwatcattaatatttgtagagtatgcattacatgctattatctcagtcttcacaacaacatgacgaatgagcttcttgtattagcatgcccattttacagattggcacactaaggcttagattaagtaacttctctaaattctaatggagggtatctgacctaagagcccaggcagttaatccacccatgattgctgcttgaagatgattattattcttgattctcaaagcaacaatgtgttatgaaaaataaacaacaactaacttttgggatcagacatatctgggctgtaatccttacttcatcagttactagcagtatgaccttggtctaacctcagttcagytatcagaaaaataaaaatactgtcattttatgaggttattgaaagaatttaaatgagatatccatcttgggaacattttatgtattcaacaaatatgggttttcaccttccactcccactttctctatatagcgtcataacctcactgttggctgaaatgctatgttaacaggacagttctacagctaaatcctaccaaaaacaaaacaaaatctatgagagaaaattagataaataaattagacaattctacttaggtatactacttagaaatactacttcctgactttgagtttagaactactcaaagaaatgatagtagaaatttgartagtattagaactactcaaagaaattgtagtagaaatactactataattctacttagaaatactacttcctgactgtgagtttagaaccactaacatataaacaactatttcatttttattcattctcacaaatgcttttccactgaaagtcttacataatttatctgtagctaatctttcttttttttttttgagacggagtttcactcttgtcacttaggctggagtgcaatggcaygatctcagctcacggcaacctccacctcccagggtcaagcgattrtcctgcctcagcctcccaaatagctcggattacagatgcctgccaccacacccagctaattttgtatttttagtagagatgggatttctccatgttgatcaggctggtctcgaactcctgacctcaggtgatctgcctgccttggcctcccaaagtgctgggattacaggcatgagccaatgtgcccagctgtagttaatatttctagatttctattgagtaaggtgattattttacaagtagggcagttcctttggggacaagcaaataaagcaaagaaggttattagactaccttaattgatttgacttaggtaagtttactaacatctaactcaaactggtgatcacaggtcyttctctcttccaggtggttcagcatgcccttgataaagccaggacrggaaggacatgcctagtggtcactcacaggctctctgcaattcagaacgcagatttgatagtggttctgcacaatggaaagataaaggaacaaggaactcatcaagagctcctgagaaatcgagacatatattttaagttagtgaatgcacagtcagtgcagtgatgctgttgaggtagcacatattttgatgttcgtgtaatgcaaagaaggagtacttaataattacttggcaagctttgatctcttttattgcatatatcaatacctagaatcatgctactcaagtacatacatgttctattcacacaccatctgaccttcagatttttaaaaggaagcaaaaatttgcttatttcatgtaagtgaaataatgcttatatccttcactttataaaactattctagcacatttgcttgtaaagcagttttctacaaggtgaatttatttcccatcaacttctgctataaaatcggaaatatgtttccagggggaatattatccaattaaccatgttgaaggttttagcaaaggcagtgtaagatagagtggggcctgtagcattgcagggagagtgtctttcacttggaattttgttttgcagcacatattacagtagttttgctagtcccttttctccagaccgtagggatttctctcaataagtattcactatttctctaaattttattctatttttttgttgagcagggaatagaaaggattacgatgtaaaatttctgggaggattaggtagctatctcctacttcaccagtaagtgaagtgcctcacatgagccatcccaaagattcattattccaaaccttgggtttggcagtataagtcacaggcctacctgtttatgaaaacttacttacttaaaataagagctacttttgggccgggtgcggtggctcacgcctgtaatcccagaactttgggaggccgaggagggcggatcacttgaggtcaggagttcgagaccagcctggccaacatggtgaaaccccgtctctactaaaaacacaaaaattagccaatcttggtggcgggcacctggaatcccagctacttgggaggctgaggcaggagaatcatttgaacctaggaggcagaggttgcagtgagccgagatctcaccactgcactccagcctgcgcaacagagcgagactccatctcaaaaaataataaataagagctaattttattgtgggtgaaaatttttaaacgtctttctctataataaaataatttccttaaattttatatatactttatcatatataatgtgtgaatgattttaaagttctgtgtaaataacaatattggtaaaatgagttacattttcaacttacttaaatatgtaatgtcacctggtgattttatctttattcttcagtgtattttcttccatttacacatttagctagcctccctaaagtgtactctaccaataattgaaatcttgttaaacaaaattaaaaccatttatatattatgctgctttctttaaaatgcaaaataaaaataagattggggacttgagaatcagatgcattgcttagacacattggtgctgactgccatgtggttattttgctattcatggatatagagctcttggtagcttctcttcccggggtagggtagacaagaagaaaataaaaatatagtatggacatgctcagaacctcagagcaggagcaccacaggctccaattctgtaatccctcctagaggggcaaatatggtacctgaaatgcctgcttaccctttgaacctatcaacatctgtcccatacctatagatagcagtaaaacacattcctttctaatgtataaccctgctagtttttatttccattttatttttaatgagtttaaagaacgcttcacaggcagaattctcatcaataaagccactgcctgcactggaccaagcaatcatgctgagaattggggtcccaaagagtttttaaggatttgtaaggttatcagctgatgaaggcagaaagtaggtagagatcaactactttttaggggttgccacaatttaaaggtttttctttttttttttttttttttttgacggagttttgctcctgttgcccaggctggagtgcaatggcgcaatcttggctcaccacaacttccgcctcccgggttcaagcgattctcctgcctcagcctcctgagtagctgggattataggcatgcaccaccacacccggctaattttgtatttttagtagagacggggtttgtccatgttggtcaggctggtctcgaactcccgacctcaggtgatccgcccatctcggcctcccaaaatgctagtattatagacatgagccaccacacccggccgacaatttaaaggtttaaaattgctgtactgttcttaaagttgtgtttaaaatatatcattttcattaaaacaatagttatcagttttataggcatgactttttatgactttttaattcttgcacttttcttttctttcttttctttttttttttttttttgagacagactctagctctgttgcccaggctggaatgcagaggtgcaatctcagttcactgcatccttggcctcccaggctctagagatcctcctacctcagcctctcaagtagctggggctacgggcctgcaccaccaaacccggctaatttttgtttttgtttttttaaacacagggtttcaccatgttgcccaggctggtctggaactactgggctcaagtgatccaccccagtaggccccaaacgtactgggattacaggtgtgagccaccttgccctgtgtcctacactctccttttctttctttctttttttttttttttttttttgggagatggagtcactctgttgcccaggctggagtgcagtggcgcaatctcagctcactgcaacctcagcctcccagattcaagtgattctcctgcctcagcctcccaagtagctggaactacaggtatgcgccaccacatctggccaatttttgtatttttagtagagatggggtttcactatgttggtcaggctggtttcgaactcctgacctcatgatccacccacatcagcctcccaaagtgctggaattacaggcgtgagccactgcacctggcccctacacttttcttaaagcaaggtattctgtagccaaaaaagaagctgaattaggccaggtgtggtggctcactcctgtaatcccatcactttgggaagccgaggcaggcggatcacttgaggccacgagtttgatttcagactggccaacatggtgaaatcctgtctctactaaacatacaaaaattagtggggtgtggtgatgcatgcctgtagtcccagctactcaggaggctgaggcaggagaatcatttgaacctgggaatcggaggttgcagtgagcagagatggtgcaatacactccagcctggatgacagagggagattctatcacccctacttcccacttccgttcccagcccaaaaaagaagctacattaggaattgatatttttatctaaaataaataaacaaaatggtacttcagcagatgtatttatttatttttataattttaactttcattttagattcgcatgtggagttccttctacataggtatattgcatgatgctgaggtttgggatacaattgatcccatcacccaggtagtgagcacagcactcaatagatagtttttcaacctttggccccctcgctccccactctagtagtccctggtgtctatcgttgccatctttatgcccatacttcagcagatttaaatgtaagttttacatgttaaatcgctcattaaatattttataaattattaaataataccatgcttaggtgtacagcttacaacttggtatttactaaagggctttaagcaatgaatgccagattattcagggcaccaaatcagtgaatttaagacatgttgtcttcttatagtgccttggatatagtagatactcaataaatactaggtgattcagtttgaaaagtcaaaaatcatagcaggtatgcattactgatactaagatgagcacacacttactgaaaagatgacctggtgggcttcagttgttttgcctcaacaatcatgtattagaatctctccgtcatgggtattatcagtcattggtgacatactcgatagtttacttctaggctagactcgtttaagtccataaaaactttttctttccattcggatggcaattttaattttagttaaataaatttttaattttattttaattaattttagccttttatcatagtttatgtgttggtttaatttatttaattttgaaataatttggtatttgagcatacatcgcctgatttattttagaacattgtgagtctaatttcccacaaggcttttgtctagattaaggcatattccctagtttcaaggacttctggtctaaggtaaacactgatctctgccagtcatgactcatagcctactccttacttggattgacctcaatccaaactgtctgagcgtccttgccctttgcttctcctctacctctgggcttgcttatagttataaaacaagagactagaagaaagaatgaaacaccagtttaaaacaacataacaaggccggacgtggtggctcacacctgtaatcccagcactttgggaggccgaggtgggcggatcacctgaggtcgggagttcaagaccagcctgaccaacatggtgaaaccctgtctctactaaaaatacaaaaatcacccgggcatgatggtgcatgcctgtaatcccagttacttgggaagctgaggcaggagaatcatttgaacccgggaggcggaggttgcagtgagccaagattgygccaccgcactccagcctgggcatcgcaggaacactctacctcaaaaaaaaaaaaaaaagaaagaaagaaaaggaaaggaaaaaaaagaaaaaacacctggcctagaaaatcctaaatacaatgaaggcagctgtccagagagatcaagatccatcagagtcatctgtaaatgttagtgtgttacagcaggggtccccaatccccagaccacggaccagtaccaatccatggcctgttaggaaccgggctgcagagcaggaggtgagcagtgggtaggcaagtgaagcacggtaggaggtgagcagtgggtaagcaagtgaagcttcatctgtatttacagctgcagccgctctccatggctagcattactgcctaagctctgcctcctgtcagatcagcggtggcattagattctcagaagagcgcgaacccaattgtgaactgcacatgcgagagagctgggttgcgtgctttttatgagaatctaatgcctgatgatctgtcactgtctcccatcatccccagatgggaccatctagttgcaggaaaacaagctcaggtctcccactgatcctacattatggtgatttgtataattattttattatatgctacaatgtaatcataatagaaataaagtactcaataaatgtaaaaatgcacttgaatcatcccaaaaccactgccccacttccccggtccgtggaaaaactgtcttccaggaaactggtccctggtgccaaaaaggttagggactgctgttacagtagctctcagcaatcaaatcttatctgttaaactgccctttctttgtaagagggaaggctgctcagtgagtcttaaaataattgaaacaccaatgaggataccagtggaataaaaacaatttaacaaggataaggtatgacacagatgtcagtgaaaagaaacaaaagaacatcacacctgttttaaaactaacccagccaacctattttatatattaccactccttaaaacaagttatggtatgttctcatgttaaatcaacttaggtcatagctaataaactgattcgcagcctactcaatgtgtcagtttcacagcatgcagagtatatcatagcgttacacatgacctattctatgaaaatatttcctaggttattgtcaacttatgtattcattgctttggttctgagctcttattccaagagggtttgtgaagtggaattataaattgattggaaatagtccagagaggaaactggaaagattggaaatggaggaatgagggtagagggt

SEQ ID NO: 12293 - DNA, 64206 bp, Homo sapiens
agtgctggaatcccaggcgtgagccaccacacccggctgaaaggtggctttggcgctgctaacatcaaggtccctgtgagacatccgagcagagatgccaagttggcagttggagactagagtctagacttcacgggagaggtccaggctggggatgtaaactcagaagttgtcagtttattagtgtttagagccatgagtctggatgagatgggagagagagaagaggcccaagcctgagctttgggcacttgattaattcaaagccacaagatgaggaagaaccacctgaaaagactaagaagttgtggacagtgaggtaggaagagaactaagagaagaaagtgctgaatgacaagcagcatcatggtagctggccatgggaaatggcccgccaaaaactgcacactgcggttcacactcttgctcggccccagccactttcctctgggctgtcaccatagaactaacaaaaagcagcagaagtggcagcctgccttctgaggccaggtcacaggaaatcttgcagcttctaccttagtgtttttgaatgctgctctgggataagccagttgccatcaaagaagtttgactactctgagccaccacgatgtgaggaagcccaagctaagcatgtgggaagcccaggatggagggaaaagatggccaaccagggccatggttgttccagccatctcagctgaggcaccagccacaggagtgaagaatttgttttagacatccagtccaatcaaaccttgccatgactttggctacagctgcaccagcatgagaaaccctgagggagaaacccacaggactaggagagacagtgacacactgtcattttaaggctctatattctgggatggctcattctacagtggataatggagacaggagttcattgcaaagggagactgaccagtcccctgcccgcaacagagcacagccctcttcacccagacccatggagaggtggctgagcagacctcagctgggcagccctccacactctgaaggctccccctttcctgccttagtggcaagaataataattttctctttgtgcccagagagctggcaactgccaagtgccctgctgtccccagggcccttacaaaaggactgcaggggaggtttttctgagaactgggtcaccggttacttagatgcttcaaacctggcagaacagagaaacatcagataaaggagactgggaacttcataggaagctgctggtccttgtcatggggacacaccatgacaagccaccagagagtggctgcctgccctctctggacccttatgtcatagggacctcctctcttctagagagctctctctttctttgtaaatgtttgtaaatctttctttgtaaacattttggaaagtatgcattaatcaggccagacacgatggctcacgcatttaatcccagcactttgggaggccgaggcgggcagatcactcgaggtcaggagttcaagaccagcttggccaacatggtgaaaccctatctctactaaaaatagaaaaattagctgggcatggtggtgggcatctgtaatcccagctactcgggagggtgaggcaggagaatcacttgaacccaggagaaagaggttgcagtgagctgagatcacatctgtaatcccagcactttgggagtctgaggtgggcagatcacttgaggccaggagttcgagaccagcctggcaaacatggtgaaaccctatctctacaaaaaatacaaaaattagctggatgtggtggcacatggctgtagtcccagctactggagaagctgaagtgggaggatcacctgagcctgggaggtccaggctgcagtgagccgtgattgtgccactacactccagcctgagtgacagagtgagaccttgtcttgaacaaaacaaaacaaaacaaaacaaaacaaaacagaaaaaaacctgtccttttctcccactgcctgttcagttccccagaggcaattgcttaacatttctttcacatttattggaataggtaacacaaggcgtgtgctaaaaatttcaaaaggtacaaaaaaggtaaagagattaagtctccctccttccttctccccacccagctcctctccctaaagacaaccacttctaccagtgtattacatctccttccagagatatgctatgcatatgtcagcatataatataaacagccttaaaaaataaaacagggctgggaatggtggttcatgcctgtaatcccagcactttgggaggccacggtgggtgcatcacctgaggtcaggagttcaagaccagcctgaccaacatggtgaaacgcttgtctctactaaaaatacaaaattagctgggcgtggtggctcatgcctgtaatcccacctacttgggaggctgaggcaggagaattgcttgaacttgggaggcggaggttgcagtgagctgaggttgtgccattgcactctagcctgggcaacaagaggaaaacaccgtctcaaaaacaaccaccaccaccaacccagaaagggtaacttgctacaaatgctgttctgcaccttgcttttccacttaaccatatattttgaaggtcttccatatcagtaggtaaataactgctttattattttaggggactgcacaatattccactgtagggatggaccgtaattcatgtaaccagcccctactgagggacactgaggttgatgccaaccttttgatattacagtgaaacagcaaataatcttgtactcatgttttcttgcacatgtatgcctctctcagtaaagattcctgaatcaaaagacgtgtgcttttgtcattttttaaaatttttatttattcatttatttttgagacagggtctcgctctgtcacccaggctggattgcagtggcacgatcatggctcactgtagcttgacttcccgggctgaagtgatcctcctgtctcagcctcctgagtagctgggaccacaggtgtgtgcccccatgcctggctaatatttaaattttatttttagtagagacagggtcttcctatgttgcccaggctggtctcaaacgtctgggctcaagcaatcctcccgcctcagcctcccaaaatactggaatcccagtattataggctgtgcttttgtacttttaataggtattgacaaaatgagactgtattgatgttcttgtttgcagacttcatacttaagtgcccctttccctacaccttccccaattctattcaaataaaaatcaacatctttaatctgtgctgtagaattggtaagaaatgtatctctgcacttttacatttgaaatatattgttagaaggttgagcatcttcatatgcttaattgtcatggcaaccacttctagcctgtgtagcgatttcttctagttgtttatttccatagagctaaataatgtttgaatgtagccattcattgatttatcagctttaggtgttatctattgatttttgctccaatacatgaggatttagctcacttacagtgtcatccttgcacctcctctatctttctacccttccttccttctctcttttttatttttattttttttttgagacggagtcttgcttgttgcccagggtagagtgcagtggcacaatcttggttcactgcaacctctgcctcccaggttcaagtgattctcctaccacagcctcccaagtagttgggattacaggcgcccactgccaagcccagctaatttttgtatttttagtaaagatggggtttcaccacattggtcaggctggtcttgaactcctgacctcaggtgatgcacccacctcgtcctcccaaagtgctgggattacaggcgtgagccaccgtgcctggtctcttctctttatgaaaaatattgctggttttccatttatagtagtgatatatttttttcctttccttttcttattaaaatagactattttttagagaagtttttggttcacggcaaaattgaacagaaagtacagagttctcatatattccctgctcctcccacccctcagtttttcccactaccaaggtcctacaccagtggtacatttgttacaatcgatgaacctgcactgatacatccttatcatccaaagcccatagtttgccttagggttcactcttggtgctgcacattctatgggtttggacaaatgtacaatgacatgtatccaccattatagtatcatgcagaatagtttaactgccctaaaaatcctctgtgctccacctattcatccctccctccagcctaaccccaggaaaccactgataattttactgtcttcatggttttgctttttccacaatgtcatgtagttggaatcatacagtatgtagtctttttcagattgtcttctttcagttaataaaatgcacttaagtttcttccacgtctttttgtggcttgatagcttatttctttttagtgctgaataatattccattgcctggatttaccacagtatatttatccattcacctcctgaaggaaatcatggttgctcccaagtttggggaatcattaataaaacttctaggaacatctgtgtgcaggtctttgtgtggacataaattttcagctcatttgggtaaataccaaggagcatgaatattggatcatatggtaagtgtacatttcattttgtaagaaactgccaaactgtctcccacaatggctataccattttgttttcctaccagaaatgaaaaagagttcccgttgctccacgtcctcaccagcgtttaggattttaatcctttgaataggcatgtagtgttatctcattagtattttcatttgcaatctcctaacgacaggtgatgttgagcatcatttcatatgtttatttgccatctgtatatcttctttggttgaggtatctgcttagttcttttgcctatttttttttttttttttttgagacggcgttttgctcttgttgcccaggctggagcgcaatggtgcaatcttggctcactgctacctccccctcctgggttcaagggattctcctgcctcagcctcctgagtagctgggattacaggtacccgccaccacacttggctaattttttgtatttttagtagagatggggtttcaccatgttggtcaggctggtctcgaactcctgacctcaggtgatccacccgcctcggcctcccaaagtgctgggattttacagacctgagccatggtgcctggcctcttttgccaattttttaatgaggtcttttgtcttcttgttattgagttctaaaagttctttatatattttggacagcagttctttatcaggtgtgtcttttgcaaataatttttcccattctgtgggtttggtgggtttgtcttctcattctcttgagtgatgtggcatttaaaaaaataaaattactttaagtttaaaaagcaagtccatttaaagagaaacacccaggaaataatagccaaggtggtagaatatggtgaaaaaatgaaagggcacccaagagcctcaggtttgggcaatactgatgacacatagagcctggttccctggcaattattatggcggttactactattttaataatattagcagttacggttggtatttttgctattacaattaatggcataggggctgtatcgcccctgtcttcctggaacctggaggcaatgaggagctctgcaaagttgttgagattattatgaccatatctgggtatttcaccactacaaagagctgcgcaaagtttggacggtaggaatcggggtggacatcagctcggtgacaggtaggaggtgggtccgaggaggggtcgggtctgggagcctccgcccccaactcaaggcaggctacacaagatctgtctccgttggcgtcccggtacctagcttgagcccgaccatgggcatgcgtggcgtggcgcgaatcctgtccctgtcgctcgtcctggccgcggtggccacgggggcctgggagcgggggccgctgggcgtgctcttgccctggcagggctccgccgcgctgggccgctgctgtcctggccgtgacccgatgtttgtcgcccgcgggcccccgcgctgcttctgcgaccaagcgtgcggcgcggcgcggcgcgggactgctgcgcagactatacgcgggtctgcccaggtgcacccggggaaaggcaaggcactagcggaacgctcggagcggaggggagctggggcgggggatgagcggaggaagggagcccagcacctagggggctctgggcttggaggggtcacacgagccgagggcggggcgcggcgcttggggactggaagggtgcgccgcggggcagacgggacgtgcagggggtcgcgcgggcaaggagggacgcagacactcaggacctaaaggggaagcactggctgtggagctgcgagccgagaaagacgcgcaggttatgaacctgggtgcgttcatctcgggggacctgaaggagagggactcgtggagagttgaggggtgtttcggaggaggggcgcaaggactgctcacaggacttgaagggcggcaggaaggtggaggattcggcccaggtgcgggacgcaggcggtggaagggaaatgagcacaagaggcgcaggcaggaaggagagcgcctggtgcgagagaggaaggagcgcacccrgtaagcggtgtcgggggggtcgtgaagcttggagggcytcgaggggagggaggcgcttgggttgaggtagggcgccagatttcgcaaatcaaaatacagcacacccagttaaactcgaatttcagataaacaaatctttctagagaaaaatatgtcctaaatatcgcatgggatatacttatactaaaaaattatttgttgtttttctgaaattgaaatctaactcggagtcctgtattttatctgagagccccagctggggacgggcgcggggccaagagagctgcgagggaggaggggttgcaagcttctttcgggcggaggggtcacaaggcgaatggagaaggtgacaaggagcatggagaaaccaagaaaagggctaacgcttggagagcaaggatggaaagacgctcaaagcggaggcggaacggtctgagtgattccaaaactagtgtgtccaagctggttagaactcaggcaggcgggtccagaagccgaggggcctgacagatacgcaggtgaagtccatctgtggtccgcgtgctgggcgtggccaccgggctagtccaagcattcctggtaaaggctcctccagagtggtacccacagcgctctattaagggctattttagttgagtcattagtgggaaggacgctgcctatcccctccccccccgccaccccactcccttcttctagagatggagccttgctctgtcgcccaggctggagtgccgtggtgcgatcatcattcactgcagcctcgaactcctgggctcaagcgattcttctgcctcagcctcccaagtagctggatgacaggcacgcaccaccatgtctggctctctatcctttttaaatcccagaagtaaagttttcacacccactggagacaaaaaaaaatctaaattctgtcaccctgtaaaacggttatgacccaactttcctatgtcagggaggaaagtgattgattgggcccctctaccgtgtgatatcactagagcttccttcagaaatttgttttaaaagacagagagggcgcttttaaaaaaatgcataatgggtcgggcacagtggctcatgcttgtaatcccaacacttggggaggctgtgggaggatcatttgaggccaggagttcgagaccagcctgggcaatattggaagacccagtctctacaaaaaattaaaaaaaaattagcctcaaatggtgatgactgcctgtagcaccagctactcaggagactgaggtgggagaatcacttgagcccaggaggttgagcctgcagtgagctatgattatgccactgcactccagcctgggtgacagagcgagatcatgtctcaaaaataaataaataaataaataaataaataaaaatgtaagggacctaacatccattaatcacctatccctctgtgcccagaagctgggctggatgtcccctggaacctgaatacattctccctgccctctggggttcaggtatggaataacatccctgtttagcagtcaagaaaagcaaggctcagagaggagagggctttgggcagtcaagaattcccagccagtggaggagctgggtctgattctgagtcttctagctccttgctgccaggagtggccaacgttggaaattcaggcagcagtgagatgagaaagtaattttggatgtggtgtcttctcaagccataggcaaaagagaactccttccagattaaatttggggaaggactgcctgggggtgcttttgtactggttggttttctgtgtagagagttcatgcagccgcgggtctgtacwgattggagctgaagtcccaggttagcaccaccaacaggggctcccctgccacagcgcaggagtgggggcccaggatgggtccaggcaaaggcatcagtgatactttctcatggtctgaccgacacccacagaatcacacaatgttagcccctcccaagagatgtcctttctatacggagtgggggctggaggaaccaggagcctcaaagctttgctttcacctttgttttgctcttttgggatctgcctccttatctggagcagggtcttgtgaagagacgcagggaaaagttcactttccacctcccaggggagcaggcaggaggggactagttaggaggcaaaagatgtagagaagtatttgcttttttcatgggctatttttaggagataaagtcaactgccttaagtgatcaattgtaatagagggagatgttgaagatgacttaaaaaacaaacaaaatccgcaaacaacaaatctaatatttatgaaataccaaatgtcaggaaggtactattttaagtgcttgaagtaaattgtctcatttaagcctcataataacgctrtggaacagtgttatcatgtctgttttacagatgaggaactaaggcacagagaggttaagtgacgtgttctgggttgcacagctcttaaacagcagatctgggatttgcactccagcagtctgactccagatctcaatattgtatagcagctcaagggtggcagagactcaagaatgttaggagagggaagcttgagtctacaggtgtaaggagaccccttgacatcttccccatttagttcaattaaaattttctttttttttctttttctttctttccttccttctctcttttcttttctttttctctctctctttcttccttcctttctttttatttttcagggtttcactgtgtcacccaggctggagtgcagtggtgcaatcatggctcactgcaacctctgcctcccaggctcaagtgatcctcctacctcagtctcctgagtagctgggactacaggtgtgggccaccacacccagcttttttttttttttttgtattttttgtagagatggagttttaccatcttttccaggctggtctcaaactcctgggctcaagctatcctccagccttggcctcccaaagtgctggaattaccagtgtgagcytccacacccagcctcaattacaattggtggccaccttctgtgtgcccaattcagctagaagcactgggggatggaagcaaggctggagttctggtacccctcaagcttattgtctatttttgggagacaaggtagttgggaaaggaataaataatttcagtctgagcaaggtgaagcttggaaatgattggtgaggatggtgtggargcagggagagagtggggctggagtgattagtaaggccttgaaagatagacaccactgtattttccaagttatttacagaatgtttccatgtattctatacttcttaaakatcatctcaaccctgtatggttgatgtccctacatatacacttatgtgtttcctgtagacttagtactcttagggttgtgacacaatttaacttaagttaacaaggatatttattggcttaggtaactaaagaacaacccagggattccagagcttcaggcatgactggatccaggggctccaaggatgtcatcaggactctatctctttccattcttcggcttttcttgtgttaacttcatttacaggcatgctgtcaccaagtggtagcaaagctagtggtcaaagacagtagctgtaaactgccatccttaatggattgagagcatttttccccagttccagccaaaatcccagggctggttctcatgggctcagtttggattaaatggtcattgctgacccaatcaatcactgaacccagggagaaggaatatatcaactggccatgtgggggtcacctgcctcataccaggaacgagagggtgcgatcagccctgtccaaaccatgtggattgagagtggggagttttggtttctcagaagaaaactgaggtggtattcccagaagatgggggaaaggaggctgggagggtactactcagctgtgggagaccacgtgctttgggaaactttgggtaaagtgtgctgagatgttgaataggaggagggcacggtaaatgactgtggatgagttgcaggaaaatgtagatttttagccactgagcttgggggtctccatctatgatccactgtcaaaaaagatccttcgtgaaccccctcaataggagatgggaaccactgagggatttcagggaacaggccagaactgtattctagaaaatccttttggtagacaataaggagggcagatggtaaggaggctgggcagtgtggttcagaggagaaagcggggtttggataatgcagaaagacattccttggctgggcccygtggctcatgccagcattttgagaggctgaggtgggtggatcacaaggtcaggagtttgagaccagcctggccaacatagtgaaaccctgtctctactaaaaatacaaaaattagctgggtgtggtggcacgtgcctatagtcccagctactccggaggctgaggcaggaggatcgtttgaacctgggaggcggaggttgcagggagccgagatggtgccactgcactccagcctgggygacagagagagactccatcttaaaaaaaaaaaaaaaaaaaaaaaggtgttccttcatgagcctgggcctgtaagggtggggtgaagcgattctaaggggtctgtgggaaatgtggtctggccatggcaggctcagctggcacgatgtcatctgggtatccaggactcagtgagcagccttaccaccgccctacccctttctgtaaggctgggaagctagaatttcttctttggtcaggaaaagtgggctgggctttgctttgagaaacactgctatctggtgttgcctttttgcaatgtcagcctgtggttatatttcctttgttgttgctaaggcaagatttgctcactcaktgttcagtggcacatcacttcctgagttgctgtgtgccaggccctgtgcttggtgatgggatacagcagggaacatgacaaatgaggaccctattgttgtggagctgacactctaatggaggaggcagacactacgagaataaccacagatgtactgagtttgtgatcctgggcctatgcgaggggtgatgatggttccctcttgtgtgcgtgctgccagtgagacgggtagaacacgtgcagggtggtgcctgcctaattttcygcaaaatctctcacctgcctggcaggcagggcaggagatcgtggtggactttggggataccccttggtccagctgtccagccagtgcctgaatctggtctgcagtcttcctgccaggttttttagccacattgtgaacactttcagtgacacaaaactcattcttctagcagcttcttctactgtagataatcctttctctcctgggaaaccgcaggagccatcatgcttctgccctcacccccacccagagagatgggcagtcatccttttgaaacctttggtatcaccacgtcacatctctgctcagaactcggcaatggcttttcgtcatgcctagaataaaatctgaactccttacaacagtcctcaaggccctatatgctatctttgtcccctccctctctgatgtcacctcctaccacttttcctctggcttattttcctgcagcgacactggcctcctcactgtccctctgatatcctacctttaccctgcctcagcgactttgcactgcctgttttgtgcctggaatacagttcccttcctacacagttcccttcatcactttcttgggggctctgttcagatgtccttgtcttggaggacttccttgactcctgcctaaaatagtttcttgttacaccacccttggcactctttctttttttccctgcctctcyctcaaccctggccactcttgacctgctgttttttctcaaagcacagatcactagttgaaattacatggttgcatgttattgtttattgtctgtttcccccactgaatgtcagctccttgagggcagggctgtacctgttttggtcatctgtgttcccagcacccagcccagtgctctgcacacagtaggtcctaaattgttgttgaacgaatgcataaagaccattgaactgggcatttacagtatggccagtgctttgcattcgccattgcaacaaacccgagactgtggttcaaatccaggtttgtctgactctacatccttggctcaacttagggattctgcctcttaagccccagtggcctcatctctgagctgggtttgacaatagtgcaaacacattaggagttggggacctggcaagtgacagatggtacccccagaagggtataatagaaaacaagggctctattcacagaggtgggggcagcagtacaggacaggaggaaatggtgttattggagcctgtgagagtaggatcygcagccaagggcccccttccccaaaatgggggacaataaacaccttgggtgcactctcctcctgccctctgctcctctcatccccgctggtgttccccactggttcaactctactggcagccagggagaggctgggagatgcacaggcttgctgggggttgagtatggagagggagtacagagtttcaggagactgttgtgaggattaaatgaagtcatgtatgggacttgcttggtttagcatccaaagcacaatgaacggggttattagatggatgatgaaagcacttgatcagtcttaggttgccacactgggtgtctcccctccctcctccttcttgccctccctctttctgtttcctttcttctcttgtttaccttcctttctttctttttccttccttccctctgagcttttcaactctgctaagatgggcagattgaaggattgtttgctccaagaaaaaaattttaaacctctgagatttatgcaaagaatatgtgacttcctgaccttccagaggcactgctgcttgtctttggcacaataacgccattccttcatcaaggatgcacatgattttttccctcttcacattttcacgttgctgaattaggacatgtctcatagctgggagggcttttcctgaagacagacctcatctttcttgttaaacgctgtgtctccagcacccaagacagttctgggctcgctgcagatgcttggtaaatatttggggtatgagtgaattaattctgacagtggtggccgccttgcatgtgcagcaaatgtgtgtgtgtgccgctgacaaaacttgctggcacatccgtagaaagtctctcgctggggaagtgcccagattccgtttctgctagactgcctttccctgtctgatttgctctggtcctgatctgggagtgtggacttggaatgaagaagtgtcggtcccagcggggacatcattagaaataccacctgtggtagacatgtgaagcacctcaaggatgggggaacccagcacgttccttwtgtgatgatgaaatatttccgacatacaccaccaatgtagagagataatacaacaaaccctcgggaaaagctaagaaacaaaccttgacaattgccactgcagtgtctgtttccctcctgtagtcacctgctgtcccactctccccagagattgtcacaatgctgaatttgacatttaaaattcccatgcatatatgggggtatgtgtgtgtttatgtacataaacatacactgtacattcttttttttttttttgaaacagaatctcgatccgtcgcccaggctggaatgcagtggcacagtcttggctcactgcaacctctacctcccaggctcaagtgatccttctgcctcactttccctagtagctgggactacaggcgtgcaccaccatacctggctagtctttgtatttttcttttttggtagagatgggatttcaccatgttgcccaggctggtctgaaactcctgggctcaagcgatcctcctgccttggcctcccaaagtgctgggattacaggtgtgagtaatagcgcctggctacaggactttcttgtgattcacagtagttatgttctgtaaagttgccacaaagactgaattaaccaatactgaattaaccaatggcccctaggggaaatatgtacacacatatctcacttagtttatactttagatcctaaaaacaactcatcctggtcaattccattttcttcattttaccaaagagtgttaggaagtgttaagagactcgcccgaggctgcctccctaacagttgctggagttgggattcaaaccccatccaactggcccagggctggagcttcttgcactacatagacctgtccctactgtctctgtcctctggtaacatctgtatgaagctggaacaagaagacagagtggggccctgtttaacttcagcttggaacctgcacattgagttactcaaatttttcactaatcttcgcttgtctgtgagtaactataaatgtgctgcaagtattgattttagggttaaaaataatttcagcaaataagcaaagtagcaaatacagaatctgtaaatcatgaggactggctgcatatatatgtatttactatgcctgtatgaatgcctaaatactttatagtaccgttttgcagttttaaaaaactatataggccaggcgcagtggctcacgcctgtaatcccagcactttgggaggccgaggtgggcagatcacttgaggtgaggagtttgagatcagtctggctagcatggagaaacgctttctctgctaaaaatacaaaaaattagccaggcatggtggtgggtgcctgtaatcccagctyctcaggaggctgaggcaggagaatcgcttgaacctgggaggcagaggtagcagtgagccgagatcacaccactgcacttcagcctgggcaacagagctagacaccgtctcaaacaaacaaacaaacaaacaaacaaacaagactgtatataaaaagcatcacattagacatgtgaatccttttgcaagtaatttatttccccttcaggttactgacagtgtagctgtggctcattttcactgatgtagaggaatagttagtgcttattaaacacctgctatgtgctgggagcaaatgctttatatttcatatttggttgaacccttaaggccaccctatcagttagatactattcttattcccatttgacaaaagaagaaattgaagcatcagttgccctaagtgcttaggaaatgtttattgaaggaatgagtgatggagacgacctaagtgatcatcaataagatgattggataaaggtggaattctaagtttaggtgaacatatgaagagttgtcatagggaaactttcaaggaaggcatagactgaggtttgcaagagttctagcacttggtgtggtgttttgggggttcagattgtggggaaggtggagaagacctggatgctggctagctaaaccccacagaggtctcccttgcagacaccaccttctcttccagcagtctcctgcactgtggcacagtggagtggctgcagtcgctgtgtgaaacctgccaggtctcctaccatgtacaccggaggcgtgtcctgcaggagccgaggaatgggggtgtccccttcccgctgctggaagagcgggctggctgtgtggagtactggagccaccagggagtggagtgccagcagtcattgcatgagtggggatgggccccaggggtggctctcagtgggaacagtcaggctggactgcagggccctccatgagttcttgggtagggtctgagtttggaatggggctttgccttcctttgccctgatcccccttctcatcttgtgaatgagttcagaagctctgaactccactgggcttctcagtcttctttctgctcctctccctgtgtgaatcagtcaggactttgtatgcaggtgataggagacccaacttaacctgaactgagcaaaactgtgtggctcctgtaactaaaattccaggggctgcattcaggcatggctggatccaggagctcaagcaatgttgccaggaatctctctccatgtctcagctctgttttcctctcagttggcctcattctcaggcaggcttttccctgtaatggtctttgacagcttcaggcttccctctaaccagcctaacagctgaagagaaggcctctttccccatagttccagcaaatatcctaggatatttgtggtggtgmgcacacccgaagtcccagctgctcgggaagctgacgcaggaggatcacttgagcccagaagtttgaggttgtagtgaactgattgcactacaagaccctgtctctagagatcaatcaatcagtcaatcaatcaaaaggtcgttctgactgttatgtggacagcagactgagaggggtcagagggaatcagggagcctagggaagaggtggctgcaatggttcaggcaagagactatggtggttgaaccagggaggtggcagtggggtgatgaaaagtgggagtgttgcttcctctgcttgaaatccttctccctacccccagccactcccatccagccattcctgggtcatcacttcctgtaaagatgtcagtttccctgaggaagatcgggaagatcatcctgacttgctaatatgtgccaagtgcctcaccacatgacctgactctgtgaggtcagtgttactattctcttcttacagacagggaaaccgaggctcaaggaggtgacaaagcttgtccaagtcacatggctattgactagaggaccaggaccctcccattctgacctttgatatcacccacctacaatcttttcgttgtactgttttttgttgttgttgttgtttgttttttgtttttttttttttaagacaaggttttgctcttgttgcccaggctggagtgcaatggtgcaatctcagctcactgcaacctcctcctcccgggtccaagccattctcctgcctcagcctcccgagtagctgggattacaggcacccgccaccatgcctggctaattttttgtattttttgttgagacgrggtttcaccatgttggccaggctgatcccgagctcctgacctcaggtggtccacctgcctcggcctccccaagtgctgtcagaatgtagtaaggtgatatatgatgagcacctactacataagtgctcaataaacagcagctgaattattttctttgctcaccgttacagccatgaggctctgatctttatgactgatcccttgaatcttctttcaaaacatctcacctctgtatttgagggcttgtcccttcaccatagcatgagagcaacagctgcatcacagtagctaacaatgtcaagcaaattacaaagggaagaaacactcactgagtacctgccttgtgccagaccctcgaccaatgttacattacattctgacaataacaccaggatgtagatactgatattatccccattttgcagttaagaagaatgaggctcagacaggtgcagtaacttgatcaaggtcactcagctataacaaggggagttgggactaacctgggcttagctggggctctccttactgctctaggtgacaccaaaagtacaactacagctgttggaagagggaagggaggctgtgtgttagggattcctaaggaatcacgaacctcttgtgaaatgattatcaattctcttctatgttctcctctgtttgatctagaaaggaagaaacttggaagctggccaagtaaaataattttattcattcatttgtctttctatcaatccatccccctatacctcctttcttccatccttccattgttacattcactcattcatctattctcccatccatccatccatccatccatccatccatctactcgttcatctagccatttccactcatctctctgcattcttctatcttcttccattctaccttcttccattcttctatcttcccatccatccatccatccatccatccatccatccatccagctatccatccatctatctacccatccattttttattcattcacctatccatccacttgtcaactctccatccatcctttccattcatcctctcttccacccatccatctttctactcatctctctgtctctccttttcttccagcctctcatcttcccatttatctacctattatacatccattcttcctttcttccatcatttcagctatctatccatttattcatttagtcattgactttaaacattttattttcttcttttaaaattatttaattaattttttgcctttcctatggtgctgatagttattgactcttttttctttgttttttttttttgtttgtttktttttctgttttttttttktttktttgtttttttgagtctaggtcttgctgtattgcccaaggctggaggacagtgatgcaatcatggctccctgcagccttgatcttctgagctcaggtgatcctccccttttagcttcccaggtagctgagactacaggtgcacgccatcacatctggctaatttttgcaggatgaggtttcaccatgttgcctaggctggtctcaaatttttgggctctagcaatyctcctccctcggcctcccaaaatggtgggattacaggcatgagacattgctcctggctgactaactcttttatctactctattaaaaaaatcattcacttattcattcagcaaatcattcattcaaaaagaatttttgagaccacaccaggccctgaagtctcagagataactatgatcctgcttccagcactataaagggcactggtagggattatctacccagttcaaagatcctacagtctctttagggctgtcttgtaagtgacttggataccagaggtaccaagctcggtgtccctatggtgccatarcctgggatgtggtccgccctaactctgttttctccttgacccacagtccctgctttgataaccacasgcagctacgggaaagagtgggaaaagtgagatagtcccaagaaacaggcaacagcagggtaagtgaaaatcaatcaacctaaagtcaaactaaaatttgtgaacatgtttccttgaactaagtttcttttttttctttttctttttttttttctggagatggagtcttgctctrttgcccaggctggagctcagtggtgtgatctcagctcactgcaacatccgccacccrggttcaagccattcttgtgcctcagcctcctgagtagctgggattacaggcacacaccaccacgccaggctaatttttgtatttttagtagagacrgggtttcatcatgttggccagactgatctcgaactcctgacctcaggtgatctgcctgcctcagcctcccaaattgctgggattacaggcgtgagccaccgtgcccggcccaaaatttcatttatcacgtctttctcttactttggcaacatccatatctccccgtttgtcaccttgttacacctgcaagctcattaacatggattttaaagtccccaatgattggtctccattcaacttcattcattcacccattcattcaactttgattgagtgcctactatgtgacaggtactgtgctagtccttgggttatggcaaggaacaaaaaagacagaaatacttggtcctcattgagtggacagtctagtgggaggagagagacaaaaaacaaataacatgttggagcctaagtgccatggagaagataaagcagggaagggggtaggggtgccctgagaaggtgacatttgaactaagatctggaggaggagatctgggggaagagtgtgcctggaagagggaaacagcaagtgcaaaagttctggggcagggcatgcctagtgtgttcaaggatcagcaagaaggcgggtatagtttgagtgcagggagagagtaggaaatgaggttgaaaagataacaaggtaggaggtagatcctgtggggcctgtaggctgtgttgaggagttgcgcactttctctcatgaggtgggagtcatggtagggtttttagcagaggagtgacatgatctgacttaagtcttcacaggattccttgggatcctacttggacaatggatagaggagaagcaagggggtaactcgggagaccaatgaggaggcaattgcagtggtccaggcgagggaagaaggtggtttggaccagggtggtttcgtcgtaccttgtgaaggatggattgtggggactggcgacagatcagcgtgttgtgggatcgcggagctgaggtcaaatttccaggacagtgcctggctcatgataggtacycagtaaatatcagttgaaagaataaggtctgaactaagtcagtggcaatggagatggacaggagaactaaaagggttaggattcttttgattgcaagtgacagaaacttagctcagactgcgtcaagtgaaaaggtgaagtattggtttagataaccgggagggaagttctgaaataacattacttcaagcagggctggcgccaacggtgtgtgtaaggccgtcagggctggctctcgtcccctctctttctgtcactcgctccatgggttgactttattctcaagcaggctctttccctgtggtggtcaagatgggcatcttgcagagattgtggggataagcagccccacatcctcccagatcagtaaccccaaaagtgtcctcttggaagtctcagcggatcatatctggaggagaccccgattgggtctgcttggatcctgggcccatccctgaaccagtcgtcctggccaggaagatggggaactctggtcggtcaactccaatcacatacccgccttagtggcagctgtgggagccacggccaggccggctgagtgatggcccctccaagaccatagggcgagggcaagaagtttccaaacaaactgccaaaaggggaagagaaattgtatggggaagacgcaatttctagttatcacagacttctggtaggggacagattcccgaggggatatgggggcagatcagagagggaaggactggggatgggctttcggctgcacctggaagaaaaccgtgggctcctctggccaccagggggcagcagattcacacagagtcattcacgagtccttgacacgccgcgtctcctccagcagggggtgctatttactgctccttgtagaaaaagttgggtggaagtaaaatttggcaaattctgggtcttatttcagatacccttgaatgggggggctttccttttaaagaattctcattgcaaatctttttttcttctgttttttgagaccgagtctcactctgttgaccaggctggagtgcagtggcgccatctcagctcactgcaacctctgcctccggggttcaagccgttctcctgtctcagcctaccaagtagctgggactacaggcgcgagccaccacgcctggctaatttttgtatttttagtagagacagggtttcatcaagttggccactgcagtgagccaccgcgcctggccttttttttttttttccctctttttttttgaggcaaatctttttcttttctcttctttttctttctttctttttttttttttttgtggcaaatctttttaataaaataggatcttttgaaagaacgtgccgggcgcggtggctcacgcctgtaattccagcactttgggaggctgaggtgggtggatcacctgaggtcaggagttcaagaccagcctgactaacatggagaaaccccgtctctactaaaaatacaaaattagccaggcgtggtggcacatgcctgtaaatccagctactcgggaagctgaggcaggagaatcacttgagtcagggaggtggagtttgttgcggtgaaccgagattgygccattgcactccagcccgggcaacaccagcaaaactccgtctcaaacaaacaaacaaacaaacaaagaaaagaaaaaacacagtggagagcttaagagtatctatttaggcttattttcagcagagatggttccattttacatcccactgcttattaggtatgtggccttgggcgagttttctctctgatcctccgtttcctaatctgtaaactaggggaaacacctaccttgcaggggttccatattccatcggccccaatgacttatttaacattttaaaaactgagctggatataattctaggagttggacccaacagtaaacaaaacaaatgaacattcctggcattatggagccagccttctaatggggaaaacagatgagaaataaaacactcagtcttttggataaagtgcttagaatagggtctgcctggtacatggtaaaccctgaataatgttaacttgaaaagcagaagttgaatcttgttgtatgcaacctgttgaggccaattgggttgcacaaaagattcctgtatcagggagaaattgtaccaacctgggcctaagatagggctggatgtacagtaggtgcttcataaatgctcatgggtacttgaggtggtatctccctgtgtggctgcaggtactgtgtccagttccagttggggtccattccagggagctgcgggcaggcgagggcaccccatgcccagtggacaaggtatytgagtcagggccacacggtctgtgtgaggagtgaatggcctgcccaggacaccaggagccggcgctgctacggggacggtggtggggccaaagggtgagcgacaggactcgggcatgggcaggtgtggctgtagagcccagggcatctctgctgcctgagatagcaccctgggagagagatgctgctccctggccagggcgggggccagcagggtcccaatcccagggtccaaagagaccagccagttaggagccggactcctgccacttccggtggtgtaaacttgggcaaatctcatcacctctcggatcactaagtgcctcatctgaagatacagataatgagaggacttccccatcggtcaggggtgagggctaagtgagattgtgcaaggtgaggacctaggacagtttctgacatccagaaagtatccaagaaaagggagcttgcatggtcattgaaccctcacgagtcccttaaaggccagatttggttactctcattttatagatrggcaaaccaactcagagaggcagtgtgacttagtcaaggtcacacagcagggtttgacccagatttggcttacattatccctctagactgcctcccgtggggtgagggtatcttggaaagcacttcacacatactaattataatactggcttacatcgattgagcgcttcctatgagttgaggattattccaagctctttatattccttcattcattcagtgttgagcatgtgctaggyactgttctgggcactagggattctgcagtgaagaaaacagctgaggtcccttcccttatgcagacagtaaggtcccttcccttmtgctgggaggaggcagacatcgggcaaataaatctataatttgtcagatgggagatgaatgttaggagagaaagcagagtaaggatgatgtcctgggggttgttaattttttttttcttttctgggtcttgccctgttgcccaggctgaagtgcagtggtgtaatcccagctcactgcagcctcaacctcctgggctcaggtgatcctctcacctcagcctcccgagtagctgggactacaggatgcrccaccatgcttggctaacttttgtattttttgtagagacggggtttcaccatgttacctaggctggtcttgaacaccttggctcaagcgatctgcccgcctcagcctcccaaagtgctgggattatgggtgtgagccaccgtgcccagccattatttttaaaagcctgatcaaggagggtaacagaaaggaggtgatatttggacggayacccaaaggaaatgagggaggagccatgtggatctctggaggaatagctttccaggcagagggacggcgagtgcaaargccctgaggtagagcgtgcctgctgcactgaggagcaagagaggccattgggcaggagcagagtgagtgagggagagcgtagaaggaggtgaagtcacactaacacaccgtatgccaatgaaacattgcaagaatctaacatggatacttttaggatctctgctttccagatgagttgactgagatacaaagaggtgcccaaggtcacatacctagcaaatggcagaaatgagatttgaccctgaactgctcagaccyccaagccaagctctaaactctagtctagactgtttcttactgaacatgcttttccggtgcagggattatcacactgttggaatatgagctctctctggggtctgtacagggagttctaccatttccaagggtgttaatttccttcttttaaaaattaagcagccctgatcactgtaaacttagaacagggaatgccaaggccagttagggtgttagggagaaacgcatttaggcaggaggcattggattacacagatctgggttcagattccacctctggccctgattggctatgtgactctgggcaaggcctgcacgtgacccggacagtcaccaccacgtacgattgtggggagcacccacaattttgcacagcacctgaccccttgtagatacccactagtgggggctgctgtcattatctctaatctgcagaatagatataataagacgtagtttgtgaaaatgagatgtaatggatgtgatgaacctggcacatagtaggttcccagtaaatacacgtccaacaatattatcacactatagggtggcccttcctgccagcctcccttccaacctccctcccgcttacttgtcctagacctgagattccactgttagagtttcattctttgggataggcgctcactttttagagcttcagtttattcatcaatttttggaaacactttctagtcttaagactctgattaatcccaaatttctctttttggacacaaatactctgggatgtgaaacatggcactttggcaaggctgagatgtgggtcccaggggccacagtacccaccaggaatgggaagggacagaaaggagagccagggctgtgtccgagacaggcatctctccacactccccacctggggccaggctggcagagcaggtgacggaaggtctcatgggggcatgagctcaccaggaaggactggcggagcagggggatccaagagaggagaggcatgagccgtcagccgaattctttccacgggcagctgtgagagcgggcgtgccaagggcatgggcctggagagggattagcctatcagttgggaatttttggagggtttatttagcttaagaagtatccctgagtttgggtcaagcataaggaacatctgccatgagccactcacctactgcgtgctgggcacgcaccaagcaggtgcttcacacgtgtgttcacagttaggccttaggggcacttttagacaagggacatgaactccattttatataatgatgatggcaataataatagtaactttaaaatgttatcatttgtaaaacacttattatctgccacgtactgggcttacaggcttacaacggtgcctggtaccaygtgggaggcgcttaatcagtgttttttttttttttttctatttttttgatgggggtcttgctctgtcgcccaggctggagtgcagtggcacgatctcgactcactgcaacctccacctcctgggttcaagccatcctcctgcctcagcctcccaagtagctgggactacagtgcatgccaccatgccgggctaatttttgtatttttgtagcaacatggttctgccatgttgcccaggctggtctggaattcctgggctcaagcgatctgcctgccttggcttaaagtgtggggattacaggtgtgagccactgcaccaggcccagtgtttgtcattattgatattattttgcatttttacaaaagatttggattacacctacagaaaattggctttaaaatatatgaacaggttcacaaacatttgggaaggtcacacacctaggtagacactgcccaggcaaggaacagagcctggccagcccccgagacctgcacacgccccctccctcagtccctccctccccataaaggaggcctctgccctgacttctctggtgatccattgtgcgacatccttgccagctttaggaactcgatgtggagccctcaacactatagttccatttcatttcgttttgttttgtttctttccaactttgcatcagtgaaaccacgcaggatgtgctctttggaattcgactgcctttgttccacatgaggtttccaacgttcatccacgtggttgcacttgyagcattagctggttcattcttgttgctgaaatagttagctattactattattattttgagacagagtctggctctgtcgcccaggttggagtgcagtggcacggattcagttcactgcaacctccacctcccagattcaagagattcttatgcctcagcctcctgagtaactgggattacaggcaagtgccactatgcccagctaatttttgtatttttagtagaggtgaggtttcactatgttggccaggatggtcttgaactcctgacctcaagcaatctatctgcctcagcctcccaaagtgctgggattacaggcatgagccaccacgcccagtcagttagctattattatgatcatttttattttctttgcacacagcatctcagatgacctccccaccaacacctcagaggggcaaagattattgatatctccatcttccactgaggagagagaggctcctaggagccaggtcccaaacgccacctgattccagagcctgtgctcttagccactccgtggtgtggcccctcaacagaggaggaaaagggggcacagagcagttaagcaacttgcccagccttgcccagcagggacgtgatcgagccacctccccagaccctcagaactgactctggaatgcccttgtggcctctgagggtcgctggctctgtggccatccccagggtgacttacaagggcccagtscccatacacttttagggcccacaaagacattttaattttaatttcttttaaaaccagaagaaaaaaactgatgctataataataataataataataataataataataatawwawtagtggatcacaaatccagcctggattttacttgtctttatacagtgcagtcacaagctagagggagggtccctgaaagcaaacatccctggagcccaggaaagccatcattcgactgagccagccccatctcttgcaggaacaagatgtggctgtggcaagcggccagccatccccggtgccgagggacctgggagaagctagggcagctccggcattgttcctgccctgtggtccacagcctcgtcttcatctagcgtctgcaccccctaaccgtctttccaaagcctcggggatggcagggaaactgcagggcttgggatcccgcagaaccaaagagttgggagaaatctgcaattttgagactgaaggaacaagccttgtcgttatgttgacactgaaaatagctttatgcttccactcagtgccagctgagtcacggtcctactgacatctcctgcccattcagggcttcccacatttcatctcccagacacactctcctggcccttgccctattctccttattgtatacttaattttttaatgaactctctcccttcccttccctttccttccctctctctctctctttctttcttttctcttttttggatggagtttcactcttgtcacccaggttggagtacagtggggtgatcttagctcactgcaacttccacctcccagggttcaagcgattctcctgcctcagcctcctgagtagctgggattacaggcgtgcaccaccatgcctggctaatttttgtatttttagtagagatggggtttcaccatttgaccaggctggtcttgaactcctgacctcaggtgatgtgcctaactcgacctcccaaagtgctgggattaccggcatgagccaccgtgcgcagcccctccttccctcccttgtctccctcccccacttccctctcccccccttctgtctccccgttcccccctttccctatccccctcccccctccctccctccctccctcccttcctcccttccttccttccttccttccttccttccttccttccttccttccctctttcttgacagaatctccctctgtcacccaggctggagtgcagtggcacaatctctgcttgctacaacctcggcctcccaggttcaagcgattctgtcacttcagcctccctagtagctgggactacaggtgcacaccaccatgcccagctaatttttgtatttttagtagaaatggagtttcaccatgttggctaggctggtctcgaactcctgacctcaagtgatccacccatctcggcctcccaaagtactgggatgacaggtgtgagtcaccatgcccagccttcttttctttactcaaataaatttatttgaaaagaaaactacttaaatatatgtttaaagaggaaacattttatcacaattataaaataaaataaacaataatagcaaacatttattaagcacccgtaagagtgccaagcactgtctcagccttttatacatactcactcattggattctgagttagatgcaatgattatccccattttacatgtgagaaaactgaggttcagagaggtttggccactttgctggaagttgcagttagtgagtggcagagtggggattcgaactcaggagctgcacctactgcttaggttccctgcacagtatatcagcctcatgagggcaggggttttggtttctgtgtccctgggcctaaaatagtgcctgacacacaataatgctcaataaatacttgttgataaaaacaaatgaataaatgaatgatcagttgctatactaagaagacaatcaggctgggcatggtggctcacgcctatgatcccagcactttgggaggccgaggcgggtggatcacctgaggtcaggagtttgagaccagcctggctaacatggtgaaactccatctctactaaaaatacaaaaatgagccaggcatggtcgtgggcacctgtaatctcagctacttgggaggctgaggcagagaattgcttgaaacccgggagatggagttgcagtgagccgagatggcaccaccactgcgctccagcctgggtgacagcatgagactctgtctcaaaaaaaaaaaaaaaaaaaaaaaagacaatcagaaaaataaatacaatggaaaccagagaagtccactgttgcctgctcaagatgctgagcatgaagcctgttctcctgattcagacaagaaaccagccagtgtggagtgataggaagaacacactcatagccaatggagacttgctccttgacaaattagaaaaattatactggaatcttggcactttgggaggcctaggtgggaggattgcttaagcccaggagtttgagaccagcctgggcaaaatggcaaaaccccatctctaaaaaaaaaaaaaaagatacaaaaattagctgggtgtggtagtgggtgcctgtagtctcagctactcagggggttgaggtgggaggatcacctgagcctgcgaggcagaggttgcagtgagccgagatcgggccactgcactccagcctgagcaacagagggaaaccctgtctcaaaataaattaaaaaaaaaaaaaaggcttaaaaggaggctaatttttttcctttaggagtcagttgttataaacatttttaacagtgaattcacataccatgccattcacccatttaaagtgtacagttcaattcttttcagtatatagaaaaaattgtacaaccatcaccacagtccaatttagagcatttttatcctcctctgaaagaaaccctgtactcgttagcagcctctccttcctccgacccctctagccctcagcaatcactaatctttttctgtctttatggatttgcctattccggacatttcatataaatggaatcacacaatatgtggtctttcgtgactagctgctttcacttggcagaatgttttcaaggttctcccatcttgtagcctggatcagtactggagtcagttatttaatgctacatcctgggttcgggtaaaacgacctaaaatgtgagtcccccgcttcaggaagygccgctgtaatgaataaagaaccttttgggggaatcatagctcaatctcttcctggttctaagcgggcaggttcaggcttccctgcggtggggttggagcaggaggtttatctttcagctgtccttgggactgggcaggaacttgttcaaatgttactgctactctatcctccttcctaaatcaggactctggacgctcctgggaatcactgtctgttgctgctctctgggagtgtgaatgaatcactgggtgagaatgtcagtagcacctgtgtgtgctggtctggggcgagaatcctgggccaaggggcagcggaggggagaaagaagcagatggccacgaggccagcaaggggctgtccgactcrtaccccacagccagcattccctgcctctacccgtacacttgttttggctgcaggaagctgttttaggtggaaatcatttgatgtgtgtaggtgctgtcttcccaaacacaccgtgctcgacaattgccccagctctgcaggatagactttttgtagctcttggtagctacccattttttcagcctctaaatagtggtggtgcctgttttaatcctctcatggatcgtgtaaagtaggtgatcttttccccattcacagatgggaaactgagcttcaggatagtcacatgacttgtycaagttctcatgattaggaaacgttggagctgggctttgaactggactgcaaagcttgtgctcttgacgaaataggaaggcagaggctgtggtggggagcagcttggttatgggtacccagaaggcagagccgtttcttgcgtaccataaaatgggacatttaccttgggtactccctttggagtgtgttgctggaacttgtgcagggacttagggartcttctggggaagaggccagcaatgtgttggggatggagacgaggagcactcagtgttatgttttggagccttgtcctacacctgaggacctccaagtctatcagtcaaggccctttgggaaatgagtgaaagaactcaaccagctcgagcaaggataatttattgactcatgtaaagaaaatatccaggataagactgccttcaggtatggctggatccaggggtttaaaggttgaagccactgcctcactttcttttggccttgctctcctctctgttgactttgtgcttaggtaggcatcctgtggtggcactaatggctgccagcagctctaggctttcttcctccccattctgcatcacaaagctgaagacagcatctcacttccaatggtctcagtctcagctacaggtctggggttgctgcttattgaccaggctcatctcacacccctggttcatattcctgaatcaatgggtsgggggagggtgggggaatgcactgttttgattggccggtgctgggtcaggtgcatatccttggaagtggaggcatggtcagtcctacttgaaccacgtgaaccaagaaggaaaactcgggacccttgtatcagaagcaatgggaatggatgctgggaatgtttcaggccacagacatcctcctcgtgggtggcagagaagccaccattcatctctgtggctttgctgccaacttgccatgggaccttgagcaagccacttcccttctctgagcctcagtttcctcatctgaacagcgatgatctttaagggcccatacagccctgaacttttgaggccaacagggtttgtctagccaacagcctggcatcctagcttgacaggtccaagctaaggcttaggaatgcatggccttcagaaaccctggggtcgaacctggggctgggcgcctggcctcttgttcttgcccatcctggcagggtacagcctgtgatgtgggagggaagggttctgaggaggtttctttgcacatccccagcattctccgtctataattggctccaaatgaaatgatctcatccctgaacactgaggaagaaagggtgggggtgaagctgctcgctggcagcatctgacatagtttatgactaacccgcttccctcccgaggcagggagagacggtccgctctctcgaagacaatgtacaattttgaaaaaaaaaataaaaaagtcttggtaaatagattgasgaggctccagcctcctgggcttttgggaggcccaaggcatttttcccctctgcccaaaccaggtatcttttgcccattgctcacaagtcaacgtgacccrtgctattaccattccccaaacttttcacgtcaaaccctggccgggaaggtggtcaatgtagccagtccatcaagcgatttgtcccatatggattctcaattgagttttgtggccggctggagcttgtttaaatgcccatacattaattttgaaagatgagctcctaatcaacttttaaaaagcttgtcacagcaccatctgtttggcgtttgtcactattgcattacataagaggaaagacatttttaaagaatgcggctacatttagtaattggatcgccggagagaagccaaaccggggcggatggcaccgtgattcagaaatgccacgggcccttctccggggtgtggcggcctccccaaattccacgcggtcttggcagagacctgagtgcagcccagcttgggagacaggcttggggtggcttcttttcctcttgccttggtcttcctcttattttttccatttgttctccctcaccccttgctaccccagtattagcagtgaccaagtggctttacttccctgagtcccaatttcctcatctggaaaatgggattcacaagagcaccatcttgtgaggtttaaatgcattaatgcctacggtgcctggcacgtggtgagtgctttataaagtgttgctattttataaagctatgtctgatgcatagtaggtgccaacacatgttcattttccttccttttycccttccctttatttatttatttatttagagacagggtcttgctctgttgcctaggctggagcacagtggtgcaatctcagctcactgcggccttcacctcccaggttcaagcaattctcccacttcagctccctgagtagctggaactacaggcatgcaccaccacacctgactaattttttgtattttttttggtagagacggggtttcaccatgttggccaggctggtctggaactcctgacctcaagtgatccatcagccttggcttcccaaagtgctgggattacaggcgtgggccaccgtgcccggccccttccttccatttaattcaacaagttcttaggaagtgcccacgtttgaggcagagctggcatcatgcacatgcacagccatttgcacagggccccacactcacaagaatgctgagcttggtttagcgttctgctgtcgctggcttgacattcttaatttttgaacaaggggccctgcattttcattttgtactggaccccacaaattatgcagcyggtctcatctggaggtctagaatgatgctatgtcttatttgaccgtctgatatttaaaataacaatagagtcaacgttttaaaatcaggagagttcacacaacagtctggcttattttagaaaattagaacatcttgccactgtgagtctgcattcccacacactgccacatgggctggagctggagtcctctatacaggccacatccgccactgtccccaccactcctggaggctttggactgagtctctttgctcatttatagagcttccagcatggtagctgggatcatgggctttgcagccaggtatgtgttcagcttttctgttaatcatcacagtaacctctctcttagggtagtaaggattaaactagttaatataggcaaagcatctggaatatgttgcactgttattgctactgttctgctttatcctggtgcagaagctcagacccccagtctgagggctgcccctccgggagctggaagctgcgcctgtggcagctggctatgaaagcgtctctttctgctgtcccacacagcagccgttgtcaatgtccactttctctccctccacctgcagcaccagagttcacaccttgggcccgccctcctagcattattttgagaaaagggccttctgtcctgtaaataggctgagtcatccctgcctcagggcctttgcacacgctgcacttgcttcctagaatacttcttttcccatcgctttgcttggccatcttctccttttggtctagctcaaatggtacttcctcagggaggcttttcctgatcgcctaagaaaagtagccctgttttctttcccctgtcatacacattcgcctatattattttcttcccagaactggtttgttgtgtatctyccagaggaccaggtctgccttggtcactgtgatatccctagcacttaggccattgcctggcacatggtagatgtttgataattatttattgaatgaatgaaggaaggaagaaaagaattcatcaactcctcatgaccaccctgtaaagcagggacaagagacctgagtcatggagaagagaagggactcctcaaggtygcacagcccagaaggggcagaaagggtgatgaggacctaggttttctgcttctacaccccctgtcccctcaaccccccaggtgggaagcagcagagacatttggatctttggctcgaccagccaccaagaacgggtcaagtgtgcagcaaggcccagagcacagcgtctgagrgtggtgagagcgattcacccaggcagccaggaggcgagactgtttacaggggctagcggctgtcgccatgacaaccggacagcctacagcttcctgcgtcaccagggacgcaggtttgctcttggctgggaagcagtggggacaatggagtgggggctgggaaatggggggaccctaaacactcagtcttggggggaggcagttctcatttctggttttttttttttttttgagatggagtctcgctctgtcgcccaagctggagtgcagtggtgcgatctcgactcactgcaacctctgcctcccgggttcaagtgattctcctgcctcagcctcctgagtagctgggattacaggcgtgtgctaccatgcccggctaatttttgtagttgtagtagagatggggtttcaccatgttgcccaggctggtctggaactcttgacctcaagtgatctgactaactcagcctcccaaagtgctgggattacaggtattagccaccatgcccggctgggagttctcatttctgagagttgcttgaaggctgggagggcctggtgatgctacctaagtgtgtgtgtgtgtgtgtgtgtgtgtgtgtgtgtgtgtgtgtgtgtagtgtctgggctgtgtggagccaagctgcctgggtctgaatctcagctttgcctcttctgtgccgtggcattttgggcaagtgagttaatctctcggtgccttagttccctctaatgtaaaataaggtggacagtagtacctcataggactgttatgaggattaaatgagataatagtctcacggcacttacaatgcaccttgcattgtgccttaattcttgacatcaatctacatctgactctaggttgtcttcttgctggggtagtgggaaatttggtctcaatcatcctcagggatccctacttccctggcttttgtcattcattcaacaaatacttattgagcacctactgcatgccacgtattgttctagaggctgagaccacagcagtgaacaaagcaaacaaaaatccctggcagagtagagctaacattctagtagggatagatagacattaaatatgacaaaaaggaaaatagatattatatcagatgacaataagaagaaaaagaaagcagggctggaggattccaactgcaggggagctgttgcaattttagaaaaattgatgcatggggatgtgagtgtgtcagggaaggcctcactgagagagtaacctttgagtacaacttgaagaaggtaaaagagggagtcacaggttatttgcaagagcattccaggcagagggaacagtaagcgcaaaggccctgaggcaggagcatgagcatgtatgtgactgtatcatgtagtcatatctcttggcaagtctgtgtgtgtgatgttatgtggcacacattggtggcatataggtggttatgcctgtccacatgggtggcaatgcacatacatgtttgttcatgtacagagctgctgtgttcagtcacagaggctgtgcctgaacaattcagggagtgacattcacactgattgccatgaaatgggaccccctggtgtagtgcagcgcagtggccccgagcatatatataaggaaatcaatgtaaaatgtctgtgaaaatgttcacacgtgtatgtgtccggatatttaaatataacgatatgcaaatatgtatatatgaatgtctttaagatgttgatatttcattcctcatggacttttgcttcagtattgatttttaaaaaatattgcattaagatattatttctcttgattactcagtttttgggtgcatcttacatttgcatcagaggcaagtgcctcactctcttaatgctggtcctcgccctgccttggagttgggcaatgaatgtgcgggaggcagggatgaggcaagggaagcctctccttctggctccttccagcatctgggctcatcagcacatgactagaatccaaacctaatctgaacacattttgttcctttaaaacaagatttattgagtgctgactgtgcgccagggactctgcatacattattttattttatccttaccaccatctctgggggtagatatttgctcattccattgaacagacatttgcttagggcctactatgtgccaagagtataagctggcatttgtgctggtctggcagccactcctgatttttctggtaaaagcaccccagttttcctttagggaacctagcctcttccctttactgtccaagtggtttcacctgggctttctgtacccctccctcagactccaggggtgggggtgtgatccaggcgacccaatcagcatactccatcccttttgctccagagattagttataggacgagtatctaacccaagttggttcaatcagagtgaatcctgggatttttgctgccctgttgggaaaaagagctctcttttcatcaggatttctagctgtgagaattctgtaaccctggaattcccagtgagagtctactacatggagagagagagagagaggaaaaactcatcccttatgacatctttaaagcccctggatccagccacacctgaagtcagttaccctaagatttttcaattctgtgagtttatacttgtttttctttttaaaagccagtttgagagggaagctgaaatcctgtgcttggcatctttgtacattatctcctttaattcagagatgaatcccatggggaaggggctctgattgtacaagaactgatcctcagggagggaggtgacttatccaaggtcacagcaggttggtagttggagcttgaattcaagcccaggtctctactcctgagccgttctgccattccacatggtctgacctctggacaagagggtttgtgtgagtattagtgacatagacccgagtcctgttatggccactgttttgctctgtgaccttgatcaagtcatttctctaatatgagcctcagtttcccatctggaaaaatggtagtgcttaccccatcatgctgtcgtgagatgatccatgaaagtaaagtactcagaacagggctagacatgcagcaatgaacataaactattattaccatggctctctttttttttttttagaaaatttttttttaaatttcataggtttttggggagtaggtggtatttggttacatctttagtggtgatttgtgaaatgttggtgcacccatcacccgagtggtatacacttcaccagagcagtatacactgaacccaatttatagctttccatccctcacccacttcccaccttgccccgcaagttcccaaagttcattgtatcattcttatgcctttgcatcctcatagcttagctcccacttatgagtgagaacataatgttggttttccattcctaccatggctccctctttgagggaagaaaggggacccagggggctccccggccaccctgctcccatcctccctgatggccacaggctcccagcagcccttgatggcaccttcatccatcttctgccagacacacagaactggctcgcttacccgggaagcaggcacttaaggaggcgcttccccgctttctcttttaattttcgttacataaatttcacatttcctggaatagagagcttgaatgtctggactcatttggaaatcgagtcagcaaagggcctcatttatattaatggggactcgagcctgacttgagacgtggcagagacaaggatggatggcagcagctcctaggcccagccatccaggctgagctcagacactgccttgagaagcagatgcctccagatttaggctgggactgttctcgttgtgtggggagctcctggatgcaagggcggtgttgtcacccctcccccactgaaacttcccaatggctgctcactctctcagagggaactccagtctgcttatcctgcttgacaaggggctgcgtgatggacccctgctaacctccctgctcctgcccaccactctcctccctcatccttcttcagtctggctggcctcctgagagcattcctgcctcagggcctttgcacttgccgtgctctctgcctgaaaggttgttctcctagctcatcccgtggctagctccttccatggcttgtctcacagacagcacctcagggaggccttccttgattgcccatctggagaaacactctccagttactctgtatcacacccatttcattttctccatcacactgagcaatagtttgtattttcttgtttacttatttgcctatttatttattggctgtctttcccatgagagtataaaccccattagagcacagactacgtgtctccttcagctttgtccccctaggatctggctcagagagacagatttcttaagcaccttaataaatatttgtggaatgaatgcctgcactcattcagcaaaccctttctgagtgccttcctggtgccaggctctattctgggtgctgggaacacagctaagaaaaagacaagaggcagggcacggtggctcacgcctgtaatcscagcaatttgggaggccaaggcgggtggatcacttgaggtcaggagtttgagaccagcctggccaacatggtgaaaccctgtctctactaaggatgsaaaaattagccaggtgtggtggcatgtgcctgtaatcccagctactgaggaggctgaggcacaagaattgcttgaacctgggaggtgaaggttacagtgagccgagatcgtgccactgcactccagcctaggcaacacagtgagactctgtctcaattaaaaaaaaaacaaaaacaagacaagattgttggctgcatggaactcgtggtctggcgcagagaggaaaacaccatagtaacgaacatttattgagtgtgacaaggattttacaaagagacatcacatttaatcctaactacagcccttggaactattatttgtaccagttcatgaggcacagagaggtgaaatagcttgctcaaggccatacagttagaaaacagaggagccaagattgtggccaggccatccggctccccactctgctggtttaacaagctcactgaagccactgggagttaaagccttgtgctgtgaaacctgtgatgggggaggctctgaaggctgtgggagcccagaaaaagcacctgacctattaggctggtgcaaaagtaattgtggttcttgccattgaaagtgatggcaagaactgcaattgcttttcacaacctaatagcttttgataggagaaaagatgagcaaagcctcctgaaagatgcagtaccttagttgtgtctagaatgtatttatttttaactttacattatagcttaagaacttttaatatctccatgctgtccacagttaaaattttaagtaatgcatattattccagtgagaggcagcaccatccatcactgttggggagtttcatgcttgcaattttgaggttctctttaatgctttgaggaccaacaccctggacttactggagtaatgtagcgctcaggtttcggctcctccctttacttggctctgaggattctacatgcctggaacaaggcacatctccaaagtcactaacgtggctagataatggataactagaagtgcctgccccctccaccatccttgtcttgatgccaggtgagatccaggctcctctgccccaagaagggctgagcttacattatctccagctcagcaggtccttggaaattaggttgttttaaggaaataaagaaatgtgatatttcaacaagacactaggracagcggttgcctctgcagagggaaactgggtggccaaagratggggtaagagggaaattttcgggccaggcgctgtggctcacacctgtaatcccagcactttgggaggctgaggygagtggatcccttgaactgagtccaggaattcgagaccagcctggacaacatggccaaaccctgtctctacaaaaaagcccttcaaaattagctgggtctggtggtgcatgcctgtagtcccagctacctaggaggctgagcttggaggatcacctaagcctgagaatttgaggctccaatgagctgtagttgcaccactgcactccagcctgggtgacagagaccctgtctcaaagaaaaaaaaaaaaaggagattttctttgcagatccttttatatctttcccattgggcaccacgtgaaattattaccgagtttaaaaaaaactttttttwaaaaaatgtagaagttaatgtattatttctgcatatcggtctgtggactaagctttatacgatgcattcattctctttatttacctcaaatgtgggaagtagctattattgcctcttcctgacaacaacaaaaaaagcctgaggactggagatgggctgtgccttgcccaaggtcacatggtgaattagtgccagaactgagactccactgggtgcagtggcccacgcctataatctcagtactttgagaggctgaggcaggtagatcgcttgagcccaggagtttgagaccagcctgggcaacatggtgagaccctgtttctactaaaataaaaaatacaacagttagctaggcatggtggtgtgcaatgtagtcccagctacttgggaagctgaggcaggagaatcacatgaacctgggtgatggaggttgcagtgagccgagatcgagccactgcactccagcctgggtgacacagcgagactctatcacaaacaaacaaacaaacaaacaaagaattgagactctactccaggccttctaacctgtccagggggtctccacttctccaggtacctcttcctttactggcggaagccatgccgaggtgtggacagaggggtggtgatacctctgtagttatcacctacagtagggtggtcacacgtcacactggtgttacacaatctgggctcaaatcctggggctgtccctggcctgctgcatgaccttaggtaaatcacaaaacctcttgggccttggctctgtgatagctgggctccaagatggctccaatgactctcaccttccagcgctcactcttttgtgtggccctctttggcagtgaatagggctgacctgtgggaccaacagggtattttggaagtgacagtgtgtgtgacttccacagctagataataaaggatattctaacaatggaatattattcagctcctgggctcaagctatcctcccacctcagccttccaagtagctgggactccgggcgtgtaccaccatgcctgtctagttttatttttatttttgtagagacagggtctcactatgttgcccaggttggtctcaaactcctggcctcaagtgatcctcctgcctcagcctcccaaagtgctgggattacaggcatgagccactgtgcctggcgccggctgatgtctgtcttgactgcaacttcacaagagagtctgtacaggaaccgtccagctaagccactctcaaatacctgagccacagaaactgtgtgaaatgtaagtgacgattgttgttttaagctgctaagtgttgggataatttgttacacagcaataggtaatgaatacagtttttcatctgtaaactaaatattgtggtaatttcacagtgtcattgatgataataatttcatgatgactcctttgatgatgacttcataggttgtatttcatacggttgttgctaagaaattagcaaatgctaattagtgcttggagcagtgtctggcacccagtagattctgagtaaatgttaactggtttgattatatgttctttgttatttctggcactgtgagatgctgagcctgaacaatagattccccgccccccttttttttctgagacagagtcttgctyttgtcacccaggctggagtgcaatggcacaaactcggctcactgcaacctccgcctcccgggttcaagtgattctcctgcctcagcctcccaagtagctgggattacatgcatgtgccaccatgcctggctaatttttgtattattagtagagacgggtttcaccatgttggccagtctggtctcgaactcctgacctcaggtgatccacccacctcggcctcccaaagtgctgggattacaggtgtgagccacagcacctggcatagatacccattaaggaacatagctaggccccaggctgcagtgggataatagagatggttaggatgagagctaccgctattgaacactcactcaatgcctgttcataagcacttcatatccttccatcgaagcctcagcagcagccctttgaggtagatgctattatttccccatttgacagactagaaaatcaaggtgcagagagagacaatgactggccctaaatcacacaccgaagaagtggggtagccaggatctgaactcagatgtttcagaccccaaagtttctattctgaaccactaggctgagctgcagcttggctccccatcccccacgcccacccctgacacaaagcttatcttttccctttaccaatttcctgcttattagtacagagttaattgcccacacatctgagtgcaatcattagttcattcacctcctatctgcagaatgtcaaactcctttgcactcgggagactggagagtagattcctttagaagtttgttcttgtgattcacgttccctctcccaggctatccccttcaatagctaggattgggaataagaatgcacacatgtacagaaaagcacagaaacatctgccctgccttagttccctacagggtctcatcagaggtggtttcattagccccaaccctttgcagcctggcaccttcagacatgccaccagctggctctcctaatatttgctgtggggccatgtgatcatcaggagggataggtcctcaaacaggcgatgagctcaggacatgggcattgccacacctgttcctctccccaaggaggggggaaagctgtgcagtcacagacaacgtggccttttataagcttgaatgtgatgtgcatacttgtgcatgggcaggagagcagacagggaccaagccaaggctgacagggatcagagggaaggacaggggtgtttgcgggtgcctgcaatgtggcagtggctgagctgggcctgtgtgcctgtacaccattgtgtttcagatatttttgactgtcaagttgcaggaagaagtatattttgcagcatgacctgtaacacacacacatgcacacacaattgacatgaaagtttcatgaatctgtacttaccttttatgagcaatscatgctgactttgattcgattctagtttattctactccagtctattttattctttcattacaaaattgctagtcatgacccatgaaatatgtcaaaacccccaaatgcaggagttcataatctgggtctacaaacttgtatagaacaaaacgatataattttattttcactgacctctagttgaaatacagcacttcctttaggtatgaatataggcaacaaatcatagtaatatgtttcatagtaattatgtttcacacacakaaaaatcacaggctgggagtggtggcatgcacctgcagtcccagctactcaggaggctgaggtgggaggatcgtttgagcccaggagttcaaggctgcagtgaactatgatcacgccattgcacttcagctggagcgacagagtaagatcttgtctctagaagaaaaatcacagattgttttgtatctcgttatgtttgttgcagatgtctcaaaataacatttatgatcttcactacctcaaaattgtggtcgttactaattgctggaactttttatttatttgagacagggtctcgctgtgtcatccaggctggagttcagtggctcagtcatagctcattggagccttgaattcctggcctcaagtgatcctcctgcctcagcctcccaaagtgctaggattacaggtgtgagcaccaggcctggcccgatcttgttatttaatttgttaataaagaagcacttgtattactacatcacacatctaaaatattttgaaaattgcatttcagtaggtttcctttgtaaacctatgtatttggctaagtgcagtggctcacacccataatcccagcacttgggaggccgaggcaggaaaattgcttgaggccaggagttcggagagcagcttgggcaacatagtgagaccctgtttctacaaaattgataagagaccccgtcttttaaaaaataactgggtgtggtggcaagcccctgtagtccctgctacctgggaggctgaggtgggaggatcacttgaccagaaagactgagactgcagtgagccgtgatcatgccactgcattcctgcctaggtgacagagtgagaccctgtctctttaaaaaaaaaaaaagaaaaaaaaaggagcgtgaggaaaaaaaacccttatgtattggcatttaaatattattctgagtctgagaagggggtctgtgggtttcactggatttgtgagagggtccatggcacacagagtttgagagctgctgccccagtgrgtcctgatacacagttcatgaaacgctaccccatgctgaaagctcttggggggcagagctccggagtcttgaacctcgagcccagcatggaaatcacatcggtggccaatgtttccatagcacatatggtgccagcctctgtacgaggcccttcacatggattatttcttttaatctttacaccaactcttgtgtgaggggtactattcttagccccatgtctctgtctctttaccctacttcatttttcttcttagcaccagaagtgtcatatatttttatctgtttattggcagcctcccccactgggatgtgtgtctcttgaaggcaggaatttgctttgctgagtgcttcatctccaaaatatcaaaatatgcaagacttaagggggtaccaaaaactcaggaatcatgccatgtcacatatcatgttcacacacacacccacaacctcagaaatcgaaataaggaacattttactgcctttttttttctgggacagggtctcgatctgtcacccatgctgaagtgcagtggtgtgatcatggctcactgcagccttgaactcctaggctcaaaagatcctcttgcctcagcctcccaagtagctgagactacaggcacacgccaccacacctggctaatttttttttttgagacaacagtctcactctttcaccaggctggagtacagtggcgcgatctcagctcactgcaacctctgcctcctgggttcaagcgattctcctgcctcagcctcccgagtagctgggactacaggcgtgcaccactacgtccagctaatttttgtgtttttagtagagatggggtttcaccatgttggtcaggatggccgcaatctcttgacctcgtgatctgcccacctcggcctcccaaagtgctggaattacaggcgtgagacactgcgcccagcctaatttttgtatttcttatagagatgggatttcaccacgttgcccaggctggtcttggcaactcctgggctcaagtgatccccttgctttggcctccaaagtgttgggattataggcatgagccactgtaccctgtctgtaatatttaaaaaaataaaaaataatgccccaaacccataaacaaaatatcaacatttcaagtaaagataggatccaacctcctgcatgtgtacattactgcctggatctccttatcctgttactggtcctgaggggcttaaaacctaacggttgctaaagtgaattagtctcattttgcagatggggacattgaagcaaggatgctaaagaccccctcggtgccaatagccagtaagtggagcagttaggattttgaactcaggcaattgagttccagccccatctttcttaaaccctgcacagccagcctcatgaattatcatgcttgatctttttggtagaggcagtaaactggtaaaatcagataggtttgagttaaaaccccagttttggctgggtgcagtggctcacgcctgtaatcccagcactttgggaggccaaggtgggcagatcacttgaggtcaggagtttgagattagcctggccaacatggcgaaatcccatctctactaaaagtacaaaaattagctgggcatgatggcgcatgcctgtaatcccagctactgaggcaggagaattgcttgaatccgggaggcggagattgcagtgagccgagatcacaccactgcactccagcttgggcaacagagcgggactctgtctcaaaaaaaaaaaaaaaaaaaaattcaattttgccccttcctagctgggtgatcttgggccagtcatctcaatgctctgtacacagattaaagagggcagaggggactggaaggggatcagaatgtggctacttcattaggtgggtccactgtgggtgtgtctgagaaagagtggggagaccgggatgttagagcaggcacccttgggtgagagctgtgggagatgaaatagagaagcatgcaggagccagtggatgtaagtatttgcagaccaagccagggactttggactttatttaacacgtaacagaaagcctttggaaggttttgatggcaaagtgacatgatcagactgacagcttgacaggacccctctggccattatgttgagaagaacctgaaagatcaagggcagaaatagggaagctggtctggacgtggtacaatatgaaggcaataaacaatggtggcctggccccaagctgcagcagtggaggagcaagaaatgcagatcccagatctattttgaaggcagagcccagaggaacggctgacaagccattcatttcagcactgtttgttatagcaaaagttgaaagcaacttgaacgttcaggagtaggagactggcaattaccatgtataatagaacacaacataggcttatgaaagaatgaggaggctcttcgtgtattaatacagaatgatttccaagatacattaaatgaaaaaagcaagatgcagagcagtgtatatggcactcttactatttgtatggggtaaaataaaacaaagcaaaacaaaacaacacacgcacgctacacatcggttatatgtatgtgtgtgtgtgtgtgtgtgtgtgtgtgcaaaaatgatctctggaaggatacgtgagaaactggcggcctctagggacagggggacaggggtccaggggtataagggaaatttcacttttcattgcatcttttggatttgagattttgtgcctcttctcaactggaggtgatgtcccccaggggacatctagcaatttctggagacatttttggttgttgcaactggggggaggtattactggcatctggtgagtagaggtcagagatgttgctaaacaccctgcagtgcccagggcagaccccacaacagagcaagagctggccctaaatgtcagtagtgctgaatttgagaaggtttgatctattaaaaaacataataaggctgggtgtgttggctcatgcctgtaatcccagcactttgggagagcaaggcgggtggatcacctgaggccgggagtttgagaccagcctggccaacatggtgaaaccccctctctaccaaaaatacaaaaattagccaggtgtggtggcgggtgcttgtaatcccagctacaggaggcaggagaattgcttgaacctgggagacagagattgcagtgagccgagaccgtgccactgcactccagcctgggcgacagagcaaaactcagtctcaagaaagaaagaagaaagaaagaaagagagagagagagcaagagagagagagagagaaagagagagagagagaaagagagaaagaaagaaagaatagaagttttttttttttcaggatggtctttattctgaggttgtatattttatgggtttgatatatcctttgttttactaagataatatatagtacatgatagtcattttttccacatctttacttggcaaaataaaatgtcagcaagccttatacacttctctaagctgaataaaaaattatccgggcatggtggtaggtacttgtagtcccagctacttggaaggctgaggcaaaagggtggcttgtgtccaggatttcgaggctgcagtgagctaagactgcaccactgttccccagcctgggtgtcagagtgagaccacatctctagacaaataagaataawttttttttttttactgggctatgaaatcctaaagtctggaaactacccttttcactcaatgggcttttgaaaggtaatgattttaaaatatgtccacaaaatatttgatcctttttccccaagaggtagaattacctctctctaagtgtgaaccagatttggtgactcactgctaacaaatagaatttggtgcgagtgatggtttctgatttctgagactaggccacaagaygcattgtgcctttctccttacccctctctcttggaccactgcccctgggggatgccagcttccatgctgtgaggatattcaagagccctatggagaagtccacatggtgagcaactgaggcctcctgccaacagccagtaaggaactgaggcctcctcagccaacttagaggcaggtcttccatcccagtcaagcagaggactgcagctggtgtcttgattgcaaccttgtgagagacccctagccagaaccactcagctaaagatgctcctgaattcctgacccacaaaaaccatgagataataaatggttcaacttgctagagtttggggggtaatttgttacacagcagtagataaatacagaaggctgggcacagtggctcatgcctgtaatctctgtactttgagaggctgaggtgggtgtatcacttgaggccaggagttcaagaccagcctggccaacatggcaaaaccctgtctctattaaaaaatacaaaaaattagccaggtgtggtggcacatgcctgtaatcctagctactctggaggctgagtcacgagaattgcttgaactcggcaggtggaggctgcagcgagcagagattgtgccactgcactccatcctgggcaacagagtgagactatgtttcaaaaacaacaacaaaaaacctcccaaaaacaaatatagaaatctttgagccctatcagtaaggcagagatcacagaaaggtagcctatgggctctggtctgcctacagatatatttcctttggccagtacaggactacaaaaaatggaattaatcactaatgtttatttatttttattttttatttattttatcttttagcagagacaggatttcatcatgctggccaggttggtctcgaactccgccttggcctcccaaagtcctgggatttcagttgtgagccacatgcccagccatagttgctaacatttaaaagttgggtatttcctttaaaaatccagatttctgacttctcttagaaagatctaatattgctgggcccacatccctatggggtaacaaccagctggagatgaatggtgttcacccctttagacagggtgtgtgttctgttttttatcacactcaccaccacccccttaagtctcttagttaagttgctttactcatttatgttacctgctctgccccagtagtcatttgagcttatgccttctattgtgagacagtttttaatgagatgcccaggcatagttgacatgagaactaaatgaccagagttggaactttgattcatgaatatcatgtaggatgggttaccactgggttgcatagtgggggtgaaaagccagttatattttcatgtcctccctcttctggggggaagagagaaagctgatgccgcctggagacaggattcctgattcaagtccccttacagcgcttcccatctcgcctccctgtgccctccaaaaaataaactcctccaggcttgttttttccataccttttattgaactctgcagacttcattaagggaccatttgcttagaaattcttaaacatttggacatattttacaagacaagacagcagctggaggtcacacaaagatcacaatttcatctcaccacatgcataaaaagacactgggatttgtgtgtgtgtgtgtgtgtgtgtgtgygcgtgtgtgttgcgcacatgcgcaatgcttattttcacctttacaggaaggactagagacattaactgacgagagatgaataggacccacgaatgcacccccgagaaaagagtggctgaggacattggtcatttatggctaatgtgattggcttggcccctgtcaagggtgaggtgatcagaatggctttactggcagaaaagccccaacctcacacgacgggttcctgggagagacagggtcttagctgatgggatctgggggcatactatcatgacggctttggggctcagaaaaaaagatcttcggctctaaaagctggagggcaggctggccttaatatccagctggactcccatggctcagggaaygcaatccagtttccagatgttggctcctatgtttctgccccaggaagtcccagaccaaaggaagtcccaacttcgaacccttggcttagtccattggaaaaccacttggtggtcccccccatgggtcgtgtgtgagctaaaatagaacatgaggctgagaaatgcagggtaggggaagaggaaggagggcagagctgctctgtgggcccccaggaagtgtggctctgagagrgctgtggcccttatcagcttggggcctacaagcatcaaattgagatgtcatcttgagtcaaagaaagatgaccttgatggggcagttatgggtttcagtgggagaggggctcctcatttttcttctcttcacagttaggtagggattcattaactcccccattcactcacacattcacgcatccagtcatccactcagaggccaaccagtcacacattcactcactcacaaaaacacaggttggatgaccatcatgtgccagcggcataggttggggataaccctgagttcctggtgcagaaaataagattctcagtttttgaccttggattgagaaggacctatgaaatcaagatagacctggagaatcctccctgtccccacccactcaggcacactcagctcaaccaagagggaggcccaaaccccagtgaagcccaaggggcagagccaagctgtggatatgtcagagtttcttgggcatcttctctgctgcctgcctctttccaatcttggttcagatcagggaagcaggaagtatgggaagatccctgcatggccccttgagggcatcctaatgggacggaattgggagtttcttatattttcatgaaatatcctatttttgtctccttgtgttgttgcaacttgagtgattctgcagggcagagcctccagtgaggagttgggaggaatcttgaaaactggtttttattttattttggtttcagaggaaggcggctgctcattctacccatccaaacatatcatcctgcccaacctcatactaaaacaaccaaagacaaaccagtcttcggttcaccctgaggttgaagtctcactttctcccaatccaccatacataaaccctctcttgtcaaatgctttccttagagaatgcagtatgcaggatgatttgrgatggaggccacagctgcaggagagtggcattctgcttggaggcagccaagagcctggttttgctgtgaaactggattaaaagctgcctttctcttttgacccttctggatttttttcattgacggggactttcaaaggtcttgagtggggtctcttatttgatttaccaaaaaaacaagcccttttggaatggagccatttgctattgcctgggaagttgttcattgtggggatggctagtggggaacagatatcattgcatcttttatacagaaagccccaggctcatgagggcacaggagctgggcggaggggctgaagcaccataagacagccagccagggatgggggacagcgtggattgctccttggctggcctggggaagggtagcatgagtctcatcccaatgtggtgcctggtaggccactggggatgggttggattggtgactgacagtcattaaaatgttccaagacggagccggaaggaagcagacttgtctcttggacaccccctctgagagctccaaagcccagaagttgcattcctgctaattgtgctgcatgcctttgcctcagtggcttgagcttatatccagagtgttgaaaccacctacacacacacacacacacacacacacacacacacacacacacactccaagaaacaaagaggaatttctgtggttgttcagcccagtttccatgcaatgctagggcccctctgcaatgcccattttttacaccatctagccagcctctctttaaacacctgtgatataagggagctcactgtccaccatggcattgagctccatggtcagacaacccagcctgttaggagggcttccttaatttgagctgcaattgaccccatccctttcatacaatagaaattttcggagaacttgcatacagccagctggcagctaagtttttttcttcaggtgcactgccccactccaccccatcctggccagcctttaggagatcttttcaggatctttggagggaggaacagagaattaggtttataagtgaagatgagggttccctcgattaacagagccctacccaaattcaagttggcatttggggtagttcaggagaaattctaggttaagataaaatcagggagagtggatggaaatgcaaactatataacctctttcttgatgaaaacagcaacagccataggcaacagtgtttgcttatctgggcatcaaacccaggaaactactggcagacttttttttgttttgtttttttgcttttgtgcagaggaaaaaaaaatcttgtctgttttatttgactctggttcaaaccagactatcagaggttttcggggtgggagaactctgatcagggtcatagtccagaataataaaattcatatttgagttggcttcctcttgggagttatctgatgggatggctcactgccatctgagggtcccagtttggctcaaatttctgattctaggcagagccccaagccctgcagctgacagtgaggtgggtggtataccaaaacctaaacgaatgcaagttggagattatctgggctttcttcatcttcctgcatgagttgacggatggagaatcactttctgctgaagatcctgcctagtgagatgtcctccgcccacccaggactgaaaactgcctctggaattaattatcaggacagtccaaaaactcccccaggcgtggataggtggaagctggaaaactgcccctgtccttgccacacacctcctgctctatggagccaggcagctggcaagggaaggggagatgagctagcagattcggggacatctcttctcagggtttggctgcaagggtgtctggccactgttttttggtgaagctgttagaaatggattgaaatggactgggtgcagtggtggctcacacctgtaatcctagcactgggaggccgaggcaggcagatcacctgaggtcaggagttcaagaccagcctggccaacatggagaaactctgcctctactaaaaatacaaaaattagctgggcgtgatggtgcgctcttgtaatcccagttactcaggaggctgagacatgagaatcacttgaacctgggtggaggaggttgcagtgagccgagattgcgccattgcactgcagcctgggcaacagagcaagactttgtctcaaaataataataacaaaaaaataaataaataaacagatcgaaacaaggaactgataaacaagttggtgagatcggaggcccagcatgttcttgtgaggttcacgagaacctgaaaaacctctgaccttcagctctgattgatgttacaggccgacagggtgctggacatgtgggagcagcccagccaggagggactcacatgtgttctggatctcagaaatgccagtgatgagtttgcttgcatgagatttttggttccaagatctctggggatgagaaaactcagtcccttcagatccctaaaggggtgtgggatataagtgaaaccagcccacatcccatcctgattttgagggccatctgtagctctgcttccctgggtctcattcctgcattcatgccctggattcttaagaacaacgaatgggagaaacacacagaaatgaatgaggaaagtcacagcattgacagagtccaggcctagtgtcaagaaatgcctacacaaggaagtcaaaccccaaagtctttccccaccctcaagaaatcagaatcaaaaggaagaaaacccaaacagcccaagggacaatggtaggaactgcaaaagaccagaaaacatcagctacgataatgaccaacaatgaaactcctaagatattgttctgtattacaaaagaagaaattagactcaattgccctattataaatttgctaaaaatacatatatatatatattttatctgaacagaaaaatagactactctgagatgcgtggacattctatgacatagtcgcgcatcagatacttctagagccagaaaaatggcaacagaaaatgcagaggtaactcttatttctgggtgtagccaggactggtttgggttgcctgggctgagtgacatgaaagcatttggatgctgtcctataagcagtgataggtgaggaaacatcagctcggggctggaagctttccattgtcctgccggggtctcaggggagccccttctccctcctgcccactctgcagctacagaaaaagtcctttcccaaagaagcatgtccggaggctttttgccttgctctcttttgattcaaagttacttgaattgaggctgaaaaaaagcctggggtattgttacttgagattagttggtagagaaataagaataggagagagattagcgatagagacctggctttagtggctcttgtccgtggtgaattttaaatatccccttgtccatggaactagacactccagctgggactggagcaagacagaaatatacaatagttacaaatatcaacaatacattacagttttacagaagagaatactgttttgtttttctccttagaaacatggatcttattaggagaaagggcagagacgaggctacagttaccaagacacatggagaagctggaagtcagtttgaaaaagtttgtatcaccagcagttttcaggggcaagctgggtgggttaaaagaaatggcctcctcaggattttgttgtttttccttcttactcttcttccttcttgatccccagtcctttggagaaagggacttcacgggaacaaatgttctctcctccttttttctttccccttgaagtgtgcttaagatagaattcctaaagaaggcactgagaaatctactgcaccaaagtcctgttggtttcttttacccaaagataaaaaggtgaatatactgtctcctccaaagcttccccacctctctcaccgccggtggcagactctcccccrtgtgattgggacacatggctacctggtccctagccctttcagataattgtggaagttggaatgcaagttcagctgggttcttgatgagtttcagtgaatttgccaaactgaccagcatccattcgccgcgtccagcccctagtttgcttgtttgggttgacttgtttctttctgctctcattggttcaggaatgaatgggaaatggaccaccaagttaaagcaggatttgccttcagaccattgctttcctcttctcttctctatcaagacctttctatcgagtgaacttctcagtgaagactcttaagtagatttcccagtgcatgtatattcacgtacataggtacaggttgggtgtatacatattaaaatttggatatgttcttttttagcgggtggatgggctgggaaaacttataatactctctttcgaattgagcacagaataaaagctatactcccccagtacatacacacacaagtaaaagaaaaaaaaacccaatcaaacccaaacaaaatactttctaagcatagtatatgctgaatttcaattattctgtttctataagaactctataggactctggctatgaagcctgaaaaggtaggttcttaatgatacttctgaattcgtccttcaaaagtgactcaataaaatgctactttacggttggacaaaatacacaaggaaggaagggccaggtcctacatgaccacagaaggcagaaagggcctttggttacaaggagagttgcaccaattggttttcgttttttttaaaaaaaaaaaaaaacaaatcattttcaatctgtacagttctcatctgcttcaaccaacaaatgaaatgcctcgattggaagaaggggtggtaagttccttctcaatatatatggctatattgaaacatgttcactttcctgatatgtaaaatagactatattattattattattattttttacagatagcatcagctctaaaaatatctgaattggaaatcacaactatttacttttatcaaaaagcatttgtttttttccctgaattttcacatttgtgctgatggtggacattaatggtgatgaaaacaaagaagagacatgtgagatggtcggcggagaactgtcccacagtcattcctcaagaggcccccagctcagactgcgtgttcagcaaagtgttttgggagtgctgcttcctctgcctggcacgggatgacctcacactctccctgcccctaagtccctttgcagttgctgcgcgaatactctgaagatacctaggaagagtgacgttctcgttttctctgttaatgcggcaaagaacaggactgcaccctcttggggggatctacagtctctggagatgctgagaagtgttatgaattgggtttgtatacagcagagaagacatatttttaagggtggtggaatgatcccatctcatcatatgtgtggcaggtggctcaaccttatgccttatgtatgaagagcaggcagaacagctccatgatatttgtgtactgagaggtggatcatgccattgtactaacaggcagaccagcaacagatgatattgagacttaagactaggtgaaccaataccatatctttcttccactgggaagacatatgcctgttactgtattgaggatagacagaactacactattgtacttgggacatcatccatcaacattacattaagagaacaacattgttccattgtactacagacaggcagaccaataacatgtcatctttactgacaggtgagccaacactatagcattgtattcatcagtggttcaacctaatgccactgtactgaggaatggccaacaacaccatgctgttggactaaaagcaggcaggacaatgccaggtcatcaaacgaggacaggaaaaccaacaccaagaaatacaccagaaccactcaggatgcacacaaatacttattgcttttgtctgtactggctgcatcgatggctgcaggaaggagagttgagcttttagtacagacagtgacactgaaaaaccaatagctggttgacaagaaagagaacagagtaaaacacccaatgtccaactgtcactgtgtccttttgagatgtgcatgtctcctgtatacttgacttcatgagaggccccacccaaggggcaagaacccctcctgacccatgagggttaagggaaggtttcagaggggcagggaaggagcccacagactttgatatggcagacagtaataccagcacaatattacccatgctggccagaaatgggcaggtagcaacaatccaactacagtcccaacaattgggctatgggaaatagtgcttattttaaagtgcaagatgttgacactgtccctggcagaacctatttttgaaaaacataaagtgctttttattttaacttttttttttttaacttgaaaaccacagaaaacaaaacagaatttctattatagtaggtactttccttgctgcagcaggaattattcagtctgaactgggcatttcaatgcgtggtatttttttcctttcatttttgcaagtaaaaaaatcatatttttatgctgttcttcagtaacacacagtctctttgaataaactatttcttttgcatatttgacacttgcatatcttttgagtctacactagtgatgtaaagaaagcgtgttcctcctccaaccctaaaacaatgctctgagttcatgctgttggctgggtgcccaccttctgaacccttcccagattgccagggggcaattagaattgagtacaagtggtgcaactcaccctgatggtatctcaaaataaaatctcaggtactatgaaataccgaagtcaatgaagacatttgagtaagggttttgcgctgggatcgtggcttatggcgcagagacttccccatgaccaatcattccctgtagctgtctaacagtggaatccatccaggaggtgatggacaggtgttcctaggggtggctgggcaacattcaataccaaattggtcaacccactctttcaacaccagccgcttgttccagcatccttctctagctgaagccaggaggactgtcaatgttgccctccgaggctgagatggaaagccacgagagaatggggagtatgtggcctcggtcctgtctaaagtggtggtagtggtggctgtgagttccactcatgtcatctcccaaagagggctatagagttgttacaaggaggtgctgtgccctatggcttggccaacttcatgctgatggacctgtcatggctctcaaggtcttagggagccttctctggagtctctcttctctctgagggctttacagggcctttctgttccagagttcatgcagaaaagctctgtggcaggtaagctgaacagctctcctctttggacctcacccaaaagtctctcctccaaggcagggcagttcagatgctctgatctcgtgtgcttccatgggctcctccccctggcaacacacggacgtcaggggagatgtggttctcaagtttgcacttttcctgaccactggggccttttccagtcaatgcttctgtggagtaaatacagttctgccttaagaacttaggggaggtgggtaaaggggagctttcaaagtggtttttctccgatcttgtccccgtgctgaacttcggactggtgctcccagggaggcttttgggggggctggagtccacactgtagagcagctgtccctcatcatctgtgtctgcgtcaatgtactggtggacacccgcctcaaagttgaacgctattgctgtgtgtttctcaggagaccgggggggtgtcttagcacttgctgtggtgtagatggaggactctgggctcagcacagccttgtccaaaagcgtggcacactccagtccagcgacagcagccgcagcactcccccggttcctgagagggtcatggtacatccctagaacggggaggagtggactggggtcaccctccatgaagttgactttaagtgctcggagcttcaaagggttgttagttttcatggaactcttggggctctcgatgaagaaactagagtgctggctggcatcagggctggggttggcctccacaaacctaccaccactggcacccagagctccccgccagcccacttctggggctgtgctgcccccagtcttgctggggagtgatgtcaaagggctgtgggagaatctggtggcctcagggaagtctgtggcacagctaatgaaactatcaatgcttgacatacttcgcatgtcaatgaccccttctgtgcgagtgggcagaggggctacggggctggggatactctccatttcaagttcttcctttggtttgctctgtgctgctgactccttggtattgaggatgggttgggattgggtcttggccatcttattgtacatgtcttccaactgctgaacgttcaggtgctgaggactagaagacgatctggctttttcaggggatccctgttccttggtttcaaaggacttacttgagctggtttcagacagtgtcctctttgtccatttccatttgttaggagacaagtggttatcttgtactttgtctttcttacccatattctccccatttttctcaaccacaatgtccatcatctcaatgctccgggcaaaagcatccttcatgttcatggatacgatgctgccattcctcttggctctctccagagcctctcgccgtttgattgctttctcctgtctcttctgctccttatagaactcagagaagttattgacgatgatggggatgggaagagcaatcaccaggactcctgcaatgcagcagagtcccccaacaattttccccaggagagtcttggggtagatgtctccatacccaacagtagtcatggtgatggtggcccaccagaaagaggctgggatgcttttgaacttggtgtcgtcctcatccttctcagcaaagaagacaaggctggagaagatcataatgcccatggcaaggaagaggatgagcaagcccaactcattgtagctcctccgcaaagtgaagcccagagactggaggccagtggagtggcgtgcaagcttaaggatgcggagaattcgcatgatgcggaagatctggaccacgcggcggacattctggaattgcagcacgctcttgttggattcggtgaggaaaatggtgacatagtatggcagaatggccaacaagtcaatggcattgagtgggcccttgaagaacttccacttcttgggcgaggagaggaacctcagcaggtactccatggtgaaccatgcgatgcacacggcctccacgtgggccagctgggggttgtctgtggactggccgaactcatcgaggctctgtagctcaggcagcgtgttgagggacagggcaatggtggagaggacgatgaacatgatggaaattatggcaaggatctgtgaggagaagagagtgggatttagttatcaaccaccccacaggatgatcatcataatatcctggatctacagggcactcctcaatgttcaagagcattttcacatttcactagtcatttaatgagccaaaaagagaatttgttgtaatccatttattgtctagatgtggaaaccaaggcccagagaaatgaaatgttttaaagctatcagcaagcccagggttcaagcatactttttcagatagtaaccattttataggccctgaaaccctgcattgtctgtcacaacgactcgactctgcagctgtagcataaaaccaaccttggataatacatacatgaatgggcatagctgtgtttcaataaaactttatttacaaaaataggcagtggactgaatttggcctgtgaaccatgatttgctgacttctgatctagaccagtggctcacactggatggggaactaccttcacagagatgatactaatgataataactatccttgattgagtgttcattgtgtgctaggcactttccatgaaatagctcatttcattcttataataaccccgttcagtgctattagctccattgaacagatgcggacacttgggtttccacagctagtaagtggaagagccagcattttaacccaggtctgtgtgacccaagaacatgagctcttaaggctgtgttaaaaatcagatttggctgggtatggtgcctcatgtctgtaatcccagcactttgggagacctaggcaggaggatcgtttgaggccaggagttcgagtctagcctgggcaacatagtgagactctgtctctatagaagaacaaaggggaaaaaaatcagatgaaagctaaccttttgctagaaaaatgcctagacactcaagattttgcaggtaattcctagggaggcacagacattctgggcccatgttaactcctgattggaactatgtgcttttgggggctaaagaccttggcttaactacctttgagtcccctggatcaagaagagagcttggcccagagaaagggctcaatggatatatgttgaaattaatggaatctaggccagtaggccagtctacagactatgcagaaaagcaaacagatgtaatcaattgctctgagggtcttttttttttttttcaaaaatacaaatccaatcacattactcctttgtttaataaatctccagggctcctcatgaaaaaatccaaacccctaaacctgtctattgggtcccctatacctgtcttgcttttgtagattttccctttctcttcctctgcccctgctaagtgggaaggggggggcctggtcaccatggttgtatcatttgatcctgcctgccaatgatcagagcatgaagtttggataaaaaaatccaagttaagccaatccgtacactggggcttagccagcctacctttgagaaatttgagttcaggaacccaggcggtgagtgggttacgggagggtaagtccctgaattaaatgttaagtagaatctaggcttgaatcagcttcatgataagcccaaccctcaagcaactgtctcccaaatgtaggggacagagatgccataaaaacatcagagaaagctgagccttagcctagacatggtggcttacatttgtaatccc

SEQ ID NO: 12294 - DNA, 137935 bp, Homo sapiens
  misc_feature (1)...(137935): n = A,T,C or G, or insertion/deletion polymorphism (see Tables 1-2)
ccaacatttaaactattgagaaaataaaaccttgctcactggtgaccacaaatttactctgtaccttcccctagactaggtatgctgttcagcatctgttttttttctgttttttaaaattgtgattaaaaacacataaaatttaccatcttcaccatttttaagggtacagttcggtagagttaggtacattcacattgttgtagagcagatctccacaactctttttctcttataaaaccaagattctatatccattatatagtaactccacattcccccatcccttcagtccctggcaaccaccattctgttttctgtcgcaatgaatttgactactctcagtacctcatataagtggaatcatacagtacctgtccttttgtgacttatttcacttagcataatgtcctcaaggttcattaatgttgtagcaygtgtcagaatttctttcctttttaaggaaaggaagaaattcattgtgtgtatatgcaattttgtttacattttgtttatccatttatctgtcgatagacattaggttgtgtattagtctgttcttacattgcaatatagaaatacctgagactgagtactttataaagaaaagagttttaattggctcatggttccgcagactgtatgagaagcatgatactggcatctgctcagcttctggggaggcccccaggaaactgacaattatggcagaagatgaagagggaagccaggcatgttttacatggcagaagcaggatcaagggagagaatggggaggtgccacacactagaacaacaccaaggggatggtgctaaaccattcatgaaggatccaccctcatgatccaatcacctcctaccaggtcccacctccaacaactgaggattacaattcgacatgagatttggatgggaacacagcgtttttctgagccctccatatttttccaacctctgcctgttacccaattccaaagttgctgccgcattttcaggtatctttatagcaatgacccactcctgggtaccaattttctgtattagtttcttcccacattgctataaagaaatacctgagactggataatgtataaacaaaagaggtttaattggcttatggttccagggtctgtacaggaagcatgctgctgacttcttcctgccttctggggaggccttgggaaactcacaaccatggaggaaggcaaaggggaagcaagacatctcatacggtgggagcaggaggaagagagagagggggcaggtgctacacacttttaaactactagatttggtgagaactcactccctacatggtaccaagctaatccattcatgagaaatccaccttcatgatccaatcacctcctagtaggcccctctccaacactggagattacaatttgacataatatttggatccaaaccatatcaggttgtttccatctctttactattgtgaatagtgcttccatgagcatgggtgtgcagatgtcttttcagacattgcctcaattcttttggatccatacccagaagtgggatgctcttcagcaccttttattcgtgtacagtcagcaacactttcatttccccacattgtctgttcactcacctcgagccatctactctattctacattcattcattcttccttctattaagggatgatgaaaacatccgaaggtaattctcttaacttcctctccctccaccttccatcctatctacatccactcacccttaccctcatgtctgtcttccacttttcacagcctatatctttcactcttcatccctttctgtcttttccaggacattgttccttcagttagcccctctctcatcattggctccttcgttccacctccaaaactcctgaagccaagacctgctgagctgcatgtgacagaaatccacctcacactggcttagaccaaaaatgaattttgctaaatcacatgacagaaaagtccaagcatgtagctggcttttgtcaaaacaggaatagtcaaagggtgccttcaggaatatcttctccttctgctttgcctggctggcttcattctctggaaaaaactccctaaaaactggcaaaatatttactgatgatgcaacatgcacgtctcatcagcttagccttccagtacaaagagcctctcgtccaataagtctttcaaaagtcccttcaatagctttcattctccaaatagggttacatgcccccaaaggaaacaataactaggagcaggacagtgaaataaacacagggcaaggcctgagttgcctgcccagccttggagatgggggtagggttggtctacctcattggttctcaggtgggatgattttgccctcccaaggacatttggcagtgtctagagacatttttggttactacaactgaaggacggaagggtttccagcctctagtaggtagaggccagggatactgccaaacatcctccaaggcaaaagacagccctccagaacaaagaattatctggtccacgatgtcaataatattgaggtcgagaaaccatagtcttccagaatcacattgaactatgggaaagaggggatttcccagtggaaaaatctaggggcaaatcccagaggaagggacccatttagagcaacagatatccaccttcacctccatctgaaaaaaatcttcccccaaaccatctatgtttctcgtttaaactacctctcttacaccaaattttctgaaagagtggttggccttagctgtctcaaccactgtagtcattcattcaagtgatgataattatggagctccttctgtgtgctaagcattattttaggtcatgggatttggcagtcgtaaactgacatgttctcatgcagcttttattctggtgggagagacacacaataagcagattttcagttggtaataaaatgaaaaaatgataagtataattttttaatctatatgaaacaggcaaaaaggaaaggaagttctgaattaatgtgcaattttaaatagtggccaaggaaggctccattaagaaggtctcatttgagccaaataactcaaggagatgaggtagtagccatgcagagcgatatctgggcaaagagcattctaagcaaaaggaatattaaatgggaggaaaaaactgaagagaaaaatacacctgctgcacttggagaaataatttgtttgcaagctgatggtaaaaatccagcagaaagaggtgtatgatagtgctggaggaagtgagaattgctggtttccttgagtgagtgagagcaaatcgaatctagggcacaagtggagagatcacccttagacttagactgtgaacagtataattatattaacaggagagacggaggtttcatgggccaaatacaagaatttgggtggagtgatggtagaaaattgtagatctatttgattgtttctattttctcaataaagaaagaaacaaagccattcacagaaattaagaatgttggagaaggtgtcagaaataaatgtcaaaataaaaatatgaaatagtcatttaggagaatgggagaataaatggattagacaaacaatagtgggaatgtcaggcagaagtataatggtccatttgaaattatttgttactaaagtaaggctagtcattgtggctatgtgtcttttccagccacattcagtttcacaggtatgacagcaaaataatggagaattgattctaaccagtaatgttgttttgtctaatggctataataacccaagagaagggtgagggagctaacagtgggtgcaagatggtgattataaagacagagtatggaatttaacctggtagtgatgaaagtgaagacacaaaggaggtgagaagctgagagagatagcggtaggatcaatgggctgcaggcactgagacagacaaagattgctggattcagtttaacgttactagggtaaaagaaaagagttggattggtggttagagagtgggatcattgaaatcactgagaggttgaaagtgacaagtctccgagcatgcacatgagcattagagtcagaggagagtggaggacaagaccacaggcagagaagaggtcaaggcactggaaggccagggatttgaaaatactattgctgtgaatgttgaaatcaccaggaactgtggcagaagtaacagtggagaaggtggccatgagccaggagctcaaactttcaaggaatgagggagaaagtagatactaggagatggataccagcagaagtggtaaggagtggcaccttctgatagcatgtgatgtaaaactggggaaatgagccttctcctcttctcttttcctaagcctactacaatctggctgctactcccattactctgttgagaataacttgaaatgatgatagcaaatccttaaaagaatgtcactggatgtactaaaaactgtgataagtgatatgatcaaagtagacatttcttccactagaattttgggaggaagcctaatggaaaccaatgcgcacagaaagacaaatgctgtatgttattagtcatatgtggactctaaaaaactcatctcatagaagtagagggtagaatactggttaccagaggctggggaagggagagacaatgggagatggagagagattggttaaagggcacaggatcacagatagataggaggaatacattcatccttgaatacttaaccctctgccctaaatctgtcagtcctacatccatacttcttatttcagtaagtagcaccaccattcatttctaatcctggggctaactcttttttttttttcttttctgaatcatgtctccttttaatggttaaggaaaacaagtttaacataaaattagcaacaacaacaacaacaacaacaaaatcaaggtttaaagtcaaaattattttaacagaaaaacccaggcaaaatagcctacctacagacaggcagtacatgtcagaaggacaggccacccccaataaaaaagataaaatattattttttctaccttttttaaacttaattatttaattatttctttcttttttcttttttttgtttcttttttttattatactttaagttttagggtacatgtgcacaacgtgcaggtttgttacatatgtatacatgtgcgacgttggtgtgctgcacccattaactcgtcctttacattaggtatatctcctaatgctatccctcccccctccccccaccccacaacaggccccggtgtgtgatgttcctcttcctgtgtccatgtgttctcattgtggaagctggaaaccatcattctcagcaaactaccgcaagggggctaactcttgattgctttcttctcaccaccaaccttaagaaaggaagtaaccaaaatccaatacatgagcaactgttcattccatctccaatatctttgttaattgtccactttatccacccagtcagggccgccatcaaacctcacttggatgtcggcaaaagctcccctgactggtcttcgcagtccattattgccctattctaatctaccttccatactatacacagatttacattttttaaatgtgtatctaattgtccctcccttttaaaaaatcttacaatggcatgacgtctcaattcagggtaaggaaattgtttcttcacattccctgtacaccgtacacatcgcctgcaattgcccttcaacacggagagcaggcatttcattagctgaccttcccacacacattcttgcaaagaggaaaagttaagcagggtgtttggaggcgagctgccatcatccaccgcctttgtctggaagcgcagggcctcacacgcgggatccatcggaagcccgagcattgtcaagctctgctgctgcacctgggtcagcaaggtgggctctgccagcgaaactcgttagaaacaatgcaaatggggagtaaacatgacctcgcccatgaaggggaagctgtggtcaaaagcattttgtcccggaaccccgcagccctccccacactctgggcgcggagcacaatgattggtcactcctattttcgctgagcttttcctcttatttcagttttcttcgagatcaaatctggtttgtagatgtgcttggggagaatgggggcctcttctccaagaagcccggagcctgtcgggccgccggcgcccggtctccccttctgctgcggaggatccctgctggcggtygtggtgctgctygcgctgccggtggcctggggtgagaggcgggcgggcgtggggaggcgcccgggcggacgrggaacccggggccccgcagagaactcgcgtgcagcgctgagctgcgctgctctgcgcgcccgggtccgaaggcagcgcgatgggtgggctgagcgcgcgacccggcagggcggcgggtgtaggatccttctgcgcactggagaccctcgstgcttctgggtaagcgtggagttcccasgtgcaggggcttaagtcgtgacgagcgcagtggaaggcgcagatgctgagcgggtgccgcacgaaattccttgcctttgtgtattcacagcctcggctggctatagccaagacgtggcgtygatcctagygaaagggracttggggatccgacaaacctgagttctggtcctagaaacttaactgtgaggcaacttagcacacctgagtctgtttgctcttctgtaaaatggggacactggtatctctgcatcgtggagttgctgcctcagtggcattaagcctgtcgagtatctaacacagggctatgtgtccccgagtccatttctatcccccaaccgttacctctgtacttagctcccaatggtgtttagacaagcagtcctagggatgcaggtgttacctgacaactgccccgcatggaactgtcctcgccccccacaccaagccaccacggccatcatcaccatgcacttaattgacagcrtactttaagacagatgcatgccaggcacttgcggattagaagagcaagggaagccccagaacatgcaatgtaaccgttgcaggtagaagggacagtagatatgtttacagttcgcattttagtgatgtgtttagtacaaaataacgcctattataattattatggaaattttgaggccacatctcttcctttttcttaacttcaaataggtaaacatcttcagttagaacccttctattattatttttcggctccccagaagtcttcttggttgcctagactcactggcaacatctcatttgaagygacagtcttggttgtttttgtccagcctattcctgacaactccgggttcgcccttctctgccactagacattttacattcattatttgagtgttccttcttctctaaaagagtaaataaaataaaataaagtagaaccaagtcccgcaagagttgttattaatatttgatctccttaggcaccrgaaagtaacctgtcaggtgcagagatgtgataaaacgtacaatcttatttttaggagagaagcatgcccagtaagttaagcaatctgttgtcaacgcttaggaatttgtgtcatctttgggagtactggccctcttcttactagaatgttgttttacttagcctatgttgattaagttactgttataaacaatcccagacactattaattgcaaaaaaaaaatttactgaggttatcacaataacttccaaatgtgaaacagcctaaactaaactacctagaaattttgttgctgacataatttaaattttaaaatgctgatggatgcttccagtgtgcayggtcctttggaattttaaagaagtataagagctctgcacccaaagtgtatgcatatagaagtaggtggtggagttttatgaaatctacttattaggaagccagcgttctgctttttccagcctctgctacttaccagctggtgtcttggacccagtaagttaagtcacatcactgaccttcagtgtccacatgtataaaatgagcayaactgacatcctgatctctgagagagacgttttgaaaatcagatggtgtaatgcatgtgacagtgttttgtaatctgaaaacccccatgcatgtctgaaaaaccatgactaagaagtcgtgcaagactgcaggatcaccgaaaarcgagaaatctcaactcctatgatcaggaaaggatgagtgaaaggtatatggctttactagcacttaaagagtgaatctagaaacagattgcatacgacaaaaaatagcagaggagctaggattgttttgttattatgagttactcacagtacccgtaaagtggtatagtgctatttgaaagaggacttagattagctgcaaatagatattgcaaatgtaggacaaccmctgaaaaatgtgaaaaaaagaactataatttatatgttaataagtaagagagaattgcatcatataaaatgctcagttaaaacaataaagatggctggggacagtggctcatgcccataatcccagcactttgggaggctgaggtgggtggatcacctcaagtcaggagttcaagaccagcctggccaacatagtgaaaccctgtctctacaaaaacacaaaaattaccagggcatgatggtgggtgcctgtagtcccagctactcgggaggctgaggcatgagaatcgcttgaacctgggaggcggaggttgcagtgagtcgagatcgtgccattgcactccagcctgggtgacagagcgcaactccaaatcaaaaaaaaaaaaaaaaaaaaaaaaaaagaaacaaacaaacaaaacaaaaaacaataaagggcaggaaaagaatggaagacaaaaaatagaaacagagaacaagagaaaaaaagcaacaaataaaaaccagtaacaaaactaaagcaactatatcaacaatcattttgagtgtcaatgatcgaaatgcaccatttgaaacagatcatcagagtggatcaagaaacaagacccaactatatactgtgtacaacaagaccgttttaaatatagacaatatatatgaaaagtaaatggataaagatataccatgctaatgctagtcacagaaagcaggaatagctgtgttaatttcaaacacagcagacttcagaccaagaaaaattattagggataaagagggrcatcatataatgataaaggggccaattatccaagaagacgtaacaatatcccatatgtatgcacctgatggagagacaaaatacgtgaggcaaaacccatagaactgcaaggagaaatagatggatttactatcatagttggagacttctatgatatctttctgatatcagaaaaggtgctgaagtctccttatcagaaatgggcagattcagcaggcagaaaatccgtaaggacatacttgaattcaacagcaccatcaatccacttgggtataattgacatatatagatgacttcatccacaacagcagagcacatattctcccgcttacattcatggggatagaccacattctgagccataaaatagtacacgaattaagctttaccaggcagtgtttaatatagggtggactctggcgccctcacgtggtcctcatataggatctggtttggttatccctgctaggttaaggtgcaagatagaagggaagttccaatttgctttctgtgctttgtggtgtattttggtttacatatgctcagatgagtggatgtgtgatttatattatctattttaatctaaaataagcttcacatttggacaggtaacatcaaaagtgtcctacacagaaatgctgggtgaagatcccagtaataaaaccaactccagaaaacaagaaaatggtagagttgacaatccctctcaccctctccgcaaagacacatgtatacacattttttgtcagaggcattaagtagaagaaatgctgtcagtctaatcacaactgatcacaactcgatgaaaccaaaaaacctagaaagtatcatgaagactgtcgaaataagctttacattcactattgtgaacagagagactcaatgtgactgttttttgtcccgttagatgttagctaatgattgtgctaagtcatgatgattaacaaagcatttaaaatatttattttatctgtgttacatttcaaaaatttatattgaggcatataatttatgttcgcgtacatatataatttataaatttatatatttgaaagggcatgctctttttttaaactgatagaggtgcctaagcaaagcaagtgcaaatctattccttaaagggtaagtatgcagaatggaaagcagagtgttctttgggttgacagctcatattgcaacagacatgaaagtgatgatgtgttaattgtgcatatagcacagaatacatcaacttgctttgaatggaatatctgaaccaggagaatgtgaaagtgggctgagtcatacaagacaaaacccgaaatgagataacaatacatacccactagaatggctaaaatgaaaaagattgaccgagccaagtgttggcgataaggtggagtaactggaattataatatactgctatttggcaggtaaaattataacattaactttagaaaatagttcaacagattcttaaaaccttagacacacactcaacattttactcttaggtttttacccaagagaaatgaaatcatatgtccacacaaagacttgtacatgaattttcatagcagttttgtttgtaatagccaacacgtggaaacaatccaaatgtccctcaacaagtaaatggataaactaaattaagatatatttatgcaattgaatattacccagcaactaaaggaaacaatttgtatacatgcagcaacctagatggatctctaattatgctgtgtgaaggctaaaccataaaaaaaaacctgagtgatttcctttatacaataggatataaatgaagtgatttaggttatatgaaattttagaaagtcaaatcaatctgtagtaagagaaaaccacctgagttatttcctttatatgataggatataaacgaagtgattcgggttatatgaaattttagaaagtcagatcaatctgtagtaagagaaaacacattgaaggttgcctagagaaggaagtggatgtttggatggattacagaagggcatgagggaactctgtgtgggtgggatgtatgatggaaacgtttattgtcttcattttggtgatggtttcacaacgcatacatatgttataagtaatcgaattgtacacttcaaatactcatcaatcattgtatgtaatatatcttgataaagctataaaaacttttaaaattatggtaggtcttcagtttgtggattttatattaatatatttgtcataggaactagtcacaattgagggattggtaataaaggagagaaaggaaactacatcaagctttctttgttgaaggctcatatattccttttttgagctattatacaactttgctttttataattacctatactattcatatactactatgcaggtaagaatattatgtaattaaggggaaggaacttctttccaagaatggttcattcaatttgctttgttactttaggtctcattccttcctctcgttgcaagctttgctgtgacatttaccctctctcaatacagcttttggcgctaggcacttcacatggaatctcttcctttgtccggcatcaatggataagacaaatatcaaaattgtatttcatcccacatatcaactagaggaaaggtgaatgcataacactgaaaataacagcaactgttttactcagtgttttttttttttacagtatcctcaaagtgctgttatctatcaaaatcagctgtgaaaatttttaaaaatagactcctgggccctaacctagacccactaaatcagagatttgggggacatagcttggattcttgatttttttgagttttataagtaattcttcattttttgttcattgcaacaaatatgcattgagttcttataattgagtgttaagcaccaggactaagtattaatttagaggtacaaaaaaacacatcatctcttgcctttaaattatgcatatctaatatctattgagagaaatagatacttctaaaagcacacaaagataaaaagcacaaattgtaataacaaacaattattgatatgaaaggaaaagcaaagtgtcrgactagaaattattatagggtggggcagagggaagtagtttagattccaaatccctaagagggtcagggaaggcttcagatgagattgggtgtgttcagggtggtatggccataggcaggctggggaaggcttctataagaaagtgacattttagcagatgcctgaaggaagaattgaagtcagagtgaagataaaattgcgtcacayagaaggaatgtcatagacgggaaaaatgtgtgtctttgggaaactgaaaaaggggaaagggccacaccttggtgaggggaccaagtggcacaagatgaggcagggaacatagacaagggcttccttgcttaacaactgctggcttaataaagcaaatgtgtgatgatggatacaggctgtctgggaaaaataagtaagaaatatgagctttcttggagcatcatcctttgcttcagtagaaagcacagagttaggcttccaattctgactaaagccattgacaacagggaaaaggcaaccttaggaattctcctctctgtccggggtcccgtgggcactatgatggagctcatgagatgcagatgagaagtcccaggctgaatccggggcacattcactcaggagagctgaggtcaccagtcactgaggtcatccagtgcattcccgacagcataggctcattccaagctagttctgcaaaggagcagaaaatgaactcttggaagcaaagcaagcactcccactttagcggaataatcgaatttaactcttagaagtccccttacccttttctaagggtaataatcgtaagtataatttatgaagtgccttctgtgtatgtggcagcatatactacttttgattctccctgcaaacctggtaggaaaatattattccctttatgaagatgaaactgaggctcagcaagattaagcggtttgcctaagacctcatagccaytaagtagaagacattgggttcaagattcaatctatgaacccaacatttttaatactatataccattctctttttgtattaatttcctattgctgctgtaacaaatttccacaaacttagtggcttaagacaacagaaatgtattctcttccagttctggaggccgacgtctaaaatagatccatagggctgtgttccttgtggaggctccaggggagcaggggttttcttgctctttccagcttccaggggctgcttccgtcctttggctcttggcctccttcctctaccttccaaaccagcaccatagtgtctctgaatatccttcttctgtctcctttcaccctcttgcctcccttttataaggacccttgtgatcacatttaaggtccacctagataacccaggataatctgcccatctcaagattcttaatcacatctgcaaagccctttaaccattacaggtaacaatcacaggcttcagggatcagaacatggatatctctgagaggtccttacttagcctaccacacctttccatatagattctcaaaattttagctgagcctaataagggagttcattaccattagggtccggtttagtagcaagtgcttcctttaagtgaaaaggtgaaagttgtccacttaataaggaaagaaaaacattgtatgttgaagttgctaagacctaaggtaagaaggaatcttctatcgatgaaattgtgaagaaggaaaaataaatttgtgctagttttgctgtcacacttcaaactgcaaaagttacaaccacagtgcatgctaagtgcttagctaagaggggaaaggcattaaatttgtgggcggaagaggtgaacagaaatgtgttctaattgacagctrtcaggtttggtactatctgaggttttgggtatcggctaatgtcttggaacatgtcccccaaagataagtgggtgactactgtatattcaaaataagcatttatatactggggagtaaatctcccatgttatttgtgttttatttgtcccacaaataaagtaaacaaagtagaattttaggcaagattcatttctagaggcagagatattttattataataaagaaggttgctctaccataaaatatagcaatttaaatttttataatcctaataacctcaaaatatataaaataaaagatggacaacattataaaaagaaatagacaaatgtacaataaataaaatattttaacacaactcatttagtatctagtaagacaagtactcccccmaaaatcagtaaagtatctagaagatttgaataaatattaacagattggattcactgaccttgttacaagaaagaattatacatgatgataggagagaggaagccacagcacaggcacttactgattaactaaattttgaagctgtgaaatgcaccttatcctttagtgaaagatgatataaatagcttagttgccttcaaactggcagagactttttgaatggatggatgctgattttttaaaaaggagcccatttctgaggcatcttttaaagcaggggtcctcaacccctgggccatagactgatactgtccagtggcctgttaggaaatgggcagaacagtaggaggtgagcagccaagcattactgcctgagctccacctcctgtcagattagtggcagcattagattctcataggagcagaaaccctattgtgaactgtgcatatgagggatctaggttgcatgctccctatgagaatctaatgactgatgatctgagtggaacagttccatctcaaaaccatttccctgcaccctccattcacggaaaaattgtcttccacaaaaccagtcccaggtgctaaaaagggactactgttgtaaaggaataagtccctttgctattattatttttattaagatggaatcttgctctgtcacccaggctggagtgcagtggcacagtcttggctcactgcaacatctgcctcctgggttcaagcaattctcctgcctcagcctcccaagtagctgtgcacaggcatgtgtacaggcaagtgcaatcatgctctgctaactttttgtattttgggagaggcagtgtttcaccatgttggccagcctggtctcaaactcctgacctcaagtgatccacccaccttggcctctgaaagtgctgaaattacaggcatgagccaccactcctgcaccccttggctattattgaagtgttctttttcttttttgatcacatctatgaagtatattggagagaaagagaaggtagaatgggaatttcaacagggtcacggtggctcactcctgtaatcccaacactttgggaggccaaagtgggtagatgacctgaggtcaggagtcgagaccagcctggccaacatggtaaaaccccatctctactaaaaatacgaaaattagccaggtgtggtggtgggcacctgtaatcccagctactcaggaagctgaggtaaggacaattgcttgaacccaagaggcggaggttgcagtgagccaagatagcgccactgcactccagcctgggtgatggagccagtctccgtctcaaaaaagaaaaaaaaaagtatggtaatttctccattaactttgatgctkctatggtcttgatctccaggtcaatgcaatgccccagaatggcttccatttgccaggcctaccaacctaactgatgartttgagtttcccattgggacatatctgaactatgaatgccgccctggttattccggaagaccgttttctatcatctgcctaaaaaactcagtctggactggtgctaaggacaggtgcagacgtaagtaactctggagtgggaacccccctgttagtcaaacatcygtaagatctgattcaatttgttcaaattttgtaactgagttgcatatgacaattagtttgccaaggtgcaatacatatgagaattattcttgtagatcataccttgttactgctttgagttcctggcgccttcattaaaagtttatttcatgagaaacagtcattgcaggacatgattgagggaaaatccccattcactgggggtctcccattttcatgactaaaattaagtaatgaatgacttgggacaagaaagagaagtggattaaataactaaaagatgtgacaatcttgggctttgagatctttggattataccagttgaattgaattacagataataacraagtttacatttttctgggaggcataatatggggatgaaacagatctgaaaggaaagttttttttgaaagggagctgatcctgaggcagtctggtgagtttcctcaaggtagcaaaatctgtggaaccatcagaactgcgtgtgttcctcagtaagctacaggcaggttgagaccttatgtactaaaaaaagtttttagtttactctacttggctccaaaattctgtttctttcctgtaggtaaatcatgtygtaatcctccagatcctgtgaatggcatggtgcatgtgatcaaaggcatccagttcggatcccaaattaaatattcttgtactaaagggtgagttggcatctcttgaaccaacatctcttggttcaagagttctaacacagccttactaccttctagtcacatgtcagaaaggacaactaaactattaccatctgctctttaacggcttcaacacagatgtttagctcctgactgaaatgagcaaaggtatgacaagatygggggaaaatcatctgtatccttgctggaaaccaaggcagagcatatatgaaaagtgtggcattcattgggtgggaaggaagaaaatgggggaagagtatagtcaaagcacacaaacagccttaacgcagaggggacattgctggaagaaagggaaggccattgagtaactgtgtgagagaaatcttaacggtcatagcacaagtagtttgctagggctgctgtaacagagtactccaaaacgggtggcttaacacaaatgaagtttttaaaattctgttccggaggctgaaagtgcaaaatcaaggtgttggcagagccatgctcccctctaaaacctgtaaggatggatccttctttgcttcttccagcttctggagccccaggccttccttggcgtgtggcagcagaactcccgtttctgtctctgtcctcacatggccgtcttccctctgggtctgtgtcctcacatgctgttttcctgtctgtgtatggctgtgtcgaaagtgctctcttttaataaggacaccaatcataatggattagcgcccacactaacgacctcatcttaactggattgcctctccaaagaccatatttccaaataagatcacattaataagcactggggattaagacatcaatatatttcggggtaagggggacacaattctcattcattgctggtaggaatgcaaaatggtaccatgacttggaaagataatttggcagttttttataaaactaaacatactcttaccatgttatccagcagttatccttcttggcatttatccaaaggaattgaaaactcatgttcacaccaaaaaaaaaagaaatctgcacacagatgtttataacagctttattcataattgccaaaacttggaagcaatcaagatgtcctttagcaagggaatggataaactgtggtacatccatacaatagaatattattcaataccaaaaagaaatgagctatcaagccatgaagagacatagaggaaccttaaatagtgaaccttttttcaccatcactaagtgaaagaagccaatctgaaaaggctacataacatatgattccaactatatgccattctggaaaaggcaaaactatggagacagtgaaaatatcagtggttgtcaggggttagggaagaaggggatgaatsggaagagcacagaggattttgagggtagtgaaactactctgtatgatgccataacagtaggtacatgtcataataaatttatccgaagtcatatagtgtacaataccaagagtggaccctaacataaactatggacttggggtggccatgatgtgtcagtgtaggttcctcaattgcgaaaaaygtaccaccctggtgaaagatgtttataataggggaggttatccatgtataggggcagggagtacataggaaatctctgtatcttctgttcattattgctgtgaaccaaaaactgtgctaaaacacaaagtctattttttaaaactgcatagacataaatacatgggcatatgtgcataaacagacacgcacacaaataagtgcaggtaaaacaggaaatttgaacaaaatctgtggattataactgtttcaatatcttaatgttgatgttgcactattgttttgcaaaatgttattattaggggaaaattgagtaaatagtacctgggatctctctgtactattccctgcatgtgaatctgattatctcaaagtaaaaagttttttttttttttaaagttcctactaaatttccaaggggatgggcttcccctcagatcactaccccttttcagggagcaataaagtaatcttccttggaatgtagcaatctgtaaccaatcaaaatgctgtaactatgcatggtcccatatggaaaatataatcctgctaaaatttctctgtctctgccyatgtaagtgataccttatgtcctccactttggagtgctgaccccattcatttggagttggtctcttccaggtggctacccttaacctttgtgctcaaataaactctatccttaaatatattttctgaatctcattatttaaggktgaaaatgtgctaacctaaataattcacaggatttgttttttattctcattttttcctaacctatccacctggttcaaggcacatagattaagaaggaaaatggaaatgggactaatatcccaggcttcactgtccctcttcggggccctggggaggagactcccaaaagtctagacatgttcacccacatcctgtatgtggtttctggaaacgaaatgatcatggcttttcctgaaccatggcttaactttgtgaatccacaactctctcttccccaggagatccaaaaaggtagggtaggatgtaaaggcttcaatctgttcaagtggatatgagactccctggctccccttacaataagtagcatggattttstctctctgccttacttcctccaaacattctgaatgagaagtgttcaaaccactatttgttcaattgcttaatctactttgggacacaagtttaataaattaaaatattcttctatctgttccccttgatcagtgaacataaagttatcttttgactcatatttaaaatgttcagtattacaacactgaacaatagtatggaggaaaaaaaatgccaacttaagtttgaacttgcttcaccattcctatcccaacccccatgattagaaaatcaaaaagaacactttgagaaataacctcagtggggtcaaaagccagaggagcctccaggatcccttgttcctaagacaaacaggcaggaggaggtgcacatataggattgcagctgttcttcacttcatttgttcacatacttcatacttgtgtttatgtctgttggcagtgcaatagaaaatgatttcatttttggtggtatactagaaggcattaaaaaacaaaataaggccgggtgtgctggctgtaatcccagcactttgggaggctgaggtgggtggattacctgaagtcaggaattcaagaccagcctggtcaatgtggtgaagcctgtttctactaaaaatgcaaaaatcagccragtgtggtggcaggcacctgtagtcccagcagctaaggaggctgaggcaggagaatctcttgaatccgggaggtggaggttgcagtgagccaagatcgcaccattgcactccagccttggcgacaagagtgaaaatctgtctcaaaaaaaaagaacaacaacaacagcaacaacaaaaatcccaaatgatattgaagtcattaataattacatcataatcactagtataatgtaatagtgcatcaagtatcttcaaaagcacccactgttctctcactatttatttgatcttcatttgtcactgttttgttgtttgaataaagctttatgttgccaggttttcttacatactcataaagcaaagttctcagctataccaataaccatgactgttatttgacattgcttcattccttcatgtatagtactatcaagtttgaccctaccctcactatgactagtttcacccaaccatctatcacaacagagagtctaacgtgaagtaaaataaatgtcataaattattccaaatttatggcacactgtgaacagtttgagacatactaattgagaattgctgactttagtattttaagtataaaatgagtgttcaattctttttgatcagcctggatttcctttggttctagttatgtatccccttccttccttccttccttcctttccttccttccttccttcctccctcccttccttcctttccttctttccttctttgctttctttctttcctttttactttcttttttttttttgatacaaggtcttgctttgttgcccaggctggagtgcagtggcatgatcagcactcactgcagcctcaacctccctgactcaagcgatcttcatgcctcagcctcctgagtagctaggactacaggaatgtgccaccacgcctggcttttttataaattttttgtacagacagcgtctcactatattgcccaggctggtctcgaactcctgagctcaagcaatcctcttgcctcagccccccaaagtgctggaattacaggggtgagccactgtgaagggcctaatttggccttctttaatgaatcttattgataaaagcccatccatgcatccgtgcatccatacttttaaggcaaagaaatacatacaacaggactgtatacacacatatacatgtatatatatgacagcttccctgcactcaagaactttgtgctatcttttaaaaaatgaaatttataggaaaaactacaattcatcttagatttgcataaaaaagtgtcataaggtaataaagaagagaaagctcatccaattgagaatgtatgaaaaagaaagtcaaaaagtcccaagaagaatgtgaaacttgggaaagtgatagatagtcctttgatgagtgtaaaaagtccctctgaatcctataagagtgtaatctctggaagtagtaatttaattgggtagttgacctgtgtctttagaatgtaacattccttattttttgcctctagataccgactcattggttcctcgtctgccacatgcatcatctcaggtgatactgtcatttgggataatgaaacacctatttgtgacagtgagttgaaatatcccttcctatttcttttaccgacacattctaatttttctctggaataataaaaatcttaactgaattcyttctrtgcaatctgtccttcacacggctgaagactgcggtaatgttctcgaatattcctatggggttcctggcaactctttctttaagttcttccttatcctgggatgtgtcttttctaattccagaagtttaaatacataaaagccttcaaacttgattttacttcaataaacgtgaaattatgttgtttctaccacctccagtataataatcatcytgcttggcaaatcagtaaagattttwaaaattgatactcttcaaggttagcgaagctgtggaagaacctggactctcatgtaccacgagatcaacacatcctcttgaaaggccccatgcactataaacctcagaagtgaacatatattttaacctayttcttaaaatttatacttaggaaataatcacacactttttaaagyagtttggtataaacttttcattgcagcattatttatattagttaaaatgttagagtaacctaaatattttaaactatggtttggaaataatctactagtaggaaaaagatgtgttcaaatgaccattataaagaattccctaagaaacataaaayagctatgcagaatgaaaataagtatatccatacactggcatggtattcagccataaaaaatgacagcataaagaagcacttaatgactagaaagagatgtattttacgtggaaaaagaatcagatgaayggcatatatggcaagatctcactttattaaaaaataatacacctatgtagtgagggccaggctgaggctgagagaaatacagtgtataacatctttgtcttactcttctctttggataactggactcctttacttttcttcttggtatttaaaaatgttacttttactagaaagtttamgagcttcagaatctaagtttacaaatgacattggtcacacatttattgctgtttatccactttaagaaacagttttgctattttgtaaaacaaattgggaaaccttccatcttatttgaaatctgtaataaacatggaattggaataggaattttcctggaaatatgaaaaagattagtaaaatagagaaaacaaaaaatataataatacacctatacctgtatytattttttatctctgtttctacttctgtaacctctctgtatccaaatcctggtaaatggcctcaagtcttcttggaaaaggctaggggaagatttacaatacatgcttttgaytgygtagcatggtgcttcctcaagagaatccagtctcccatccgttggtgctgctctgggtctataaactattcaagtctaggaattgttgatgaacaatgaacttcttttgcaataattcaagtcagacttctattcacttgacctaaaactcttacacttatacaaatcaagtaacactttagtcggctatccgtctactttggttttagagactccatgatcaattagcccaataacaatgtcctcttcaatcaaatcattctgattgctgtttcagctcaaatatgcattacaagaacccccattgtctctggcaattaagtgctgccactgggactctgccaccctgaggtcctttggtccccaagtgaattcagagaatccagttcaatggcaacagttcccattgtcattcctggcctacagagaatgaaccgttgcagaggatgctgaaactccccatgtgaatgtatttctcaagcctctggtaaaaggtctgtcttctgaaccctctactcctgcactgtgcctcaccagctctatccaaggatacaactttcagagtggaatggctgttgcttaacttctgcctctcaaatatcaggctaatttctcatgctataaccctagtccagaaccgtacagagaaagtaagtctggaaaacttaattccaaattggcctggttgacatggtgccaaaccaccaaataattataattttatttaactctttgtcttcttttctttctttccttccctccctccctcctttcctccctnnnnnnnnnnnnnnnnnnnntccctccctccctccctccctcccttccttccttccttccttccttccttccttccttccttccttccttccctctttccttattttctttcttctttaccacgctggctaggaccaccagtataacattgaacattggtagcaatagatgtcatccttgtcttgttccacatctcaaagttaaagtttaaaacatttcaccattaagctggtgtttactgtaggcttttggtagataaccatttttgaaataaggaaattatcttatatattcttcattgctaaaaaatttatgtctttgaatcatgttgaagtttatcaaacactttagttacatatattgatgtaatcatatctgtttctctttttctgttaatgcaacaaattgttttgagtacatttttgaaaggcaaatgattttaaatttcaattttacattcttaaaataaatcaactcagtcataatatttaatcatttttatatatggcaaatatgcttttatgatatattttagatgtttctattaaaatataattcatgtatcataaaagttacctttttaaattatacaatttagtggtgtttagtatattcacaaagttgtgtgttatggtctgaacgtttgagtccaccccaaatccatatgttgaaatccttacccctaaagtgatgacattaggaagtgaggcctttgaaagatgattagggcatgagagcagagccatcacgaatgggattagcgtcctaataaaagaggcccggaagagctcctttggccctcccaccatgggaggagatgctgaatctgccagtgttggtcttgaactccccagcctccaaaactacaagaaataaatttctgttgtgtacaagctaaccagtttatagtattttgttatagcagcccaaatagactaagacattgggcaaccagcaccgccaattaattctagaacactttcatcatcccattcctaacatattttagagataagactataattttctttcttgtaatgtccttaataagattttgatatcaaagctatgacagtcttataaagccagctggtagtgtttcatatatttgtttccttgtaagggtttatataagattggcattatttcttctttaaaaataattcaccagaaaaggtatgtggcctggagtttacgttcttgggaagtttttttttttccaaccattttcctgtaccatgtagacttttggctgaagtataacatatatatatayatayacacacacacacacacacacacacacacacatatatacatatatacttatatgtatatatgtatatatacgtatatacgtatgcatacgtgtatgtatatgtgtatatatgtacgtatatatacatacgtacgtatatatacgtgtatacgtatatatacatatacatatataggtatatacatatatatacgtatatatacatatacatatataggtatatacatatatatacgtatatatacatatacatatataggtatatacgtatacrtatacatatataggtatatgtatacatatatacacactatatatatatacacatatatatagtgtgtatatatgcacacatcttaatcatgcagttcaatggagttttacaaagtaaatgtatccatgtaaacgtcactcagattaagatatagaacattatcagcaccccagaagccttcccgatgccctttcccagttatcttcccaaagaaaccactattctgatttataacactaatagttttgttgcttcctaaattttatattaaaggaatcaaaaaatagatactcttttgtgtccagcttcatctcaatgttatatttggaagagtcatttttgtttttgcaggaaggattgttgggtcttctttattattatgttgtatttcattgatgatcttgagtaccttttcacgtttgtgaagtgctattccaaacttttgcctattatttattagtttgtctattgttttgtagaagttctttaaatattctcatgttttctaataaatgtaacacaaatattgtctttcaggctgtggcttttcttttttccttcttaatgatgtcttttgtttatgaaagttctacattttaataatattcaatttatgagtcttcttttttccagttactgctttttctattctacttaagcaattgggccaagtgaggtggctcatgtctataatcccagcattttggaaggccaaggcaggaggattgcttgaagccaggagttcaagaccagcctgggcagcagagtgagaccctgtctctacaaaaaaaataaatatataaaattagctgggctcagtggcacatgcctgtagtcccagctacttgggaggctgaggtgggaggatcccttgagcacagaggttcaaggcttcagtgagttatgatggtgccactgcactccagcctaggtgacaaagccctgtttcttatggatgggcaatagatctaatatcatctattaaaaagactattccttgcatagtgcaatgcgacaccaccatgaccataagtcaggtgaccttatgagtggatctcattccagagaggttctgtttcactggtttatttgccatactataagcactacattaagattttaattactatagcattacattaagatttgatatctggtagcatatatctcctaactatgtgcatcttcaagatttacttggtgattcttggccctttgcattaccatataaaatttagaatcagcttgtcaatttccacataaagaatcctacttgaatttgtattaagtttctgttgactcagtagatcaatttgtggacaagtaacaaatttacagttttgaagtttaaatttatgaatatgatatatcctcccattttgaagtcttctttaatttcttttaataatatttgttaatgtacattatagaagtcatgtacctatttcattatctttattctgacatattatttttaaaatttcattctttaattatttacttcttagatatgcacctgtttcatctcagctccagcaaatttgttaaatttacttataaattgaatagtttatctgtagattcttttgaatttgctgtgtaattatgtcatctatgaatctgacaaagtttttacatcttttcctttcttatgtcttttgtttatttctcttgctttattgcattggctagaacctccagtacaatattgaatagaagacatgatacaaggcttttaatagtcctcataaatcatgatgtatgctgtagatttttgcatgatatcctttattagattaaggaaactcccctttctttctaattactaaaagatttatgaatgttctttctaattgatcactgcatgtattgagattatcatgtttctttttcactctgttaatgtaatatattacattgattgatgtttaaaagacaaacgctgaattcctagaataaacctatgttgcttgtgatgtgttatagatgattatcctatgtatgggggatatgcgtgtgtgtgtgtgcaggattgctcatatttttattgtaacattgtaacattgatttaatatttaaaatcagtcaaggtaaacctcactttgatcattgtatcatcctttggaaatattgctggattcagtttcataatattttgttcagaaaatttgcatttatattctcaagagatcttgggttataatttgcttttattttaatgtccttatcaggtttgggcatcaagattatgttggcctsataaaatgtgttaaaaattatttattttttctagtgtctggaacaatttgtgtaacattatttttccttatatgtttggaagaattcagcagtgaagcaatctggacctgagggtttgttgttgttgttgtcaggatttaatatctttaatagctgtaaaactattattttatatcttattgaattagtttgggtaagttatatttttcaaggaatttactcattttatttagatttcctaggttatcagcataatgctgtttattatagtctcatattagcctttggatgcctgtaagttctgtagtgatacccttacactcattaatttctgatattggtaatttcttttgcttctttttccttgattagttttaccggggctttatcaattttactaagcttttcagaaaaacaacttttaactttcttgttttttctttagtttatgactattttctcttttattgatttctgctttaagctttgtgtattcctccagtcctaaattcttgatactaattaatttgtttccaacctttatttttctaatatgtacatttaacctatcaatttttctctaaaactgttttatttatttccaacaatctttatatttttattatcattgtacataaaagctttctaatttcacttttaatatctcctctgacccataggctgtttagaagggcattgcttaatttctaaatatttagagatcttctagttatcattctttcattaatttaatcatttgagacatggtttattgcccagaatatggacgattttggtaaaatgttacatatgcacttgaatgtacagttattttgcttcattttctagaaatgtcatttaggaaaatgtggtttagaacagtctttttttccccctccacttgttctctcagttatggagaagcatgtgtaaaatatctgtattagtttcccagggctgctgtaacaaattaccacaaacttagtggcttcaaagaagagaaatttactctcttaacagtttggaggccagaaatccagttaagatgtcaataggattggttccatctgcaagctgttctgtgcctctctccaggcttccttccagtggctgctggcaatcgttgatgttccttggcttgtagatgcatcatttccttctctgtctccatcttctcgtcgccttctcctctgtgtgtgtcctttgctcttctgtctcctataaagacactggacatggatttagaggccaccctggcaatccagaatggtcacagctcgagatcattaacgtgattgtatctacaaagactctccaaactgggtcatattcacaggtttcagagatcaggacacagatattttttaaggaggacagtggttattcaacccattacaatccccaactacaactatgaatttgtctgtctttcctctttgttctagcaatttttactttatgtattttaaacatgttattaaatgcatgaaatttttggtttattctttctgctgaattgactattttatcataatgaaatgtctctctttacctctcataatacttcttaccttaaaatctactttgcatattaatacagctatataagctttctttattgtttttatattatatgtgttttaaatcttttactttcagcccttctttgtcttatatttaaagcttgtctcttataaacatcatatagtaaggttttgttgttttattcagtcttagttgttcattggtgtgtttggaacattaaaatttaataataaaaattaaaaataaataaatttaatatagttactgatataaagtctaagtcttggtatttgtttcatgtgtttgttcctttattcctcatttctcacattttttaattcatcaagtatttttattattctatttccccagtagcttttaagttatattccattttttattcttaaatgactactctagagatagacatccttgatttactatagtctgctaaaattgtacttttaccactctccaaacaacgcaagtaccgaaactattaatagttaattccatttatgtcctccccctctttttgtattgttgccatacgttttgcaaaaagaaaagcttcagctgaattaaatttaaaagagtttaattgagcaatgaacgattcgcaaatcaggcagcctcccgagccaaagtaagcgcagagactccagcccagctgcaatgggggaagaggatttaccgacagaaaaaggaaactgacgtacagaaaacagaagtgaggtacagaaacagccgattggttatagctcagcgtttgccttatttgaaaacagttcaaacagttggccacatttgattggccaaaactcggtgattggcgtaagagtagtctgcggtctgtttacatcttcacttgttatagtttgcagtttacagagaaacctttaggctgagcttaaactacgtaaggctttaggctaaacttgatttaacgatttacatatattctatatttcaaagacactgttgtctttataaaaacagtatttatttatatttacaccttagtgaattcttagaatttttatgttgcctcagcatccatttagaatatgtttagctttctcatgccagaagcagggcttagtcacccttaatgccctttctagttctgtacctcctcccaattttkcaacgtggtcgagccagatatctgccttatacaactgcctcctggtgaccacctctctatgggacagctagataaaacctacttgactagcgtccctgacctctgtgccctgcatggacttcgcagatatgctgccgtgaccacctctcagtcgcagcacgactgcctggaacatgtgcctgctttctttaaactcaccaattagaactccccatgggagataccttggcttgtagatgcaagatgctgggtcatactctggtccccaataaaggcattggctgatgggtccccttctctctctctgtctcctcgcgctgaccaacctctgtgtgatcttcaggcgtgccatacccccagcccgtaataaaatctttactgccatcttgtgtttcttgtaatgactgaagaggttttctctatcataaagatcctaaatgaaaacatacccgcatatgagctctttctggtgtgtttccttcttattgcaattctgtcaattctatatgaaactattttccttcagcctgaaaaagtctctttggcatttttgtattgtagagcttctgacaacaaattctttaaacatttttctaagtgtggttcctctgaaggttattgtccatgtttcctggctgcttttaaaatggattacactttaaaacagattttttacaatattattgtgttgtgtctaggtaagaatttctttgtattgcttgggtttgcacatttttttttttttggttgttttttttttttttttttttttttgacagaatttcactcttaycacctgggctggagtgcagtggtgggatatctcggctcactgcaacctccgcctccggggttcaagttatcctcccacttcagccttccaagtagctgcaattacaggcctgtgcctccatgcctggctaatttttacccttttagtagagatgggttttcaccatgttgaccaggctggtctcaaactcctgacaagaggtgatctgcccacctcggcctcccaaactgctgggattacaggcatgagccaccgtgccaggcctgtatagccttttgaacctgtaatttaatgatgtcttgcatcagtcttggaaaattctcagttattaattcttcaaatgttgtttatgctcagttctctctctcttctcatcgagggacttcagttaaacatgctaggctttattcttctatgtatttagtctgtattttttaatctttttatatattggtgcttggttttgagtattttcttctgtcctagcttccggttcattgattttctttcagagtctaacctgctattaatctcacacaaattcttaatttcagcaatcatattttacttttacaattctagactttttattttccaaatctgccctcttccctttttttttttttttttttttttttgagacagggtctcactttgttgcccaggttggagcacagtagcataatcatagctcactgcagcctcaaccttcacaggctcaagcaattctcccacctcagccacctgagtagctgggaatgcaggtgtgcaccaccacacctacacatctggataatatatatatatatatatgtatatatacttttttttttttgtcgagacagggtttcgccatgttgcccaggctggtctcaaactcctgagctcaaacgatccactctcctcagcctcccatagcgttagaattacaggcgtgagccaccacatcccaccctgttctttttaatagtttctagttcttacaagtttcaattatacccttgaacaggtctgtagttctaatgggtcagtttctgtcatcagtaattgtgtgtgttattttatctctccaaatatctggttatctttgattgtgtatcaggaattctatttgaaaactgtgtctgtagaaataatttcaaggccttagataacccatcttcttccagatggaatttttgtcattgtttctgcaggcatctggggacattagcaatctaggaccactctaattcagtctcaggaactgtgattttccagggccacccacagtaccagtacttgaagtactagttccagtctctgagacagcaaatttattttcagttaaccctgattaccagggcctagttcttgtggcctcagaacacatcagaaggtattaccaggccttccatttggggcaggccctggacttccattgttgtcccttaacttcatgagaaaatcaaaagtctgttcagcctctcagttgccccgtcctgattcagctgcccattcccaaacaataagcagcccagktgccaagcccaaatacccagctctcaactggattctcatcttctcctagatcatggcccaggaatgcttcactagtttgttagctttctgatgctttaacagataaatatttttaattctccagtatttctagcctttcttgagggtggatggttggagcaatattttatttgaactgttgagattactattagtagaagcagagcctgaaaaatttttatttttaattttaattcattcatttctaaatttatccaattaaattcactcagttttaatttcaagtgttttgggatttgggttgaagaaattttgttctagtttatagcaacacagtatactatgtactactgctatactttaaaatgtatttaggggtttttgtggactaatatatgatcacttttacacagatatcatcttatgatatcaaacttagatttgatgaaatgagttggtaagcttcatrtcttttatatgttgtgaaaccttgaaattacatttggaagtatatttttgaatgaattttggtaatttgtatttccatttatatcatttagattttcaaaatatttaaccccctgtagtctacagttttataaatattctcatatacataaaaatatgyttaaattctttttcctactgtgtatatttgtgttttctctcatcccttatactttatcttttagcaaatgtttttgtattttatttttctaaaaaagctaaccttggttaataacaaaaatggaaattaagaaagcaaacggaaaagagtaggagaaaactgtrtaaatactataacactatgatcaaagagctatttaaaatgaaaagaatgtggattgagttaatacatgcatgcaaatactataggaaatcatatcagtaagaaaggcaggacacatcatattatgcccattgaagctacaactttataaaaatgtacctatgtgttagcaaagattaaaagcaaataatgaatgtaaaaatagctatagtttagtgactcatgagatttctgtcattcatwatttaaactgactgttatttatcctgctcttcctttttccaggaattccttgtgggctaccccccaccatcaccaatggagatttcattagcaccaacagagagaattttcactatggatcagtggtgacctaccgctgcaatcctggaagcggagggagaaaggtgtttgagcttgtgggtgagccctccatatactgcaccagcaatgacratcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccaggggtgagtctgactgaggcctagaagggccctgccagtgacatgcgttgctgttggatcaggagattagtatttgttcagggggagggatgtgtgctgagcagggtcgaggagcaaattttctaggtagtgaacatgaaattcagaaggtgtgtgtacatgcacatgtgctgaaattgcgaagcaaagctcaacctgggcaagggatatgatgtttctttggggttcttataaacagatctatcaattacctttgagtataataatggttgatacaaaatgagtgattcctctggccgggcactataatacaggctacatgtgaattttaatccttaaaacaaagttattaggtagttaccagttgttctatgtttgtctgtattgttttgcttgagatactgtcttgatctgtcactcacgttgaactgctgtggtgccatcatgacttacttcaacctccgcctctctggctcaagcaagtctcctgcctgagcctcccaagtagctgggaatataggtgcatgccaccatgcctggataagttttttatatattttttgtagggatagagtctcaccatgttgcccaggctggtctcgaactcctcagctcaagcaattcacccaccttggcctcccaaagtgctgggattataggcatgagccaccgtgcccggcctctatgttttayagagaatatgtgccttagacacatcagataacattctgagacagtaacttgcagacaaaactggattgcaagtccacctcactccagagccttggctttgctcatcagcattcagtcatgaaatcaaaacttactctagatactttcaaggagggagggatttcatgcaggttgtattagtctgttctcacattcctataaaaaactacttgagcctgggtaatttataaagaaaagatgcttacttgactcagagttctgtaggctgtacaggaggcatggctagggacccctcaggaaagttacaatcatggtggaaggtaaagaggaagcacgcatatcttcatatgcttggcaggagagagagagagagcaaggcagaggtgctacacactttggaacaagcagatctcgagagaactctatcacaagacagcactagggtgatggtgctcaaccatwagaaaccacctccatgatccagtcacttcccaccaggctccttctccaacactgggaattaccatttgacatgagatttgggaggggacatagagccaaaccatatcgcagctaataggtcacaaaaatgttagaagggcaggaaaagcaataggacaaaggcaaagttacgagagatcagggagctgctgtggctcccagtctacagcacaggagcctggagtgatggtgaaatggccagcccctcccactgagcaggcagctccctgtaagctgctagtgctgcaggagccaccactgctgccagaatgcagctgatattgctggagccaaagtcattggcatcgttacaattgaagctgtagctactcactgaagccatctatactgccactgcctgagccacttctagaagtagaacagattctgccatcatcctgctttttaatttggtatatatgcctccaattggcagaacctaaccagagcccagctatcaaggaagatgaacaattgtagttttaaggcttcctttgctagctgtcaaaagacagtgcagaagtgtgaggctgggggccaacagaaatttaaccagcacagcacctcaatattacatcaccaggcattgattagtccagggaaacactgggtgatgagccctgaaaatggacattacagcatcagagtatttacaaactccytaaagaagtcatttttctattccaatcccccatttgatgcttgagaaagctgaagtccagaaaagggaactgatctgctcaaagacaaaccgaaattattttttccattttataacagttttatgtaatttagttgagatccaaatgtgttctgatttcctgagttccaatcaactatattaagagagagccagcgctgcccttacaatatgttgcgtaaatatacactctcatcatggtgacagtaggtctttcagattttgttcgacagtttcccaccttctcactgaagtgaaatgaatgactaggcagcaccttgctacatagcatgaggagaggagacccatagttctttaccatcctatgtcaggtggccgctgagagaagacttgaaaggagatgagcatagatgtatggacgctctttgttgcaccagtgtgataggtgatggagggacctattagatgrgacatgggcaggggcactcctttattgcttaaaatgcaagactaaattggtgatgcctttctagaaaggaagtatgaagatacraaaatccatcattcctcccaattttgtactgggtgaacagtaattggaagcattctagaaggaactgtccattgtgaaatcttagttgcatactttagatgaaaaacaatgaattggagatacctctgttttagtcacagttgtgccacgtgtcagttctatgactgatggcaagacatcttccttgccctgtgtatttagtttatcaatgtaataaggctgttattctaactttattattatatatagattcgtaattattattcccttggccagtttaacagtgagaaaaaagttgttttcacacaattagctgtactttgtttctctctccccagtatgtcagccacctccagatgtcctgcatgctgagcgtacccaaagggacaaggacaacttttcaccygggcaggaagtgttctacagctgtgagcccggctacgacctcagaggggctgcgtctatgcgctgcacaccccagggagactggagccctgcagcccccacatgtgaaggtgactagactcttatctggcttgatatttttagcttgcgtctttattctccacatgccagtgatttctgttcatttttctttatctccagtgaaatcctgtgatgacttcatgggccaacttcttaatggccgtgtgctatttccagtaaatctccagcttggagcaaaagtggattttgtttgtgatgaagggtgagtatgagcttgcctgacctgctggacattgaaattggggttgggaatcagtctaaaaaggggagatttggtgtggcacacacacacacaccttcagagagatgaactttcgaaagtatacctaggaagaaaggaaagaaacatatagaactaataacatgagatatgaagaggaaactggaacatatattaactggcaagttcaaaggcaagtataactactggttatgaatatataagtaacacattaagcaaaaaatatcagccagaaacggtggctcacccctgtaatcctagcacctttgggaggttgaggcgggcagatcacctgaggtcaggagttggagaccagcctggacaacatgatgaaaccctgtctctactaaaaatacaaaagttagctgggtgtggtggcatgtgcctgtaatcccagctattccggaggctgaggcaccagaatcacttgaacctgggagatggagtttgcagtgagccgagatggcaccattgcactccagcgtggacaataagagtgaaactccatctcaggaaaaaaaatcatattttacaagcaaaaaggaatatgagtaatttagagagtcccaggaaaaaactggaagtaacaaaagcttattataaaaagctaggatcatttgtgaatcatttcagtaaattctttaaatcgtcaacagtgaaatttgtaataggactgaaaatgtaaaaatcagcattttttaaaaaaatccagccatatatcatctggttaatcatgggctctgggctctgagctggggtcctgatggctgctgttaatatttccrgcaagctcattaccttgtttatgtccacctagtgctcttcgcagggtgcacatctctacacgggagctgaccggcatgggcaacaaagcacctgatcccaaaatgtaacacagaatcttggcagcctccaaatgccagcacccagtaagagttaggagggcatcggggtccagcagacattgagaattttcgacaattgcatgcaraaaataagtcctctcttctttcctttttcccctagaatattcatgcttactcttcagcagcccaaattgcccttttgagccttcttcacgccatcacagatgtggagatgaaaggacagtctgttctctcgccagctatttcccacttttccactccaaactgggagctgttttacttgctgttccagggtcagagttaggaaggcattacattagaagactgggtttctaataacaacaatgagtgatttatcaggttatcatggagtaatcagtgaaactccaagcctgggtcctgggtcaaggggatggcgcctatgtcatgaccacctttttcagttcaagcaggactatcatgtgaccaagctactgcattttgccattctatattgttcccttctggaggctgtgatttttccagaataaggtagcctgtgcaactctgccacctgctggcctaaggtcctaataatcctgaaattggggctgggccttagattgtgaactaagggttctcttggctgaaacagctcacactattcactcctattttcttctttagatttcaattaaaaggcagctctgctagttactgtgtcttggctggaatggaaagcctttggaatagcagtgttccagtgtgtgaacgtgagtagcaggagtaacatttcaggccagtctctcccttcatctgttcagtatttgacccatgacctcccctaatgtggttcttcaattttctagtttgaattattgatttgaaaattgcttattttaataatgtttggttgtgaatcaaatgtatacatcacctgtctttggaaccatctgatctgtctctgtccttctgtattctgtgttctagtgcgataaatcctatggtagcatgattctaggtcaggagagattagataatgtgaagccttaacaatttgctttctttctctctttcttttgtttcttttttctcttccttcctttcttcagttctttcttcccttctctttctctcccctttcttccttccttcctccttctttcttttccattttgttcttccatcaggtgcagtctacaatttttgtatatatttgataatacacaaatattaaacatgcctttatttaatcaatatttattgatcacatactttgtgcctgatgttcatctagccacaggagttatatcagtgaacaagatgaatgaattccctgtccccatgttgtttccactcagttggggaaagggacaagaaaaaaaataaatacgatgctatgaagatagtagagcaaagcatttaggcatgagggaaaagtgaggagcaacattagacaaggcgagcagtttgagactccttaaattctcaaaacatgtacytaaataatttatgctgagagattcataaataatgtcatttttaaaaatttattatacttttaagttctagggtacatgtgcacaacgtgcaggtttgttacatatgtatacatgtgccatgttggtgtgctgcacccattaactcgtcatttacattaggtatatctcctaatgctatccctccccgcttcccccaccccacaacaggccccggtgtgtgatgttcccctttttgtgtccaagtgttctcactgttcaattcccacctatgagtgagaacatgtggtgtttggttttttgtccttgtgatagtttgctgagaatgatggtttccagcttcatccatgtccctaaaaaggacatgaactcatcaatttttatggctgcatagtattccatggtgtatatgtgccacattttcttaatccagtctatcattgatggacatttgggttggttccaagtctttgctattgtgaataatgcagcaataaacatatgtgtgcatgtgtctttatagcagcatgatttgtaatcctttgggtatatacccagtaatgggatcgctgggtcaaatggtatttctagttctagatctttgaggaatcaccacactgtcttccacaatggttgaactaggttacagtcccaccaacagtgtaaaaatgttcctatttctccacatcttctccagcacctgttgtttcctgactttttaatgatagccattctaactggtgtgagatggtatctcattgtggttttgatttgcatttctctgatggccagtgatgatgagcattttttcatgtgtctgttagctgcataaatgtcttcttttgagaagtgtctgttcatatccttcacccactttttgatggggttgtttttttcttttaaatttgtttgagttcattgtagattctggatattagccctttgtcagatgagtagattgcaaaaatgttctcccattctgtaggttgtctgttcactctgatggtagtttcttttgctgtgcagaagctctttagtttaattatatcccctttgtcaattttggcttttgttgccattgcttttggtgttttagacatgaagtccttgcccatgcctgtgtcctgaatggtattgcctatgttttcttctaggatttttatggttttaggtctaacatttatgtctttaatccatcttgaattaatttttgtatacagtgtaaggaagggatccagtttcagctttctacatatggctagccagttttcccagtaccatttattaaatagggaatcctttccccatttcttgtttttgtcaggtttgtcaaagatcagatggttgtagatgtgtagtattatttctgagggctctgttctgttgcattggtctatatctctgttttggtaccagtaccatgctgttttggttactgtagccttgtagtatagtttgaagtcaggtagtttgatgcctccagtttgttcttttggcttaggatagacttggcaatgcaggctttttaaataatgtcatttttaaaaaatgagccccatatgttcaataatgagtagactactgatttctcctagtctccccatttataatttccccaatagaagatagaactttgcttcatttcttgattctaatgattgggaaatgtgtttctttagaaaaccatgaaattttactaaaatgtttatgttgttagaaatggacatcttacagtgctttttagagtaaaattttggaagaacataacttatatagagattcttgctgtctaagaaattcagtgctccttgaagcagcatgacaaatttctgttctaccatcatgaatgaaagctcattgattggactactcaagctttctcttatttttcataactgttgctagttaaagtagcttcttccaaattccagttctaatgaaaaatgccaattagaaatgaggaagaaactgttctaaacaaatcagcagatgctagaaaggagaaacaacttgaaacctgacccagaaagttaaaagagaaaataaatcatcaacagacctagacattttcaaaagcaaagccatctgaatccatttggagttgttttttatcatggccttactatgttttaattcactgtgacagggctattgttatcactgagattgatgatcaatatcaagaagtaatcagcgaaaggtttcacctatttaagatgattagcacacatatgtacatttgagaaatatttcctaagaatgcaggctccttcctcagcactctgtccccaggatcctgatgagtggctgacacaggacaagtgcttaattaatatatattgactaaatgaatgagcaacccttcaaaatggctatttttctttttcaaatgttttgctacttcattaaagttgtaaagtttccattgtccaggaaccgttactatccggaagattcaggatagacaagtctcttttgtactttgcaatacactttcattgatatctcatttaatccaactcttcaaagtcctaatgtctactgtcatctccttagcatattttcagcaacaccaatcatagcaccctgtaattgcagaatacctctggtgaaactcctgaatgaaacttagagctttyrtrttttttctagaaatcttttgtccaagtcctccagttattcctaatgggagacacacaggaaaacctctggaagtctttccctttggraaarcagtaaattacacatgcgacccccacccagacagagggacgagcttcgacctcattggagagagcaccatccgctgcacaagtgaccctcaagggaatggggtttggagcagccctgcccctcgctgtggaattctgggttagtgctcatttccccacatcccaaatgggttcagaatatctaacccaggccctccatatttccgtaattacaatgtggtatttatttgtgcatttgccacaatggaatgccaaaccaatgatagatggttctaaggtaggtcaacacataagatcctgatgacctttgcagatggagggactgatgaaaaaagagggaggcggtgagtggtgggaaagtccttcattagaatcatatgaattaaaaacagatgcctgtgaatctccttattgaaatgtttggtttagaaatctgacctagaaaatcggtggctccttctgccaggaaacgtcttgagttcccgcccatgcttgacagcctctcattggagttttgatgacttgaagtacaaggaaaccagacaggaaaggtggaacctgggcagaaaaactctttctggcttcctaaaaatgtgaaaaattaaatgggagctatctttacattaaattatatgagcattagctgagcgtggtggcaattgcctgtggtcccagctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccaggagaaattagagcagaaatatctctttcaatagtgagagaataggaaaaagaagtagaaaagctgggaacaataggtaaagtttaggctaggccttagacttctcctgcattgtaatccctctggtttgccacatatgcatgctgtcaggaagttgatgaggtatgtacagcacaatttattttccattttttgcctttaggcaccgactcattggtcactcatctgctgaatgtatcctctcgggcaatgctgcccattggagcacgaagccgccaatttgtcaacgtgagttgaaatctctttccccattcaccccaccgtttaatcctagagttgtcctcctagaattacaaagaatggatctcatccctcttggaaatggtatccttctcatatttgaagaatccagtcatatccttaaaatggctcacagcattccaaacttccaccttcagctagaaatgcttttttattttttcttatctcaaggtctaattttttttaaactagtctttagctcacttaaacagtcccccaatttcatcctctgttgggtgaacacctcccagtttaaagagcattttatttagtgaagtcaacaaatacaaagtcagtgaaagaaaccccatatcctctctgcaagctcttagtatcacatcagatattcaagccatgcagctctttcttccttcttattctttgtctaaacaggatcatgccatcttccctgtgagttgtttggaagatgagctttctacattttggggagcaaagacgaatgagcaattgcaagctaacaaggaatataaaatgtgtataatcctgggtttagtgatggtgtgaggaaatcagcaatttcaaacccagttggtgggaggataagtgggaacaaactttgtagaaggccaataaactggctgggcactgccctacggtagagtaggacacagtattcagttcttccaagatcagacgagattgggcgcatttagggtggtatggttgtagatcagtatccagttctttttattatttctgaatctgtaagtatcatgtttattatatgtaatattrtatatttgtactttgtctttgttagttcttccagagcttttgttcttattatttaataaagatgttatactgagccacatgtggtgactcaaacgtgtaatcccagcactttgggaggcctaggtgagcagatggcttgagtccaggagtttgagaccagcctgtacaacatactgaaacgctgtctctacaaaaatacaaaaactatacgggcatggtggcacatgcctgtagtcccaactactcaggagactgagaggtgggaggattgcttgagccagagaggtcgaggctgcaatgagccatgatcgtgccactgcactccagtctgggcagcagagcaagaccttgtctcaaaaaaaatgctatgctgtatgctttattatattaatatccaatagaataaagacacatgccttctatatagagagaactaaattaataatggtgagataacagttaaattctcatttagcaggagaaataaaaacatagactataggctaggcacagtggctcatacctgtaatcccagcacattaggaggctgaggtgggcagatcacttgaggtcagtagtttgagaccaccctggccaacataatgaaaccccgcctctactaaaaatacaaaagttagccgagtttggtggcrcatgcctgaaatcccagctactcaggaggctgaggcaggaaaatcgcttgaacctgggaggcaagggctgcagtgagccaagatcacgccactgcactccagcctggggaacagagtgaggatctgttaaaaaaaaaaaaaaaaagtggactctaataatacatggacacatttagtgaaataaacttaactgagtagagcagaacttataatattttaaaactgtaagaacatgtctgtacmttagcaaatagtagatgagaatagtattttcaatatttacttctggtaatttggaattaaaaaaaaaacttttgggaaaatttacaataaagtatgattttaacaaaccagkctaggcgtggtggctcacgcttataatcccagcactttgaaaagcagaggcatgcagattgcttgaggccaggagttcaagactagcctgcccaacatggccaaaccccatctctactaaaaatacaaaaataaaccagacatggtagtgcatgcctgtgatcccagctactcgggaagttgaggtaggaggattgcttgacctgggaagtggaggttgcagtgagccatgatcgtgccactacactccagcctgggtgacagagcaagactctgtcccaaggttttgtyttggttaacttgctgtccctttttccaggaattccttgtgggctaccccccaccatcgccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggcccggcccctcagtgcattayacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccaggggtgagtctgactgaggcctagtagggccctgcaagtgacatgcgttgctgttggatcaggagattagtatttgttcacggggagggatgtgtgctgagcagggtcgaggagcaaattttctaagtagtgaacatgaaattcaggtgtgtagacatgcacatgtgctgaaattgcgaagcaaagctcaacctgggcaagggatatgatgtttctttggggttcttataaacagatctatcaattacctttgagtataataatgkttgatacaaaatgagtgattcctctgcccaggcactataatacaggctacatgtgaattttaatcctkaaaacaaagttattaggtagttcccagttgttctatgtttgtctgttttgttttgcttgagatactgtcttgatctgtcactcaggttggactgcagtggtgccatcatggcatacttcaccctccacctccctgactcaagcaagtctcctgcctgagcctcccaagtagctgggaatgtaggtgcatgccaccatgcctggctaagttttttatattttttttgtagggacagagtctcaccatgctgcccaggctggtctcaaactcctcagctcaagcacccacccaccttgggctcccaaagtgctgggattataggcatgagccactgtgcccggcctctatgttttacagagaatatgtgccttagacacatcagataacattctgagacagtaacttgcagacaaaactggattgcaagtccacctcactccagagccttggctttgctcatcagcattcagtcatgaaatcaaaacttactctagatactttcaaggagggagggatttcatgcaggttgtattagtctgttctcacattcctataaaaaactacttgagcctgggtaatttataaagaaaagatgtttaattgactcagagttctgtaggctgtacaggaggcatggctgggaaagttacaatcatggtggaaggcaaagaggaagcacgcatatcttcatatgcttggcaggagagagagagagagcaaggcagaggtgttacagactttgaaacaagcagatcttgacagaactctatcacaagacagcactagggtgatggtgctcaaccattagaaaccacctccatgatccagtcacctcccaccaggctccttctccaacactgggaattaccatttgacatgagatttgggaggggacatagagccaaaccatatcgcagctaataggtcacaaaaatgttagaagggcaggaaaagcaataggacaaaggcaaagttacgagagatcagggagctgctgtggctcccagtctacagcacaggagcctggagtgatggtgaaatggccagcccctcccactgagcaggcagctccctgtaagctgctaatactgcaggagccaccattgctgccagaatgcagctgatattgctggagccaaagtcattggcatcgttacaattgaagctgtagctactcactgaagccatctatactgccactgcctgagccacttctagaagtagaacagattctgccatcatcctgctttttaatttggtatatatgcctccaattggcagaacctaaccagagccyagctatcaaggaagatgaacgatttatttttaaggcctccattgttagctgtcaaaagacagtgcagaagtgtgaggctgggggccaacagaaatttaaccagcacagcacctcaatattacatcaccaggcattgattagtccagggaaacactgggtgatgagccctgaaaatggacattacagcatcagagtatttacaaactccytaaagaagtcatttttctattccaatcccccatttgatgcttgagaaagctgaagtccagaaaagggaactgatctgctcaaagacaaactgaaattactttttccattttataacagttttatgtaatttatttgagatccaaatgtgttttgatttcccaagatcagatcaactayattaagagagagcctgagmtgccgttacaatatgttgtgtgaaattacactctcatyatggtgacagtaggtctttcagattttgttcgacagtttcccaccttctcactgaagtgaaatgaatgactaggcagcaccttgctacatagcatgaagagaggagacccatagttctttaccaccctatgtcaggtggccgctgagagaagacttgaaaggagatgagcatagatgtatggacgctctttgttgcaccagtgtgataggtgatggagggacctattagatgggacatgggcaggggcactcctttattgcttaaaatgcaagactaaattggtgatgcctttctagaaaggaagtatgaagatacaaaaatccatcattcctcccaattttgtactgggtgaacagtaattggaagcattctagaaggaactgtccattgtgaaatcttagttgcatactttagatgaaaaacaatgaattggagatacctctgttttagtcacagttgtgccatgtgtcagttctatgactgatggcaagacatcttccttgccccgtgtatttagtttatcaatgtaataaggctgttattctaactttattattatatatagattcgtaattattattcccttggccagtttaacagtgagaaaaaagttgttttcacacaattagctgtactttgtttctctctccccagtatgtcagccacctccagatgtcctgcatgctgagcgtacccaaagggacaaggacaacttttcacccgggcaggaagtgttctacagctgtgagcccggctacgacctcagaggggctgcgtctatgcgctgcacaccccagggagactggagccctgcagcccccacatgtgaaggtgactagactcttatctggcttgatatttttagcttgcgtctttattctccacatgccagtgatttctgttcatttttctttatctccagtgaaatcctgtgatgacttcatgggccaacttcttaatggccgtgtgctatttccagtaaatctccagcttggagcaaaagtggattttgtttgtgatgaagggtgagtatgagcttgcctgacctgctggacattgaaattggggttgggaatcagtctaaaaaggggagatttggtgtggcacacacacacacaccttcagagagatgaactttcgaaagtatacctaggaagaaaggaaagaaacatatagaactaataacatgagatatgaagaggaaactggaacatatattaactggcaagttcaaaggcaagtataactagtggttatgaatatataggtaacacattaagcaaaaaatatcagccagamacggtggctcacgtgtgtaatcccagcacctttgggaggttgaggcaggcagatcacctgaggtcaggagttggagaccagcctggacaacatggtgaaaccctgtctctactaaaaatacaaaagttagctgggtttggtggcatgtgcctgtaatcccagctactccggaggctgaggcaccagaatcacttgaacctgggaggcggagtttgcagtgagccgagatggcaccattgcactccagcgtgaacaatgagtgaaactccatctcaggaaaaaaatcatattttacaagcaaaagggaatatgagtaatttagagagtcccaggaaaaattgcaagtaatgaaaagcttattattaaaagctaggatcctttaagaatcatttcagtaaattctttaaaccatcaacagtgaaatttgtaataggactgaaaatgtaaaaatcagcatttttttaaaaattcagtcatatatcttctggctagtcatgggctctgggctctgagctggggtcgtgatggctgctgttaatattcccagcaaggtcattaccttgtttatgtccatctagtgctcttcacagcgtgcacatctctacacaggagctgaccggcatgggcaacaaagcacctgatcccataatgtaacacagaatcttggcagcctccaaatgccagcacccagtaagagttaggagggcatcagggtccaaaagactgagaattttcgacaattgcatacaaaaatcatgtcctctcttctttcctttttcccctagaatattcatgcttactcttcagcagcccaaactgcccttttgagccttcttcacgccatcacagatgtggagatgaaaggacaatctctgttctctcgccagctatttcccacttttccactccaaactgggagctgttttacttgctgttccagggtcagagttaggaaggcattacattagaagactgggtttctaataacaacaatgagtgatttatcaggttatcatggagtaatcagtgaaactccaagcctgggtcctgggtcaaggggatggcgcctatgtcatgaccacctttttcaattcaagcaggactatcatgtgaccaagctactacattttgccattctatattgttcccttctggaggctgtgatttttccagaataaggtagcctgtgcaactctgccatctgctggcctcagatcctcaaaatcctgaaattggggctgggccttagattgtgarctaagtgtcctcttggctgaaacagctcactattcactcctattttcttctttagatttcaattaaaaggcagctctgctagttattgtgtcttggctggaatggaaagcctttggaatagcagtgttccagtgtgtgaacgtgagtaataggagcaacatttcaggccaatctctccccttcatctgttcactatttgtcctatggcctccctcaatgtgattcttcaatattctagtcttaattatcgatttaaaaatagtttattttaataatgtttggttgtgaatcaatatgtacatcacctgtctttgcaaccatctgatctgtctctgtccttctgcattctctgttctagtgcgataaatcctttggtcttgtgctcctaggtcaggagagattagataatgtgaagctttaacaattttctttctttctctagttttttctttcttttttctcttccttccatccttcagttctttcttcccttcttctctccttctcccctttcttctttccttcctcccttctttctttttcattttgttctcccatcaaagtgcagtcagtctacaatttatatatatatgataatacacaaatattgaacatggctttatttaatcaatatttattgatcacatactttgtgcctgatgttcatctagccactggagttatatcaatgaacaagatggatgaattccctgtccccatgttgtttctacttaggtggggagagggacaagaaaaaaaataaattcaatgctatgagacaatagagcaaagcactgaggaatgaggcaaaaatggggagcaacattagacagggtgagcagtttgagactccttaaattctcaaaacatgtacctaaataatttatgctgagagattcataaataataagtcatttttttwaaatgagcctcatatgttcaataatcagtagactactgatttctcctagtctacccatgtataatttccccaatggaagatagaactttgcttcaattcttgattctaatgattggaaaacgtgtttctttagaaaatcatgaaattttactaaaatgtttatgttgttagaaatatacttggacatcttacagtgatttttagagtaaaattttggaagaacataacttatatagagattcttgctgtctaagaaatccagtgctccttgaagcagtatgacaagtgtctgttctactatcatgaatgaaagctcattaactggactactcaagctttctcttatttttcataactcttgctagttaaaatagtttcttccaaatgccagttctaatgaaaaatgccaattagaaatgaggaagagactgttctaaacaaatcattagatgctagaaaggagtaacaacttgaaacctgacccagagagtaaaaagagaaaataaatcatcaacagacctagacattttcaaaagcaaagccatctgaatccatttggagttttttttttttttttatcatggcctgaytatgtttcaattcactgtgacagggctattgttatcactgagattgatgatcaatatcaataagtaatcagtgaaaggtttcacctatttaagatgattagcacacatatatacatttgagaaatatttcctaagaatgtaggctccttcctcagcgctgtgtccccaggatcctgatgaagggctgacacaggataagtgctcaattaatatatattgactaaatgawtaaataacccttcaaaatggttatttttcttcttcaaatgttttgctacttcattaaagttgtaaagtttctactgtccaggaactgttactatccggaagattcaggatagacaaatctcttttgtactttgcaatacattttcattgacatctcatttaatccaactcttcaaagtcctaatgtctactgtcatctccttagcatattttcagcaacaccaatcatagcaccctgtaattgcagaatacctctggtgaaactcctgaatgaaacttagagcttttgtatgttttctagaaatcttttgtccaagtcctccagttattcctaatgggagacacacaggaaaacctctggaagtctttccctttggaaaagcagtaaattacacatgcgacccccacccagacagagggacgagcttcgacctcattggagagagcaccatccgctgcacaagtgaccctcaagggaatggggtttggagcagccctgcccctcgctgtggaattctgggttagtgctcatttccccacatccctaatgggttcagaatatctaacccagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatttgttgtgatatgtgttttattgtggtggtctggaactgaacctgcaatatatttgaggaatgtctgtaacacgaagtgggcggcttaatacaacagaagtttttggagttccattctagagactggaaatccaaaatcaaggttttgggagggccacgctccctctgaatcctgtagggaaggatccttcattgcatcttccagcttctggagccacaggccttccttggcatgtggcagcagaactccaatttctgtctctgtcctcatatggccatcttccctctgggtctgtgtcctcatatgctgttctctctgtgcatgtctgtttccaaagttttcccttttaataaggacaccagtcacactggattagggcctacyttcatgacctcaccttaacttgattgcgtctgcaaagatygtatttccaaataagrtcacatccacagggactggaggttaagacttcagcatacttggggggagacacaattcaacctataacagagcccctttgaaaatgtcaggcatcaggtgctcacagcacacggtccagctgttggtgctcacccttgctcagcacacggtggaggctctgcctcaatctcattcttcatgggaacagctaagccaggtagcgaatacgggttatgtttgtgtcaccacaacagacactgaaaggaagtttgtggtgtccagcacacttgccagcataggcctcacagaccacagcacctagaatctgacaaaaattagaataaatccgatgtctccttttctctcttttttttaagcatttttaaatrcaattggtaaatttcctgactgtaccctmctcatcttgcattgctgaataagtgaggaacctctctatggcatgaagcagaaaaccmttgagcttatgagaagaaacaggaaatacatgtaaaagagaccagtctgaaaaatcaggagaaattttacaaaagagatttactgccaagaaaccagggaaactttcagaacactctccttttcatatttgtaacaagwttcaattgtacaaatacttctgtgaaactagccatgaagtgtgtacatgaatgaatatatgtattcagtgtgtttatatatttcatttcatacatgtgatctatatcatatatatatatcacaatgaatattgcagaaaattaaagcaaagagtaagaagagttaaccaaatgttccctgaatgcagtgagaaaagatgaaaaggagaagacaggcaagcacagtggctcacatatgtaatcccaacacactgagaggctgaggcaagagtatcacttgagcccaggagctcaagaccagcctagacaacatgrcaaaaacccatctctacaaaaaagtataaaaattagctgggcatggcagcatatgcctgtagtcacagctaggcaggagactaaagtgggaggatcacctgagcccaggaggctgaggcttcagtgagccttgatggcaacctgcactccagcctggatgacagaatgagaccctgtctcaaaaaaggaaaaagagaagacatatgtaacacagtgtcaggattcaaaatacatgtagcaaaaattccagaagggtaagcaaataagcccatacctagccatcactagggaaacttctgtgtttcagggatagagaaaaaaactctgattccagaaataaaatgtgaaaatataatacccgcaaaagaaataagtttattgacaccacattgattctatacaacactaaattgtagaagatagcatttctcttgagccaagctaatattcacacctagaggctccagatacacattaaaggataagaaagacacaaaaattgtaccatttaagtatgtttcccaggtaattcataagcaaatttttaaaaaggagaatgatgaattccaaaggaaatctcaatgagataggatattggtaaaaagaaaaaacaacaataaaaaaatacacacaaaaactcggcaatgtaatcataatttactaataatctctctaaactcatagaacrtatcaataaaactagaaaatgtgagacagcaagaaaaggtaggctaaacttacattacagaaaagatgagtagactgactatatagagtttgactctaaaattgagaaaataggtttaaatakctgttgtgtgcatatccatgtgtgtaatatacatgyacatatataaaatgaaattcctcattagaaaaaataataagtttaatttccaaattattagaataactaaaacagctgaatctatctcttccatatagcaagtgagagggaaagaaaaggaaagacaaggaatgcatttgtctcttccaccagaaataagccccctcatttttgggtcaggtcattttattcattgctttctccacatcctcatcattgggcatcatgaaatcaatgaaaaaggcagtgaaagaatgatgatgaaagcaaatcaaatgtatcatttatctcaatacatttggtttaatcctcttgttgaaaaacaaagtctcttagacaagatcaaaagcaacaaatcttgtatttataaaaaacatgtctcaagtaaaatgacatagtattatacacacacacacacacacacacacacacacmcaaattaagtgaaaatgcaaacaaaaaaaggcaaaaataatatttagagaaagatagaatttaagaaaaaaattgtcaaactggtctacaaaataattgttttattttcgtgccagttgcagtccacagtgaagccaagatattaagaagcaatgtgggccaggagaagttagagcagaaatatctctttcaataatgaaagaataagaaaaagaartagaagagctggaaacaataggtaaagtttaggctaggccttagacttctcctgcattgtaatccttctggtttgccacatatgcatgctgtcaggaagttgatgaggtatgtacaggacaatgattttccattttttgcctttaggcaccgactcattggtcactcatctgctgaatgtatcctctcaggcaatactgcccattggagcacgaagccgccaatttgtcaacgtgagttgaaatctctttccccattcaccccaccattgaatcctagagttgtcctcctagaattacaaagaatggatctcatccctcttggaaatggtatccttctsatatttgaagaatctagtcatatccttaaaatggctcacagcattccaaacttccrccttcacctagaaatgcttttttttttcttatctcagtctaatgtattttaaactagtctttagctcatttaaccagcccccaatgtcctcttctgttggttgagcacctcgcagtttgaagagcattttgtttagtgaagtcaacaaatacaaagtcagtgaaagaaaccccatatcctctctgcaagctcttagtatcacatcagatattcaagccatgcagctctttcttccttcttattctttgtctaaacaggatcatgccatcttccctgtgagttgtttggaagatgagctttctacattttggggagcaaagacgaatgagcaattgcaagctaacagggaatataaaatgtgtataatcctgggtttagtgatggtgtgaggaaatcagcaatttcaaacccagttggtggcaggataagtgggaacaaactttgtagaaggccaataaactggctgggcactgccctacagtagagtaggacacagtattcagttcttccaagatcagacgagattgggcgcattcagggtggtatggctgtaaatcagtatccagttctttttattacttctgaatctgtaagtatcatgtttattatatgtaatattrtatatttgtgctttgtctttattagttcttccagagcttttgttcttattatttaataaagatgttatactgagccacgtgtggtgactcaaacttgtaatcccagcactttgggaggcctaggtgagcagatggctttagcccaggagtttgagaccagcctgtacaacatggtgaaatcatgtctctacaaaaaatacaaaaactaaacaggcacggtggcacatgcctgtagtcccaactactcgggagactgagaggtgggaggattgcttgagccagagaggtcgaggctgcaatgagccatgatcgtgccactgcactccagcccgggcagcagagccagaccttgtctcaaaaaaaaatgctatgctgtatgctttattatattaatatccaataccataaaggcaaatgccttctatatagagagaactagattaataatggtgagataacatagttaaattctcgtttagcaggagaaataaaaacatagactataggctaggcacagtggctcatgcctgtactcccagcacattaggaggctgaggtgggcagatcacttgaggtcaggagttcgagaccagcctggccaacatggtgaaaccccatctctactaaaaatacaaaagttagccgagtttggtggcgcatgcctgtaatcccagctactcaggaggctgaggcaggaaaatcgcttgaacctgggaggcgggggttgcagtgagctgagatcacgccactgcactccagygtggggaacagagtgaggatctgttaaaacaaacaaacaaacaaamaaaaaacacatggactctaataatacatggatacatttagtgaaataaggttaactgagtagagcagcactcataacattttaaaactataagaacatgtctgtacattagcaaatattagatgagaataatattgtcaatatttacttctggtaatttgaaattaaaaaacaaaactgttagcaaaatttacaataaagtataattattagaaaccaggctgggcacggtggctcacgcttataatcccagcactttgaaaggccgaggcaggcggattgtttgaggccaggagttcaagactagcctgcccaacatggccaaaccccatctctactaaaaatacaaaaataaaccagacatggtggtgcatgcctgtgatcccagctactcgggaggttgaggtgggaggattgcttgacctgggaagtagaggttgcagttagccatgattgtgccactgcactccagcctgggtgacagcaagactctgtcccaaggttttgttttggttaacttgctgtctcttttccaggaattccttgtgggctacccccaaccatcgccaatggagatttcattagcaccaacagagagaattttcactatggatcagtggtgacctaccgctgcaatcttggaagcagagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccrccgtgtgaagtgccaggccctgaacaaatgggagccagagttaccaagctgctccaggggtgagtctgactgatgcctagaagggccctgccagtgacatgtgttgctgttggatcaggagatgagtatttgttaagggggaggtatgtatggtgaggagggtgggaaagtaagttttgggggaagaagcatgaaattaagaattgggggtgtgcatgcacccatgcatatgtgtcttcatttggaaagcaagaccttaattagccaagaaaaaagctattttggactcacctattatttgattctcagggcaaagtaccagctgcaatctctctcaagtatattgaaaaattatatggactttctctatgatcagctatgtgctaagcactttatatgcattttctcattcattatttacaacaacactttgaaattgtgctattgtattatccatttaatagtgacatcagcttgatctttcagaggttaaataaattagctaagtcacatgttctaagcgagacacccaggattttaaaatgcaagtgtatcagaccccagagtctgaatgttttggctcttgccatactttcatcagtatccattgctgaaagaaagagactggcttacaaagacagaaatcatagcctcagaatagacaaagaccttagagtttgtctataatggtctgcctcctacattttattttgattttattttatttaaaaactatttattagagttgaygtcccactctgttgcccaggctgaagtacagtgatacaatcatggctcactgcagcctcagattcctaggctcaagccatccacgtcctacattttatccctaggagtctaagtcaagagtgaaagtaacttgttcaaagtcagttaaatatttctaaattcatgtttaatgaggtatagattaggttgatgttaaaatgggttctgatgccctaagcatgaacgaacaggactataaataaaggcagatgttgagtcaaatactctccaaataatatgccctctcgtgacaaaggactgtcttatttaakggcttgtgtttttgatggctcatcttgtctactgatgccacaatagctggcttagcagctgtgtaggaggtgttatggttgatacatagggacagagaaggagcttacgattcttctaccaacccatgttagccttgtgcaaccactgagctgggaagatgaacagataaagggatataaagacggatgtactgaggcaggagatgggcagggcttgtgttctggtcacaatcctgctgaccaaaacaggctctggcccagacaggatgaagtgaaaaaacagcaggaaccagcagatggcgatgaaagcaattgctagctgccctcatagtcccatcagcaccatgacagtttacaaatgccatggcaacgacctagaagttaccgcccctttcctggaaagttctaaataactcgcccctcaatctgcattgatccaytccttaatttacatgtaacygaaatgggtttacagcagtataaacacagttgcctgccaggaacccttatgttgctgactctgggtgtgctgcctgtgagttagccctgctctgcaagaagcagtgcctttcactaacagattgctgtctagcaccactggctcatccttgaattctgtcctggatgaggcaagaacccttccagagtaagccccaatttaggggcatgcctgtcccgaaacagtatgactgtactttagtcattggtgtgcaatcagagaaatygggggaaatctgtaaaacagatttggtctcaggtgacagtctcattacctgaataacaatggtacaaatygggattaccttcctaggaaatatgtagatggagaatccaccaatactgataacttcacattggatagccagagctaggagaaaatacctcatgccctgtagatttacaagtgaatttggggccttgtgctagggagaattgggttctatttctctacctctgactagctatgaggtcttcaggaagcataggaaattcccccataactaacaagtactctggaactgtcctttccacagtgtgtcagccgcctccagaaatcctgcatggtgagcrtaccccaagccatcaggacaacttttcacctgggcaggaagtgttctacagctgtgagcctggctatgacctcagaggggctgcgtctctgcactgcacaccccagggagactggagccctgaagccccgagatgtgcaggtgcctcaactctctggcttccagatttctctctttaccccacacatggaggtcttactcctattttttcttttttttttttttcttcttctagtgaaatcctgtgatgacttcttgggtcaactccctcatggccgtgtgctatttccacttaatctccagcttggggcaaaggtgtcctttgtctgtgatgaagggtaagtgtgacccagaattcagatcagggactcagcactgcagagtgactcttgagcttaaggatcaatccaaaaagagggctgacctaggagaagaagaatccagggagattaacctctggaagtgtagctttaaaataaaggtagggactaagtggcactactatcaggagataaagagataaagaaaaaatggcgcatataactgagtgtcaagtacaaacagaaatacagtcaccagtccagaaaaggggaccaacctggtggaaaagaagtactagaggagactaatatctgaaacaatgattggaaagtgtggtatgaaccagctggatccatgaacagaagtttaaaaagcaaaaagctcaactcatttgatttctcacttatagaggctcagaagtaaaatcattttggaaaacgtgcagcttccagtaaggcacaaaggaaaaacaatggccgaaatacaaaagatcttgaaaaaaaaagtgtgtatatatatgtatacatacgtatacatatggacacgtatatgtatacgtatacatgtacatgtgtatacatatgtgtatacatggacacgtatatgtakacgtatacatatggacacgtatatgtakacgtatacatatggacacgtatatgtakacgtatacatatggacacgtatatgtatacgtatacatatggacacgtatatgtatacgtatacatgtacatgtgtatatgtatacgtatacrtgtccatatgtatacgtatatgtatacatatgtatatatacatatgtatatacatatatatggaacatatgtatatatacatatgtatatacatatatacatggaacattagatgtatgaataaataataatttgcagacatgaagagataaataaatattctaggggttgttaagaaaagtttgatatataagagaaagttgtatataagataaaataacatgcaaagattatttcacaaaacttttaatcaaataaatagtggaatttggaataggaacgaaagagtaagtagaaatattctaaattccaattacatgtgattgacagctctgccagctattattgctttgtcctcactgaaagctacactttttccaaaatgatttggcttctgagcccgtcaatgagaaactaagtgagttgagtgttttcacctgtgctttagcttgagcagtaaaatgttaattaacttaggaattctcagggaggaggttgagatctgtcacgaagggaagagagaaatggtgcattcatccagccactactgctttgttctttaggtttcgcttaaagggcagttccgttagtcattgtgtcttggttggaatgagaagcctttggaataacagtgttcctgtgtgtgaacgtgagtagatggaatacttgttcagtctggatctttctgtttttttcttaatatagtttgccccatgggattatctattgtttgtcccgctgtttgtgcccgcttttgatagaaattgttctttgttggaatagatacaagcaatgttttgggraaaaataaacatgagaatcatgtgttttgggtaccatcctataaatatttatgaggagagtctgtgctataaatagagagaaatgcttcatagaaataaatgtatggcaagatgctaggctaaatttttctcttctttcctgtcaaaagtaatagtcatacttcaacttttcagttcttccctcaatcatccatttagtcatatactcattctttcaacagaaaattatttgagcacctactatgtgccaagcaatcttctgggaactggggatatacctataaacaagacagataagtccatgtttaagtttttgtgcaaggataaagacaaaaatcaaagacatgaatagaaatgttcaaatgatactaagtgttattaagaaaatgctcttaattgagtcagtgctgtcaattgagaatgtagctgaggacccaaaaggcaagtgtagcccagcaaacctctgggtgtagctgagggttcaaaatgggaggctgttgcagcaatctaatcagagatgttggcccaggatagcaattgggaaaggtgatgatgagaagtgatcaaattctggatatattttgaaggtgcagatgacaggatttggtgatggttagcttagatagagggtgtgaaagaaagagaagaaacatagccagtttccaggtttttggccagagcaaccgccagggtagaatttcccttagctgaaatgcaggggactgcatgaagtttgggaatgggggaaatcaaaagttaagcttgggacataactttagtgttcctcttagatatccagatggatatgttggagagtcccaggctgcccatagatakgtagaagccatcattgtatctgctatgcttgaaatcaggactgaaagagatcttcacctagggagtgagtgctgctagagaacagatgcatggactgagcctggatgtccaggattaagagttgcaaaggtgagaaggaatcagcaaaggggattatgatgaagcagccactgcagtaagagaaaacacaggagggtgaggtgccctggaagccaagtatggaaattattttaagggattagactaatcaactgtgtcaaattctatagagaggtcaaattaggtgagaacagaaaattgatctttgggtttagcaacttggaggtaacaagtggaagtttcagtggagtgctggcaaacactgattggaatgaattctagggagaatgaatgggaggaactgtaacagatcatagacaatattttagaggagttttcatgtaaagagagtagaaataggactatagctgaagagggaaatgacagcaagaggtttgcttttgatttttaagagggcagaaaatagtgtgttaaaaacagaaacactactatgtcccatctatccatttacttcttcactaaatcaatcagggtattgcttccccttctgatcatagctattaaaaatacatgtttacaatagaattttgctcatatgaatactttgccttaaatcatttcaatgtcttgtattgatttatatgatgaaaatgataatttcatcttacattgttggaagtcagctatttgacaatcttaacttccctggaatagttaagaagtatgaaagaaaagaaaaagaaaataccctcatgaacccaacatatacctgaaatcgcttactagagtgtaaacattggttaagctattttaacctttgattagtttatctatarttcttttaagctgtaatatcctcttcccaaattcaaagcaaattagaaaagggaaggagtgtccccaaatagaggcattccaaggaataaatgtgtttctttaatgaaaaaaataaataaataaacccttaaaaaccaatgagtatctcaaaaaaccgtaacattcttgagccttttgaaacacatacaggagtacatagcatttttttttcattgtgacagcattactgcaatctttcatctgtattttgaaaatcatagcctggcatcatcaagaaaaattaaatcactgatatacaaataataaatgtataatatattttagaaagatgtctctaggatgaagactcttgatgtcaaagatcatatttatcctgtgctttaaacagtacttgacatacagcagatattcaaaaacatgcttgttgaattaatggatgattcccctttaatgtgactgtgaagatttttatttactttaaaggaatatactctttattattcagaaatattaactatctgaaaaatttaggatgcttaatttgggaaaggcttttgtaataaacattgatttagttgtcatttcatttagctccatcttagcagaggcctaatacatttattttgcagtttctactttccttaagaagaaaagtacgcttaattggcaacacagtcacagtatgacaactgtagaatcrccttggattatactttaaaattttttatggaattgagagctcttgttttctttctagatatcttttgtccaaatcctccagctatccttaatgggagacacacaggaactccctctggagatattccctatggaaaagaaatatcttacacatgtgacccccacccagacagagggatgaccttcaacctcattggggagagcaccatccgctgcacaagtgaccctcatgggaatggggtttggagcagccctgcccctcgctgtgaactttctgttcgtgctggtcagtatccrcttccacatatcctaaatgggttcagaatatgtggacccaatccctcatgtttctgtaataagactatggtatttgtttgtgagcttaactttgtcataagtgtaaatgtcaaaattacataccatagctaaaacagatgggtttcagcagcgccaaggtatgtttgaatctataagatgaaaactcttcttgctggtggagtggaagagggtgggaaaaagggactgagggaggggtggagggaaggcagtaaggcacagttatgtaaatcaggaagaaaaatgtattcactggagacgacatgaaaacawctgcctctgaacactaaccagtatctgtataattgacagtctccataagttcatgaggggtacatgggcatgcaaagttcaaaattggaaatgtggatattatttagctaaggttttaaactagtgttctgctgcatgggctaagtaaccaaaaagactctctttgtcttgacttaaagtttgtccacttgtcatcttgcctccaggctgtcttaatctttgtacttgaactgttccactcagggggtaagaagcaaggaaagagtagcscaaagaaaagagtaggaaaaggaagaggctatttcttcctaaggaggggaagaagttgcctggtccttcagggcaaacattaggccttttccagagcagaaactggagtagattagggatgtggcaccagccttggaatattccattatccacagggaagccctgagagacaagagccagccaaggtgaaaagactaaacctgatgaaaggcatttaacctttctttgacctttactctccaactgagtggtacccatcagaatgcagtaaatttttttaatgtaaatgcctagaccccagtgcaggcttaatgaacagatggaggaagccttctccaaaaaggaggtaatggagttcagactctatttgaaaatatgcagcacatggctgggcacagtagctcacacctataatcccagcactttggaggccgaggtgagaggattgtttgaggccaggagttcaagaccaacctggccaacacagcaagctcctaactctacaaaaaataagactgaaaaattgtaaaaactgtaaaacaaaaaaagtaaaaatatgcagcacacaatatactctctcagaaagaagacatagcttcttacagaaggctgatggcttagtctgttttgttctggttctttttttgttttgttttgtgtgtgtgtgtgtgtgtgtgtgctttttttgagagagagggtcttactcttttgcccaggtggagtagagtggtgcaatcatagtttactgcagccttgacctccctggctcaagcaagcctcccatctcagcctgccaagtaggtgggaccacaggtgcatgccaccacacccagctaattcttgtattttatgtagaccggttttcatcatgttgcccaggctggtcttgaactcctgggctaaagcaatccacctgccttggcctcccaaagtgctgggactacaaggcgtgagccaccatgcccagcctattttgttctatctttaaatgcctggtttagcatcagaagaaaaacactgtattagtttcctagggctgctgtaacaaattaccacaaactaggtggcttaaaacaaaagaaacttattatttcacagttttgtaggctgaaattgagatgttggcagaggtattttcccatcttctaaggctctggaaaataaccaattctttacttcttccatctgctgctggttcctgggattccttggcattccttggtttgtggatgcatcattcaaatccctgcctccatcatagccttttcccctgtgtctctatatgtcaaatccctccactttttccctgatagggacaccagtcattggatttagggcccactctaaataaaagatgatctaatctcaagaacctaatcttaattctatctgaaaaaccattattccaaataagtttctattctgaggttttaggtagagatatcttttgggagaacatcattcaactcactacaaggggtacctgctatgaaaggccagagaggcagcttatgatgggcaccctgagaatggagtatggagagagatgataaaatatgtcttgctactcakgagtgaattagcacaaacacatgaagatttgagtggttaactgaggatataggcactccgataggaggtcagaatgtgaaactacaagctgaagttcttgctttggtgaaataagggaagaaagatcagaaagctgagtggtcttccaaatagtaaaaaaaatcctgctgagtagatgcattgaagagcttcatcccaaggtaacatcaaggagaagaaaatcttttgctattcttgtaagtctctttgtttctgtgatccacctatcagcttaattgaagagaaagaggmggtagggtggaagtctctctgctaactttgatattcctgtggtttttctctccaggtcactgtaaaaccccagagcagtttccatttgccagtcctwygatcccaattaatgactttgagtttccagtcgggacatctttgaattatgaatgccgtcctgggtattttgggaaaatgttctctatctcctgcctagaaaacttggtctggtcaagtgttgaagacaactgyagacgtgagtaacccctccctgggaactacttcatgtctgttaaagcataggtgggaccgggcttggtggctcacgcctgtaatcccatcactttgggaggccaaggctggcagatagcttgaactcaggagttcgcaaccagcctgggcaacatggccaaaccccacgtctacaaacaacaacaacaaaaacaacgtaggtgggatttgattcaatttgctcaaattttggaagcaagatgtctatatttgcccaagatattttgataaaggaaaggatggtcttgtacatcaccccttcttcttgcttgtagttcctgaaccttgactagatgctcatttcatgagaatggctctcacaaaagaattagagagaaaatttacattcactgtagatcatccttgatggctgacaccattaaatgaatgaaacaggggtacaaaagaaatttatgtgagttgcagtgaactgtgcttggctaactaaaaataggggagacatcccaaattttgaggcctttgattttggctggcggaatgagagtacaacactttagccataaatgacttgttttgtttttgttttgtttctgctgttgctgttgtgttttttgtttgtttgtttgtttgtttctgagatggagccttactctgtcacccaggccggagtgtagtggcgcgatcttggctgcaacctcctgggttcgagcaagtctccctgcctcagcctctcgagtaactgggattacaggcacccactcccatgcccagctaatttttgtattttttagtagagatggggttttgccacgttggccaggctggtcttgaactcctgacctcaggtgatctgccggcctcggcctcccaaagtgctaggattacaggcgagagcccatacataacctttattaggaggtgcaagatagtctttttcaaagttgtgttcgtagctacatgattctgaagttgtctgccaagtttcctcaaagcagtcaattccatgaaacaattggaactgtatatgctgtttagtatgccacactccagtctgaaccttacaaaggtaagttgaactctatatttaatcccaaattctgcttcttcccctaggaaaatcatgtggacctccaccagaacccttcaatggaatggtgcatataaacacagatacacagtttggatcaacagttaattattcttgtaatgaagggtgagttgagaataccatctcttgaatatgagttccagaacagcagagccaacttctgacccagtctcagatagacaaactaaactattgctccctttactttaaaagcaagcaataggacttatagatggagatgatacgttggacatagccatatgatcaaaggaatacaaaaaagaaggtacaatatgtattgtattgtaaaccagaggagggcaacatgttcctgtcaaaggtgrtacatgtgaaacctggtcaggcattcattggatgaaaaggagcagcttacaaataaggaaaaggaaaaaaggtagttgaaccatgtaaacctccttaactgagatcagtaggtaatacagttgagttggaggaccctgaagcagagtttgggagggtaaacattaattgtaacagcagctctggaagagtatgcatcaaagtgcacacagagaggagacattatggggttcttgctcttgacttctccttgggacaagtagccacaccaaaagccattgcctcaactgagaaggggcttttaaaaactctggagtrgacctccatcaaactccagcagacctgcagcagaggggcctgactgttagaagataaactaacaaacataaaggaatagcrtcaacattaacaaaaaggacgtccacatgaaaaccccatccaaaggtcaccaacatcaaagaccaatgatagataaatccacgaagatgaggaaaaaccagcacaaaaaggctgaaaattcccgaaaccagaatgcctcttctcctccaaaggatcacaactccttgccagcaagagaacaaaactgggtggagaatgagtgagttggacagattgacagaagtaggcttcagaaggtgggtaataacaaactcctctgagctaaaggagcatgttctaacccaatgcaaggaagcgaagaaccttgaaaaacaggttagaggaattactaactagaataaccagtttagaaaagaacataaatgacctgatggagctgaaaaacacagcacaagaacttcatgaagcatacacaagtatcaatagccgaatcgatcaagtgaaacaaaggwtatcagagattgaagatcaacttaatgaaataaagcwtgaagacaaaaaaagaatgaaaaggaatgaacaaagcctccaagaaatatgggactatgtgaaaagaccaaacctacgtttgattggtgtacctgaaagtgacggggagaatrgaaccaagttggaaaacactcttcaagatattatccaggagaactgccccaacctagcaagacagtccagcattcaaattcaggaaatacagagaacrccacaaagatactccttgagaagagcaaccccaagacacgtaattgtcagattcaccaaggttgaaatgaaggaaaaaaatgttaagggcagccagagagaaaggtcgggttacctacaaagggaagcccatcagactaacagtgaatctctctgcagaaaccctacaagccagaagagagtgggggccaatattcaacattcttaaagaaaagaattttcaacccagaatttcatatctagccaaactaagcttcataagtgaaggagaaataaaatcctttacagacaagcaaatgctgagggattttgtcaccaccagacttgccttacaagggctcctgaaggaagcactaaacatggaaaggaataactggtaccagccactgcaaaaacataccaaattgtraagaccatcaacaatatgaagaaaccacatcaactaatgggcaaaataacaaatcagcatcataatgacaggatcaaatttacacataacaattctaacattaaatgtaaattggctaaatgcccccagttaaaagacactgactggcaaattggataaagagtcaagacccattggtgtgctgtattcaggagacccatctcatgtgcaaagacacacataggcgcaaaataaagggatggaggaatatttwccaagcaaatggaaagcaaataaaagcaggggttacagtcctagtctctgataaaacatactttaaaccaacgaagatcaaaagaracaagagcattacataatggcaaaggatgcaacaagaagagctaactatcctaaatatatatgcacccaatacaggagcacccagattcataaagcaagttctgaaagatctataaagagacttagattcccacacaataatagtgggagactttaacaccccactgtcagtattagacaggtcaacgagacagaaaattaacaaggatattcaggacctgaactcagctctggaccaagcagacctaatagacatctatagaactctccaccccaaatcagcagaatatacattcttctcagcaccacatagcaattattctaaaattgaccacataattggaagtaaagcactcctcaaaatgcaaaagaatggaaatcataacaaacagtctctcagaccacagtacaatcaaattagaactcaggattaagaaactctctcaaaactgcacaactacatggaaactgaacagcctgctctgaatgactactgggtaaataacgaaatgaaagcagaaataagtaagttctttgaaaccgatgaaaacaaagacacaatgtaccagaatctctgggacacagccaaagagtgtttagagcactaaatttatagcactaaatgcccacaggagaaagcagaaaagatctaaaatcgacgccctgacatcgcaattaaagaactagagaagcaagagcaaacaaattcaaaagctagcagaagagaagaaataactaagawcagagcagaactgaaggagatagagaaacaaaaaacccttcaaaaaatcaatgaatccaggagctggttttttgaaaagattaacaaaatagaccactagccagactaataaagaaaaagagagaagaatcaaatagacacaataaaaaatgataaaggggatatcaccactgatcccacagaaatacaaactaccatcagagaatactataaacacctctacgcaaataaactagaaaatctagaagaaatggataaattcctggatacatacaacctcccaagactaaaacaggaagaagtcgaatccctgaataggccaaaaacaagttctgaaattgaggaagtaattaatagcctaccaaccaaaaaaagcccaggaacagatggattcatagctgaatcctaccagaggtacaaagaggagctggtaccattccttctaaactattccaaacaatagaaaaagagggactcctccctaactcattttatgaggccagcatcatcctgataccaaaacctggcagagacacaataaaaaaggaaaatttcaggccaatatccctgatgaacattgatgcaaaaatcctcaataaaatactggcaaacraaattcagcagcacatcaaaaagcttatccacaacgatcaagctggcttcatccctgagatacaaggctggttcaacatacgcaaatcaataaacgtaatccatcacattaacagaaccaatgataaaaaccacatgattatctcaatagatgcagacaagggcttcgataaaattcaacagcccttcatgctaaaaactctcaataaactaggtattgatggaatatgtcccaaaataataggagctatttataacaaacccaccactaatatcatactgaatgggcaaawgctggaagcatgcgctttgaaaaccagcacaagacaaggatgccctctctcaccactcctattcaacatagtattggaagctctggccagggcaatcaggcaagaraaaggaataaagggtattcaaataggaagagaggaagtcaaattgtctctgtttgcatatgacatgactgtatatttagaaaaccccattatctcagcttaaaatatccgtaatctgataagcaacttcagcaaagtctcaggatacaaaatcaatgcaaaaatcacaagcattcctatacaccartaatagacaaacagmgagccaaatcatgagtgaactcccattctaaattcctgcaaagtgaataaactaccttggaatacaacttacaagggaagtgaaggacatcttcaaggagaactacaaaccactgctcaaggaagtaagcgaggacacaaacaaatgaaaaaaacatttcacgattgtggataggaagaatcaatatcatgaaaatggccatactgcccaaggtaatttatacagtcaatgctatccccatcaaattaccaatggctttcttcacagaattacaaaaaaaaaaaaaaaaaaaactactttaaacttcatatggaaccaaaaaatagcccatatagccaagacaatcctaagcaaaaagaacaaagctggaggcaccacgctacatgacttcaaactatactataaggctacagtaagcaaaacagcatcgtactggtaccaaaacagatatatagaccaatggaacagaacagaggcctcagaaataatgccacacatctacaaccatctgatctttgatgaacctgacaaaaacaagcaatggggaaaggaktccctatttaataaatggtgttgggaaaactggctagccagatgcagaaaactgaagctggaccccttcctttacaycttatacaaaaactaactcaagatgtattaaagacttaaatgtaagacctaaaactataaaaaccctagaagaaaacctaggcaataccattcaggacataggcatgggcaaagacttcattactaaaacaccaaaagcaatggtaacaaaaaccaaaattgacaaatgggatctaatgaaactaaagagcttctgcacagcaagagaaactatcatcagagtgaacagacaacctacagaatgggagaaaatttttgcaatccatccatatgacaaaggactaatatccagaatctacaaggaacttaaacaaatttacaagaaaaaacaaccctatcgaaaagagggcaaaggatatgaacagacatttctcaaaagaagacatttatgcagccaacaaacatgaaaaaaagctcatcatcactggtcattagagaaatgcaaatcaaaaccacattgagataccatcttgggccagttagaatggcaatcactaaaaagtcaggaaacaacagatgctggagaggatgtggagaaatagaaatgcttttacactgttggtgggagtgtaaattcgttcaaccattgtggatgacagtgtggtgattcctcaaggatctagaaccagaaataccatttgacccagcaatcccattactgagyatatacccaaaggattataaatcatccttctataaagacacatgcacacgtatgtttattgcagcactgttcacaatagcaaagacttggaaccaacccaaatgcccatcaatgatagactggataaagaaaatgtggcacatatacaccatggaatactatgcagccataaaaaaggatgagttcatgtcctttgcagggacatttatgaagctagaaacyatcattctcagcaaactaacacaagaacagaaaaccaaccaccgcatgttctcattcctaagtgggagttgaacaatgagaacacatggacacaccgaggggaacatcacacagtggggcccgtcagagggtaggagtccaggggagggatagcattaggagaaatagccaatgtagatgatgggttgatggtgcagcaaaccaccatgacatgtgtatacctatgtaacaaacctgcacgtcctgcacatgtatcccagaatttaaagtatgataataaaaaaaagactgtgtactcatttttggttgccatgataaattcagagaggaaaaacatgatatatattaaattttactgcaacaactaactgccccttgtcatcagcctattctgtcactagagtgagtcagtattcctcttttctgactgtctgagcctggacgatttaaactgcttttcacacaacctcttgcccaaccttttctcacctcccattgtgaatgaacatagatttccctatggtaaacaaaacaaaatatcaccaaatctaaggcaagataaagaaattgaagataaaagaaaccaacccaagagatcagagaaatattcatctgcacaacagcttcctccaataaacaggggacaatctttaaaaatctctcatatgtgtttgtaacatagaatcgatggaactatatgaggcatttataagatttaatgatctgatatcagaaaagttgagatttgaatgaaacacatgggagtcggaaaaggagtgatgactggtagattggagcctgcccccaacccccggaaaaaaaaaaaaaaaacaccaaagggataatgaagacaagattgaattctccagaattcatcaaggaccagacttgaaatgacacatatatacacacaaacacactacacacaaacacacagggatataatatagaaattccagaaaaaataaaagaaagcagaatgaatagaagcattaattagcacataatggaagacaatttctcaggctataaagaaaaatactaagttgatccttgaaggcttactagacaaatcaagattaacaacaatgggccccggccctacatggaagaaaattatgccatccaaatataaaaaaatactgccactctccagaaataacaaaaaagaagaaattcatcttagcaccaagcttccgttctgtaacactaagtagtagaagttagtgtttgagaggaaatattgtacaataaaatttctgtactcggccaagctgccattcatctgcaaggcacagatgcatcgtcttaaataagaaggaaccccaaacatacaccagttagatatactgcctacaaaaagaaaaactcccacaaagctgtgggagtttttctttttgaagaagaaatcaaaattccaaatggtgttgtatcaaagaaatattaatgaggcacaaaactagttaaatggggtcactaaaactgttttatttaatatrgaaataaaatatcaaagcaggactaattcttgaaagataattcatgtaatatgaaaagaagaagaaacttgatataaaaaatagattttatcacttcagctaggaagttagagatgaagtaagaaaaaccatcataaacttatcatatgtaggggacacatattcttgacataaaaaataaggagaaaatggtacttcacaccagtataaaatctatatatctatatctatatatatctatatctatatctatatatatatatawaatcaaattttaaaagataatcagaagggcgaaaccacttggtccataaaacaaaagaggggtgagagaaacaagagctagcaagctttctgtctctcttttgggaaactagcattattacgttaaagtgaattaatacatgtattttaatgcctcagtttttctttctaatataataaatattaacagatataaactccattggtaaaatcactttgaggtccttaatacttcttaaagtggccgggcgctgtggctcatgcctgtaatcccagcactttgggaggctgaggcgggcagaacacctgaggtcgggagttcaagaccagcctggccaacatggagaaaccctgtctctactaaaaaatacaaaattagccaggtgtggtggcgcatgcctgtaatcccagctactcgggaggctgaggcaggagaatcacttgaaccygggaggcggaggttgcagtgagccgagatggtgccactgcaccccagcctgggcaacaagagcraaactctgtctcaaaaaataataataataataataacaataacaataacaaaaatgtttaagagtgaaaagaattcttgagaccaaaaaagtttaagaactagggcttgatgatgttcaagcaaagataggaaaaggctattgcaagtacggtacaaagcacagggggaaggtttcataagtatatatataatatatatataatataacataaaattcatatatattataaaaataataaatatgatataaatttgatatraaatattatataaatctgatttttaacatattttgattttatactggtgtaaagtactattttctctttattttttacatcaagaatatgtatcccctacatagtataagtttatcatagtttttcttacttcattcctaacttcctagttgtagtgataaaatctattattttatatcaataaaaatattgatataaattttatttacatgatatacaatatttaaatataacatattttatattacaaaatatactactatgtattacaaaaaaaaaaacaaactccatttagcagagcaagaatggagtttgttttgtacagtgctgagttccaacccatagaattgttaaataaataaaaaggaaagaacactataagatcaaactcatcagttataatagtaaatgtgaatgattccaatccccccttttgaaagacaaaggcttctaaatatggtcagaatcctatttacagtarcaycaaaaagaataaaatacttaggaatcaatttaatcaaggaggcacaagacctgtgcactraaaactcagtaactgaaaatgagcaaatgatgtgatagacatgtctccaagggaaatatacaaatgcccaataaacacatcaaaagatgttcaacatcaytagtcattagggaagtgcaagtcaacctgactttgtactaggatgttttgtattaggatggttataatatttttaaaaaataggaaataaaaggtgttggcgaggatgtggagaaattagaacgcttatacattgctggtggaaatgtaaaatggtgtagcactgtggaaaacagtttgatgattcctgaaaaagttaaacatagaattaccatataaccagcaattctgctcctaggcatatacctaaagaaattgaaaacaaggactgaagcagatgctcaaataccaatgtccgtagcagctttgttcaaaatagccaaaaggtagaaacaacccaagtatctacgagcagatgaatggataaatgaaatggagcttatccattccatggaatattcttcagctatacaaaggaatagagttctgatacatgctacaagatgcataaactttaaaaacattatgctaagtgaaatgagccagacacaaaaggataaatactgtattccacttttatgaggtgccaaaaataagaaaatttattggactaaaaatagattagagataaccagtggaaggagagaatagggagttacaactcaatacatccagtttctcattgggatggtgaaaatttttggaactaagcagtgataatggttgtataatgttgtgaatgtcattgatgccactgaattatacccttaaaatggttttaatggcaaattttatgttgtatctcttttaaaacaataagaaagaaaaaaatttttaaatatatcatgtgatattaggaaagaaaaaaacagataacagtataagaaaaataagaatttaaaacatatcaaataagatttaaaaattttgtttaagatattgatacttggtccagtgcacaataaagacaagaactttttttttttttcttttgagatggagtctcgctctgtcaccaggctggagtgcagtggcactatctcggttcactgcaacctccgcctccagggttcaagccattatcctgcctcagcctgccgagtagctgggactacaggcatgcgccaccacgctgagctcatttctgtatttatagtagagacagggtttcaccatgttggccaggatggtcttgatctcttgacctcgtgatctgcctgcctcggcctcccaaagtgctgggattacaggtgggagccaccgcgcctggcctgaagacaagaacttttgaacaagagagcgctaactaacgtattgaaatacataaaacaaatactgatatatagaagagctcattcagctgyttcaaagacagagctctgtaacacatgtactcttacctaaagaactgtctcccaccactggaaaggaggtcttctctgaccaaatacacagcatcttggagttggccagcattaacttggatcatctggctggccaggaaaggagtgctcagggagaaagaggatggtcaccatcccaaccagattggccattagatctatgtatcaacagagtgacatacgggagaattaaaattctagtatgcaaaaatacrccgtatgttaacagaaaatagactgcagggaaatttgtattaggtaaaaccgagagaaagttaagagcatacaacagtagataagcaatagacaacccgatataaaaatgaggaaagaatatgcacaggcaattcacaaaaggaaacataaaaatggccttaaaaattgctaaaataaatatttaagcaaaaaagctcarcttcactatggtttggggaaatgcaaattaaagcaacaatatgtcatgttttcacagtcacattaataaaagtttaaaagacggaagtagaggtaaataggaatttgaggaaaaggagccctctcatagtggttcattggaatgtgaattgctgcagctttcaaaaaaaaatcttacactatccacaaacaatgaaagcatagatatcttcttagctactaatcccactcctaggaaaaggagtattaattacaataggttctttattgcagtattgtttatataagcaaaaagagcaaacaaccttgacatccttctattagcagtaggttgaataaatcataagacgtctactatgaactattttgcagcaatcaagaagacttaattagatctctgtttagtgatttgaatgggtgaccatgttgtgatgtcaacagaaaaaaataatttgcagaaaagcatatagagtttgttctcaatttggaaaaataatgacaaatttggaggagatatcctatacacatatgtgtgtttgattgggtttggaaaaatcaggaccacctgagatggaggtgggagtgacaaaatatacatggtatactaagtgaatatataggttatacaattacgttgttaaatttctgaaaacaagtgcaacttaagcatataactaaggagtagatgttaacctggacaaatgaaacatagattgttttgagcaagagacrgcaaaattttttgtcaagagccagatagcaaaattttcaattttgcagaccatgcaatctctattgcaattactcagttctgccattgcagtggaaaaatagccctagacaaatgaatgtgtgattgtattttgataaaacttcatttacaaatacgtgctatagaacaaatttggcctgtgagccatagggtgacaatctccggttagatgaagggattgagagcattatttttcttcaattcttgtcattatgcaaagtcagagaattttctaaaataaataaaaatacaaattggcaaaataataatagttgaaaacttcagattgggcaaataagtgaacaaataatcacatgttgaggaataaggctgctttgattcttgtgtgttcaactttgaaacctttatcacagttataaaaaccatttataaaagtgatataactccacagagtatacctcaataaatttgcacatagaagaaatcaaaatgggtatattttctcatcgcaatacaccaaaaactaggaattaataagcaaatgatacattaaaaattcaaagttttagaaaacggagtaccttagatcttgatcaaagagaaatttaaaaacagccattgcagattacctggagaataacaatcgctaaygatcctcaagtgcatgtgcctcaagcattcttctaagtcctttacttgaattgatttacttagtctttaaaagaccctttgaaatggatatcatgcatatccctcattgtatagaagagaaaactgagacagacaggttaactaatttgtccaaattcatgtgacaggttgaggttagaattagaatatcgccagtcagcttcaacaacctgtaatggtaagccttacattatttatcttcttaattaggaatgctgaaacatatattactcataaaaatttctggggtgctgatgccaaaactgtcctcagagaaatttttcaatcctttttgttacttgacaggaaaaaattcaaataaatgaacaaaacatttcttaacaatttttaaattattaaaaacatatataaaaggctgctggagtaaggaattaataaagtaatgaacaaagaaaaaatcatagaaattataaagaaatctaaaagcagattctttaaagtgaccaattataaaacaaacagactgggtcaattgtcatttcacaaaataacaattctataaatatacaagaatgagaaagaagacataagcctgttgatattgaagagatttaatacttgataaaaatattatatcttctctattctaataaaattaaaactatccatgaaatgtaccatgtcagaagaaaaatacaatttaccaggtgtagtttaaaataggcagaattgctgataaacccatatctgtttgagtccatattttcaattcttttaggtatatacccagaagtggaattcctgggggatatggtaattctgtttaacttttcaaagaattgccagactattttccacagctgctgtaccattttacatccccatcagcartgcacaaatgttccaatttctctacatcctcaccaacacttgtcatttttctggtttaaaaaaaattattattataccaccctaaaaggggctgaagtcagtttgatttacattttcctaatgactaatgatgtggagcatcttttcttgtgtttattggccatttgtatgtcttttttggaaaaatgtctattctcatcctttgtccatttcgtaattgggttgtttgtttcattgttattgagttacaggagtcctttatatgttctaagtattaaatccttatcagatagggttttcacatattttctatcattctgtgggttgtctttttaatctcttggtggtatcttttgttcttgacttggactgcaggacacttcagttcctcactacatgggcttctccaaaggacagctggcctctcccagaatgagcatctcaaaaagagaagaaaacattgcagtgctttttgtggttagcctctgaagttgcacactatatcatttccactttattctaatcattagaatcaagtcacaaagcacagcccacattcaaaaagagaggaattgggctccatcacttgaagggacatgtataaaataatttgtggacatatttaaaaccaccacaaagaagcacctttaaaaaaagacaatggcccagttttgtaactcttttttaacttcaagaaatagataatccaagtattaatattatttaaactgttatggaacatagaaataaaattatagccataattaaagtttgccaaagattacaaatgaaaataaaataaaatatatctctggctcatttgctaatataaatactaaaaatcttaaattgactattaaataaaaccaatattaaaagaattatgcaaggggaacaagtaaggttattccagaaatggttccaaattaggaaacccacaaacttacaatattaaagagtacaacttttcttaaatgtcatataaatatactctctaatgccaaaaaacacaatgaatggttaaaatctaaaagcatgcttgaatataattaaagttcaaaggaaaagaacactcggcatccttcctattattcaaagtagttgtggaaattcaaaccagtaaaatgacagccccctgtatttagagagatatacatatagatatagatagagagagagagaaggcaaatttattattaactgatggttgtttacctgaaaacccgaaggaattatttgaaaggttattagaataggaaatggtagtgagatatcgagtaaaaaataaatacttataaattaattactttctttatgtaggtaacaaccaaatagaatataaggaggaaaaataccattcacaacagaaacaaaatcatctagaaagaaatttaacaggaaatatataggacttataagcagaagatttaaaagagggggacatagaaaaatacttcaagaaatggaagatataatattttatttaaaagatttaatgttgtggtgatgttaattatccctgaattagtatgcaaatttaatgtaatcagtttcaatgacattcttttttttaatttgacaagatgtctgtaaatgtcatgagacccaccaacagaatattctgagataataacaagaagggtgtttgataccagatcagaggtgggtttgatacccacctctcagtgtctggtaaccacctttctactctctacttctacgagttcaactattttagatttcacatgtaagaaagatcatgcggtattagttcttctgtccctagcttattttggaaggtattttaaggcacaaatatgttgtagtgtaattatgttgtaatttttcctgacctgatgtcccacgtctgtaaaattcttttattgaagcctaggctctttccctaggactccctgtctggaatcataaatatcttacttctgtacttaacagaattgttctgtctgcatatagtccccactttttctccaagtagtttctcaaacaaatgcacttcctttcctgaaaagatgagtaagattttaacagctttaaatctttatatatagatatattttaagccaaacgactacactgtacatggttttatagccctctttaatacttacgaactatattgtataattattctaattattatatattactctacaacaccatttttagtggttgcattttggttattacttggatagtccataacctacctaacaaagtccttaatgtctggaattaaagtggtttcgcatttcaactgttagcaaaaacactacaatgcacgatcctgcacacgtgaaaagaaatgagatgaggacttcactaacttcaaagacagcttaaggattcagatcttcacatgtacacaagagacaagatttgcagatttgagtgaaaggctatgcacgattttaagcctttcagtacatattgccaaagtgccctccactaaactttgaccatgacctacggagtgagtcacaacagtgactctttctttgagtttatattactgctaggttttgtcaatttgccaatctaatgggcaaaaacggcattttatttgcattttaaagtgtatttatcatgtttataaggaagctaaacttttcatatgttcatttgactatttccatttttcgtttgtaaattatttgttcataattctttaccatttttctacttgggtgtttgcctttttataattgatgtataagagttgtttttattatttttcctctgtggtttgtcttcaaatttgtatgtagaaaggtttatttgtaattattcagttttatcagttttgttcatagtagaatttttcctcaatgtatgtctatagaagcctcaaatcagaaacacgtttgcctaaatcacctagttcttttatggttttatttttgacatttaatctttgatacacacggattttgctttgatgaatgtcatgaggcagagatctagcttagcttttcagatatttgccctatcaatgaataattcagttttccgtgtcttgaaatgccatctttatcactgccaatttcttacaaaaacttgtatctatttcttgggctttcccccattttgctctagggatctgtgtctctattcctgcatcatttcaattattttacattttaaatgcattttaacatcccttctgtttttgtgccttaaaataccttccaaaataagctaggcacagaaaaactaatgccacatgatcttacttccatgtgaaatctaaaacagttgaactcatagaagtagagagtagaaaggtggttaccaggcactgagaggtggggagctgagatttggtcaaagggcgcagggtttcagttagacaggaggagtaagtttcagagatctattccacagcatggtgactatagttaataataatgtgtatttcmaaattgctggccgggcacagtgtctcatgcctatagctctttgggaggctgaggcatacgaattgcttaagcctagaagttagaaactaggctgggcaaaatggcaaaaccctgtctctaccaataaatacaaaaattagccaggcatggcagcgcatacctgtagtcccagctactcgggaggctaaggtgggagaatggtttgaacctgggaggcagaggttgcagtaagccaagatcacatcactgcactccagcctgggtgatagatccagaccctgtcaaaaaaaaaaaaaagaaagaaagaaaagaaaaagaaagggaaaaaaaattgctagaagagtagattttaaatattctcaccacacacacacacacacacacacacacacacacaaaacaaatatgagaggtgacggacatgttaattagcttaatttaatcatttgcaacagaaacatatatcaaaacaccacattttaccctataaatatatacaattattgtttgttcataaaaataaaatcagattttaaaaaatattcactgtgtttttttcagccatacataggctggaaccttcttcacattttggctccaacaatctagcttagtcacagcgagcacatctaaaacaacctctaggaggccaaaagtcagaggactcccatgatcctgtgctcttagacaacttttaaatgtatgataggagacaggcagaggaaaacacaggtaataatgggattatccttttctttcctttctccagtggttctcaacttgtttaattgcagcaatttttaagattttttttcttggcacacttgaaaagattgtataccatagcctaaacaggctagcaataagtaaaattcaatcagtacctaaaacgtaaaagagactcactgtgtctacaaaaacattgacggtcattgccatagtcacacagttccctttagctttctgtcactgtttcgggaagagctggtatatcagttaggatttccagctgtaaaagacagaagaaataaaataacaggatctcaaacatagatagtagtttacttctgtctcaggttaaaaatcacgaaagtaggcagtccagggtttatacgatgactccataatccacagaaacctgggttccttccactttgctactctgacctcttcaaaatgagagcccatcttatctcatggtctaaactccagccagtatagaggacacagggaagaagggaaggccaattcctttaaagacactttccagaagttgcacaagacactccacttacatcctctggccagaagttagtaacatggctatgcccggctgtaaggaaaggtgagaagtgaaacctttattgcaggtggccaatggcccagttaaaaatagagggttccattactaatgaaggagaggaaagtggatactagggatggcaccagtagtctttgctacaaatggttactgccctgatcacatttcttacataatcaagaggaaaagttcttaactgttgcagttactgcctcatcattatatggcattccattttaccctttaatttttacttggtcaagtttaggcctgctgtacaccagaacacatgaatagctttgctcagcattctttgtgacgttgctcacagtaacattatggatacctaataaattttttaaaagacaaaatgttctacgttttgtggcctactctggatggctttawggtaaagtgggtgagtatccctaccctttacatttcaagtgtaggggtgtttagctgtctcttctggctctcatttactgactcttctgggtaaatccattgttctttcttttatacaagagactatctgagcacccaaaacttgaaagtctctaagctaggtgctatagtgttaaatatttcagtaagatattttccctgcttaatccaggagcttgtcatttccttgctggaagtacacatggataaaataactgcaaggtttctgaaagacttaagtacaaaaatgtcctgcaaagaaaaagggaaatatctcattcagttgtgagggattaggaataaaaatgaattggagaggtcaaaatgtaagcttgtcctcaaaaagaaaggactaatttgcagatggagatggggtttcttccttccgaggtctgccatggtgtaatctgtcctgtaatgtctaatgtctacctgctattattttctaaatggtgagttaaatgggaaatatgtgtagcgtataaccattttctatcmtttgctttaggtttcgactcattggttccccatctactacttgtctcgtctcaggcaataatgtcacatgggataagaaggcacctatttgtgagagtaagttgaaatacttttctccacaaattcctctgtgtgatcctgacttgcccctggagtacaaagaataaattgaatccttcttgcacaaagtagtctctcagatatttgaaaataggagtcagatgcttcatggtcttcctggcttttctttatcttaaaaggtgatttatctgaaactgtgggcttgaacctaggcaaaataccctactttcccattataatagtaaatatttccagtatagagagtgttgtccttaatgagtacattttaaaggcgttagacaaaattagatctgtctttgccaactcttactatctatcaggttacaattccacaaagtaggctactcactttcttgttattctaatccaaataataaaaagaactcttcttccagttcttagcaattttcctaagcctctgatcattttgagttctaatcctccttcaattcttttaggcccatgtcttcagttgtatttgttctcgattagctgaccctccatttttcccataagatatttttcaatgaatctccaaaactttaaaaccatggaagaatgattgcaaattggcaaagtgttatagctgtgaagaagtcgtcatcgcacacagagttgatggcagcaaaagtaggcacagacttccagaaagctaatgaccaatataaacaaaagtaaagtaaataccctctgactgacaattccatttcccagaatttagcccaagaaaataatcatgaaatagtcccatgattttggtccagagatactcaatgcaataatatttgtgatagtggaaaatgttaaacaacctaaatgttcagcatggtttgaaaatagctagtagaagaaataaggcatattttaatggctatcagtttttcggaaaggtaaaaaagtgcaccaggaggaattaaaggttgagatgcctcatccaagtggaaaaagtacatctatgtagctacatgactgattattattcagccaccaaatatggtagtatagaaaatatatccatccatacatatgcatgtatccacatatgtatctaagaggatataattaaattgttacaaatagttatctttgaaccattttcactttcttctttctctttgtccatattttataaatttcctacaatgaatgtgttcattgtagtcactaatattcttcccccccaaattaacattgacttttaaacattaaatgaatgagaatgtatacaaggtgcctcccatatctgccaagaacttgaaattctatgaaataattcaaattatcaaagaattatcagtttactatacraagttttcaaggcatggcaccttttgtagggggttatcttttataaaaaaatttccacttctacatttataggtcagtgatcatttaattgagtcaatactggttatgtgtgtatatgtgtgtagtcacttagccaatatgtgaatattattatcttaygatagaacacagtattcatttatcattttattgcccttaaatctgccattatttcatttctcatgccttatcttttgtgtttccttttctctctttttcttcataaataatgccagaagtggtatatttaaactgcaaagaggttattttaataacctataggaaaaaatagtccagcaatagataagtaccttaacaatctgtgataaaatcacatgtattatccacttaaaattataaatatataaacccaaaaaaacatggattttttttgtgaaatatgagcagaacccatatcatacacacctaaatttcaactaggtaaaaatgtctgattattagcaaatattttaagaaaataacagtattgtaattccatttagaaaatcattggattatttgcatttggtatttaaattcatagtaaaataattcattattaaaaaataagctgttttaccatactcttccttctctcagtcatatcttgtgagccacctccaaccatatccaatggagacttctacagcaacaatagaacatcttttcacartggaacggtggtaacttaccagtgccacactggaccagatggagaacagctgtttgagcttrtgggagaacggtcaatatattgcaccagcaaagatgatcaagttggtgtttggagcagccctccccctcggtgtatttctactaatraatgcacagctccagaagttgaaaatgcaattrgagtaccaggaaacaggagtttctttwccctcactgagatcrtcagatttagatgtcagcccgggtttgtcatggtagggtcccacactgtgcagtgccagaccaatggcagatgggggcccaagctgccacactgctccaggggtgagtgtgacccatcaagactttgctgggtgtgagggtacgtatagatgataggagttgttgaaattaaggaagaagtgtataaggactatgaaattggcataaacataatagtagcttcactgtctgttatctctgttaataattgtctcaaagtaatggcttattctctcatctatagtagacatattttagatgcatttttgaatttaacatttacagcaaatatatgaagtagctactattggtatccccattttactttgagagaactgagtcttagtgatattaaagaacttttccaaggctctgactccagagcctaatcataatgtacagtggaatgtatcatgaacaataatgtgtaatagtgatgatcgtatctctatccctggagtggggcagtaggcaagtgagccatgaggaccaaaatgagagcatcaaatcaaaaaggccttggacttcaacttcaactttttctcattataattgaaaagactgaagctcagaaaaagtgttttgctcaaatccaaacaaatatatatatatgtatatacacacacacacatatatacttgatatataattatatattgttcagattgaggctcaaattcattctttgaggttttttgattgtttgtttgtttgtatgtttgtttgagagaaggtctcgctctgttgcccaggctggagtacagttgtacaatcatagttcactgaagcctctaactcctgggctcaagtaagacctctgcctcagtctcacaggtagctggaactccaggtgctcactaccacacctggctaatttttatttatttttagagacagagtcttgctatgttgcccaggctgatcttgagctcccgtcctcaagcaatcctcctgcctcagcctcccaaagtactgggatttcaggcctgagccaccatgcctagtttcaaatgcattctgatgccctgagaacacaccaattgtcctgtggatggaggcagccaacatttcggttaaaatacggtctaagcaatatgttctatcactaaaaagtctgtagcttttttttctttgagggggggttgttctttttgtttatttttaatttattaatctttaatttttgtgggtacatagtaggtgtatatatttatgggtatatgaaatgttttgatacaggcatgcaatgtaaaataatcatggagaatgaggtatccatgcccttaagcatttatcctttgtgttacaaataatccaattacactctttcatttttaaatgtacaattaagttattactaactatagtcaccctgtcatgctatcaaatactacatcttattcattctttctttttttttttgtacccattaactgtccccacctcccctccctaccctcaccccctatccccacgattttgttcttgatgcctcctcttttcttagctgaaatgactggcttaaaacatggagtgggaagaattaggactggtcacagggacagaaaggaagctaacagttcagccctgtgctgactgaaagagggtcagggagtgtggaaaatgaagaatacgtgaaggtgtctgttagatgagaccttggcaacagtactccttgctgttgccttacgcatgagcttgagggactgcctctgtaggaagtggaagagtggccaaaccacccgcactcacgactctgtgctccataaccagtagttgaaagcaagaggaatatgctgccttatagtctttggaacatgtttcagtagaaaaaacacagacaaggtgttggagagactttgattctagtcacagttctgcttggtttccttagcttccttgttagtgagatgtggctactgaactaccaatcttctcttttaatagctgcactctgcaatgacgatttttaagccctctggtaagcataagatatarcaaaggaaattgccccatatctaacaagtgctctggaactgtcctttccacagtgtgtcagccgcctccagaaatcctgcatggtgagcataccctaagccatcaggacaacttttcacctgggcaggaagtgttctacagctgtgagcccagctatgacctcagaggggctgcgtctctgcactgcacgccccagggagactggagccctgaagcccctagatgtacaggtgccttgactctctggcttccagattgctctgttttccccttcacatggaggacttactcctgttgttttattttttcttctagtgaaatcctgtgatgacttcctgggccaactccctcatggccgtgtgctacttccacttaatctccagcttggggcaaaggtgtcctttgtttgcgatgaagggtgagtgtgacccamcgttgagaccaaggactcagtgtggagaatcactctcttgagatcaggggttaatccaattaaggagctgacctagtagataagaagtacccagagagattaatttatggaagggtagttttgaaataagrgtagggactaagtggcaccactttcagaaggcaatgagaaaatggcacatacagctcaatgtcaggtacaaacctaaatacagtcactgatcttgagtacacagttggaacttgaaatgaatgggtacgtatttatttggaggcaaaagaacataattttataagaggtatgctagaaaataaatgatgaataagacaaaaattgtttgccccataagaagtaaggtagaggttgtcttaagaaacttaaaaccaatcaatagtggaatctgtaatagtgcatggataagtgtgttttaacccaataatatatcttcaggtcaggaatggccagtgtaattcttttaatgcaggatttttctcagccactttgccagccagtgacttctggacagcaatgcccctgcccaggccttgcttgggcccaggctcaccgcaggaaacaccccagatacttagcccactgggcggcgtctggctggtgctctgactgggaccctggggccaccatgactgcacactcagcccctggtgggaggggatgtgtgagtgagtgagtgtggggtccagctggccactccaagcacctgcacaggaatgggctctgagcagtgctggcggctggaccaggcatgtcacactgaagggaacgtggtggtgcccaaacaggggtgcccatgaccccaaagcccagaggaggtgttacagcacactaatggctcttagcatttgataatgcctgcagcccaacagatggcagtgtgcttaacagctctgtcaatcctgtcgccccacatctcctgtcgcccagctctggcttgatccgctgctgcttcctttcgcgtggtacagctgccctcccacagcagagggcggagggccacagtgttacaggcttctttgtacctgcgtttggtgggtcctgagttgttgtcccgcatccaagaagaacaaggttatactgacaatagaagggtgaggagggtggagaagagttttattgagtgacraaacagcttctcagcggagacgagacacgagggtggaccccagatgaagtcagggggtcattctctctctcagcgtggctggttctggggcttttatggacacagaatggggagcctgtgctgattggtttgtgactatgcaaaaaagactaaaacaaagacaccactcaaaggtgggcacaacagtgtaaaaaaccaattagggaagctcaggtatatgtaaactaaatgaacagtgaggatcaatcagaggaaagcacaccaaatgggaagagaggttctcaarccagtccatggatttacctggaacttgtagctaggctttaaactgtcttcagcttgaaggtcgggtttcaccgggatctgccccatctgcctaggatttgtctgcctcctgcttctatcagtttcaagtggtattattagttgtttatgtgtatccattactcttggtggtgtgcactatgagtctggagggataactagattgggcaattaagcagttatttttaatgatttccaaagaatcttcggcatttacaaagtccaccacctaataatgatttccaatttcagaatgatttcagatttcagaaggcaagcaggattcaataagttgggcattttggggtgcaaagactcttcccccctcccttctttttttcttagagcacgtggttcagcatgcttctgtgagcctcctctggcctgttacagttgtagtagcaagaagaacagtgcccgttctctttctagatgttcctggctttgcttaccaaatcgagagctgttctgcctcatgacccactaatgagaataagtgggatgtcagagagccatcagtgaaagatgacacctgaaggttatggctcttgtgcccatggagaagtatggttctgtgttcatgccttctgtaggtgatgctgggctatgaagtttatatggcaattatgcacatcagctctaattgctttgccagtcacagggtaccatggttctttagaataaattggcctttgagtttctgtcagctactgaagaattcagatccctaatgaactaagacttttagctgggcctgaacctaagacctaaatgatagtcgaggaggaaatggtagtgaggaagctgagcatctattagcgaagaaatcaagggagagatgggaattgctcacacatttgctaccactttttttttctttaggttccgattaaaaggcaggtctgctagtcattgtgtcttggctggaatgaaagccctttggaatagcagtgttccagtgtgtgaacgtgagtagaaagaactatgtagtttggatagctctccttattttcgttttccagcatgtttttccgcatggcatcacctgttgtctagatctttacttaactaaattatggataaaaatacttctttgttggaagaatttcaagaagggtcttgtaggtcttctctgacatgtgtttttgttactaatctgcaaatcacttagtttaatgactgtttaattttgtggggaatgtgtggcaagaaactagatgacataaaggtgcagcacgttttagtcagtcatttatttttagttttcttatcaaggaggaatctttcttaaatttttatttttatttttattttctgagacactgtcacccaggacagagtggagtggtgcaatcacagctcactgcagcctcaacctcctgggctcaaatgaccctcgcacctcagcctcccagtagttgggactacaggtgcatgccaccacacctggctaatttttgtactttttgtagagatagaatctcgccatattgccccagctggtctcaaactcctgggctcaagctatcctcccaccttggcctccaaaagtgttaggattacaagtgcgagccaccatgcccagccaaatttttatgttcttttatcccctcgcatatcataaacaatttagtcagcttgttttttagcctgcagtatttaatgacatagggcttcccatgtgccaggactttccatgtgtagaaaaagcratgaatagtgaatgaatagtgaagacacctccctactttcctgggatgtattttcttgttgggaagcagactatgaacaaggaaataaataagtaaacaaaattctaaaaattataacatataaaatggtagttaaatagggatgttatggagaaaataaaacagagttatatgataaattagtacgatggaaggagctgggatgatgaatcagtgtctgaaatgatgaggtgtcctaagtttccaaaccatccgcttaaataaaatatgccaaaattcagaaaaaattcagaaactcttagataaaagtacatgtttgacataccaagacattactgattgattctattctgtctactaaagcaaggcaagaattttttaaaccttgttttcctgattattagaaaatgtttattttaatttgtattgtgttaaaataacttatagaaatcaatttggataccttatggtgagtattatggtgaagaacattcaatacctgaggaaactcaagtattcaacaaactcaaccttacagagacacatagagctgaaaataaatatataaataaacttaggaaaacacaaacaggtaaaattcaagcatgagaagtcaatcattgtttgatgtactaggtcttttatatacacataattctgataaatttgggtatctcttcctaaattcatrtcaaactagaagcatcaattgcttttagggaaggaactgttctaagcagactaaaaggaggaagaaatggtggctaataattggaagaaatcaaaaaaggctctttggcaccatttaatctgagtaaaaacagccttactggtgtctgatgacaccactggaaatttggtattggtcctgatggtaatggtcttgaatcacyaagaaacatttacattgctaaagatgatagctcatgtttattaaagttcatagatttccttgaaacttatggtctctgatgaccaaaactttgtctgtcttgaacctcattgtcaactcaggaatcttactatgcctgagttaaagtagacaaccaaatgggtgtttttaaaaaaaataaaaacaattactttccaaattcattgtgaacataggtacctgagtggtccaggaacactgtctttgggcttttgcaataaactgtaatttaggtctcacttcagttagttgcctctcaacaaaagccttacagatttaaattccgtctaccttagttatattctttctaaaagttatattctttttaagcgcacagtcacaggtcactattgtttcagtcatcttaagtgaaattctaatagaacttaaagctcttgttttctttctagaaatcttttgtccaaatcctccagctatccttaatgggagacacacaggaactccctttggagatattccctatggaaaagaaatatcttacgcatgcgacacccacccagacagagggatgaccttcaacctcattggggagagctccatccgctgcacaagtgaccstcaagggaatggggtttggagcagccctgcccctcgctgtgaactttctgttcctgctggttagtacctgcttccacatatcctaaatgggttcagaatatctaggtaagaacctccatatttctatagtgacagtcatttttgcttgtgaaaatggctttgctgtaactgtcagagacagaactacctcccaagtgaatgacaaaygggttatagataggcacgctgtctcaattgttggtattctgatggtccttcctatggggtgaagagtgtgggatggtaaggagagaagggggtggacagtgaagagaattgatgaggtccagatttagtagggaatgttttcaaagtactgaaaacaaatgctaaagaaaatactcttttattccacctctactactacgagttatctttatcctggagagatggatgtgctgtgcaaaaagtacacattgatgatgtaatttacttcagaactgataacgctataaaagtaatttgagaaactcagatgtagggatttatactttttatgttgtttccaagggtttgttcaagccactgactatgtttgtttgatccttcacctcaacattaacaaagggaactcaggaggccctggagaagcagagtttaaaattgtactcttagcctaatgggtgcagcaaaccaatatggcacatgtatacctatgtatcaaacctgcacattgtgcatatgtaccctagaacttaaagtatatatatatatatatatatatatgtgtgtgtgtgtgtgtgtgtgtgtgtgtgtgtatgtgtgtatatatatatgtgtatatatatgtgtgtgtgtgtatatatatatatatatatatagagagagagagagagagagagagagagagagagagagagagattgtactcttagcctccatagctcattcctttgatatattagtctggctttaaacgacagtacctgacaactgtaggcacatgtgtggctgtgactgcccacaccagttccatcttccagtaaggacagaacagcactgaatcggtagcttgtcgatccctgtggtactcccccatctgatctagtttgaagttagagactgtagaggatagtgtttaaatgtcaagaggtctaggtttagagaacccgtctttcactgatcaaataggagggagtggcttatgacctggctggttgaggtcttcatgtacctctaatagccagagatattggatgtgttcatgtattcatatgtctatgtttaactgagtgtcttttcttgtgtttgtgtgggaacttgttcttagcctgcccacatccacccargatccaaaacgggcattacattggaggacacgtatctctatatcttcctgggatgacaatcagctacatttgtgaccccggctacctgttagtgggaaagrgcttcattttctgtacagaccagggaatctggagccaattggatcattattgcaaaggtgacttatttcttggtattccttattcttgctgggttgtatggaatgcatgaggcttgtaaggctgagagacattgaaatgagcttaatgaaagggataatatttttttcttctcggcaactgctttcttttcatttacataaaattatttcatcttattaactgtcctctttgcatggtcgatagcagtgcttctccatccagagcattaacaaaatcaccttgttaaaaagattctcaaactccattccatggcctcygattctgttttaaagtggggtcaaaagtctatttttaacaaactcatcagaatgctctgatgcaggaagaccacagaccacacttcaagaaataccactttgccttcttggtttgtatctaggaaaaaaatattgtaggcttaattttgagactattacaactgaaaagaagtctgtgcttgaagatgaaggatgtactgatggctgggcagaaaaagaaagtaaaacaaaggataagttaaacaaaataaagtagtctgggtgcggtggctcacacctgtaatcccagcactttgggaggctgaggcgggaagatcatgtcaagagatcgagaccatcctggccaacatggtgaaaccccgtttctactaaaaatacaaaaattagctgggtggtggtgcgcgcctatagtcccagctactcgtgaggctgaggcatgagaatcacttgaacccagaggcagaggttgcagtgagctgagatcacgccactgcactccagcctggcaacagagcaagactccgtctcaaaaaaaaaaaaaaaagaaaaagaaaagaaaagaaagtaaattaattagaaagatgtattaaattcaggctgggcacggtggctcaggcctgtaatcccagcactttgggaggccaaggtgggcagatcacctcaggtcaggagttcgagaccagcctggccaacatggtgaaaccccgtctctaccaaaaatacaaaaattaatcaggcatggtggtacatgcctgtcgtcccacctacccgggaggctgaagcaggagaattgcttgaacccaggaggtagaggttgctgtgagcccagatcgcgccactgcactcctgcctgggtgacacagtgagactcaaaaaaaaaaaaaaaaagaaaaagaaaaagaaagaaagataaattttaaattcacaatcatgatttactaacttctttgttctatgtgcagaaattggccagaattatgcatttaataaagagcagagtgccagtatttgttgtgaagccagacagaattaacatggtactcctgttccctcacagmgtgaccccagtggctccagggctagatcaccgttagcctaattcctaatctttccacagctttccagttgcagagctgttaatcaacagtgaatgcacagtacattccatattctattactttacattaagaaatgggagtcaggaaatgttaaatcataaggtttttggaggaggaagattagtaacatgtttaaaaacatgcttcctcttagccaagggcaaaataggttttggctattttctcctattctcgcagttaaaacggacaatcaacaataaaatatcaatttmtttctgattkgtctaatttcagaagtaaattgtagcttcccactgtttatgaatggaatctcgaaggagttagaaatgaaaaaagtatatcactatggagattatgtgactttgaagtgtgaagatgggtatactctggaaggcagtccctggagccagtgccaggcggatgacagatgggaccctcctctggccaaatgtacctctcgtaagtgcaagtgcaaggaatgtgggatcttcccggtcatggttattgctcattcattcatccatattggcatcaagtgtagtgtgatgtttatggcatatgctatgagctatagagtacaatatgagcatccacctattccaaaactcccatagtgagagtaaggccagacttcctcttctcatacttctcactgcagctctgcaccttttttgtctatatcactttgtggttgcatgagccacacagtaatgatttatttacagcctacgagccttacaagaaatgttttcagcatgagttagggagcaccttccaagctgcagagagcagccggcctgtctccctcactactggaggggacaggattttaagctagcacagctggatagagcagatttagaaattacgtatcattgagctctgtagaagagtagccctctgctggcaactggaaggtactgtaagatagaaaactacccacatcatggagcagatgagcaaagttaataatgaacagcctttcttaatccaagttagtgctacactttccyttctccccatctcttatgactcttctaatacatggttctacaccaagattgttcaagatccagttttacaattaatcctgtaaatatgctaatatgactcgcagataatatttctaaattatcagcttgacactcccttaatatcaaattatatttgcttttttggcaaaaatctcactggataacttactaaatgcttttagagtattctgaagatctggctgggactgacagaaaattcaggtcattggagaaccaaccgtatcaaatattagaacaaaatataaagcaataatacaaaagtcactttgcaccaggataagaagagacatacaaataagtggaacaaaattgatattaataaaataaaggggccaggtatggtggctcatgcctgtaatcccagcactttgggaggccgaggcggatggatcacctgaggtcaggagtttaagaccagcctggccaacatggtgaaaccccatctgtactaaaaaataaaaaaattagctggtcgtggtggcagatgcctgtaatcccagctactcaggaggctgaggcaggagagtcgcttgaacacgggaggtggaggttacagtgagccgagatcgctccattgcactctggtctcggtgacaagagcaaaacattttttaaaaattgtccattaaattaacaataaaaaggttgttaggtgaacacccaatacaaagcaaggatgtgatgaaactgatattgttgtgtgttgaaggtactattgtaaatttgcaaaaactcttatgaaaaacaattatgaaatgtatgtggaaaataatacaactattcctgccagttagccctcctagaaatttaatctaaggaaataatgtaaaatattaaaatattctatgcattttattaagggtttcatgagacagaaacctagaaacaagctaaatgcacaatagaagtcattgaatacactatgatgcatctactagattatgttagtttgcctttgttgtaacttatatttctagtatataattatgtgaaaacacacatataaggaaatgtaccagaacagaatgtatcaaaacattttttgggtatgaggattggggtgacttttttctttagttctgtattataaattttcttctgtaattgtattaataataatttttaaaagtcttctctgagtgcagaaggtaaaatgagagtatgtgaatgaaaccaatggctttttgcattagaaaaaatattagactgagtcctgaagaaaaatcaggatgacttgtcactggctgagaggtcctgttcaatcatgttgcatgccagagtgatgttttgtgacttttgtcttccttttaggtrcacatgatgctctcatagttggtaagttttatgaaagttttgctgaggaattctggcatctataacagtaagtacctacctataatgaatgaaatgtaaaaagagagatcaaaatgtcttgaggtgtaaagagatcaaaatatcttcagttgtaagttcaactagaaagaaaataatgataagttaggccacaatatggtgaaactggcatcgtcatatgcatactaaataaccttcatcaaaggctctttactatctttgaaccattacaaatgaataatcattcatcagtgtcaaaaattctttatttgaatgtggtgggagaatgcaacttcttctttcagttgtaacctggagtatgcttccagatggtgatcctgctcatttgcacaaatagaaagccataagaccagtcttctgagcccatatctgtgatttgcctaaataagaatagttttgtaataaagtttgcttccaagggaatactgtggcatattactcttacatccctttttacgcatctggacactgagacacagagagttaacgtaacttgtccaagaccacagaatggggtagcctgggtctacttatctgtggagactgtgcactttaacaatcaataaatggacaaaatgacctaaatatgtaattcaacaagagagagaattccagtattttcacaatgaaatgcctgtgtgttaagtcttaggcaagagacatgggcagggccatggagagctggtggccagctgccccatcacggttctcacttacttttggaaaagctgacattggactaaacgttacaaaacggctcagctcacaccttaactttaataaccctgtgggagtgagactaatgctatagaaacccagagtaaagcagaatgtatagttacatctttaaaaaaaaaaaagcattggcaatctgtagtgggactggatactaagatagaatttaaaacctgtaagttatattttccatgcatttaattaccttgttttactgcctaggcactttatctggtacgatcttctttattttactcatcattttcctctcttggataattctaaagcacagaaaagggtaagtatagccatattatcccaagaaatgtaaactgtacttaccccctcttggaagtcaaaagaaagtaaaagacaaacaaacccattgctacataaacagatgtggtaattcttataaagaaagtccttgacacacagtatagacaaagaggtattcacactaaaggaagtatataggatactaagaacaattaaaaaataataataataacaaaaaaaagaccatttggccaggtatggtgactcatgcctgtaatttcagcactttgggaggccaaggtgggcagatcactagaggccaggggttcgagaccaacttgggcaacatggtaaaaccctgtctctactaaacatacacaaaattagctgggcgaggtgggacacacaactgtaataccagctactcgggaggttgaagcatgagaattgcttgaacccaggaggcagaggttgtagtgagccaagactgtgccattgcactccagcctgggtgacagagtgagactacatctcaaaacacacacacaaacacacacacacacacacacacacacacacacacagcattttaagaaggaattgagttttacagaaagagaaagtaggcagaaggggtttttaaatagttgttcatgaggctgtttgatatcctagttttgctaagacattgcagacactgacctctaagcccagatcctatcatagcactagaagttagattgggtcacttatggcacacatatcatatggcacacataggctgccagtggggaagaattgaaactttccattgggtattttaatatataaacaaatattttgtaaacaccattaactttttttttttttttttttttttttttaagaccgagtcttgctctgtcacccaggctggagtgcagtggcacgatcttggctcactgcaacctctgcctcccagattcaagcgattctcatgcctcagcctcctgagtagctgggactacagccatacgccactacaccaggctattttttgtatttttagtacagaaagggttttgccatcttggccaggctggtcttgaattcctgacctcaagtgatccacccgcctcagcctcccaaagtgctgggattacaggtgtgagccactgggcccagccatcattaattttttaaatttgaaagaaaaaaaacttgcaaagactaagatctgaataaagaaacgtctttgacagggaagagaacctacacagcttttgtactggttgattgaattataacaacctcaatgaggccagaatcaataatatcaatgttatatggttgatgagcaagttctatacccatagaaaaactgaatttgtaacttttaagtgaacggttttctatagcaaatattctaaacaagtacagtttcctacaacaagctttacagaaactgaagttttgatatttcacaaagatgccaatatactttttaaaaagtagtttgtcatagtagatcttgctgtaaagaacctagacaggaactcaatttcatggaaaaatactgaattggtagatatttaaatttaaatatccatccttcctaactaatgttctctatattttacggcttgacatatattctttgctcttttccattataaaaagaaaaggtaagtagctgggcactttaccttaacaaagtacttgtgtcaatacatttttcctcttaaagtttctcattaagtaccatataattagtgagttaattttttaaaaaattactactacgtctgaattaaaggagttggggcttctaattttctgtatctatatcagtctgtagttaaaaccacacaggggaaatgattatcccttcttcttggaagtattcaagatactttaatatcttgaagatatttgattatctccacccttctaactatgtcattcttcattacttatggtccattccttgttaatcaactagagggtcacactcccaagcctaactattgatttgtttcacctacataatttaagatcatttcctcatattaatcaccttcaggcataaacatgactcaataaccatttcataaaattatttctttggaaatgattgtcttgtaaagtctaagcaacctgagaccatataccatttcttcatgttttccatctcgtaaaacctgcctcctatttttttcatattctttaaagtgtaatgtccatggcacaaccattctctctctgaccagtggctaccagaaatgtggcagaaagaaagatcatgatccttgttagacttaaaggtcagggaggtaaacctcccaaacatctatgtaacccacactaaaacctattctatatgtgtaatccaggaaagtttttaaacattttctaaacttttacttttgacctgtttcacttcttgggattgtaactgcctgatgtgttcttcctgcctgtcatacagacaaaaccagttccctgagataatggcatattgcagtaaagaaagagatgaattaatacaaggccagtcacgtggaagaactggagttatcactcaactcagtctccccaagaacacaggggctagggtttttatagatcatttggtaggaagggagctagggaatgggtactactgattggttggggatgggggtgtgggaaatgttcctcatgtgctgtgtccacctctggttgggggccacaggaccagttgagtcatgagtcacargtccaggtagagtcagtcagttgccaaatgcaaaaacctgaaaaacatctcagaagaccaatcttatattctacatagtgatgttatctataggagcaattagggaagtcacaaatctctgagcagtaatggattataaaacctatgcctatattttagcagagttcaggtccctctcctaatcctaatctcttggcctttcattaggtttcaggtcctgagcaaggagagagctagttttaggaagagactgttattatccttgctccaaagttacattataaactaaattcctttcatggttagcttggcctacacccaggaatgagcaaagccggcccacctgtgaggctagaagcaagatgaagtcagccatgttagatttctttcactctcagaatctttgcaaaggtggtttcagcatagtgagtgcatttatctaacaaaacaccactgattttcatgttagaaataacacatagctaaaactgggaaaaagaagtaataaacttaaataatcagaaggcagaggtcccttctttcggaaggagttgggctgattaatcatgcagtcatacctccttgagtgggtgtggccaataagctaagtcattgtggctatgtgaggagggctgattattccttatctggagctcaagctttcctcacagaaagacaagggcataaagggcctcatggcaaagaagaaggaagccatgtgggaaacacagactatgagtggagagtatcgtagtggtcaccaagtcagaagagccatttatcctggagctaaaaaagactgacagatatagaatagtgtagaacaagatggcctgctctatgggagagccacagtcacaccaggcctagagaggtgcaggctgacttctacctcaaacactggagacaattcagaagctgcataagcagtctgaagacttactaagaaactaaaatgaggctgggtgcgatggctcaggcctgtaatccctgcactttgggaggctgaggcgggtgggtcacctgaggtcaggagttggagatcagcctggccaagatggcaaaaccctgtctctactaaaaatacaaaaattagcctggtgtagtggcacatgcctgtagtcccagctactcaggaggctgaggcaggagaattgcttgaacccaggaggtggaggttgcagtgagttgagattgtgccactgcactccagcctgggcaacaaaggcaaaactccatctgaaaaamataaataaataaattaaatwaaataaaacaagaaaagaaactaaagtgatagagaaatagaaggaatacacacacagaaatgatctcaccttctttaaaatgctcctcaaggaggtctactttaactatcctagtaaagatgacatgaccccacccccacattccyagtctctcttatcctgctttatttttttcatagccttattctcttttattataattaattaaataattacattccatgtttattctctctctccctccatgaagtcggggatttttgtcctatcttcaccaatggatacacaacaaatctaaactgtccctgggacaaagagagtctcaataaatatttatcaaatgaatgagtgagctacacaccactaacagtgttaccacaaggggaaatttctgccgtaattctctaccaagttgaacagtgcgtctttaacttgtcctaaacttactccaggtttcaaggctgctccttgttctaatataccaactgtctcagtctgttggtatatatacttgggcagttataacagaaactccatagactgggtggattcaataagcatttaagctgggtgcagtggtacctgcctatagtcccagctatctgggaggctgaggcaggagtactgcttgagccaatgagtttaaggccagcctgggcaatatggtaagaccatgtccctaaaaaacattatgtcatttctaaaaaccaagcatttttttctcatagttctagtgggtagagagtccaaggtcaaggcaactgcaaattcagtgtctggtggggatcgctttctagttaatagacttcaatcttttctccgtgttctcaaatcagagaaaaggagtaaaggagctctcctggtctcttttctaagggcactagtcccattcacaagggctctgctctcatgatctaattacttctcaaaggtctcacctttgagatcctatagtaattagatcctataaattttcaacatataaatttggaaagatacaaacattcagtccattgtaccaacactgcatttggtaagcacatatgcttaaacgatatcacacttgatttcatgtgccttctcaatcctcagctttccctgattaagaatacctaattactctgcccatttcctcygcaccctccaccttggcctttccactcactattactactatctcctgccttcttggtctctactattctcctcaccatccctgctccctggactatgatcccctgtgagcagggaccacctatatccacccaaagcaatttttatttaatgattttttaatctctacttgtacagcagtcaaaattaataataagagtagaaatggttaatgtatctacaaaaagagttaacatgtttatttataggtttatttaccatttattatcttctttggtcctcaaagcaactctgtgaggtaggtaggcccaatcatattgttatcccaaagcataaaacactctaggttcaaagaaattcagtggcttgtttaaagccagtaggaagttgttaggaattaggcctttagtccagattatttaactggaaatcttgaactctttgtgctagtattttgacaatgttagttgccatttctgaatctgactctatattactgaaattcagtatccagaactgtacatagtacaaacctaaagtattttccttttttctttcaatattctttttctccctatattttactgagtttgttttagctactttggtatattgaaccagtatctttctagagaaccgtatgcaatctctactttttttactctttattctgagtcattaggctataaaaaattaaggtatttctttaagggcatctttccatattgagatttcctggcgtttcacacagacttggcaagttcttcctgtgatttaatctcactgccttgttatttcactagttaaaaatatgcgcctgcacgttttgatatttcactgtgtatttacaacaataatttgtgataatgttaaataagataggtcataagataggtcatgcactcatcagtgaggaataatactggttagacttcttcattcagagcccattattgcctcttgttactgcctcgtacccactcccatttctacacaaaacagccttgtmcacagtcaaaatttcaaagtttccattgttgtgatgtttagaatgataaaatacttaaggccatcctctgtgaagtctccctgaattttcctatgttcacattaaccaccagtaactaaccaaatagctcttcattcaacatatactcaccgagatcatattctccaaaaccccatgtaccactcatcacccaagaccaccttcagaacactactcatcttaccacttaaccaccactccttggaaggtcataccacctggctatataccactccactcttcctcatccatggatctcaagtgtgccttccctgtcctgtgaaaactctgccccctgaagcagtctgcctctttttctcaaatgatgctgtcattctaatttccataagatggtaaagaataactgagtgatgaggaaacagtggtacatgttgaagtgagttaactcttcaagcttccattctaaaayccctaataccaactcatacataaaatctccaggtactggtactgttttatcatttcattgataaaagatgaagtgtttattaacccccaaagaggcagtgtaccataccaagtgagggtgagggctttgcaaccgctaaggcctgtgttcacrgtcactcactctctatgagaccctgagcaagatacttatcctcagtaaatttcattttccttgcctgtgaaatggagataataatagttmctaccttacttaacatagtgcctcatttatgatgcatgtcagaaaatgttagctattatttacacatgattgttattactgatattaaaaagtgagtaaatatttctttttactgttagttcttaaataccttcatgacagctactgctgctcccctaaccgtggatattgcttgtacagaaaacagaacacatatcttcactataggagaaaaaggaagcctcgtgtaacactgcagtgcaaagtcattcatgttgtgcagcttaagtgtcaaaatctcgatgtaaatcctatttactaatcaaaattatgtcagaaatagtgaaatgtrttaaggcatggacatctgcctataaacaatttagagtactctgacagaaaatataggatgattttagtattattttctaatctaagtttttgcttagtattaaaagatgagatttggttatgattttcctttcagacgtcttgcaaagatatcaggaacttaaggcaaataataccttaaatttcaaaatgcaaattactaatttctttcaaaacagatacttaaatgattaagacagtttttctatttttttctctgccaattagcaataatgcacatgaaaaccctaaagaagtggctatccatttacattctcaaggaggcagcagcgttcatccccgaactctgcaaacaaatgaagaaaatagcaggtacctatatacatactgaattcaaaatgttttcaacaactcaaatatcaaaaatggaaacaggacttgaatatgatattgcactaggtaggtcattgataccaaagaatttagaaagtacttcaggagttggaaacttcttttttttttattggattattattgtcatttccamtgttttggggtgatgactctataagttagtacagtcacagtcactactttttcaaagcattcctataatttcctgtatttatgctatgaaactttgmgaagtagtatgcttttttcttgtggaacccaagaatttgctgcctgcttgtacctccaagtcttccagcttcccttaaatgcacagagtcactttaatgtcctctagagactttcactttacctccccagccaccaacccccttgatttctgacttccactgaattctctacttcatttggcctctttgactgctccttcttttggtcctcattcccttgggcttattaaatacctaacctttcattctacctattcaaagcaggcttactgcaagctgttgtgcagtacacattgctaaagatttggggtgaaaagggaaattataccattatcaaaagtggtatgtatcaatattagaaatcactgaactgaaaagtaactagtacaccagggacctgaaaactaccacctgtgagccaaatccagctggccacttgtttttgtgaataaagttttactggggcacagccacacccaatcgtttgtctactgtctctggctcccttttatactacaacagcagagctgagtagttgcaacagagaccccaaaagccaaaagtatttactatctggccctttagtggaagactttgctaacccctgaactatatcatactatgagaaatttctcactggctagttccccttttaacctgggctttccatcctcttcccaggcctctctctctcattggatactcctctcttttgttcaaatctttactgcattctcagggtatgcagtaaatacaggcattcagactctcgggcttcttgcaaattcaaaactccatttttctttaaaattcagagcaatttatttggctctggcttactttggctatgcccaagaatcctaaaatgtcctacccataggtgtttggaacattttcaggaataagatcaccatatgccctagaacagaattaggccagtcctgtagaaagcagaagcaaaagcaccacaatcattactgaatttcctttctttatgtcctacctctttctcatatacctgtgcattaatctaaatttggcatgttacacctacatacatcagaaatcctaaattcaacagaggacagtggaaggggccccaggaaaagtaaaggaagtggaaaaggtattttatagttaaccaaaacataagtagaagcaattcaaacttttctaaacaaaaaattacagattatgtcctattttctcctataatagaaatgaatttgcaatgccctgtttattatctgtcttcctagttgctttgcttctagcttatttgtcattactgtttatgaaaacaaatgaaatatgcattgcttttttaaaattcagaattgatattttactttttgaagctttaatgtttatctggcctgatccttctcaaatgggcatatgtatacactgggggatacatggctaatgctaatataccaaggggatataaaaatcataagatgaaaatggcatggtttcctagagaatatatttttctaatattactccaatagttcaaataaaaattgtattatttcaacatgaacacaaacacatttataagggaggaaaagacaaataaataatgcaggaagtttaagataaaataagacggctgggcgctgtggctcacgcctgtaatcccagcactttgggcggccgaggcgagtggatcatgagtcaggagatcgaggccattctggctaacacggtgaaatcccttctctactaaatacacacacacacacacaaaatttagccaggcgtggtggtgggcgcctgtagtcccagctactcgggaggctgaggcaggagaatggcgtgagcccgggaggcggagcttgcagtgagccgagatcgcgccactgtactccagcctgggtgacagagcaagactccgtctcaaaaaaaaaaaaaaaaaaaaaaaaaaaagataaaataagacagaaaatattgtgctttcagggatgctttagactatgtctccaaagttcttgcgtgaggcattcattttcctttactatcagagtgctatgggggaaaagtcaggcagaactgattcagggccagctgtgtggccactcatttacaaacagacgaaataacagcagactggaagaacaacaaccatttttacaagagttcattttaaaaatattccacaatgataaattatttgatttagcctcattcctgtcagattacctgcctaaaacacttttccgcctttctttctatctaaattccctgaacccagctccagctctgaattcaatcaaccaagatgctctcccaaacaactctagtccaaaatgatatctctctttgaaactcacatttcctgactacaccatttaaaaaataaactaatttattttaacagtaatatctcatcattgttaaaaacaagaaataggggaaaatataaaaaatataaaaattacctgcaataatctctatctagtagtattcttaagcttctttgcatattrttagacatttgcatatacaccttgagattatattgattgcacaatattgaatcctgctttttttaccaaatgacaaacatttctcccatcattataacagtacataacctatagtaattgacatttcctgtgttgttttttgcctgttaactctattgcattcatgtagttgcttatttattcttcaaacattcttagccacttacaatgtgccatacattgtgcttatgtgtgttttcttttccatgctaaattaacytctgatgaatagagacaattttttaaagatctccccaatctctgagtataatcaaatgagaaatgttcagtaatcaactgagcacgttaatcaattgagaaatttttcatgcacgtccctgtgaagagatcaccaaacaggctttgtgtgagcaacatggctgtttatttcacctgggtgcaggcgggctgagtctgaaaagagtcagcgaagggagataggggtggggccgttttataagatttgggcaggtaaaggaaaattacagtcaacggggctttgttctctggcgggcagaagtgggggtcgcaaggtgctcagtgggggagctttttgagccaggatgagccaggaaaaggactttcacaaggtaatgtcatcacttaaggcaaggaccggccatttacatttcttttgtggtggaatgtcatcagtaaaggcggggcagggcattttcacttcttttgtgattcttcagttacttcaggccatctgggtgtatacgtgcaagtcacaggggatgcgatggcttggcttgggttcagaggcctgacaaaattaatttatgaaaatttcatttatcctcaactttttggaaatactcttacatcaaagtacacctcaaattgtgtacactgactactgatcacttttcggtaggtataaagtccttaaaaattttgtttcaactttcccttttaagattagaattttgaccacagtgttccatgggaacaaagtgaatcatctgtggcaaaatatgctagtcaagaagtgagttagaatctgtgccaagcgttaagaccttgtgcacccaggttctggggcggagtaaagaggcaggctccaaagacatagctgtgtgttggacatgagagtatttggaggaatacaggtaacaggtgatgctgggaagtcytgtgaaatggaasgagaacraagatgaggaatctggtggcmgtaataaccggggaacagatgagctggaggcctcatcaggaggggtgtcccttggtggaaggacaccattcccggccttaaaaggagasgctycagcacggctggggaagcacgtggataccttgtactaaatccactactgcagctcattcttaactgtaagtagaagaggaggacatgctttctgaagctgacccctccaagatgaccagttcctatttctgtcccctgctaccaccatggtgtagaacaacagaatcaaaaaaacattttttctgttatgggtgacctgtacgttttctagaatggaaggaggctgtttagtagctcaactctgagaacactttttctttggacaaaattaaaaaaggaaaaggtcaagttaatcattaatctctctgttttctactaatgtctccattttcgccatactttctatgtcctacatagcagccatcacagagggcaataaacacttctaatgaccgtgtaatttatatggaatgctgaaggggtgggttggccctccacacctgtggatgtttctcattaggtggaactagagacttggaaaagaaagagacacagagacaaagtatagagaaagaaaaaagggggcccaggggaccggtgttcagcatacggaggatccaccggcctctgagttcccttagtatttattgatcattaatgggtgtttctcggagagggggatgtggcagggtcataggataatagtggagagaagttcagcaggtaaacacgtgaacaaaggtctcggcatcataaacaaggtaaagaattaactgctgtgctttagatatgtatacacataaatatctcaatgccttaaagagcagtattgctgcctgcatgtcccacctccagccctaaggcggttttcccctaactcagtagatggaatatacaatcgggttttacaccgagacattccattgcccagggatgagcaggagacagatgccttcctcttgtctcaacagcaacgaggcgttccttcctcttttactaatcttcctcagcgcagaccctttacgggtgtcaggctgggggaaggtcaggtctttcccttcccatgaggccatatctcaggctatcacatggggaaaaaccttggacaatacctggatttcctagacagaggtccctgctgccttctgcagtgttttgtgtccctgggtacttgagattagggagtggtgatgactcttaacaagcatgctgccttcaagcatttgtttaacaaagcacatctgcacagcccttaatccatttaaccctgagttgacacagcacatgtttcaggaagcacagggttgggggtagggttacagatcaacagcatctcaaggcagaagaatttttcttagtacagaacaaaatggagtctcctatgtctacttctttctacacagacacagtaacaatctgatctttcttttccccacatttcccccttttcgacaaaaccgccatcatcatcatggctgtttctcgatggttgctgtctctttggagctgttgggtacacctgcagactaacaacagacaaaacaggcacacaaggattaatatgaaatttataatcgtagtacttccgatggtcttaacccaagtgacagggttaagatttgcgaggccatcagcaactcctgcgattgcctcagttcctggcaccaaatttaaatgggcttttgatgtttcaaaaatttgttcctttaatttggaaatgtctaaagtgagattatcttctgttccctgtagatggcatctgaccatgtcccagtgatgctcagactcattataaacttggggtgtaatacaaaaatctgagatattccagtcacactgtaactggaaacgatggtctaagttcataagcctgtctcccatccaaatgacagtttgtctaagatcattaatttggtttgccaatttttgatcaataccagattgtgaattccacaatcttgtagaatttttttgccaatcattaacaaagtttactgactgaacagaagagtgcaatgcaactcctgccatagcagccgtagctgtgactgcaattaatcccataatcactgtaattaaagtaaaaatgaatcttttggatctatttaaaatggcttttaatacttcagtcaaaatatggacggatggcaaggcctcccacggttggtccatggacatagaaatccacacggcttctcttgccctcaccagcagaatacactgttgccaattaaaagttgaataaatgcaagtaaacaatctgcaattttcacagcttatagtttgagagtctggtttaataactatatttcctacaactagcatataagggggctttacacaggtttggaaaggaactgttagactggaatttaggttgatagtataaaatagcttacgatctcgtttctaaagtttgatttctagaccaaattctaatgcagtatgaggccacagtaagcctccataattctggatgttcaggaccagaaacaggacttattatttttggtcttggggtagagattcctttttctccctattcccaagggtagaaagactgtaattttttagcttatgtttgtctaaactttctgttaagtcgctatcaacagctrgactcacttgtgcactgggacacgactgagtttgtcctgtgcaattgtggtagaattgacctcgaggtgcccaatctataatagttccgaattcactgttttgtaatatcaccgcactattggccacacattcttcccaaactaaaacttctgtattttttgatcctttgggaatttccttggggcaaggtttccctttaggtctaaattttaatgatctttgataagaaaagtcttgtaaataatttacccgtggcctgagtgacatcccgcttaccatgtgataagtgaatctactgatgggactgacagtaggtacttctaccaaccaattttggactgcaggcattaaacatcctggtgctctccctaggcagataggaggataatgatacccaatggaaatatttatcatcatcccttcttcctcaggtttggcagggcaatgatcatctgtggggccaggtacccatacactatcattaacatatacttcaataggattatccatccatgtgactggtgtttccatctccgcggtggcgcttttctttgcatctccgatgggttcatcgtagatcttcaaatgtctagtgggtatccaaacaggaagctgattttctcctggtgaaacacaagcaaaacctctcccccacgtcaccaccttccctatttcccatgtcttatttttattatctttccaccaaatcagttttccttcatgtgggctgttctttttaccagtaaaatgttgttctgcagaagtagtagtctgatttctataaatgtttaaaaaatttaaagtatagagtgctagattaagttgcatctgaggagtggtacattccttactgtctcccccttctttttgcttaactgagttttgagtgttctattagttctttcaactatggcctgtctgtgggaattatagggaattcctgttgtatgtgaaactttccactgatgtaagaatttttggaaagctttactacagtatcctggtccattgtcagttttgatctttttctggaactcccattacagcaaaacaagataataaatgttttttaacatgggaagtactgtctcgattatctggccctaaacaatgtaaaatcacagtactttgatacacttctgaggctgtgcctacgctgacaagccctgtaacagcctttagtttaggccaatttttggccactgatttaaagcaatgatagagacatctgctccagtgtctactaacccttcaaactgttttccttgaataatggccttacacgcaggtctgttctctgagacccgacttgcccaatatgcagcctttcctgttggatcagtgcttccaaaccctcctgttctttttatctcactatttccaaccttaatataaggcaggagtaataattgcgcaatcctgtctcctggactggcactccaaggaattgaagagctaataaccaattgaatttcgccattatagtctgaatcaaccacatcagtacgaatttgaactcccttcagacttagacttgatctacctaagattagtcctacagtcccctcaggcagtgggccatatacccctgtggagattttttgtgggggctcccctggaagcagagagactgcctttatagtacataaatccacagctgcactgccgcttgtggcgggggacaattgttgtactgtggtaactggctcattccctgaggcacttgggacagtgggggttgttgtccctgaaaaccctgaggaacaaagggctgaattgggaatgccccagtttgttgcggggcctgaggctggcccctttgctcattttcccgacaatggttgcccatttctatcaaatttagaatgacattgactagcccagtgttttccttgtttacatcttggacataagtcaggtggctcttttttatttgagactgggcaattcttttttagatgaccaatttgatcacaattataacatttccctccaaatgttctaacttgtcctcctaaagcaactcctgttattgtggaataaagtttagaaaatatccaaagcttatcagcctgtaaattctgggtagttcagttgtctaccatgctgttaattaaatgaaaacatcctgttatttcagggtccttccttgacaaagtactatacagctgaagaacatctcgaatayarttttggtgggaaaggagccaattgatttcaacagaatcagatctgagcttcataaagtctttgaagtgacttcacagagacgcagacatgtgcacttgaagatgctgccccttcccyggtacctagcaaagctcctgcctctttgtgtgcgtcactgtgaaaccccyacccttctgcctcgtgctaaacgcacacagtatctagtcaggggaaaagactgcatttaggagatagaaaatagtttggattacttaaaggaataaggtgttgcctggaatttctggtttgtaaggtggtcactgttcttttttaaaatatttgtaatatggaatgggctcagtaagaagagcttggaaaatgcagaaagttatgaaaaataagtcacttataattatgctacctactgataaccactcctaatattttgattcattttctgcctatcttctttcacatatgtgtttttttacatacgtacttttcccccttagtttgtttccttttattttatagagcagaaccctagtcttttaaacagtttagagtgaaatatatgctatatcagtttttactttctctagggagaaaaattaatttactagaaaggcatgaaatgatcatgggaagagtggttaagactactgaagagaaatatttggaaaataagatttcgatatcttctttttttttgagatggagtctggctctgtctcccaggctggagtgcagtggcgtaatctcggctcactgcaagctccgcctcccgggttgacaccattttcctgcctcagcctcctgagtagttgggaytaccagtagatgggactacaggcacctgccaacacgcccggctaatttttttgtatttttagtagagacggggtttcaccatgttagccaggatggtctggatctcctgacctcgtgatccaccygcctcggcctcccaaagtgctgcgattacaggcatgagccaccgcgcctggccgctttcgatattttctaaactttaattcaaaagcactttgtgctgtgttctatataaaaaacataataaaaattgaaatgaaagaataattgttattataaaagtactagcttacttttgtatggattcagaatatactaaattaactttttaaaacacaacttttaaaaaatgtatcaaaataataaacgtgttctgatatttttaaaataagtgaccttgtgttctttaaccagtccacatctttagagaacaaaaatgtgttatgatattatgggccatgctaatgacctctagaaaacatcagaatatttctggatatttaataatagctttatatatgactaatgctcatttctatgtaattctgtttaatagttgctttaaaggtgaattttgccacatttactttgacagcagtataaggagtgagatagacatgaacctgaatttcaatttaaaatcatggaagagagggaaaaaaaaccagcttaagaaaaatcaactgataaactgcaagaaaaaaatgcaacttacatcacaaaagctaattgctttattatttagagagtacttaaaaattaaagaccaaacttctctccacccaacaaaaatgggcaaaggacatacagctaggtcaccaagaaagaagggcaaataggtggtgagtacatgtaaagatacttgataggacttttgcttagttgaatctttagcaaatctcttttatttcttgggattttgaagaagtaatttttaaaggaggactagaaactaagtgattgggaattggcctttttagaattaaaatttcccattacaagaaaaaaaaatcctgtgttcttttttttttccagaatggagtaggtcagtgagcaatgtgattaataaatatttcaatgtctgtgacttttgatttattttggagacagggtcttgctctgttacccaggctggagtgcagtggtgctatctaggcttactgcaacctcacctgtcactttttaattgcaagaaagctgaaaggtttttttctattatatcagttataatgagaaatactgtatatactaactatgagtaaaatactatattgcctaacttgtattattaagcaattctgctaacctgtgaccttacattttcatctgaaaagcaggggctggacaccaattgccctatgaagctattgctagtcctaacattctttgttttgtttgcttttttggcacacttaagtgtgtactatgaagtttatgatgctttaatgaaattttctgtctctaccattgtaatgagaaaggaataaaatactttattttgcaaatctacttatggaatatagttctgtacctgattgttttcataatccctgtgttgatgtgtaatgccacagacatgctcttgatagtaacaggaaagaaaatcagacacagctaaacataaaggtcagttggctggcaggtgcttagcaggtgtaaatagaggcccattcatgctgctccacttgctcctgaaaagcataatgtaaatacagtatactaattaggaggcaaagaaccatctaacatggttcttttttttttttttttttttttttgagataaagtcttgctctgtcaccaggctggagtgcagtggcgcgatcttgactcactgcaacctccgcctcccaggttcaagcaattcccctgcctcagcctcctgagtagctgggactacaggtgtgcgccaccacgcccagctaattttttgtattttagtacagacggggtttcaccatgttggccaggatggtctagatctcctgacctcgtgatctgcccacctcggcctcccaaagtgctgggattacaggcatgagccaccgcgcccagccctaacatcaaattttaaaagagttggccacagtttaatgacatccctgcacaccagcctccacccatactgcccttcataagccccttaaaggagatcccatagttctaaaccgggtccacaaacacacatatcctcattctctccttttcttctctttggcagtttgacaaaatctttagggggaattggaggaaacattaatctcctaaatcaacttcattcaaagctttggcttcaagttctacccgttaaggcctcaggaagttcattgtcgacattgaactcagtcactaaaatgacctcaaggctaagggatagaccacagctccacttcacaagtaagcttgcaacacctgatttaggaaagtttgctgtgcagacagttgtagctcatccattttacagaccgatctcgatttgtttcctagggtctaaaattatttaaatcaaaatctctcagaaatttctggacatttaataaattcatgctggaggagaactggcagagatatgttaaatgcacttgaccacaagaaccatttatttcatccaatatttaccagctattcattgtacacttactacagattttggcactggagatattataagaaagctctaaccctgacttatggaacttatcccaaaaaataggaaacaaggctcagaaccattcaaatgaagcttcagttaactcaaataaaaattagttttataaatttaatgtgaaagtcttcgagtatattaagaatggcttgattaaccccagggatggaaattttactgattgaaagaaagtttcaataaaataccgatcttcgaatctaatctgacacctgaaactaggaaatcaaacactagccatattttttcttctattctttataataatttttctcatgagaaaaaggtatctttcttccaagcctgaaaataaatggagaatttttaatatctattgatgtggagaaaaataaatagactatctgctttcacaaataagtgctggcattgagccacagaacatgtctgtcatattgctctttcacaccatacattaacaggaataataatttctcctcattgagtttcctatttactatccccttaattatacctcctttaattactgtcatagagtgtctgaattttataatccaagatactaagatgtttatttgatataccaccagactcaatgtcttgtattctatgccaaaaatttgaaaatgtttgggaagaggaaattccgtggtttggtgaacccagaaagtcttcagtacatctcagttatagaactgtattaaatacatttaaactctataattccataagacccattttaggtttatacactaagcatccaattcctcactatcctctcatacaaaccctgtgtaatacaagttctactcccataattctatgaacaaaacaacaattgatacatagatttgatttttaaaatacattttctttaccttattctaagtgtaacatagggtcaacatagaaaaagaaaactgaaaagcacaaggaaagtgaaatatctataatcttaaccattgttaattttgttgtgttccaaattagtgtatgtatatatatatatatatatatatatagcatttttgttttaataaaaggactgccaaaatgcacatgccaatttggactctgctttttccacttacaatgatatcatagtttctcacatttggtattcttttgcaatacttgctgcatagaattccatcacacaaaggtaactgccagaaattccttattacttttgctagacacttagggtttacattttttacaaaaattataaatctttgatcacagctctgatgatttctctgggaactgagagcctaacacaagtcatttccactttaagacttttaacattctgaaaagttatgttacaaacagagtgctggtccccctgcaacatgctcactcacattggctgacattttaattctttgccaatctgaggggaagagatgtcaactttttttgtttgctcttttaatgccagtcatgttcccttttttttcccccttttaccagtcatactggcttactcagaaccctacaaatcaatcctgctcattcttaattttccaacattgttcctgagattgtttcaccagaaaagttctcccccttatccacttcgcctaacaatttctacccatcccaatcctcctgcatttattgcttccaggaatttggcacttaggacacccttgtccttacattgttcatgcatgtatatttcgtcttcaataaaacatttagttgctcaagggcaagggtcccatagagtctcaatatgctaacggcctggtgttgcttaataatttagattctgacgggtcctctccagggaggggagcaaagggcaaattatcttaggggctgggagtgcagaagccaaacctttgagactgtgaaaagaagacggcgccgagacgattcagtagcaggcattcaagcaagaaaaactcaaatattgttcccaataatgcctgactaatgccaaataccaagtaagggcccaggcagtcctgacagcctgcagtgccccaggataaaactaaccctgaggggtgctagcccacgataaccccctgccagggctctggacacgccctgtctcctcgaaggccaacgggctgcccctgcgcgccgaggccccgccccgcggcccgccgattggccccagccgccccggcgctaagactcaatttcacactacgcgcccaggccacgcccacctgtcatgcggccctggaaactgtgagtttggggattgttgtgtccactaaccggactcagaagggacttccctgctcggctggctttcggtttctctgctcacctccggataaatcacggggtctcccgcgccgctcatggcgcctcccgtccgtctcgagcgtccctttccttcccggcgctttcctgggttgcttctggcggccctggtgttgctgctgtcctccttctccggtaggaccccggggtggattcgcgcgtccgcggcgaggctagagctctgctcagtcagtcgggcaggaggcgcggggcgaagctcactgcacgtcgtgcctgcttgggatagagagcgaggccagggttctccgaggggtgccgtgctcagatcccgggggtatgtggcgggggatgcgggaaccacgcagaagcttgtttggtggcatcgtgtgcgcggccgacatttacgcaggatctggctgcgttcccaaaagaagcgtgaatcgtgttttcgggattgagcccagtcagcaaggggagggcttactgggcgccccaggtgagggcttgctctggagtgcacaggtgcgtgggattgttgctagagcccgtgctgtgcccgtggtgagagtttgccctgtgttcccttggtgccttggtgagtagggtgttcattagggcttggacagtacccgcggtaagggttgcagtgcgtctgctgtgccccatgggctgggctggcctgggctgggctgggcgagcaggggcctggccaggtgttgctgggagcgtgctgtgcgcaagtggcctgtgtgcggagttcactgtgggcaagacagctcactgtttgctttgagtggagcgagcgcggactctgcggctagggagggcatgttgagtgagagcaggctctcagtgcctggggttagagaggtggtaagggcgcaccatgcttttagtgccttctgtgaacagtgtccgtgttgcctgagatcgtattggtcttgaattttaagtggctgcttttttggggggtgggtgggccatcgagtcatcttcctgttcccaaccaatatagacagtatctgattccattgcctagtggctttttgacattgttttccttcttttcattagtttgagtcatatttgagagatgtgaagcaacctaaaaaacactggtagccaaacctagtgagaaattagtatcctaacaaaggaaggcagataatgttaatcttgttttcccctacagctcataaactgaagcttaaggcctatcccactgttttgtatttcattgaatggaatcaatatttttaaaaatgcatgctaggccaggcccagttgctcacacctgtgatcccagcactttgggaggcccaagttgggtgattgcttaagcccaggagttcaagatcagcctggacaacatgtcaaaaccccatgtctacaaaaaataaaaaaattagatgggcatggtggtgtatgcccgtggtcccaactactccagaggctgaggtgggaggatcgcttga

SEQ ID NO: 12295 - DNA, 41509 bp, Homo sapiens
gcactcctcccacctcagcctgctgagtagctggggctacaggcacacgccaccccacctggagacttttttatatttttggtagagatggggtctctccatgttgcccaggctgctctcaaacgcctaggctcaagtgatccacctgccttggcctcccaaagtgttgggattatgggcatgaaccaatgcgcctggccacctctctctatatctttccgttacatgtcttaaattctgcccttggctgatctacctatgcaccagatcacatttatttattcattcatttgtgtggtagactgccaattgttccccaatagagattactggaatgtatcgttagtctcttttatctcctctcactgaattctgctgcttagaactttaatgtgatagctggaactttatcttggaccaagaaggagggcctcctcctagggatggcagactaaagaggaaaaaggagcctgggtctctcaagactccgtggaatagaattgccacgccactcctggaggctttgcctctactattttatatcaggaagaaacttctggttaagccactgttataggttttctgtccactctcagcaaaacctaatcccgactaatcacagttctgagatctggaattgcacaccaagtaacataagctaaagtagtgcgcatgagcttagtgaaggagggtgggtgtcaggaagcatcaacacaggcatgtgtggtctggaaagtggatgattcttgtgtggagcatcctcacattttctccctcttccgttccagactcttatctttatcttttattttcagtccctctcctggcctttgcattatttactaatcttaaatttgctgatattaccttattagtacactaataatgtgtaaatagacttactcttgtagctatttcccctcttggttgtcttagctccattcccttcagtatcaaaattcatgcattcactgctttgcagaatctcattcctgaagcgagaatttcagacagctggtaaatttagtcattcaaagctttaaagtaaattcatattacaaaagcaaccgctttatttgcattgtttcccaatggaacagttcagcgataacactcattacctattttgacaaccaagaagttgacattagccagagacggttgctaacacaataattatctttcctaactcatttctttaaaatcattgtacttccagaccattgtttttctctctttcctgaatcccctaggtcctataaaacacgtcatcagattacaccatctactgtccctcagttgtctatatcatccatacccaatagatactcccctaatattttaataattatagagtttaatagaggctcaatacctctttcaccactcttgccataattcttagtgattccaatatccattgaacaatctttccaatactcagacctctcaattttttgacctcctgacctccaatgatttttttcctccatctgacctcagctgccagttccaatggttacatcatagacctggccatcatcaataactggcacttctccacggtttccatttcaatcaagcatcccattctctaatcaccaactcctatatttcctgcttactttctctaagatcctctccaacaattctttaactcccttgggtcctccattctattgctcctgccaacttttcattccattgcagcccctttagcctccattgcagtgaggtattacaagccacagttccttgcttacccagcttagtttccactgtacaatattataaatcacatccttgaaaacactcttaactcccttactgcggtctccatcacccttgtctagtaatactccaatccaagttagatacaactctctgtctactctgtgcacacaagtgactgaacatgactggtcctgtttgccatcactcccaatgacccacttgaggggtttgtgctgcccccttctggaactctgggcttcagcgaactggagagtgggtgttctttaaatgttgcaccctaggtgcctccgttgccctggtggacaccatggtgtaccatccagatctcccctccagagttgtcctgaatccgggccaggagcactaacattcctttatccaccaatyactggatgtaggtggcccagggagcaggtatgactttgagccaggcagctctcatgagccaagggcaagtctgcaagagactgagcgggagctgtcaaccaccaacactccctgctgctgggggcgtaagtgcacaggctgttctaaccaagctgctccctcctcagggcttttgcacttccacttccttctgcctggatgttcttttcctaagtttccaaaggatgcactccttcacttcccttaggcctgtgctcaagcatctggttgccagagaggtcttccctaacagctgtattctctcctatcactccactttttcttcataaaatttagcagcactcaacatattttattactttagctgcttggtttggccttcctttgctagagtgcatgctccaagaggacagggttctgatttgtttgtatcttccatgtcctgaatagttcctggtcttcattaggtcctcaatatgtcaacatatatttgatgggtgcacaaattgaaacgccttaaattcatagtagtcagctcataaggcagagtggtttagtggaaggagcttagggtttggagttagactgatttttgaaaacacctttatttaggtataagtagcatttaataaattgcacatatttaagacataaactcaatacattttgacatatgtatacactcataaattcaccaccacagttcacataatgaacatgttcttcacccccaagagtttcctcttgcacttttgtaatccctccttcctgccattctccatccccaggcagccactgatttgctttctgtttttaagagtagtttgcattttctagaaatttatatgattagatcaaaccatctgtattctttttttaggtctgactttttttgagattcatccatgtttttgtgtgttcctttttttgctgggaaaaatttcatttgtttattacttattttggctgacagacatttggtttgcttatagtttgaggattgttaaaaataatgctactgtgaatattcctgtatgtttttgtatggacatatgctttcattttttttgagtcaatacctaggagtgaaatggtgaggcatgtgtttaactttttaagaaacagccaaattattttccaaaatgatcgtaccatttttcattcttaccaggtatgagatttctgattgttccacatccttgccaacacttagtttactcagtctttctaattttattatttatttatttatttatttattatttgagacagggtctcattctattgctcaggctggagtgcagtggtgcgatcatggctcactgcaggcttgacctcctgagttcaagtgatcctcccgcctcagcctcccaagtagctggcactacaggcgcatgtcaccacatccagctaattttaaaaaattttttgtacagacagggtcctacgatgttgcctaggctgttctcaaaactcctgaccccaagtgatcctgttgctttggtctctcaaagtgctgggattacaggcacagccacaatgaccagcttctaattttagacatccaataagtatgtatctcactgtggttttaatttgcattctgtgggcccagcgcaatggctcacgcttataatcccagcactttgggaggccaaggtgggcagatggcttgagcccaggagtttgagaccagcctgggcaacatggtgaaaccccatctctacaaataatacaaaaattagccaggtgtagtgctgcacacctgtggtcccagctactcaggaggctgaagtgggaggatcattagagcctgggaggtcaagactgcagtgaggtgtgattgcgccactacattccaggttggatgacagaatgagaccccgtctccaaaaaaaaaaaaaaaaaccttttctgcattctgctaatgactagtgatgctgaggattttttccatgcctttattttccacgagtatgtcttcttttgtaaagtgtttgttcatatcttttgcccattttgtattgagttgttttcctattactgggttttgagaatacacacacacagaatacaagtcctttataagatatatattttcccgcagtctgtggcttatcttttcattcccttaatagtgcagatattcttcattttaatgaagtcaaatttatcaaattttaaaaatggattatacttttagtgttgtatataagaaatcttttcctaacccaaagtcacaaagatattctcttgtgtttttttttctggacattttatagtttcaggtgctacatttagatctatgatccattttgagttcattttttaatgtggtgtgaggtatgaaccaaagtttatgttttctgcatatggttatccagttgttccagcaccatctgttgaaaagtctattctttctcctttggattgccttgtatctttgttgaaaatcaattatctatatatgcgtgggtttatttttggactctctgtcccattgatctatttatctatcttcatgccaataccacccggtctctattttactttagctttatggtaaatcttaaagtcagggacggtaaatgcagttcttttcccttttttgtaatcctatcttggttgaaagtagaaatcagactgatgcgttttaactctagtttgatcatttaattcttgtgtgatttcagataagccaattaattatgtttattattcatttatgtatctgttcattgttaaaattatacattgtaattcttaaattaaatgctaattattattaagagtgtgaactaggaagacagctccggaaataaaaggaactagccaggcgcagtggtgcatgcctgtagtctcagctactcaggaggcagaggtgggaggattgcttgagcccaggagttggaggctgcttggcaaaatagcaagaccctgtctctaaaaaaatgaaaaaaaaaaaaaaaaaggtactggaactgcagggtggtacggggcatggataaatttaatgtgctcaccagggacctctcactatctttctcagtacagggacatgctcctgccctttcatattccatgttgaagttttgcaacaaattcttcctgacagtaggaccaatcacttactttgaactaaaagaacaacaacaaataaaggtgaaaaagaaaaataaaactggtcagcatccccgagttcaaaataattattctaccacatcaacaactttctgtgcagctttctaaaatttttatttagacagaaattgttttaaaaagaaggttgctttgaaaccaaggttacagtagctttttggcccgcttgccgtggctttctccaactctcttcttcttttcagtctttgcaatacctgtccctgccggtctccaagtgcccctggttacaggtcagctccacactgaaggggaggagctacttcctagggtctcttcccagcatcacagccctacatcccagcgaccaacggtgttatactcctgggggccaaagaggaccctgattgctttgttttgtgccatgtgagtactatgtccaacaggatggctggtggacgagagacatgtttgcctttgattggattcattcttatctgtcttaaaatggtgagttcatcattccaactacccacaactatttaggggaaaaaagaaagacacattatttttctctccttttttttttgaggagttggggaatagggagatagaaatcagaatactttggtttgtaccgaggttgtatatgtttgcgtgtttgaaatttaatgccatatactagagaaagaaaacaagattatcattatattttaagaacaaagatttctgaaaaatctgtcagcagctactgacttagttcaataggcagattcaaaggggaaaaaaatgaaatagtaatgggatctgcctccagcctctaaattctatttagagttgttttgtggtagatttgggtgctgggaaatgatttgtgtggagaaatacttgtatggattgaaagactgctcacgttagatgtaaaaatgttgtgattaatttattaccgcttttattcatgttttacgtttgttcaagttgtgtttttctgtgtggttctaattttccaaactttccttttcaggttgcttcagcaaaatcaggtacaattttctgacctgcaagtttttccttctcgtatttgattttaatttccattgttaattcacgggctaccctgaaatctaaaggctatatgagaaaaaaaaattcaatattttctgagcactcacactgggtgctaagcactctattgggtcctggggagacaataactggtaagacaaataaatggattgaactcgaaagacaaatcttcataaagtgttcttgctgaggactataatgtacagagccatgtaggcatgcattttctcatatacggttagccatgtgtgaaatattacaatgatcatcattccagttaagatattgtacagagtctaatttatacaaatgttcttgtttatcttccggggaattagagggaaaatgagaaatgttatatttgattaaattgtcaatattccctactttaaaaagaactttatacttctaatattgcatatttgaaatatagacaatagtcactcagggctgaaaggggaccctcttttaaaaatagttgatctccatctttcttgagtagataaccgaaggcaaaaataatttatctagaggcccctcctagctcatttgtgctagaaatctaagtacctggaatggaaatttatttttaggagggttaacttatctgtaggaaccacataatatcaaccatatcaccgataaattctcatagtgattcaacataaattagaaaaatttttatttattattttgtctacaccacagaaaaggaagtgaaattaagacagttaaaaaatttgatacagatacatgtctgagccatgaaatttcataaaattcatgcatatacagtaagtttttaaaaatttctatttcctggccaggtaccaaggctcacgcctataatctcagcactttgggaagccaagatgggaggattgcttgagcccaggatttcaagaccagcctgggcaacatagcaacaccccacctcttgctttattcttatttacttgtcttattcttgagagwtctttaggattagccaggaaactataggagggtctgcttggccatatacaaagtggcattttttttttttttttttttttttgagacagagtctctgtcacccaggctggagtgcagtggtgcaatctcggttcactgcaagctctgcctcccaggttcaggccattctcctgcctcagcctctccgagcagctgggactacaggcacccgccactaccccyggctaattttttgtatttttagtagagacagggtttcaccgtggtctcgatcacctgacctcatgatccgcccgcctcrgcctcccaaagtgctgggattacaagcgtgagccaccgcgcccggccggcttcttaaataagtcgactttgggtggacagaatctaactctgccgtctcttacaaggtcctagcacacccaggacagaccaagccctcagaacaggcccctttttggtgtttatagcatctgcactaatctagagaaatggtgggtcaggctaagctactgatgctgctgctaattgactcaattgctaattgagtcccggcttttcaacagatagaatgtgttttagctacactgtatagaaggtttcattttggttgtgtgtgttttgattctctttgggctctggtattgctgtgtatctgtgtctggtcactggggcctcgtgggctaatttagatctctttgagctggtggaatgcacagatgctgagaatcaaagggttcatttttgactgaccagagtggttggttgcacatctagggaataaagttttctctttcatcagtccagtcagtgggctaaacatagaagtaagaaagagtaaggaactgctgctattttatggactttacactccagcttctcatctactaaagggcaacatactacataggtgttgatctcatttcattgttgatgctggtcacagcctgccctaaaaccaggtgtaaaacagacaatctctctctycagcctgtgtttgccgcatactcctcagaatcccactttcacaggacccctccatggcagcgccatatggtctggcttttccgaacccatcaaaatttacttgtcttggctcatacacaaacatgcrcgtgcrtgcgtgcacacacacacacacacacacactttccaagtgccctaacatacattatttcacttattctttacaacaatcctaaaatgcaggtattttaaatttcaaagtaaatcctaatatgtaggtattaataatccgtatttgtcaaggaaggtaacaagtctagaagaggtaaaatgacttgcatgccttcacacacaaaagtaaatagcagggccagggctcaaacccagagctcctgaatccaaaccctttgctattttcccaccacacaaccccgagtttcattctgtgatactggcttcctgcattatgacttccaagcaaatgtgcctctcctagatcaattccatgaggccagttttgtggagcccgcgggccccatgacaggcctgtggggagagggtctgtgtcatgctagccttttagatgcctttcaaactgctccgtgaatgcatgatccggcctcctgkgtctgtggccagtttggctgtcattttcccaggaagttagttcattccaatgaacagaactggtaacataggagataagattaactctggggacagaggaaacagaaggagttgagagacaccagaaaattagaggaaagaaggcatatagcacaggatmattagcttggggagcagaagakrggtgtgtgtgtgtgtgtgtgtgtgtgtgtgtgtgtgtgtgtgtgtgtgttggaagagggagcccctgctggggctttctattctgtaggggagagagggagcgaagccctttcctatagaattggcttccactggcaagtggctatgatgagcaggcctgagattttcctccagcatatayaagtgtcataattttctttcaatggcaaaagagactatcctgggtgatgttcaaggaatgtctggccagggcacagaggagactttgttcatttttgcagcatggttatttctgagatgctgccaaagctaactctctgggctattggtacagaaagagaaagttgtctgtatcgtgcacatagggacttggctctgggagaaggggagctgatgctggagaatcacctgtctgtctttactccttctccctctttgccctatagttctgcttgtttgtcttccctttagttttgaatttgacatatagtgattttacccagcaagtggagtacattaaacctgaaagtccaagtgccagtttcaaataaaactcagctatttttgtttgaccttttcttccacttagatctcctatatccaagacatttttgcatctatggaattttgtaaagtagtcaatctgattactgtgctgtatctcctactccatactcctgagtgtaggaatgctttgtgtaagcccatgacataagcattcatatctcctggcaaaccatagcccggcccatcacattcttatgctgaggcagatattgtgatagagaaagggagaataaagtttacttttattttgtatggaagaatctgagaattattccactctgataatatgaaagaaagtgctatggagtaattataacaaagaactcaatcctccctccttgctccattggattaaaggttatctggaaaacgtgcaaagtgcatgagagagtgaccgcagccactgagcggaggcaggaggaatggagatgggtccagctggaggcagtgggatggctgtgggaccaggaggggagatcaatggcaaagcagcctgcaaaagtcacagaatgcccaaytggagtagaatactctggaagaaagcctctcaattattytctctcttcccagagttctttcccgtaattacttctcattcttatttagctcttttaaaagtacaaaaagtgcaaattaccccacaggcaattggggaaaactttraaatcccatccctgaatgagaggtttgagctttctggatctcttctggagagtagctttgtctttctttttctctgtttttccttgatctgaataataagggcaaaacttctgtctgaaggaaggcatgagaatgatttagcttgaagagtaaaatgatgaaagaagtcatcctcrtaggtatcttggctaatgtacaactctaaaacctctttcagctcctgaaatacccactattgatcaggcatattcaaaactcagcaacagtatcactgtagaatgggctacagtgccgggtgccaccagttacctcctcacggctgaagacggggacacagtcattgaaaccacggtggccaattccccaggcactgtgacgggactaaaggctgcaacctggtatgaaatcaccatcagatccatcagcgctgctgggagaagccaggcgtcacctccaaagcaggcaaagacaggtggctggatggatgctcatcctccgttgagtgtttgcttgtgacttggatcagttatcctggtgctgcaaatgcagaatgtgatttggtgtcacatgagtgcctacaattcaaggcccagaagtgaaagctaccaaatgatgctgtttgagaattcagctatctgcggaggaggtggcatttaaatgccagctgctttgctttggaaaataaagcccatttctgggcatctttaaaagcatcccagcttttaaatctctgaaatagggatttctggttttaacacgccaaatgaagaacacagagaagggattttgctgcactctgaccgtatggcatatatgttaacaaaacaaataaaagcatttggagtttgtcatcagcattactgaaattgatttgataaagttgtacctaggcatatttctgaaaagttatgtgcacattaaaatggtgtaacccctaattttcccattgatttatattatgattataggaatgttttatctaatttctgactaacttcagttaaaagtagtgcctgatatttagcgtttctctgtttcccattcctctgccaagtcatttatgattagtatacacttaaatagcaattatttaatgaaactttgttgtgaatgctcttctaaagcaaataattattgtatattatggatatcaatttacttgcttctaaatttgaattatcctctattggactttggtaacacaaatgcatgtgtttttatttttttagtgttggctgcaccaattctagaagtaagctctccaagttcagactccattcttgtgcagtgggaagctgtatatatggcaattgcattctcygtgtccrttatgcgagccaatggcttggggartatatggaaagagaatactacaaacacctccttgacattcaccagtttagaagccggaactctctacaccataaaggcctatgcatggaatgccaacagaatccctggggatgactccacctgcaatcagagaacaagtaagaacttctcagctcagcctcgaacaattctacttttgattaatgaggggggctgtgtgttgcagccatcaagggcagtgttacatgacaagtacagagcagctggcaacagctatttaaatttattataaagttatttatagtgccttgtctattcctcctcggtagtttaaacgcttcctgcatggataaagaaatgctactcagaatgcacacagcatggctccgccctctaatatccaactcaatttcagcattcacattcgacctcacacaaaagaagatgattcttgttargtttacccatcaccccttgtccctttctgggttcaggccaattagtataagaattgggccaaataggaattcatttgttcagcagatactgagtgagtgtgtgccaactttgagctggcattgttctagagatacagcagcaagcaaagcaaggtttctgcaggcacagtgcttgatgctgcagtggaattcatgtttcagatctgtttcccaaaggcctcagcttgggtctgaagtcagcatggggcttcccactattgctcctccagctgtggggagaagctgaagcttggtgtgcattttctcaccgtcccacctagaggtcccccgagcaaaggactctgcagcattacaactggaggtccaaattgagctgctggagtgagccaagcgaatgagagagagagagagagagagagagagagaacgagagggggtgttttttctttccttgaggcagagtaagccatccactggcaatgtaacctacatagataggagactctcaccaaccagattagctgtttctccacttggggaggacacaggaaaggatggaaagaaaccagaaatgttctctccaactttccctaagtttggaggggaatggaagccccatagtgtatgggccaaggcagaatgtagggagaagagaggggtttgccttttatactatttccctagggaggtagtataatcatagccctgcggtgattcatgacagtcttggtgagtcaggatgtctgtgacaagtcagtctccctgggccttttcctaggctggctggcttgctttcttccctccttcccttatcttcccctcctgtccttccctttcctttccctttcacactgcttttttctttccacatttgttgagggcccactgtgtgctgggcataagttagctgatggaaatacaaaagcaaataaagcatgatccctccattcaaagaatggactatgtcaaaggagagaccaatggtgagtcagcgtttccagtttcacctgaccagtgctttggcagaaggctgccgacacagcgaggcacaggaggcagcatcttcatcaggctggggcactgagacagcatcccctagaataacttgtttcttaaagacttcccctacataggtttccccatgttttacaaagctttacagagtttagatttcacctctggattagtttcctagggctgctggaaccacaaactgggtgacttgaacaatagaaatgtttggtttcatggttctggaggctacgaagtctgaaatcaaggtgttggctaggttggttccttctgagggatgtgaggaagaatctgttccaggcctctctccttggcttgtagatggttatcttcacattcacatggaattttccctatatatgtgtatctgtgtccaaatttattcttttaataaggaaatcagccatattggatgagggcccaccctaatgatctcatcttacctgattacatctgctatgaccctatttccaaataaggctacattctgagagtactaggggcaagaacttcaacatatgaacttggagggaactcaagtcaactcataacaggctctcactactctacctatttttcctagttctcccatgcttcctgtgggaaaagcaagttgccctaaaacactgcaggctacccctaccagccctgggcccagcacttccctaaagcagaactgcctctgcagactagctgaccatgcagtgggaaggggcctgtcragatggcccacgggaaaatcatggcagatgcctgccttacagagaatgagttaggtcctcatgtcctcaaagaggccttcccggccgggcacggtagctcacgcctgtaatcccagcactttgggaggctgaggcgggtggatcacgaggtcaggagatcaagaacatcctggctaacatggtgaaaccccgtctctactaaaaatacaaaaaattagcagagcatggtgccgggcgcctgtagtcccagctactcaggaggctgaggcaggagaatggcatgaaccccggaggcggagtttgcagtaagccaagattgcgacactgcactccagcctgggtgacagagcgaggctccgtctcaaaaaaaagaaaaaaaagaggccttccctgtttgccccagacatgtccagaggatgctggtctctgctcacagactgtttaagcagtttcctaaggcctgctgcgtgggcgttattacagtacagattccaaagaacggaggccaatttctcccctccccaggccaggacaccttcttacgcttttttaatgcggtaactcttaagaaaggaaggtatatttacaagaatgtagggttaagtgttttggagacactaaaagactgccttaatatgtatgcatcacacttgacaccttccttccttccttttgataatgaatggaaagaaaatctgctcctctagaaacaattatgaccgaaaagctattacagtaaaagttgtagcagatgtcaaaagtaacgaagggatatgtttagtttcattgatcaataacagaaaatatttgacctatcacttaataataacgtacccacgtggcccttttagttctccccatttataatttcatttaactattttaactacttattaaataatgcattaattcattcaaaatatgtcttttggcacctataggtgttaggcatggatcttattagatctatttagatataagaaaaaaataaataacaaaaagggtaaataatatggggtcaaggtcacacagtatattatgagtttgcatagtagcagatgaattaccagttcccaggcatcatcctaaatcccaattttatgctttgaacacttgtaattatccaactattgggtaccttatcctccaggctctgcaacattgttatgccaactcttacgtagtttgtaaggctactacaaaatcttaattgtttctctaaaatgtaggtcctcgggcccctgccaacattcaagtctctttcgatagtggagctctgaaggcatctttttcctgggcackggcagaaggagctttcaattatactgtgatggctttgagcgactcttcagagctgacctgcagtacaactttcagttcctgcaccatctcttccctccagtgtggaactgaatacttgatttcagttttagcaagtaatgatgctggatctagcaaatcatcttcagcaatgaccctgaaaactggtatgtaaacaagagtgagactgctgtcgggcttgcagccctgactgctgtaagggagacgttcactgacaatgtttctgaatactctggaaaaaatgaaaatgaaagcctggtctaaatgaaagcatagagttggacattctcatgagtttgaataatattgatagtgaagcgagatattgtgtattgcaaaaagcactttttggaaaattaggaggcctggtttctattccagatctttcattaattagttttttctttttcctttgtaaagctgtgaaaattctaagatgtgatttgagttgtacacagctctaactgtgcatacagataactgcgtcttctttgtgtcatgtctcatgtcctaggcttggtgggagccgccatttttttaagaaaaagataggatatttctagttctgaacatgtgtttagatatttttccattttcattcttatcagagagataaccacatacacatgtggaagttgactcctctatttagaaatatctatgtgtcttggggatggaaactaacacttaatgaaactaacacttaatgaagacctactatgtctctggcactataagtatgttatttcatttaaatctcatgacaactcagtgagktgggttctattttctctttttttacataagaaaattgaagctcagagaagttaaataattttcctaagggcacaccgataataagtggtagagctgagattcaagctgctcaagtttgcctaattccaatgcttaaagccaaagaaaatgttgacaattacaataatatctactttatctaacagtcagttatgtcattctaagtttaaaaagcttctgaacagaaagaaaaggagctgtcatcaagttgatgcactccattccacaggaaaaaaaaaataaagctattctttcaggcccgcactctcttatagttatgttaaattaaggtcaatgataacaaacttgatgatttggcttctcttttgacaactgtgatttaatgtgaatggtacattagaagcgattatgaggacaagatagctaagagtgggagaagagagaaaaaatactttcaaaagcatagcagttctgagttacgcagttaggcatttaatgcaggggagaaccatgcagagtttttaaatcttggacacacattaagagcatctggggaacttttacaaaatcccaatacccaggtcccacttaagaccaactggagttgctgggaatagaatttggatatgaatagtttgtaaaagctccccagttgattctactatgcagtcagggttargtgccattgaaataatccttcacacttaacaggtccaggatgttctaaggcagtttgtgtataacacagtcatgatcatagggatgaccttgacttattartaaaagaactatgtttacaaactacggtgtgtctcctggggcccagaagtgtgtaatatatttcgggaagatttccactagagaaaactaaaatttttaaagcttagcacttgaatgaacaaactttacttgaattcattctttcagaagattttgttccatcaataaatgaggcattatgtggataaatgaggtattgccttaacacagagaaacagtcaatattaatcaaatcaatacatgcctgcttttgacatagtctagcacttattgtgtgagataaattttaggacatctgagaatgtctcctgggtttgtactgagttgtacatactatttgatttgttccttattcgtagcatctagtatcttaactctatgcttaagatgctccctggaggatgtaatgggcatragaatgtattctgtcattcagtgcatgagaggctgcagttagaaaaactttccaggttgcacacgggggctcatgcctgtaatctcaacacttcaggaggccgagatgggtggattgcttgagtccaggagttcaagactagcctgggcaacatggctagaccccgtctctacaaaaaatacaaaaattagctgctcatggtggcatgcacctgtagttccagctactcacgaggctgaggtgggaggatcaccttagcctgggaggcagaggttgcagtgagctgagatcgcaccactgcactccagcctgggtgacagagcgagaccttgtctccaaaaaaaaaaaattaattaattaattaattaaaaaataaatttaggctgggcgcattggctcctgcctgtaatcccagcactttgggaggctgagaggggaggatcacttgaagtcaggagttcaagaccagcctggccaacatggtgaaactttgtctctactaaaagtacaaaaattagttgggcatggtggtgcacacctgtagtcccagatgcttgggaggttgaggcaagggaatcacttcagcccaggaggtggaggttgcagtgagccgagatcacatcactgtgctccagcctgggcaaccgagtgagactctgtctcaaaaaaaataataaataaaataaaaaataaatttaaaaaaatagtttttttaataaaagaattttccatgctatggaggctttacagataaacccccagaaagacccagctccattccttcctacttatgtgatcttagacaacttaccaacctctataagcctcagtttcctcaattgtaaaatgatgatagttgctggaagaattagagaatatattaatataaaacacaatgaatgatgtctgtattttaatctctaaaacaggtaacttctgggatattcattattccactcaagccagactagcttcatctctggatgaagtcaaatatttcaacaaataatctaacgatgaaaatttgtatgtcttaagatgactatgaatctctgatggctcattatttcaaacaatatttcatataacaagagaatgtgagaggtcattaaaatttgttgtagtggtttggggcctgtaacatagcctttggtcctataaagaaaatcttctaatgcttccagtgcacagttttgcattttgtgcaccaaattcaatctgtcacaaagctcagagttgctaatttgggttgtattgaaatcttggataattgcaaagatgcgaagaaaatctcctgcagtagtctcatgtttattattgatcatttcctagttgcttgtgcacccggaagagtgacgatccaagaagatccccctggccacctgtctgtggcttggtccartgtagatctgggtgactactatgtggtctttgtgaagagtgatgatggcttggaagtacactgcaacacatctctcactcagtgcaacttcttatctgagtgtggcttcacttattttattagtgtttttgyctataacaaggcagggcaaagtcctttgggtgacatattcarttataccacaggtaagtcccatttgatgtttgttaagggagttctgagatctctaacctcagcagcagaatggatcacctattccacttattgacttaccacctgggagtcattctagagccaagaacagaaagtaatctcttatctcacattctttccagactagggaattttggctttgtggacctaagcataactagactgcaaggtttgggagtgaaaagaggagaaagaatgtagttgttcaaccttgctctgaaagattgaactcgccacaaagatgtactcagtgagtgttctagcatgtgctgctgccagagagaaggcagtgcctcygtttcaggaggtcactctttccctgagaccaagacagacatacaatggccaagacgctacatggtgtggagggctttggagtaggacacctgggtttacaccctaacttgaccactaattcattccttcagtgaggataatgatgcccaccttgctagttccttagtatcctccactgcaaaatgggacaaatcatgaaaacatgaatgtaaaaaggtcttgtgtgtgacaaagcatgatgcacatatttttattattagcatcaccgttgctgttgctattattctcctctactaggcttgcatcttgtacaaggcaggaattatgtcttatttatctcttcatcctcagtgcttataatagtgtgatcagcatatgggagatgctcaagttttgaagaatgagtggagtgatttgaaattaaataactacattacaaataagaatactcaaacataattatgtaaaagtctagctgaattacagtaaattttgacaggatgagggatctaaatcattggtgcctttggaatgtggaaaaagaggctatcgataaggtcccgacacgagagggccctccagagtggccttgaactggatcttgaaggatgaatgggaatgtaggtggggcaagagcatcccagggaaactccaagctgagtcagacatttgccagtggggttctttagggtctcttaagacctacctatatacggccgggcacagtggttcacgcctgtaatcccaacactttgggaagccgaggcaggcagatcacttgaggtcaggagttgagaccagcctgggcaacatggagaaactctgtctctgctaaaaatgcaaaaattagctggacgtggtggcatgtgcctgtaattccagctactccagaggctaagacctgaaaatcacttgaacccaggaagcagaggttgctgtgagctgagatcacaccactgcactccagcctgrgtggcagagcaagaccctgtctctktgaaaaaacaaaacaacaacaacaacaaaaaaactacttatataactgtgagccctaccccccagttttatttggtttactgtctggaaaggctgacaggatctgagaagttagactgcatatgattttaccaggcagaagaggggaatggctttccagtggaggggtcagcaatcttctctgcatagagaacaagggcgcacgtggcgtgggggaattgaggagtctggtgtggmagggagtggggggagtacagcagaaccttatagcttgcaatgaccttcaatgtcatgctgaggatttaccctctatgcagtggcaattaggccaagattggaccttgacagacccatagggagtcactgtagtcatcagggagggcagtggcagaggctctgggcatgggaggtcaggacacagtgtacccccagctgcattgctcttgatgggaccrccattttccctctgctcctgctttcagctccctgttgtcctagtgacattaaccccgtgttggtgtccagtgacagagttgagattgtctggtctcctgtccgtggtgccgaactgtatgaaaccaaggctgtagatgggtacaacatggttgagtgcaaygacactactcctgcgtgcaccctttcggctctagagtgtgacaccaagtacaacatcacagtgtattcattcaatgaagtccgaggcagcaatatgtcatgtactccscagttcataaccacaggtaaggcacagctatcattccactcactggtgtctgaatgattcaccccagctctgagcctcaggatgggcattcagtgagaccaataaaaaggttaaatcccattaatcaatctttgtggagaccaagagagcccccgttgtacgaaggagaggcagaggagaaggcagaagaggaaagtggaaaaaatgaaaacaaaaggggagaccacggggagagtagaaggttttgcccatgatgacttcagccattcggttcctcctatctttgaggggcctgcctgtactcacaccatgaaggtgtataaatatgtttcttacttacttttgcttttggagttcacaatgcttttaaacattttccagctagtccagtactctatgaacccaatgccctgtgttaatgtcaacagttccccacgcataggcactatgaatttggcccgcatgcatgacgtggttgaaaactgtgatgatctcactgggggcaaaatcagttttagaccaaatgrcacatgtgatatttttgactcatgctggttcaattaatactctaaaatgtcttagctccttgcagtcctgaaataaaaaatgtttcaagggatgcattctccatgattaatgtgcactggcgatccactaatgatgatgctacttacacrgtgactgcccaaggggagaaaggactgtatcagtgcagcagcacaggagagtcctgcaccatgcggggcttgccctgtggctcagtgttctctgtcactgctgtggccgaaacacaggcaggacggagcctgcccagctacagtgtgcccctggaaacaggtatgtagcaaccaccagcctgaatgttgacttcagtggggtccttatggagtgtttcaagacatgaacttccttatttaatctaccctcagtgcaacagaaatacattaaactcagagacgtttcaaagagtcccggtcatagacaataaaattttcaatattttacaagttctgtaaaaatatcctcaagactagtatatccattcactggcatcagagaaggaatacttactcattctgcaaaacatttatttgaattcatattcccctatgatataatctatcgaaacagctaacaaatgagtagccaaatgagctgggttgttacttatttctttggctcagccctttcaaatttttctctttaaaaaatgctttctggccagcatggtggctcacgcctgtaatcccagcactttgggaggccgaggcgggcagatcacgaggtcaggaggtcgagaccatcctggctaacacggtgaaaccctgtctctactgaaaacacaaaaaattagctaggcggggtggtgggcacctatagtcctggctactcagcaggctgaggcaggagaatggcgtgaacccagcaagcggagcttgcagtgagcagagatcatgccactgcacttcagcctgggcaatagagtgagattccgtcacaaaaaaaaaaaaaaatgctttctgactttcaatttcctgataggtaaaagggagataatggcctcatagggtggctatgagtattaagttgactaatgctgcaaagcacttagcataatgcctgatgcacagcaagagctccataaaagaaaactattattacagcgtagcattgtgtatgaatgaaacgtggcaaatcacttcaagcctgtggacattagtttttcttatatacagtgatagatggcactttggactataaaagttgaaatacctaaaaaaagaagccagcagtaagatagagaccatacaaaatactgcatacgtgaagatgttaggtatcctatattcgggtaatgggtccctgaaaagtcaagatggctgtggtattttagacagctaagaaatcaagcttttatatcagtgatgtactatgaaattttcaagaaaggcaaattatacttaattgctaatgctatgaaatgttctgttgggagaagtgaaagcaaccgttactttgaaatttgcagttagaattgttgaagatgggccgggcatggtggctcatgcctgtaatcccagcactttgggaggctgaggcaggcagatcatgaggtcaagagattgagaccatcctggccaacatggtgaaaccccatctctactgaaaatacaaaaattagctgggcatggtggcacgcacctgtagtcccagctactcaggaggctgaggcagaagaatcgcttgaacctgggaggtggaggttgactgcactccagcctggcaacagagcgagactccatctccttctcaaaaaaaaaaaaaaartgttgaagatgggggcaacaaaggatktctttcttattctgaaaaaaaaaaatggtggaaacctgcaacagccagttggtgcagtgcattcttggggaaagtacccactatatacagtgaatgttacatgacgcatcagagggaatgaacaaaaggaaattttttattaacaatggaaagttggggaatgtaggatattgagtgaaacacaggcaaaataccattctttatcatttttcacaaataatcttcagtggaaataaatctccrattctttttcttttatcccatttaagtgccatgctgtccaaccggtctgacagtaactcaaatcacccagtcagtaatcaacgtgagctggactattgggagagtggctcaaacccatgttgcagttctggagtcacacactggacagtctaagtgtcacactcatcaaaaccactgcctcctaggrtgcatcacatgtggcatcaattacacagtgacattaaaagcaattagtgccaccgggttgactgcagattgctcctaccaaagttatttctctggtaagtgaactctagctctagagtagcagtaaggacttgactattatcaatccaggcatragcctttcctcctcatttaaaaagatgctgcatctccacctagtttgcattataaactcagattactttctaaaatggttatagtttccctttgacttagaacctcaaagcttcagaggcttctgttggtagttggtgaattaactcccctagtaacaatgttcctctatgctttttctgaagggaccatgtatctttatatgacatagctacttgcaacacagagtaacgtagcctggcagagttttctgaaagctagatcacacattctgtttggtttgcatttttttcttctcattattattgtgctactacctctcttttctaagcttcttcagctgcttcaatggtttcttatttcaacaggctaagagagcaaagacatctgtctactgacagtattgtaccttgttcttcacaaagaccaaaccattagggaatagcaggggaaagtaaaagcagtgcaaggttaccaaatctcttgcatgattctaattcactgaagtggctgcttgtaacacggttttgataaaactcttgaggatgcttcctaggcttaaggagaaaaagtacaatgataagttacctctgcctggggcatgggatggaagagttggaatataattttggcatcctagaggtagtagaaagagtcttaactgggagtcaaaattagacatggattctwataagctgtgttgcctaatcttccctgattctgtctcctcattgaaaaagacaggaatagtaatattttccttcgaagttgttttgagaatcaaaataaatcataatgtgagaacattcagaacatgctgcacgtatgtcagctggtatgtactttcttttgacccattatcttgtattagatttactgcttaagttctcaccttgatatccagttctcagaatatgacccattgcttattcttttaagaataaatcaagtaagcctgattataataacttttaaaaattatacagtaggatctttaacttagttactaaggaatccatttgatgcccttattggcacctaatgtgtggcttgctcaaggtatttagaaaaggaaaaaaatactaatcagtggcctggcgcggtggctcatgcctgtaatcccagcactttgggaggccgaggcaggcggatcacgaggtcaggagatcaagaccatcctggataacatggtgaaaccccgtctctactaaaaatacaaaaaaatagccaggcgtggtggcgggcgcctgtagtcccagctactcgggaggctgaggccggagaatggcgtgaacccgggaggcggagtttgcagtgagccgaccagcctgggcaacagagcgagactccgtctcaaaaaaaaaaaaaaaaaaaaaatactaatcagctaccatggatgaagcgtggaccagcaaacttggtcactggcatgttgtataaatggctgcacctaaagtgtcatactactcatctcggcaaaattggttcttcaattaaggctgaatgcagttaattatatttaagtttaatgccaccaaaatcaaataaaactagggcattatgagggatcttgacaaggattctgtgcctttgactcacagtttgaatcatgtacaatatgtatctgccaatttttggacctttctgactcaccattgttctgtattaaaaattcatactgcacaccaccttcacacatggatttctctctctctctctttctttctttccctccctccctctcttttctcttttttctytctttctttctgtctgtctttctttctttttctttcttttttttagacaggatctygctctgtcacctaggctggagtgagtgctgtggcacaatcatagctcacagcagccttgaactcctggccttaagccatcctcctgcctcatcctcccaaggggaccacaggtgtgcaccaccacaactggctaatttttttttttttttttttgtagagtcagggtctccctatgttgcctaggctggtctcaaactcctgggcttaagcgatcctcctgccttggcctcccaaagtactcagattataggcataagccatcatgcccagccacccatggatttctgattatgtggcccaccatggaaataactcgagtaccccttcaaatcttgctctgatctaaccagtaattaatcctgttacttagactagtttgcttatattttttccctgcagtaatcaaggccatttttggatgatggtggaataaaacaagtgattttgtgtttgttatttttattgcctaggtgcctgctgccctttgggggtgaaattatataggctgggccctaatggcatccggatctactggcaagcctccaggggctctgccaattacagcactgacctctatggctccaaaggcattttcacgtgcaccccgagtgctggcctcagtttctgtgatgtcactgagatacyctgtggggatgtatacactgtgatggtctcaccagttgctaaaacaggattgaagcttactttctgtccaaaaaaaatatattcaggtaaagcaagttatgacagtttatctaaaactaaccctgaactcatatctgtgaattaagatgcaatcaaacttatttactatgtatgaagggcacagagggtataaaatttctttctttttttttttttttttttttgagacagtctcactctgtcgcccaggctggagtgcaatggcatgatcttggctcactgcaacctccacctcccagggtcaagcaattctcctgcctcagcctcccaagtagctgcgattacaggcacctggcatcatacctgagtaatttttgtatttttgtagagacggggcttcagcatattggccaggctggtcatgaactcctgacctcaggtgatcctcctgcctcagcctcccaaagtgctgggattacaggcatgaaccactgcacccagtcaagggtataaaatttctacacagcacaggcagattctggctgtggaagaccccaagattctttggaattgtgatgctttatttaatttagagattatcttctctgtcccactcttccccttcctaaaaaggactagatgcttgctgcttaattagtaaagcaaatttaagataattttctgctttgagatttagggatagattttttaacatagtcttgctgataatgatagacatcctgggatgttggaaattaggaaacttgaacttttatttgcacagactgagaattatgactgaggaaaagttagaggatcagaaaarataaatttataaatcacaagctaggcttggcaatatgagtgggcagacaatctgtgatcacaaagcatggctgtcagcaactaccatctcaccagagctggcaggaaaacattagcaattctccgctctgtgttccagcaccttctgctaccttgcccagggcacagtcatatatttttcatgtattcctagaagaaaagagatgatgaagccctagaattttgcaggtgaacacagaaaaaaagaataaatattggctcacaagcccttactgatagccagaatctaaaattttgaatgatatgtaggtgacaggaggttcaggatggcccttggtgatggaaggaggacagttcctcccaaggggctgttctcrttgtccctggctgtcatgctctgattccttgtttttccattatttggtccacaggacaagctggcccaaagcatagccctatgggaagggacaggaataggttcctggtgtcaggatgagctcttaggaagatgagtctacagctcaataacaatactgcatcataactgcataatattttataatttatccagtggtttcatatcacaaatctcatcaaatgctcaaaatatgctatgctataggctcaacatatttcattatctccactttgtaaatgagaaaactgaagctcagaggctcccaaatctctatctacaactcttctcttctcctgacccctaagtccgtattcaaatttgatacctccacctggaggtgcccaggcatttcaaacccctcaggggcaaaaggaactcctgatcctctgctgtttctgatcttcctcccatcgtccttgtttcaggtacattagctaaaaaccctggagtcagcttctgtctccctcaccctccatatctaagtaatctcgaattctcgtcctggtcaccttcatgatggttcctaaatcccgagtcttctcttcattcccacagctactgctatgcctcaggccctcaccacctctcccctagactactgcaccagtcccatctccctgtcctcactccagcctctgtaatgctaccagagttatcattccaggacactsgtccaattgtgttacttttatgctgccacatcttcaaaacttttccatttccccataagataacattcaatcctctgggcatggtgttcacagtcccttataatctgtcccctgtctacttatacctgcactgttcaatagaaatttaatatgcaccatgcatgaaaaattaaattttctagtagccatattaaaaaagtaaaaagaggtgaaattaatttcataatatattttagttaacccaatatatccaaaatattatcatttcaacatctaatcaatataaaaattattaatagatattttgtacatttttcatactgtctttgaaatctggtgtgtcttttgtacttatagtacatttagttcaaactagccayatgttcaatagctacttcagtgtccactgtactggacagagaaattgtttttttttgtggggtttttttgtttgttttttattgagaaagggtcttgctttttcatccaggctagagttcagtggtgcaatcactgctcaatgcagccttgacctcctgggctcaagcaatcctcctgcctcagcctcccaagtagctgggactataggcatgccccaccatgcttggctaatttttaaaatttttttgtagagacaaggtcttgctttgttgcccaggctggtcttgaactcccgggctcaagcaatcctctcgccgcagcctcccaaagagctgagattacaggcataagccactgtgcccagcctgaacagagaaattctaggctcattccacaacatccgtcctgagaggactctattctctagtctaggcatctggcatcattaacgtgtgcctgcttcggccacacacacctcctattctatgtcatgttctggagctactgcagtgctcttctctttgcccggaattccaccccacttccaccaagagaactctactggccccaattttccttgtctgtgaagccttctccaattatcataagcagagttagccctctctctctccctcctttatgaccccacagcacccttatctgtactgcaacatattactgtgaattgaatgtgtgcttttctcctaataaatgattatctatttgactcccagtaygtagcacgtaactgttgcctgatatatttkaaatttaaaaaagaatgaatcaatgaatatacagctaagtgagtgatggaagtcttttgttctttctcctgctccatgcccacaatttcacccttagagagtcattcctctgagggctggttagccaccagaagtccttgtgagttagaactcaagttctttgatgggatgccatctcaagcctgtagccatttcagcttagtaacattaggtatctagactcaagttaggaaatcctcctttgctcagtgtccctggtaaaagccatacatttgggagatgttttttggttttgtttgtttgcagtatcagtgatgtcttattctgataatcaggacaatattgtaaatgacaataacgactaatgtttattgaatgccatgtgccaggcactgttctaaggggtttacatatattaactcagtccttacaacaaacctatcagcttggcattcttttttttttttttttttttttgagatggagccttgctctgtcacccaggctggagtgcaatggcgcaatctcagctcactgcaaactccgctccccaggttcaagtgattctcctcctcagcctcctgagtagctgggattacaggtgtgcacaactaccatgcccggctaatttttgtattttttggtagagatgggggtttcgccatgttggccaggccggtcttgaactcctgacctcagstatctgcccacctgggcctcccaaagtgctgggattacaggtgtgagtcactgcgcccagctgagcttggtatgcttattcttactgcttttcagataaattgaggcacagtaaagtgacttgcccaggtcatactgctagtagtatctccttctcttatcacccaagttcgttcttgttcgttttttggtttactttccttttattctttcttaagttaaatcttcactatcttaaatacataaatgaatagattttattttaaatgcttgtgtttttattacagtaacttgctctggaagtacacttggaatgggtaagtcatttttctcatggataaaatagaacaggatttttgttgctccattttggggttaatgaagtcagctgacttttcaattagaaagcaaatgctttctttctttgatacaaggggctcctgctctcttatcccatgactttttctccccattatagtgcctcctctgagattccaccagttgagatgaatttctttgaattctgaagtctttttagtattctaggatcctacaggaaaatgtaaatagttttgggaggggcagcggcttcatccctcacacttcagaaagtgattcccagctcagctgtacactggagtcacctggagagcttaaaattaactgatgtctggttctgtccccagaaagtttgatttaatgggtctggggtgagagctgggcatcaggagttgtaaaagctcttcaggtgattctgaartatagccaaggctaagaactgctactttagagccgtgcttctcaaactttattgtgcacacacatcacctggggcctcgttaaagccagattctgatttggtcggtgtaggaagtgtctgagactccgtatttccataaggtccaggtgatgctggcgatgccgaggctgctggtctgaccacacatggagtagccaggagttagagagaatctgttaacrgcctgcagagagctacgatgtttgctcctggtttgcatgagtgggtataccccgtggagagagagggtgctgaaagggcagttggaataaagagaaccctcactgcctccttggttttgctcagggatgatcttgtctaggctattttggttgcccccacagagatgactcttggcagggcagtggagatgagcaaatggagccatgagtgttgacccagtaagcagtgtatgctgcctcatgaggagtccttgccacagccttttaggggacagcttggtctggggccttaggaaaaaatcccctgggaatattatcaaccccaaactacagaacttctctcccgcccacccccaccccacccctccccattcagacatggctgattttgaatggtgtgagtgtaaatgaagccttcttgcccgtaaaccccactggacagccttccagtcggggctggctccccacccacacccccttccactggcaggaactgggtctagagtctccactccctgttctctgcctgggctcccttcctctcccagtctattgcttctctgagcacagcaggttacacacttttcaattcctgtcccacctgcaggtctgaaataagcacaatccttattaatttttcaagagtttttgttttctatgactacaaaaaggaacagacttggcttactgaaaacaaactgtgaggacacttctaattataaaaaagtctcccaaagtagtagagaccatacaccctggtcttcagtgaaaggtacatggacctaggtctgcattctttaatcagtatctccctgagacatagaggtgtggtagaagtgtcctaggtccccaggggagaggagtggtgtatgatatattggccttgcctatgattttgttcaaggaagggtttcaaataaaaacaaaaaaaataaaaatgtaaaaatgtaaaaaaaaaaatttaaaaatgtttgaaaagaaagaatgtctatgttttaacaaaaaacacaaaaggtggggtggcaaggagagcaggcatggtggctcacgcctgtaatctcagcactttgggagaccaaagcaggattgcttgagccctggagttggagaccagcctggccaacaaaacgagaccttgtctctacaaagtgtaaataaagtagccaggcatggtggcatgtgcctgtagttcccctgtagtcccagctacttgggagggtgaggtgagaagattgcttgagsctgggaattcaaggctgcagtgagctatgatagcaccactgcgctccagcctgggtgacagagtgagacaccagcatcaccagagagctttttagaaatgtacagtcttgggccccatcctgacctactaaatccccaggtgattcgtgcatgtattcaagtttgagtagcactgcttaggtactgctcttaaactctgctgtgtattagaatctcctggacagttaataatgaatgcagaggcccaggtcctggcctagtgaagtgcctctatatttccatcaggttcccaggtgattttgatacacatgaagtttgaggagcactgctttagatcactaatgtcctcttttctgtccttctaggcttcagcttatcttcaccattcccttccttagccagggctcagtctttagcctgaaatctgctactctcttgaagtagatatttgtagaaatcctgtaggagccagacacagtgtcacacacctgtagtcccaactattcaggaggctgaggtagagaatcacttgagcccaggggtttgaggccgaccttggcaacatagtgagagccccctgccctcaacgccatctctctaaaaaaaaaaaaaaaaaaaaatcccgcaaggccctccaaaaacaagagtaagccagattatttgagggtttctaaggtcatatggaagtcattatatctagggggaaattctaaattgctgtcttcaatttcagcatttcccctccccaaacacagagcaagtccaatcaggtccctgggctgacattggagcctctggatatgctgaggggagccatgggaatcttgctggtctaaggttttctttgggttttctttgactcttggagtatcctaaagcttttcaaactttttttttttttttttttttttttttgagatggagttttgctctgtcatccaggctggagtgcagtggtgcaatctcagctcactgcaacctccacctctgggattcaagcgattctcgcgcctcagccactttagtagctgggattacagatgtgcgccaccacacttggctaatttttgtatttttagcagagatggggtttcactatgttggccaggctggtcttgaactcctagactcatgcgatccacctgccttggcctcccgaagtgctgggattacaggcgtgagccaccgcaccggccataaacagactttttaagagagatctggattcaaatcctgccaccatcacttgctcttagtcaagttgtgtaaattctctctgagcctaggtttcctcatctgaaaattagagtaaataataatccctcataaaagaaaatcaggattaaatgagaatgtaaattattggacacaataataggctcataacaactacttaataaatggtagttgttaattcatattcagtttaagctcatatcacattctattatgtaccaattattaacattttaatgtgctacttctaacgaagacatttgcattttaaccttggtcctcataatacacttcctcattgattctctaagtgtggtcctggtgccaaaagtatcagcatcagctgggaacctcttagaaatgcaatttttcagactcttccacagacctattgaatcagaaattctggggctagggcccagccttctttgtttcaacaagccctcaaagtgcttctgatggatgctaaagtacaaaaagcatggctttaattcaagaaagctatttcaatgctggaaatttgatgcaagttggaagggaaaggaaaaaaaaaacctatttgaggtgatagcggctctaacaagaggtagatagatgggaggggtttgtgcctgacatcacaccatgagcaggggctgggggtgttccttcatctttaggacccaacatgtttcagtgtcacctgtacatcctgggcaactttgaggaagcttcctctctgtgacatacttagcagctaaacaggtttatgttttccatataaaactccctgagtcattaaaattttggagttccctgaggagcacagcaagttggcctgggggtgaaaaggaaagtccttttgttttgaaccagtggtctgggattaaagagactctgggagggttcatttggtgaagcaggagagagactgctctggttagaaactgctgatcagtttgaacactttgtcagttgtcatagtttcatgtttacttgccgtgaagtgctgcaaaaatagcatttcaaatcaacatacacataaaatctcagacactggtgctttttaagaaaatgtctgcatattgaatgcatcttttactgcttcccttccttacccttttcagtgatttatagagggaagagaaatgaagaatgacaaagtgagccccagataaaaacaaaaacttgaccaagtgagtaacgtaaattgattttgtgtgattttatggcaaagttttttgtctttgtttaaaatgttttcccatttgtcttgcagagttgtctcatttgttagtgattagagatggaaaagatctactagaatgtagaataaaaatgcctctaggataggaaaagctcctttggcctttagaagaacaactctgactctgcttcctgagggcaaggtcaggtgtgtcctcacctgcacagcagttggagatctgctatgtgaggactctggagagaaatgaatccagaaagtcccctggacggctgctagcctgagttggcacactgtgagaaccctggaaacaagaaagttctgcttagcagaaattctgagatttcacatccacacacaccacagacttcaacacatccacttcatgagtgttttacaacagcacttgtctgcagccccctcaggggctggaaatgttcactcccagaaagtcaagccacccacatgcagacagcacttatcccaagacaaacctccagcaggacttcagtataggttggaaagcagtagctgccagggcaacctgagataacaaacgccctcatcgcaagttaggagcaaagctgagctgcttgcagggttcgctgagccaaagcatcaggtggcgtgacatctatgggagcatctgggaaagcagagctgccagcctgttgctagaagggttgcagttatgctttctgcatgagagaagatgtcaaatggagagcctcaaactgtggccgactgacatgcgtgcatcttttgggggaggaccatccatcttattggccatatcccccactcatattgtaattacttttttcatctttggagggggaaggcaatgaaatataacataaatctctcatacctaaaaaagtttgtccttcaaatatcagtaacctaatttaaaacatgtgagtagacttgtataacacacacacgcacatgcacacacacagttatagtgcttgctccccaaacacatggctatggagccaagcatgtctctagttaggaacaaccataaaactctgcccagggggaattggaccatggaattaggctcgaactaagcatggaagaaagaacaaacttccctttctgttctctcaacttcctatcaacgtgcgctgcaagagagaagtgatatgctttctctatgagactgatcagagatacgtaatgggtcactaataagagatcttccccagaacatctgtacatgaacagagacaagccaaaggtatatatctctaaaaatggaattggaagcatcagagagcacacctaataccctacaaataccaaggcacagaaagtgaaatagccatctgcctagctaggcacctaaggctgaattgttttggtcagaatgtcacagaagaaaatgtgatccacagtgggtaaagataaaattaggttatttaacgtgtatatagcacaaactaccagcttgtaagtgctctccatatgctcgttttattctcataacaaccctacaagctaagtaataacattatctcctttatacaggtagggaaaaacgggcccagaaaggtcaagtagcccacccatgttcacacggctaatcagttcaaacacaaagtttcagggagagaagtaagtagcattggttagacctgctaattcatgctatctttcagttaaaattttaattttaattattatgggtacataatagttgtatatatttatggggtacatgtcacattttgatacaggtatacaatgtataatgatcaaatcagggtaattggggcatccattacctcaagcatttatcatatctttatgttaggtacccatgatatcttttgtttttttttgttgttgttgttgtttttgtttttttgagatggcgtcttgctctgtcgcccaggctggagtgcaatggcgtgatcccagctcactgcaaccaccacctcctgggttcaagcgattctcctgcctcagcctcccgagtagctgggactacaggcacccgccaccacgcccagctaattttatactttcaatagagacggggtttcaccatgttggccaggatggtctcgatctcttgaccttgtgatccacccgcctctgcctcccaaagtgctgggattacaggcgtgagccaccgcgcccggcctcccatgatatctttatggaaaatatttctctagattattatgaataagtgatcgcttattagaggagatctgggaataggatagtgagtgagtgatctgccctaactcaagtgcgtgtacattcaaccctcggttattttggccatttacctgctctgaattatacaaagcagcttttcatccctggccagtgttagcagattttaccttctactttgctgtgtcacatttagggaatccaagttcatttttcaatttgtttaggcaagcaaactagaggagacgtagagaaactgcttagggagcttatgcaaatctaggggagcctgggaggataggcaatttggtacactagaaagagcaatggccttggagccagatggatccagatcctagctcattttgagatttttcatgatttatttaacctccctgagactcagttttctcatatgtaaaatggcaatggtcatcttgctgggctgttgcgaggtttgagataatatattcatattcagcacacaggtgcaatgaaactgaggtgtttgaggtcacactgctagtaagaggcagagccagattttgtaggatgtaaacctatgcctacgtgcagttaaagaccatgcttgctccactattccgcagtgccaccaaggactctggccttcaggagcatgagccagaactgcaccccatgtgaccagagtcaaacttccaacccagagggacctgtattattccctggcacctggtcattctcctgaagggtaagagatggaggcacctcacccatctcactcttccctcttggtttggctcttcagagcaaggggcttcacctcagaagggtgaattttccctggcacatatttttcttatggattggggcttcaccctgctaaactaagcagaacctaacttaaaatgaaaagggagagggaaatcatatgtgcacttgtttaaaacattgagcaactgaatcaatttagagtaggtttaaaggaggtcagggctccagcttctattctcatataagccttgaacagaaaaaccactcagccataggttgtgccagaacccattttatggccttttttattgttagatacagggtctcattctgttccccaaactggagtacagttgcatgatcatagctcactgcagcctggaactcccaggctcaagcagtcgtcctacgtcagcctcgcaagtagctacgactcctcagcttgcaggtagcatgcgccatcatgcccagctaacttttttattaattttttttttttttggtggagacagcagtcttgctatgttgcccaggctggtcttaaactcctggcctctatcagtcctcctgcctaggcctcccaaagtgctgggattacaggtgtgagccaccatgcccagcctgttcttaattcttcatttgcctttcctctcctaaaaattgcaggttaccccacagactactctattgctttccatgtagcccaagcctgatctttgttcccactccaccactaagtgcatccttggcaagttacttgacttcattaagcctcagtttccttgttgtaagtgttgctttgaggatcagtgaggtaatctacttagcatggtgcctggcatatggtaagtaagcactcagtaaatattagacattattattagtagtagtatctaaccacttctacttccctgtgtgaccaatttgaatctttacagccactggttctttgcaaatccttctaggaaagcctactttctgccaatgtcacatggttatctcacagttagggctcttagcaactaaactgatctcacttacgtttgattactttgatttaaagtcccaaaggaaccatctcagtaaacagatctctacctaaactttctgagctcagatctcctcctctgtgaatcaactttcaacaataattgtagattctgaagcattaacaggccctccctacatttgttgcataaatttgttaataaatgattattcttttgttggttcatttatgtatatcttatcattaaggcattcaatttttaaactaagttttaactacctgcagcattccaggaattgtgctctttaattagattrtaaattattcaggggaaagagttgatctctcatttctttgagtttcctaaaagtccagcacagttcttggcacactggagggaacctcacagttctacgcaattactgtgtccttgaaaaaatgaatgaaataatcatttggggacagtacattttccattgggtagttgggctggctactgagtgaagtctattatgaatcgccttgcgaagtgaagggttcttctgtaatggggaggatcctccagtcttcgtgtatgtgtgaactcggaatttcatagacggccttggctcacgatcggtttggcacttcgcgttcctaggccacaggacgtcgaacctcgggcgacagcagcctcccgctagggggctcccgacttcccacggaggttccacctgtactgcgcagcctccgtccgggagtgggcggaaattcccttgctgacgcgcgtgacgtcaccggagggcgcggtctgctagagggggtggggcattcccctgcagcaaggggcggggccaccccaacgccgcttctgcggccaaagtaggttgggagtggaaggtggtggctgctgctccgcagtgtsgggaagatggcgccgccggtggcagagagggggctaaagagcgtcgtgtggcagagtgagtgcggtggggtaggggttgagagagggaaggccgggaggctgccgtgccgggcctcgttttgcagccccaacccagcggtctgttgaggagccgccgcgagcacttgttgctttgggacctgtgtgaggacttcttcctgctttcctgccctgccttattccttgccagcaccagggatgggcggggtgcgacgggacgcggccttctcgttggcgtcgggcaccccctcgcctcggccgcgctctggccgcgaagctccgccccgggtgagccgcccggcccggctttccctcccgcggagcccgtgcgtgccctcggccgcgctccccactcttctccgctcccgtccgcgctccaccagttggggatgtctctccatccgagacaattcgggcgctgtttattccgcccccatctccaccccacactggagtttgcaaggactgtttattctgcttattcgtgttagtatcaacccgtgcttttcaaaaaacctcactgtttaacagactcatcttcccctattccgagaggagcctactttctgaaaagttcttgagaagagaccattggaatgaccggtgtccagccgtgacatcttcctgcatagcctgggcaagagccgctccttccgttttccctactctcgggggcccctccctgctgttaggaccggactccttattggttactgatgttctgcggtatcatccacaactttcataaacatcgctccaaacctaggtctggcaggttagagaaagaatgaaaccacccaacaggaataaccatcattstttggtatctctgagttcaagataattatggcctagtagtggaaagggagtagcatctaattagtatttcttagtccaacttgttgaacaaaaaacaaatgatttagtcagcagaattctgggagttagagttccttgtctaaaattaaaaatccaaatcagtaactgggatagtgcttaacatatagcaggcactaagcaaatgtataaataggtgaaaaatatgaaattatcttttaaaagattagataattttaaggttggcatttgctttttcaagatttacatggctgacttaagatttgagatgttttaaaacaatggtatttaaatacatttatgtgaaaatgggtaacaaattgtgttgtataatttccaagatatatatgtgattaacatccgcatgtatgtatttaagccagttctttacatattgaatcataagcttttccctttttcacattttccttctgatcctcatacagataaagacattgtttttattatctgtcattctgtgacttccttttttttaaacaactgacattgactcaacatttttcatgttgcttcacaatctcgtaattaacattttaaattgctttttaaataccttgaggtggcaaaaaattttgatagcagaaaagaaaagaaaaaattatggccaggtgcagtggttcacgcctgtaatcccaacacttcgggaggccggggcaagatgatcacctgagcctaggagtgggcaacaaagtgagaccccatctctacaaaaaaattttaaaattaaccatgtttggtgacatgcacctgtgttcccasctacatgggaggctgaggcaggaggatcccttcagcccaggaggctgaggctgcagtggacattgattgtgccaccgcactccagcctgggtgacagagcaagaccctgagtctaaataaataaataaatagctagcgtaagcccgggcacagtggctcacgcctgtaattacagcactttgggaggccaaagcaggtggattgcttgagctcaggagttcgagaccagcctgagcaacatggtgaaactctctctctatcaaaaatacaaaaattagccaggtgtggtaacgcacacctgtggtcccagctactcgggaggctgaagtgggaggatc

SEQ ID NO: 12296 - DNA, 17663 bp, Homo sapiens
tgaggtctcaggcctgcaggggagggtgctgtggataaagcttaagtgaatttgctgagaagtctttcatttgccacacatacatgatggagaatctcttgagagggaaagccgggagcaagtagagaagtgaggagggggaggctgaactttggacattacatcagcctcctgcttactctgatagctccctttcagatgcccatatttattttcttttttttttttaacctaataaaacttcagtctcttcccattttcgtataggaaggagagattgtgccctccttccaaacctcccctgacctctccagagcaattcctgattaaccaagggctttgtccatctcatccagaggaacccagggtcctcgttggcccggctgggaccattccactgccccagaataccagggggccrtgacagcacccactgacagtaagagctcactycccttggctgcccttctcctgcatctcccaggcccccagagtctccccttcgatctttctccctagctctgtgtttggcctactccttctggctttcctcaacagtgttccacattcccctcaaattcccttttggtgtgctggcattgccatggtgctgctcctgcaagttctcaggaggaactgtggtgtcagggagcagargtttggggttggggtatagtggctgggaggaggggtgcaaagtatgtctcctaacgcttaccctgcctatgtcccctccactgccagctccagcaaggaagctgccacccaagagagcagagggagacatcaagccatactcctctagtgaccgagaatgtaagaggggcaagggtsgggtgtctgggcctggggtaccttaacacaagggaagagaatgctcaggggacccagggaaaggattcgttctctctaaagactcagatttcttgggctgggcatggtggctcatgcctgtaatcccagcactttgagaggctaaggcaggcagatcgcctgagtccaggggttcaagaccagcctggccaacatggtgaaaccccgtctctactaaaaatacaaaaattagctgggcacggtggcacgtgcctgtaatcccagctacttgggaggctgaggcaggagaatggcttgaacccaggaggcggaagttgcagtgagccaagatcgtgccactgcactccagcttgggtgacagagtgagactccgtctcaaaaaagaaaaaaaaaaaaaagaaagactcagatttctctttttttctaccaaaacctttgctgtcatgactctcttccttttttcttctttttctgtcttgctcttcattctccctgtccccagttctgaaggtagctgtggagcctccttggcccctaaacagggcccctcgccgcgccacacctccagcccacccacccccccgctccagcagcctgggaaactcaccagaacgaggtcccctccgcccctttgtgccagagcaggagctgctgcgttccttgcgcctctgccccccacaccctaccgcccgccttctgttggctgctgaccctgggggcagcccagctcaacgtcgtcgcaccaggtaataggagttgaagggctaaggagcctcacagctataaaagaggatgttagaaatggcaaagggcaatttgaatccatcagagagatggatcaataagatgggtggcttggggggggtcctgaaacctttcaagaaaaatatttgtgcaagtgatctgggaaaaaaatgcagtgaaggagcagaataggaccttatatggagcctagggaccctggctttaatgtgagagttatgtggaatggtaggaagaacaccgagatccatcgagttgggggaacagagccttctaagattgggaaaatcttcgcttaatacttgctggggaaggggcagtgtctgacagagagtgggaagccactggcttgtgtgccaagagtccatcgcagcaggcagggagtgggcatttcctttatttctctccctttctcttcacctctgacttctctgtttttctctccccygccccccgccatttcccatctcccttcctcccatccataacatccttccacagctcccttccccgctctgaggagagtcgatactaacagctaccctctccctgccctgggagacctggggtgggcagggaacccctccctgagaacctcagacccactcttccattgcatcctgtaggacccagtggaacctgacagagcccataggattccctcttctactttcttagacagcagggatgtcagggtctcaaactgcctaacactttgtagcttttcttaacacaaaagcaccccttctctcctaacttgggctctgaatactttcccaacaggaagtctgatctgttgccagacttcttrgttagatggctcatacatttatctagagaagcacactcttgcttgctgtcaaactttagamcaccatggaaggtctaagggcatcctgtgccagggaaactttttaaggaattttatctatgggataaaccccatattccctctagtgtctactggtggctctaatactgctttgtgctgcctgccacacttgccctttgagcctgcgaatggccgctagtgagcaagctctgcttcagagcagtctagttaggtagaacagggacttaccagcttcccaaagggatctactcaccattgccaaactcttcatttccacattttgtgtaggtgtcagggaaccccaaactggtgttgctttggggtctctaaaggagattggctgacaccaccatttcccccagatccagattctctgagggaggttgtttcttgagagtagatccagagtgtcaaggatctgttagatcctggaatcccttcttgcatccatccctccctggtagctaggtcccgatatactcctgtcttgtgagattgtcgagatgagatgggggaccactcttcctctgtccttcctctctcctttcctccatagcaaggacgaccttccctgctccatgcccagagtatagctagatcccttcccctccctaccctctgaatgtgtgctagatcaggtgccccactgtgtttcctgaaatccttgggagccggatctccccatctcccctactcactcttcccttttcttctctcagtgttgtctgaataaagtgtgaaatcttttgtgttttctaaattgacattttcaatgaaaaaaagaatcacaaaaaaaaaagttgtcagcctcatttgtgcgtcatcccttattttcctgggatctcaggacctctgtccctctcatttctcacttctgagatctgcacatcttttacccaggagcctcagagctcctgagtctggtgtctgcctatccccatcttcactgttagtcctcctgcagattctgtgtctcctttcatgtaggtgctggatccctgtgtgtgggcttccgtatctactccctcattccctccaggaacctccagctctccccagtgacttctaccctttactctgggcgtgcctttgccaagatgtcaaagcttaccaacatctctggatccactaattacctcctgcctcctgtattcgtcttcccactctgattacctgacgtctgctccactaaaccgctggatctctctcaagacaaacccttacctccattgagagtgcaacacagtctgtcaccctatttacagaggcccccttccttttcctcctaaattcaaaattcagccttgtcacttcctatttccctctggtctaaggaatctttttttttttttttgagatggagtcttgctctgtcgccaggctggagtgcagtggcacaatctcagctcactgcaacctccgcctcctgggttcaagcgattctcctgccttagcctcccaagtagctgggattacagaagtgcaccaccgtgcccagctagtttgtgtatttttagtagagacggggtttcaccatgttggccaggttggtctcgatctcctgatcacgtgatctgcccgtcttggcctcccaaagtgctgggattacaagcctgagccaccgcgcccagcctggtctaaggaatcttatagttaaggtaaccctgttttccaaaccaaacaccagagtacccgatccaacacatttttgaccacatgtgagtctgttcttctgacatgatttggatcacacctagccatagatttaacacattacctcaactagaaagaatagagcaataaatcagaagcactccagaaaatcttgggtataaaatgaacttcccccgcccttttctggggcacagctttgattaaaacctgttaggaatgataattacccccttctctttgttcctgtgctattccttttactcctctcctctgattcctccatacccacccatctttcatccagtagcctcctccccatcatctcccatttcttctacagggggactcccccaggtctggtagcccaaagctgctgctacagccgccatgggggggtgaattcctcatcccccaatacaggtaagtattcactcctccctaccctcaaatcaagtaggccacattcactgtctactcctgccttcccattcacatgcctgatatttccacaggcaaccaagactccaagcagggagaacaggaaacaaagaataggtgaggtctaaacccctcccctaacagcctcccaccaccatctgactcccttcctaacatcattctcagtcacttcctactcttaaatcttattgtatgaactggacaccagctcctcccacaattccttctaccttacatcctgcaagcccctttcccccacaggttcaactctggtacttccctttggaatacggattctctgagaggttttaaatttggacatagcactaatggttccagcttcatacccatcatgtgtcctacattaaaacctggcccgagaccttgaagagtctgtaatcttaatttcctctttagtattcctataacccactctccatctccccacctaccaggtctgccagtgaggagcaggccttgtcacaggatgggtctggggagaagcccatgcacacagctcctccacaggccccggccccgccagcccagtcctggacagtgggtggggacatactcaacgccaggttcattcgaaacctgcaggaacgtcgcagcaccaggccttggtgaccgcagccccgtcaaacatcttcaaagtattatttctccctcactacaggaaagagccaaagcccaaccctcataatagatggatacattcattcattcattcattcagcaggcttatcagattcaagtcatttgtatcttttaaccagaccaataaaagtatttatttttatcacaagagctgttgaaaaatttgactcattatttcagccgcctcacccctcactgtcgttgcacccattcagccttcagccctgtttttgctcagctttttgctcaaaggcctcagctgtgaatacagcgcttgggggggcgggggaggctgtaacttgcgcaagcgcactcaggcagtctccgagcccgcgggcgcaggcgcgcttacagccgacagagcgcttcagccgcttccctcgagcctgcagtgcgcaagcgcgggacatctccgtttccctccctcagccccttccccccctacccccccgccccggcctcctttccccttcacgaagccggctctggggcgcgctcacccctgtgaggaggccggaggtcggactcaggaggctccttctccactcccggaagatcatgtaccagcccagccggggtgcggcccggcgtctcggcccttgcctgcgcgcctaccaggctcgaccccaggtgagcggaggagaagagggagggaggagagggggcggggagagaccctcctcaaagccggtgcgtggggcggagcgcgcgctgggttccgcgcaggcgcagagacacccgccgccccttcccacctgtgccctgcagcgcgtggacaggctaggggtcgcgggagcgggagggaggcgctgccgggcctgtcgcgcaaggacgtcggtcctcccaggtttgagggcggtcaggcggggtcaaggccaggcagcggggcgcgtctgcgttgcgcccgactctccgcggttacctgtgcctagaggtgatttgaagggcaggggccgagagattcgtagccctgctgcggcgccgtcccggagttccccggcccagaccagacccgcggggcgccctcagcagcccgcccgtcttgcactcggagagcggtcctggcaggaaggccggccagtgtgcacccggttcgggcccctgcgcccgggctggcaagatggccacgcccccagcagagacggcgcctctaggacaccatcggggaccgaggtacccgagcggtccgcccgccttccctgcagtgagacgatcccctggggggttccttgggagcggagggactcgggtgaggcctaactttgggtgacctccccttgcagtttcaacgtcggtaaacccaggagagtgaaggccagcctttaactgtctcctgaggttgtgtctgtcattagaggggcccgaaatgataatagcttccatttatgtactgctttctaggtcgctacgttttgtttacattcattatttcatataggcctcataacccagtgaggctttattgttctcatttataggacatttgtaggaagcggaggcatagggaatgagaatgcctaaagttacatgatagaattcagattcctagcttcagctggatattcttttttctctgtacatttgcctcgcacacttaatcatggagatgtacaggccacagcatttaatccacagtacaataaaacctgttattcgttaactcatcaagtatgtattacatgattcttgcgataagagaggtgaaactgcccccagtgttggaatctttttttttttttttttgaaatggagtcttgctccgtcacccaggctgaagtgcattggcaccatctcggctcactgcaatctccgtctcctgggttcaagcaattctccttcctcagcctcccgagtagctgggactacaggctcccgccaccacacccggctaattgttttgtatctttagtagagatggggtgtcaccatattggccaggctggtctcgaactcctagacctcgtgatccgcccgcctcggcttcccaaagtgctgggattacaggcgtgagccaccgcgcccggccacatttctttaagattccaacactgggccgggcacggtggctcacgcctgtaatcccagcactttgggaggccgaggtgggcggattacctgaggtcaggagttcgagaacagcctggccaacatggtgaaaccccatctgtaactaaaaatacaaaaattagccgggcgtggtgaagggtgcctgtaatcccagctactcgggaggctgaggcaggagaatggcttgaacccaggaggcggcggttgcagtgacccgagttcgcgccaatgcactccagcctgggcgacggtgagacttcgtctcaaaaaaagaaaaaaaagtaaaatgtctgctaggttttgggaggtgccggtatttatgtcacataaaacagtttgctcggctgggcgcggtggcccacgcctgtaatcccagcactttaggaggcagaggcgggtggatcacgaggtcaagagatgaaaaccatcctggctaacatggtgaaatcctgtctctactaaaaatacaaaaactagctgggcatggtggcgcgcgcctgtagtcccagctactcaggaggctgaggcaggaaaatcacttgaacccgggaggcggaggttgcagtgagctgagatcgtgctactgcactccagcctggcaacagagcgagactccatctcaaaataaataataaaataaaatggtttcctcctgttttcagtagagatggagatgaatccatcccttttttcctatagtaattccatccattctgtcaggaggaataggtattggaagcctgttgagcatccaggggatcaaggggtgttagacaagtggattcttatctttctcccttctgttctttctccttaggaccagctttatccagggactctaccattcccacccctttggccccactccacgacaaccacttccccatcttctcctctattctggtctcccctgcccccacgccttcccacccagcgtcttccccaggttcccccactacctctccctcagatccaggccctcagctcagcatgggtggttctccctccaggaaagggggaggagggaccaggacctgagttgcatagcggctgcctggatgggcttagaagcctttttgagggacctccctgcccctatcctggggcttggatacctttccaagtccctggaactgcccacccttcccctgccaccccgtcaggagatcctagtatggaggaacatctgtctgtcatgtatgagagactgagacaagaggtaagtcagtgcaaaagtggccttcgtctacagtgggaaggatgtgsgtaatccttggacgtacagggatagtcaactggattcttttttggaaccatgaggcaggcatagaaatatattataaacattttcctgagaaaatgatgttccagccaggcacggtggctcaaagtgctgtaatcccagcactttgggaggcttaggcaggtggatcacctgaggtcaggagttcaagaccagcctggccaacatggtgaaaccccatctctactaaaaacacaaaaatcagccaggcatggtggcagacgcctataatcccagctactcaggaggctgaggcaggagaatcgcttgaacccaggaggcgcagtgaaaggagatatctccattgtactccagcctaggcaacagagcgagactccgtctcaaaaaaaaaaaaaagaaagaaaatgatgttcctcattttgggttaagggaggttaatcatgggatgagatctttcactccaagatgggagtaaggaggccttaaaaatagaaaactgggcctggcacatggctcacgcttataatcctagcactttgggaggccgaggcaggcggatcacaaggtcaggagttcaagaccagcctggccaacacagtgaaaccccgtctctactaaaaatacaaaaattagctgggcatggtggtgggtgcctgtaatcccagctactcgggaggctgaggcaggagaatcgcttgaacctgggaggcggaggttgcagtgagccgagattgtacctctgcactccagcctgggcgacagagctagactccatctcaagcctgtaatcccagctactcgggaggctgaggcaggagaatcgcttgaacctaggaggcggaggttgcagtgagctgagattgtacctctgtactccagcctgggcgacagagctagactccgtctcaaaaaaaaaaaaaaattagaaaactgaaaaataggattatcttttctttcccactgggttgatgccatcttcttccacctagcttcccaagctcttccttcagtcccacgactacagtctgtattccttggatgtggaattcatcaatgagatcctcaacatacgtaccaagtgagaaytggggcacaggtagggcactggggaggaaaagcacccaraggtatatacatgacccttttcacttcccagagaagttcctagactgcttctcacagctgttccccattccttagaagccagtttggttttctaattctgccatcatgagatttctttcccatcccttcttcacaggggccggacatggtacattctttcactgaccctctgccgtttcctggcctggaattattttgcacaccttcgtttggaggttttacagctgacccgccaccckgagaactggaccctgcaagcccggtggcggcttgtggggctgcccgtccacttgctctttttgcggttctacaagcgtgacaaagacgagcattaccggtaagagagaaatgagaaaggacccaaactataatcagttccttttttttttttttttgagacggagtctcactctgtcacccaggatggagtgcagtggcgtgatctcagctcactgcagcctctgcctcccggcttccagcaattctccagcctcagcctcctgggtagctggaattacaggcacaccatcacacccggctaatttttgtatttttagtagacagagggtttcaccatgttggccaggctggtctcgaactcctcaccttaggtgatccacctgccttagcttcccaaagtgctgagattacagatgatctagtctcccagacaacccttgacctatcctcacttgactgtttaaggacagggatcctgtttagtttatgttaatgttaaaaaaaaaatagagactgggtatattagaaaaacctctgagcttcagtttcttcctatacagtgcctagcacatggtaggtactcaaatacttactgaacagactgggtgtggtggctcatgcctgtaatgccagcactttgggaggccgaggtgggcggatcacttgaggtaaggagttggagacctgcctggccaacatggtaaaacccaaaaaaatacaaaaattagcccagtgtggtggtacacacctgtagttccagctacttgggaggctgagatgagagaatcacttcaacctgggaggttgaggttgcagtgagccgtgatcacattactggactccagcctgggtgacagagtgaaaccctgtcacacacacacacacacacacacacacacacacacaaaagtactgaacaaatgaaaagtcctgtctcatatgttgagccttacaacctggtaaatttccgcctgggagtagaatcccaataaattgttagactcagccacaaacattggatataagtttttaaaccagcagttcccaaactgctgcacagtagaaatgcccaaggatygttaaaaaatattgacgccaaacactctgatttaaytgagacagggcacaacytaagcactgagatgtttgtaagttgcccaggtgatctaatatgtagcagaatttagggactactcgtttaaacaaatgcttgaattcagctttgggaccagtcaccttctccctcagtaagcctccctctattccccaggacctatgatgcctactccactttctacctgaattccagtggcctcatttgtcgccatcgtctagataaaktgagtcctaggtagggctgggtggggtaaagggtagaacatttgtgtgcctcccccaactggcattaacctttctccctgcagctgatgccttcacactcacctccaacgcctgtgaagaagctgctagtgggagccctggtggccctggggctgtcagagccagaacctgacttaaacctgtgttccaagccctgatccttgaccttggagtggaggcagcactgaagactgctacgcccaagagaaggaggtggaggcagccaagaatctcaggagccagcttcctctcctcgtttctctccttccttcctttccatctcatgctgtgtaaagctgctgtgtaatttaacttgtaaataataaagtttaactgactatatgagatagaatttcacatatcactttctctagatcccaaatgttcccacaagctttattccaaaaataattttatttaataggtattaaataatgtatagaaggaaaaggagctggtgtcaggttctgtttacgtccttctcttaccctagctcttctcgtgttttgcctatttttttgggcattttcttagcatggggatcttctagctccttggccttataataatggggagccacctccagaagccaactgctctcaatctccagtacctaggagagagaaaagatcaatggagttcccttctttccaacatagatcttttgttgttgttatttttttttcttaaattgaaacagagtcttgctctattgcccaggctggactgcagtggcgtatcatggctcaaagcagtcctactgcctcagcctcccaagtagctgagactacaggcacacatcacagtgcaccattaattttttgtatagttggggtctcactatgttgcctgggctgatcttggcctcccaaagtgctaggatcctgccttggcctcccaaagtgctgggatggtttacaaaaatgagccactatgcccagccccaacctagatccttatgtgtatggtcaaaagttatctttcctctttgactgcagggctaggtgtaaaggtgcctggctctattattatatacccaaagggcagatacacctctgtatgttattcaagataccaaataagctattcccaagaaaagtctagaacaacatgccaggcacagtggctcacacctgtaatcccaacactttgggaggccgtggcaggcggatcatgaggtcaggagttcgagatcagcctggccaacatggtgaaacccagtctctactaaaaatataaaattagctgggcgtggtggtgggcacctgtaatcccagctacactggaggctgaggcaggggaatcacttgaaaccgaaggcggaggttgcatgagctgagatggtgccactgcactccagcctgggctacaacagcacggaactctctcaaaaaaaagaaaagcctagaacataaagactatactctgtgagaccagagactgctttgttcattatagccccagcacctatacagtagccattcaaatatttattgaataagtgtctagttctcagatcttggaagatgctgacacacctgttagaaaggatgtctttgggctgggcatggtggctcacacctgtaatccctgcactttgggaggccgaggcaggcatttgagaccagcctggccaacatggtgaaacctcatctctactaaaaataacaaaaattagccaggcctggaggcttgcgcctgtaatctcagctacttgggaggctgaggcatgagaatctcttgaaccccagaggcagaggttgcagtgaggctagattgcgccactgcactccagcctggacaacagagtgagactccgtctcaaaaaaaacaaaaaaaaacaaaggatgtctttctattttaccctaccttcctctttctgtaccagtcccagcaacttgaacctgggttcttagcttgccaggacaccatctctctacatagtctccacctgcgtgggcacaggatgttctcctcacctgtctcatgaactctttggtggtcaagacaagttcgtggtagagcagccagcgtggctgttgctcaaagagggaggagttgggatgaatgaagactgtctgctgctgtttcactgtgcggtagccactccgagtcaaccgtgccgtgtggtaaaagtaaccagcagtgatggcctaaggagcgggcaggaaagaaaatcaatggaaaaggcagacatctggggaccctaagaatgcactacctttttagttcaggcttcaggaaaactagagaggtaaggaatgcatgaagaacttcccaggaatgaaccttcagtggtctggggaagaaagggccctgggaggacacgtcatacacaaggggaagagggcatgctctcacgctggaggaaatgctgcatgcccccagagaagcttgctcctgggaaggtactgggggtggaaagcaggaggctgaagaaatgctgaccttgcgtacacggatatagtccccctggcaggaactgagaccaacttccacacgttccaagagcccttccagctgttcccgcacatcccgggctcggcgcatcgatctgaactgtacaaagttctcatagcaccactgggaagagtaaccactctcagcccactgggaagacagttaaaaagaaaggagagataattaagtatacagcaggactaaagtcccccagtgtctctcattcccactcacccaagcccagtgacctgtgtgtaaacatttagcagaaccaggtggtcaccgccagggagaaagaagttgacacgggcattgtcagcatggacgaccttgtcctttggtcggtagaagatggagttgttgacagagagcatggcagccactgtcaggatctcctctgaacagctgtacctgggacaggaaggggaaagcatgagttcaaagcaagacacataggaacagatatggtggagtggggagtgatcactgtgtgatggatgtttcctcatgtggggaaggctggttggcataatggctacaaagcagccagcagatagattctggcagcagcttgggggtcaaggaagtaggggccatagatgaaacacagtcacaaaggagggacatccatggaggcaggagcaggaaacaccggggaattctgaggcttctgcagaaagtgtgcattcactatgtgcatttggaaaagatctctgacagcagaggaatggcatttaaaggtcatccctccacagctacatctaaatgttctagttggaaaccttaggaacaagtaagttcctcaaggggccgggcgcagtggaatcaaggataggatcaagtgtcttacccttgtgggcctcaaaagggggcaatcagagttatctaatactttattatgtgttaagggatagtatgatgaacagaaaaagacagacaaaggggaccctggagacagaggaggcctggcctgtttgtgtgctgggggcccaggtggaggcgagggcttacttctcagaggctaagatcattttggacagcatggggtccaccggcagctctgccatctttcgaccagactaaggagaagagagagagagttgagcccagtcctccctcaggtttcccgctactactacaggggtccctggagccatcctgacccctatcatcctgcctccacccatgctgtcccccgactcaccgtggtgagctccccaaggtggttgagggctcccagagcatacagctgctccaaagccagcagcagtgtctcatatggtggagggtccaggaaatcaaagtgcattaggtcatggatccctagaaagaggtgtgatggatggaacagagtcccttcaaaggacagtgactccagcccctccctcctctctcaggtagcccaatcacctaagctcttgagcagcaacacgacattgcccaagctggtcctctggatctcaggcactgtggtttcctcaagctcgtgctgataggcccaggcggtatacaggcggaagcacttccctgcagccacccgacctgccctgccagctcgctgattggctgaggcctggaaagaaaggggaacaggctggctgacaatttggtcagggaaaagaaaaaggcagtatttatgcaagaaatctggaaggatgcaaactgctcatcccggttccctaggaagcccccaccctgcttctgagttggaccttctctgtgggccaactccacctcccccactcccatgcatccccaggctgaccttgctgcagggtgtgacagtgagcgattccatgcctgtgcgggggttgtagctcttctgcttacagaaccctggatccagcacataaatgatgccctcaatggtgagtgatgtctcagcaatgttcgttgccacaaccacctgagtgataggatatggggtcacccagtgaccccacctacctagttacccagaaaaagtaatcttggaaagttaggagtagtgaagcagttgcagtaaggggcaggagctgagggaattagtagtatccaaggtcaggagcaggggacaaggccagaagacaggggacagggaagtgggggctgggagtcagcagggccataggaggaaaggaaatggagaagaggatttagggttttttttttttttcagagatgggaaatgggggtgttcaagttcctgcccgatcctccccatcaccgctttcgtcttcacacaacacttcctgtaagagcctcctaacgtgtatccctgcttctgctcctagcctctgtcacatggcatccaggatggtccttttaaaatacaaacctgtcacatcactccccatccttcagtggcttcctatcctactctagaattcaatccaagccccttaaaagcctggatcacctaccccagctgcctttctgacctcatctgctagcactccaccacctccctcactcctcccacacactgctttgctctgcccaagtaagtgcactcctcactggatcatttgcatcagctattccctctgtctggcatactcttctcccagatatcagcctggctccctccctcacctggtttgggtctctattccactttccccttactgaagaggccctccctacaccccaaggaaaataccttcatgccagtcctcactcccaccccacagagtcaagttccatcctactatgctgccttgtatctcttcatagcactggccacaaattgacaatatgtatttatgcatccactgcttccccgatagaccacaagtgcaagtttgttaggctaaggactttgttttgttcatcactgtatcatcaacccctgtgtacctgacacacagaaggaactcattaaatatttgttgaatgaaagttatatctctgctcaaaatcctttgactgctactcagctgtctaaagtccaaacttcgccaagcacagtggctcatgcctgtaacccagcactttgagaggccaaggcaggcggatcacttgagtccaggagttcaagaccagcctggccaacatggcgaaaccccatctctactaaaaattagctgggtgttggccaggcatggtggctcacgcctataatcccagcactttgggaggccaaggtgggcagatcacctgaggtcaggagtttgagaccaacctggccaaaatagcgaaacctcatctctactaaaaatacaaaaaattggccaggcgtggtggagggcacctgtaatcccagctactggggggctgagacaggagaatcgcttgaacctgtgaggcagaggttgcagtgagcagagttggtgccactgcactccagcctgggcgacagagtgagactccatctcaaaaaaaaaaaaaaaaaaattagcttggggtggtggtacacacctgtaatcccagctacttgggaagctgaggcacaagaatcacttgagcctgggaggtggaggctgcagtgagccgagatcttgccactgcactccagcctgggcaacagagcgagactctgtctcaaaaaagaaaaataaataaagtccaaactttcctgtcatcaaaggccctccctaatcttagccccaaattgtttttagccttgtctcctactccttcaccacatgaacctcccactaagcctactagctcacactctgacctcaaacataccttgggccttcctctgatgacttctcagccatttttcttttttgagatggagtctcgcactgtcacccaggctggagtgcagtggcacaatctcagctcactgcaacctcctcctcctgggttcaagcgattctcatgactcagcctcctaaacaggtgggattataggcgcacgccaccatgccctgctgatttttgtattttcagtgg

SEQ ID NO: 12297 - DNA, 74870 bp, Homo sapiens
agtcactatccatctgctatcatttggatatttgaccctgtgaatctcatgttgaaacttgattcccagtgttggaggtggggcccagtgggaggtgtttgggtcatagggatgtatccctcatggattgcttggtgctgtccttgcaattatgagtgagtgctcactctgttagttcccaggggaactggtagttaaaaagagcctggcatcttctccctctctctgcctctctcaccatgtgatctttgcacatgctggctccacttcacctctgccaagtagaagcagtgtgaggcctcactggatgcagatattggcaccacgcttcttgtacaacctgtggtttcagaatcccaactgaaaaagtcagcctaaaagtgtcctgtgaaacacctgggaagataggacgtcaggcaagcaacaacttcaatgcaaaatgtgtcttgttccaaaagtgacaggaggaccactgccacagaaaccaccctaaagtcagaagcagcggtaagaagataggcctgatggaagcagagctgacatgcagttgctgactttcacatgcttccaacaagcagattttgcagcagagcaatatgaaacattgattggatgaatacagaagcaaatgaatcagaaaatttagcaggattgtgttagattgggcaaaaaaaaaaaaaaaacaactgttgcaaataaaatgaatatacagttattgcccataaattctcagtgtctcaatccatttaattttttttattgtggcaaaaatataataaaacaaaatttgcttgaaatcagacacagaaggaaaaatattgtatgcttacattcatatggaatatctattaataaattaggcacattccctgaggcagaaagaaattaaaaattactagcggctagggggaggagagagtgggagttatcacttaatggttacagaattcctgtttgggttgatgaaaaatttgagaactagacagtggtgctggttgcacaattttgtgaatgcaattaatgtcactgaattgtacacttaaaaattgtcaaagtggagaattccattcatttaactttaaaaaatataatttttaaaatcttatatgttttgccataaaaattatagtatttatacaatctaaactggaaaatactctttcttagctaatacatttttctatcatatacacacaggataatattatatctactattatataattacttaacatcatactacgaacatcacaccttccttgtttattgtatacctatgtcagtttaagtcagttttttttttttgtagtgtgtatgtagtatttcagtgtttggatgtaccaaaactttttagttgagaataaattgaaagatatacaggttgtttctcagttttcctgttagaaacaatgctgcagaagttctgtccctctagagaaccctgccaaagatacacatgcaacatttttccatatatatatatatattccatatatatatattccatattatatattccatatatatattccatattatatattccatatatatattccatatatatattccatattatatattccatatatatattccatatatatatattccgtatatatatattccgtatatatatattctgtatatatatatattccgtatatatatattccgtatatatatattccgtatatatattccgtgtatttatattccgtatatatatattccgtatatatatattccatgtatatatattccatgtatatatattccatatgtgtatattccatatgtgtatattccatatgtgtatatactcatatatattattatatatgggagtttatatatatgggagatatatatatctgggatatatatatatatgggagtttatttagtaatattaactaatacaatcacaaggtcccacaataggctgtctgcaagctgaggagcaaggaagccagtccgagtcccaaagctgaagaaacttggagtcccatatttgagggcaggaagcatccagcacaggagaaagatgtaggctgtgaggctaagccagtctagctttttcacgtttttctgcctgctttttattctggccgagctggcagctgattagatggtgcctacccagattaggagtgggtctgcccttcccagcccactgactcaagttttaatctcctttggcaacacccttacagagacacccaggatcagtactttgtgtctttcaatccaatcaagttgacactgggtattaaccattacagcaattatctatgtaatcacttcaaatatattcctagaatgtctgggtcattgtgtggagttgtaccaatgcattccatccctagctgtccagaaatttccccagagaggaagaaattagagactgttggcagtaatgccaagtgaagtgcccatttctataaacaaaaaaaaatggcagaaatatacagctaaaatggaactaagaaaggtcccaggctcttattataacattgttagcatcccaaataattatttagtagactaaagaaagatgccaggagctagcacatactgctccaatctgtgattagattgggaaaggtggaaagtgaagagaaatttgaaagcccatattgcattcttcgaccttggctgggggacttatgaaatcatgatccagctaagggaaagcctgtaatatcactgaacagaacagagagtttagtcaaggaagaaaatgctcagcctcatgatcattctaccatgtggtttcattttgttgttgtgtttttttcacttgcaaccagtctagggggtcacccagaaagaaaaaagtcctaccaagaaccctggctactcagccaaaaccatctccaggctgtggtagtaactgaagtgaagaggacttttgtttctggtgaaccttgtatctgtcttacaaagagaaatgaaggggaaggaaaaaaggggttagcctgtcaggaaaaaaaaaaaggaaaaagaagaaagggaaggaaggaaggaagggaggagggaggagggagaaagaaaagaaaagagaaagaaaggaaagaaagaaaagaaaaaagagaaagaaaaagaaggaaggagaaattattactgacctaatcaatggccaacagagtccaagcaccatgctgatgaatctagacttctttaatattggtcattaatgggaaaaaatcattggccagatgagaaaaattagactacagaatgatcaatccaagtgcgataatcagcaaagttccccaaagaaacacacataattattaaaaaaaagggaagatcttaaaaatactactacttagaattttgtattagtcacatttgagagagcttgcttagctcacaataatttcccccttagttcttaagttttctaatagtctcatttgtttgtcctactgatttgttttcatgttagacttttgattatgagtttatcttctgggaggaatatttcttttacctctgttgctttgtgttctgaaatttggatgtatctttatggaatttttgtgttttctctgtgacactccaggatagtaagaggaggagggaggaagaggaggaaggaggaggaggaggaggggaagtaacagcaaataacattttttgagcttttacaattttccctcatttttctatgtacttacatagatgaatttaacccctacaataaccttatatatatattaatactgttgtttttccacttttggggggtaaaaaacctgagggcgtgagagttaaatggattgtgcaaggtcacacagctagtacatggcagagccagaatttggacacaagtttggctccagagtgtttacactaactcctgtaatacatctctggacaggttattatactgggagaataaattcagatccttctcctgtctcttgtacctgatacatgctctacatactttgtggtttcattttctatgggcgatctatctatctatctatctatctatctatctatctatctatctatctatctatctactatctgtctgtctgtcttccagaaattgggcagagaatacagctttgctctcccctgaggttgtaggtgaaattttcctagtctgtttttagcaccggacagtcctataaaccctctggattcctgcaggaatatgaactccagcttaccaacctttcaaggaccaagttcaggccagagggtcattaaaacacctgaggcttggttttcagtccagtatatccttgaactgatggagtgtctgaaatgccactcacaacttaagggaaactttaaattccttttcagttttaacacctggaaacatgtctttctgtctttttttgtttcttccattgttgtttacattcttcatcttttttcttccttttttgaatttgactatatattggaaattcaatttggggatatattttacccaccacttccatgcccttctagctggaggctgggcactttagtatattagatcaccatttgtggggaaattgtcacattacgtaaggaaaacagcctcccaaaatgaaaataagtaagaggaaacaggtcaagaaaaaggaaaagaaagcatacacaagaaacaatggtaagaaatgaaactaataaatatatttaatctaaataattatcattgatattgtagctgtgaattttaatacaattataagaatggcagaatgaaaatgattcctaaaataaagtataaagggtctaaaacaatgataacaacaaaaaaattcataaaagccttaactgtattccaggtggtttaaaagtaactttgagttttgttatattactattacaaaatgttaagtgtttatgacctcccttcccacaccccatgagaactttagaacacctttattaacggtgtttgtgccaattttcaatgtaaaaaaagtggcatttcactgttgactatttttaaaaacagaagtaattgccaaggagagaaattttatatatatatatatatacacacacacacacacacacacacattatatatatacacatatgtatacattatatatatatacattttatatatatacacacaggcacacacatatacacataatagtatcatggctttagttgtcattgttgtttaaattatctgctttgctccagaaagtttctcagctttatgattattaacatctgtggattgggagccgtgtcaaatatttgagatttcccaattcatggactttgatttcctgttttgccattcactgtggcaggtcaagaaaagtttgcaactctttacagagcagagagagacagactatgctatatgaattaaacatgtttcagtttgttgtagtcttcgtgcacaaaaatttatctgaatctttttatatgttttgtagacctgggcaaaccactggcttattttgttcatatgtattatgaaatcctgtatccactgtgaagagggtgggagcaacaaatttgttaaaaattcttcatttgtctgtcctaggagtttctccaaggcgtactatggattgcttagctttattaggaaaaaaaatcagctccagaatactctgctaacttagtctgaattagttaaatatacaactaactggcagttgtgtttattcatcagtagtgaaaagaaaatagatacagatttcttatacaaatttaactgctttgtttggttagttattgtttttactctttcttgttcctgcctccatcttggtctcatcatttctgaagaactagttccattttccttgtttaccgttttcccccttatccctgtagttgaaaggctaagtgaacaaacacagagtttattttattcccaaccaaccacggaacagtcatttccttgcagaataattggcttagggagaaagagacacagaaaacaaaacaagttcatcatgtacagcttggtctggctacaccccttttcagaaaccaggctgtgtaagagctgctggagtaggcacccatttaaagaaaaaatgaagaagcagcaataaagaagttgtaatcgttacctagacaaacagagaactggttttgacagtgtttctagagtgctttttattattttcctgacagtaagtaaagctctattttgttgtgctgtgccaaatatgtgggtggacactgctaaaatcaatctatttttcagatgtttcccaattcttatgtgttttatgttaaagacctaagactaaatttttctgctttttcccaaccactttttattgtgtagattgtaacagtaagacatagaaaaatggaaaaaatttgcttctgtgctagctgagggagaattatctgaatattttgatgtaaaaatatgaaagaatttcattttgaggttacagaaacgaaaaaaattgtgtttcttgatttgcaaatctttgggcaaaattactttcccgtgtgatttatttttgcttcttttaaagctaattttgtagtttcattagttattcagggacttctgaattcagaaaattgagagaaattgctttattcttcctgtatctcagaatcaagtttcaagtagtttgagcctggattatgatttacaacctatctcttttcataaaagttgattcaatctgaaggtaaaattacaagaaaacactttwttgaggttgtatctagtggatgtaatttattattcagacaaatttaagtaatcagacttttgatgttaatttgattagctctgagatttctgtttmaatgtaaagaacaagaaatggctattaacaggatgaaattaatttaatcactctattcatgtacttaaagttctctcatacaaggccaaaaatgtgaaattataggttctgaagttgaattacagcttttccatttcagtactccaagttattgcaaaattgtgataataatcactctgccttcccaccatcacccactcccctaaaaagcttaaggtgaaatatttgaggtgaaattttacagtcataaattattgaaataatattttaaattcatgtttacactttttaaaggtagtaaatattttcctcaacactatgatcaaggtttttcttattacacttatttttttctaggttgtgttccaccatgattactttctccttcagcgaataggctaaatgaatatgaaacagaaaagcgtgtatcagcaaaccaaagcacttctgtgcaagaattttcttaagaaatggaggatgaaaagagagagcttattggtatgtttaaaaatttgtctctttccacggttagcactcttacagtgtttcattacctactgattctcttatgttctcttttaattagtagatgggatttattgattttaccagttctctctagttgtatttgttgaattgagagactgaagaataacataaaattattaaagactaaaagaattcctcatataaaaagagattaagtgaacatttaattatatggtaaattacagcaactgctagagctactaccaaatgttatacacttagagccaagaagtacaaaaaaaatgttgtcagaagaaatggagacattttaattttgtggatttattttcaaggacatgaattttctacacaaaaattgtttttaagaattatgatcaactaacaccactgaaagtcagtttgcatcaagcaggtgggctaatcacagatgactagcccaaatctcagtggcttaacacagcaaatgtttatttttttattttttatttttttattattattatactttaagttttagggtacatgtgcacaatgtgcaggttagttacatacatatacatgtgccatgctggtgtgctgcacccattaactcgycatttagcattaggtatatctcctaatgctatccctcccccctccccccatcccacaacaggccccagagtgtgatgttccccttcctgtgtccatgtgttctcattgttcaattgccatctatgagtgagaacatgcggtgtttggttttttgtccttgcaatagtttactgagaatgatgatttccaatttcatccatgtccctacaaaggacatgaactcatcattttttatggctgcatagtattccatggtgtatatgtgtcacattttcttaatccagtctatcattgtcggacatttgggttggttccaagtgtttgctattgtgaatagtgccgcagtaaacatacatgtgcatgtgtctttatagcagcatgatttgtagtcctttgggtatatacccagtaatgagatggctgggtcaaatggtatttctagttctagatccctgaggaatcaccacactgacttccacaatggttgaactagtttacaktcccaccaacagtgtaaaagtgttcctatttctccacatcctctccagcgcctgttgtttcttgactttttaatgattgccattctaactggtgtgagatggtatctcattgtggttttgatttgcatttctctgatggccagtgatgatgagcattttttcatgtgtcttttggctgcataaatgtcttcttttgagaagtgtcttttcatatcctttgcccactttttgatggggctgtttgtttttttcttgtaaatttgtttgagttcattgtagattctggatattggccctttgtcagatgagtaggttgggaaaattttctcccgttttgtaggttgcctgttcaccctgatggtagtttcttttgctgtgcagaagctctttagtttaattagatctcatttgtcaattttagcttttgttgccattgcttttggtgttttagacatgaagtccttgcccctgcttatgtcctgaatggtaatgcctaggttttcttctagggtttttatggttttaggtctaacgtttaagtctttaatccatcttgaattaatttttgtataaggtgtaaggaagggatccagtttcagctttctacacatggctagccagttttcccagcaccatttattaaatagggaatcctttccccattgcttgtttttctcaggtttgtcaaagatcagatagttgtagatatgcggcrttatttctgagggctctgttctgttccattgatctatatctctgttttggtaccagtaccatgctgttttggttactgtggccttgtagtatagtttgaagtcaggtagtgtgatgcctccagctttgttcttttggcttaggattgacttggcgatgcgggctcttttttggttccgtatgaactttaaagtagttttttccaattctgtgaagaaagtcattggtagcttgatggggatggcattgaatctataaattaccttgggcagtatggccattttcacgatattgattcttcctacccatgagcatggaatgttctgagccaaatcatgagtgaattcccattcacaattgcttcaaagagaataaaatacttaggaatccaacttacaagggacgtgaaggacctcttcaaggagaactacaaagcactgctcaatgaaataaaagaggatacaagcaaatgcttatttttaactcctcatggtctaatgaaagttgagagtggaagtaaagtaggttgggtgggtgaagaaatcttctccacacaatcattcaggcacctaggcttcatccaggacctctgccaccatcttggaccttgaagacctctagaggatcctatgcattcagtcaaaagatcaggaaatagtgggaccaggacagtgagaatatagaaagttgtatatgtccatgaacgaggcctggaagtagtgcatatcacttctgcccatatcctgtggtccaggaaatcattcggttccacttaatttcagtaggctgagaatgcagtcaagcatggtgccaaagaggtaatgatgattgacattggtgaacagcaatagtagtagcctccaccagccagttccttttcattttctttagtttacaatacaaggatatgacaactggcaaaaatattgctatttgccaccataaactctatctaggatactccatgtcttataaattctatagtcagctgcccatgcatatagagattgtcatcctgttattcactccattagtttctatgacggcttctgcaggagttcatgatttaatgcaaaagttttgttctagtattagagaatgataaatgtggctactgtctcagtatttatctttcatttgattctccatgctctgaggcttggagagcagagagaacataactgtatagcacaattggaatttgttttcaacagtattttgtattaactgagatctttaagtgaatgcaaccttaattcattatttttctttttatatgcattacaggaatggggcctctcaatacttctaggactgtgtattgctctgttttccagttccatgagaaatgtccagtttcctggaatggctcctcagaatctgggaagggtagataaatttaatagctcttctttaatggttgtgtatacaccaatatctaatttaacccagcagataatgaataaaacagcacttgctcctcttttgaaaggtaggtgtactcatggcaaaaaaagagttactgatagatgtctatatactgttgataagttgtctacacattaatttgaagttamagtcatatattatgctaataacttaagtactaaaatagcatacaaatctggttagattattgctttctctcacaacaactagcctttgaaatattttcagcttgttgggagtccagtttagggaggtccatatttctactggaatataactaaacccagatttatacttttagatttgcaggatagtatctagaaggaatatagtaattgaaaattgtgtgtgtttttaacatggcatacaatgattaagatttgtatctcaggaaaaaaacatctaaataaataaaataggtcatggttattgaacaataatttcataactttgaaaagyagaaatgaataatctgatgattattctgttctgaatatagtacaatcagtaaacatctttaaaagtctttattctaaatgagatcattatgatgtaaccaaaataagcaaaatgcatatttcattcatgggcaaattgggtgcaatttggctatttactctttaatcctccattcctgacaagtgaaattcctggctattgaaaatagagtcacttttaaaaaatcttgttttctgcagaaggcaaaggtcatataaattgtctttgcttcagtaaatctgaaataaggaatccctgactgtatagtaactacaacaattamttctgtttttgtactctcattctcttatgcatacttaatttggcacaattttttctttatgtacctaaaacttgccctgatacttgtcattatgaaaataaaacatgtaattcttatgcatgtcttctgactgtagaatctaaaccattaaatttccccccttgcatttgggttaaaattgatttaaatggaaaatgattttaatttaagtctaatgaaattatatggggaaacagttgaatatcacattatgttgtggcaaaactcttacaattttctatgtctatttttaccttgtaattcacaggaacaagtgtcattggggcaccaaataaaacacacatggacgaaatacttctggaaaatttaccatatgctatgggaatcatctttaatgaaactttctcttataagttaatatttttccagggatataacagtccactttggaaagaagatttctcaggtgactttccatatcaaatatcattatggaatttttcatgttttcaacataaagaacagaggaggttgggcaacagagatgctttcaatgacacatgagaaaacagggaaagcccatttcattgctgaacttatttcaaggtcaatcgtatgttcctactacaggatgactgcaaaaattgtagagtcatccaacatatatgtgttgagcrtgcagatgcatgtgtcaaaggacacatgagtaaccaagactgacaggccccagcctcaggtgagattccaggttagcagcaaagacagacattgaacaattaatgacaagtacaagaaaaagtgtttcatgggcacttagaccaggggttcctaatagtgggattagagaagtcctacctggggaaatgatgtttaaagggagaccagaatgaatagcaggtgtgaggtgctagaagcattgtgtttcagatagaagaaaggtaattgtgaagaccctgaggtgagaaaggacatctgttcctagatctggaagaagagcagtatagctgaacaaggaacatgaaaaggaatgtaatgggagagtgaagctgaagtcactcaagtgctacctcctgtggcatcttgtaaacctaggcaaggaatagccactgagtcactttaatcacggcaaaagtgtaattcggtttccaaaattaggggaacactccagatatagcccggggaatagattgccaagaggctatggagaatgtcaagaaacaaggagtccattatggctggagcagagtgtttgctttcatctcctttttattttctaagactttctaagcatgctgtggtctgcaagaataaaattgctttattaaaaactttcatttatttgcttcctttttctatgtagttaaaagtctactggtgggccagccatggtggctcacacctgtaatcccagcactttgagaggccgaggtgcacggatcacctgaggtcaggagttcgagaccagcctggccaacatggtgaaagcctgtctctactaaaaatacaaaaattagctagacaacgtggcctgtgcctataatcccagctttgggaggctgaggtaggagaatcacttgaacccaggaggtggaggttgcagtgagctgagatcgcaccactgcactccagcctgggcaacagagtgagacttcatctccaaaaaaaaaaaaaaaaaaaaaagacaaccacaacaaaaacgaaacaccaccaccaaaaaagtttactggtagagtctcctctagattgttttcttttcaatacttgtttcatattctccaactgccctcgtcccataatgttggctgtgcttttctttgtgcttacagctcattgctgggatggatatggtgagttttcatgtacattgaccaaatactggaatagaggatttgtggctttacaaacagctattaatactgccattatagaagtaagtgcttgattgaaaagttctactaattaatgtcagctacttccagagacctcaagatttttgatgaaagataattgtcttagtccgtttgtactgctacaacaaaatacttgagattgggtaatttgtaaaggacagaaatttatttctggaggctgagaagtgcaagatcaaggtgttggcaggctcaaagactggtaaaggtccattcctcatagatagcaccgtctaagtgtcctcacgtgatgaaagaatggagagcaaaaactgcctcagctagttccctctagccttttacaaggcactaatccattcatgagggctccaccctcatgacccaaccactaccccaaaggctctccctcctaataccatcacaatgggaattaagttgcaacaagaatttaggaggggccactttcaaaccgtagcaatgatatataatcagattttcctgtggttatataatgaagcagatattcagaccaaggaacacattgcatatctattttaaaactttaaaaccaattttattggttgtaaaactaattttgaagtggttgtaaagacacaggaggctgcaaatgtaatgtacagagaagtccatgtacccttcatccagttgcctttactgggaacatcttgcataactacagtacagtaagaaaaattggagaaccgacataagtaaaatacacagagcttactcatagttcaccagtttctatcttttaaataataattatgtttgtttaaactctactttagatcacaaccaatcaccctgtgatggaggagttgatgtcagttactgctataactatgaagacattacctttcataactaaaaatcttcttcacaatgagatgtttattttattcttcttgcttcatttctccccacttgtatattttatatcactcaatgtaacaaaagagagaaaaaagtctaagaatttgatgaaaatgatgggtctccaagattcagcattctggtgagtgactaattcaagtagtgcaaattaataaacaggaaaattaagaagcagtgaaaaagtgttattgtttcagagcatcatggtttaaacttgatgcattggctactttttcttttgttctgagttttttacttagtctgttaaattttgccatgcaaaatagtgcttataatgtgctgagcactttttctgtgccgtgaatgtcttaagccaacactgatacagggggactgtcattcattttataagcaaggaaaatgaagttcaaagagaataagagaattgcccaatgtgagatggagggtgagtgccggagctgagactctaacccakgtgccctgactgcagcttgttttctcgcctggtcttcttacagttaacagttgatttctccagactttctcatgttgaagagagtataatcctgtaaaagttgacttgtgttcaggggtttggccacaaggcatagattttttggagcaagtaaatactatatgttggaataaaatgagagagcccacataatattcctaggacatacaacacaaaggctggcatgtaagaagaccttagcaagggcatttgctatatatattgatatttatatcttgccccccactccacattcaatttaaagtgattttgaaatmatgagtgcgtgtacacatacatatgtgctatgtatacatatttacatacattacatatgtatgcatacatgagcatgtgtacacatacatacacacatatatgtacacacacacactcatgtatgtatatatgtatgtaggtagatagatatgtatttgtgtcataataaagacaaataattaggagtagaaataaagacctagcaaataggccaggcacactggctcacacctgtaatcttagcactttggaaggcccaggcgggtggatcacctgaggtcgggagttcgagaccagcatgaccaacatggtgaaaccccatctctactacaaatacaaaaattagccaggtgtggtggcgcgtgcctgtaatcccagctacctgggagctgaagcaggagaattgctggaacctgggaggcagaggctgcagcgaactgagatcgtgctactgcactccagcctgggcgacagagtgagactccataaaaacaaacaaacatacaaacaaaaccaaacaaacaaaaacaaaaacaaaacacctagcaaataatcagtaagtaagattagcagataggaatgcaaatcatacaagctccaagcttccaaaaggcttttgcaatactatcaatgacaaaatccatactgtctgtctagaaaaagtaaaaaaggaaaaataataccccaaaagaaatataacatttgttatattaaatcctgggagatgtttttctatctatgccccatatcaagcaaatactctttatggttttggaactacctggaatggatgagaaattatgtattgaacaattccttgggagccacgtgttacctgaaataaaactatggtacagtaaatttttaattttctataaaatatattttattaatggagagaatcttaattctaatatacataaattgtaagatagaaaaagaggaacctgtgtcttcaaataaaaaagagagaagaagtttttgcagtggaactttgggaaatacaaaagaatggacttagagcctcccatggagtctgttaggagggaacccctgtaaaaggggccttctttctgtccagggcatgtcctatgggacagtgtccctgcagtcacctgagaccagggaggcatgagtcaactctatattaaagtcagaaaggtatggaacatttgggtgtgaattcattctcaggataagtgattcttagtatgtatgtgacctaaaaacttagcaaaataaattcatatatacgtccttaaaactaagaagaaaaaagattctgaaatgtttctactaagtgcaggctatctagtggaaataaactttatgacaatttttttaccaatgtaataaatgtgaaatttaatcagtatttattctttaagtatagtgtctgaattgctttgtttttagcaagatagtttttatacacttattaacatctgactttccactccacccctgcaagtggttcctttttctaagtagtggcaatttctaggtaatttctttcatttgtaattttcatatcctgtgttttttcaattcctacctaaagtagttcccttctgaattcaggaagtaggttctacagaatgtgatatgttttttaaaagtgctgatgtttctaacacaggcttaattattgtaatggcatgaaatttaaaaagaagtcaaataaccagtaaatctggtgtgaacatgttctactgggacatattgatgcaaagtcctggttttaatacttgtgctatatgcttcagctattgaattctcatttaattagtcagtgttaagtagatgaacttatctctggacagagataaggcctgcaacttcatgaactttgttaccgatttattctgtgaccgtggataaaccccttaacaaataatagggattgcagtttccttatttgtaaaatgagacacgtgggctaaaacactctatagccttgttagatctaagattgaatactctttcttaataaccacttcataaaaatatcaacactagcacctctaaagcaaaatcgtgcaaatatttaagggtgcagcatactttatacaaatgtaagtgaagaaatcatgaataggattagagagaatagaatgggcttagtagagttgtgaaatttcaattttctactacgaaagagactggaggtgctgcctgctgagatccccatggatagtcaaattatcaactgccccagtgyttatagagttacttgattgatcagaggcttttaagttgcttccaattctacaattaggacggtatggcaatatctaacaaagctgaagttacaaaatgcttagaaacactcttgtacatttttctcaaaaaagacaagtacgagaatgttcttggcattgtaatagaaaaaaatggaaaacaacctaaatttccatgggcagcagaattttgggtcatattctcataatgaaatattatacagcagtgtataatattgttgattgataaagacatcttgcagaataatacatacatatgatattattgatactgtttaatacaatagtcatactatttacacartacatgcacacagagctgttgcctaacacgtaggtaccaacgaggcacaatggcccagctgtgcttacagtcacttaattaattttggcatcctttttttttttttgagatggagtctcgctctgtcacccagactggagcgcagtggcatgatcacagctcactgaaacctctgccttctaggttcaagcgatttttctgcctcagcctcccgagtagctgggactacagrcatgcaccaccatgcctggctaatttttttgcatttttagtagagacgggtttcaccatgttggtcgggctggtctggaactcttgacctcaaatgatctgcccacctcagcctcccaaagtgctgaaattacaggcatgagccaccgtgcctggccttggcatcctttctattggttggtgcctataccagtgttcagcatctatcatctctgtatgcatatatggtaaaggtaacgaagatgaatggcaattataaagaaggagaattgcgattgaaaaaggatatgcaatgagcttctgctgtaggattaacagtatagttattaatctagaaggtacaagggtagtcattacattgttctttagatgcttttgtatatattaaatattttgtaaataagttaacataatttatataactttttgtctttatttaggctctcctggggtctaatctatgctggcttcatctttattatttccatattcrttacaattatcataacattcacccaaattatagtcatgactggcttcatggtcatatttatactcttttttttatatggcttatctttggtaagttgatacatttattaccactttctctgctttagatcttagctatatgtagctaatattaatgccctagtaggttactgcaatcactactttcatgtccattgtgtgtgtgcatgtgtgtgtccttgtgtgtacttgaaatagtttctatggagtgaaaaagttatgtaatccaaataaaatttgacttgccttttgcataaaggtctgaactaatgaaatgatgtatcaaaaagaaaaaacaatgctgactctaaaatatcaaagtcttttctgtataattattgaggttatttttgaggggtggacccaattttttttcccttaagggtgctcatcacatggtagctgatcacaatatctcttctccctctaatattctgtctcatacttacttctcgtttcactccgctctgccttctctgaacaagaacctctaatttccatcttccaggttgttttctgcagaaagtatgtagatgctccttcttacattaatttagcttcattacattaatttagacccaagtctgcatttctaccctatcctcagctctcattccagcttttcccccaccctttcctagcaacaaaagcctggcatttgagtaggacaaacaaggatcctttttcaagagaagttgaggaaagaacagactcattataccttaatattttcaccactttctcactgataaatatttatgttatgatataaaaatccttatttgattgggctgccaatgattctcagtgagctaaatattttttataacagctgaatgtcttctctctcttgcaggtagctttggtgttcctgatgagtgtgctgttaaagaaagctgtcctcaccaatttggttgtgtttctccttaccctcttttggggatgtctgggattcactgtattttatgaacaacttccttcatctctggagtggattttgaatatttgtagcccttttgcctttactactggaatgattcaggtaagagcctagttaattggtttattactgaaatttcaaaagaagtagatacttcatacgctgtaggatcagcactactcaaactaagagcttttattctaaacaatttttctaaagttaagctttaaaatgttattattacattgtaaaaaaaaaagtcacctcacaaagaaacttaaatttaaaaaaatccttcagattttaccgctcagatatattttcattttgaagtattttcttctaggtttttttcctatatacaaatatttacttttattactattcatttaacataatgaaaatatctgctagtttattaaaattgttatatatgaacccacttttattgtataaactatgaatatgaaaaactttccaaacacaagtatagtttaacagataattataaagtaaattaaagtatctatgaactagatcaaggaataggatgttgccaccagtcacaaacccctcagaacactcctccttcgtaaaggtaaaaattttatgatattcacttatttgcttttcattaccacttaagtatgtgttcctaaagaaaatttttggttttgcatgttttaaacttcataggagtgatgttgcacaaagtgtatttttgaaaatctcttttttcattcaacatgacgtttttaggtggcagcatagtttctgtgtagctatagtgtagagttatgtagcatcctattgtgttaacatactatcaattttcttatcaatagattatgataatttttagtttttgagcatttttaataaagctgctacaaacattctagtacacatttcctactgaatatggacatttcattctgttcattacgttartataacaaacagaatagtggggctgagagtatacaaatattaatcttagtagctaccaccaaatattttcccaaagtggttgcatcaatttagttttacatcaacagtgtttcagaattccagtttttctaacacttcaccaggatttagtattgtcaatctttcaaattttagttattctgatggttatgcaatgatatatcattgtagtgttaatttgcatttccccgattattgatgacgtttaatgcctttgtatatgcttagtggattacgaattttcttttttataaattacctatccagttctttggcccatttttcctctgagttttctatcttctcccaattgctttatgataattccttatacatgttgaacatccgacatttttccattatttgttgctggcttttttcctctcttaatggtaactgtgatgaacagagatacataattttgataaggtccaatttttcaagtttctcttttatgtagaatgctttttgtaaaaatcaatgtaaggaatcattgcctacaccaagtttacaaagatattttctggctgtttttctagaatattgactggttcagcttttacattaagataaaaatccacttcagtgtaacttttgtgtgtgtataggtagaggcaatattaattttgctacacaaatatccaatttctccagctcaatttatcaactagactatcctttccttgaatgaattgcaatctttcttttatcataactcagccaatcatgtattggccaaaatgcctatccttgcactgtggcctcattgtcttaattgttttgctttatcatatgtcttgatatctggcagtaacagttttacctctttaatctctttttcaatagagtcttgtctattctaatttctttgcaattatgtaaattttagaattagcttatcaagttacataatcacacacttatgtgcctgtgcaaagccattaagagtgtgatgcagttgaattattcgatcagttcgaagaaaatagtcatctttttttcagccatgaacataatatatctttgcattcatttcagtgatctttgattttctttaataattatctttttttatttttattttattttgagacagggtcttgccctgtcacacaggctggagtatacaaacacagctcactgcagcctcaacctcctgggcttaagtgatcttcccgcctcggcctcgcaagtaactaggactatagacatacaccaccacacctggctaatttttaattgttgtagagagttggtctcaccatgtcgctcaagctaatctcaacctcctgggctcaaaaaagcgatcctcccaactcagcctatcaaagtgctgggattacaggtgtgatccatgcacttggcctgttttagttttcactgtagaggtcttacacatttttatttgattcattctgatgcttttgatatttttcatgctgttataaatagcatctatgtttaaattcttatttttaaacatttgttgttaatgtagagagatgcaactgatttctgtacattggcgttctatccagcattcttgctatattctcttactaaacccaatatttttctgggttttatacatatataatcatgttgtcttcaaataatgatggcttatatttttcccatcgcaatccttatgctttttatttctttttcctactttcctgcacaggtccggacctctagtacaataatgaatagaaatgcaggcaaaataaaagctttctacattgtgccattaagtatgatgcttattgttggtctcagtgcatgtaattcaccagattaaggaagattcatcttagtttatgaagatattttctttactatgaatagatattacattttaccaaatggtttttctgtgtctattatattgatcacattattttcctatttaatgtttgatgttgaattacactgattgattttcaaatgttgactcaattttggattcctagaataaattcaactttatcatgaaaatgttaacattttaacatagactgagaagctgtagagtgtgcagggtaaggaactggccctaagagtaagactttctttgttctaatttcacttcgccacttttggctactcaacttcgctgtgccttagttttatcatatgtaaagtgcagattaaaatcttattatttttataagccttattgcttatctgatagggttttaaggaagattaaatgggataatatacaaaacacttaggacagtgcctagaacatagtcgctgttattatgtggcaaaattctaaatacaaacttttatttgaaataataactagaaaaggaggtaagttctctttttatctaattaaaggcgtccaagaatttcttatattctttccaaaatttatatctcctttgttgcccagaatagatatttgtaatactgcaatgattttctgaaaacaaacaaatgaattataatttaaattattatacttagaacattgtatttattaaataaatatttctttctaattatttttcattgtaaaatagaaatattttgaccaatacctttatttacttatttatatatttgactagtaactactaagtgcctcttgaaaaagctagttaataaattaatactttttcctgctatgccaagctatttatttatttattttaaacatttatttttattttttgaatcttagattatcaaactggattataacttgaatggtgtaatttttcctgacccttcaggagactcatatacaatgatagcaactttttctatgttgcttttggatggtctcatctacttgctattggcattatactttgacaaaattttaccctgtaagtaatagtgagtttttctctgtcctctacagttattaattacattgaatatattttttaagattatatagacttttaaaatgaatattaaatatttcccatttcaaactaataagttcattatttctacttcatagttctaatggtctaatgaaatttttatgtaaaaacaattcttcttatgactttactatagcaatatattataattatatgacaacaataattataatacatcttgtaattgtgtggtaattaaataatgttaggttttcatggatccctgaaagtgttttgaaagggtcatattaggatttatgtcaaaacaagataaaagaaattagttcttatggtggtttggctctcgggaggccattatactgtggaagagctttctcatgaatatttgttcagcatcattctcaaaatgttttatatattgttcatatttacagaagtatattgatcgcccagttaaattatcttgcaaacaaccaaaaatgtcacgtaagcccagaattttttcacacattctagaatcagaaagctttttttctggcacaatcttcttgtttatcctcttattttatatgttccttccactatttaaggttgtcttataggttttctatgtatttacttgtatatattcctgtctttctgtgacttctggttgatatgtgaaggcccttaataataaattcaactttgttttttaaactggaaaaatatatttaaaatatcactataaatttattctaaacaaatacagtttctccatgtattcatgcctaagcaggaatatatagatttcaatattatgttcaattatgttgctgtggtcaaattatttaagttgacaaacatgtctacaattatttttatgcactgtattaaggctttgtgtcttcccaaatatttggtttcattcattctcctaaataccttttagatcacattttaaaaaaatttaataaatatgtttattgggtgatacaaayctgtttttcatgagcctattaaggataatgcaacccattgttaagactggaaaaaaaggacatataatggtttccttgttgggtgtccttttctacagatgtagacaacagaggctctaagatctgtactaatgtcttgatcagggaaaagctggagtccaactcagctggtcatacacctaatattttattcgaacctcactttcctattgactttcttttttttgatcacattctatttatactttgttgaaagctgtattatattgtttaattttgcaatatgttatttcctttgagttcccattgtttacttcatcatcaagttttcttcttaataataaattgagttttagaagaaaaaatgtctctatgatgcttaaaacttcaaggcattctgcattgttgttagcaaggcttctttgcgcattsttttactattactgatcatattttgttgcctcttggttaattagatggagatgagcgccattattctcctttatttttcttgaattcatcatcttgtttccaacaccaaaggactaatgctaaggttattgagaaagaaatcgatgctgagcatccctctgatgattattttgaaccagtagctcctgaattccaaggaaaagaagccatcaggtaatcacacttataagtaatactaatgcatgagcacaaggctgaagaattattattatttttaattttattattattatactttaagttttagggtacatgtgcacaacgtgcatgtttgttacatatgtatacatgtgccatgttggtgtgctgcacccattaactcgtcatttagcattaggtgtatctcctaatgctatccctcccccctccccctaccccagaacagwccctggtgtgtgatgttccccttcctgtgtccatgtgttctcattgttcaattcccacctatgagtgagaacataaggctaaagaattattaaccgagagcatcagggtgagcttgaggcaaaatattgaaggagaagatatttgtttttgtcaatgtcactttgaactgctccatttccatcaccaccaatttcttctgttacttgaaaggaaaatcctccttgtttatcagctctgtatcatattatccagccacacttcatcttgtccccctttctgcctctttctcttgtgcccacctctcttttatacttgctcctttcattctgtgaacccctctctccatggtttcatctggytttatatgataagttggaagaagtaagaaattctgaatcagaaattcttagatcctaatactctcctctctcatttgatgtgtactcttggaaaaatgagtaaattttatgagtctcagtgtcttctatgaaacaagattaatattgactttgtagggttgttatgagayttggtatatcacagaattgcatgaggagcatttagaatatctgtttttagccagggattctaactcagcagttttgggattgaacccaagtatcrtggatttcaaaatagctttgtagatttttctacaaagtttggtacaaagttaatggatcagcgctttaaatagcaatcgtttatttattaacagatgtttacttagtgctgactatgtacctgacttgcacataattcgcacaaaaagcttacgaggtaggtatctttattttccccattttgagaatacaaaaagtgaagcaatgaaagcttaagccttttacccaatatcacacaactcgcaagtggggaactggaattgtaatccagatagtctggctctacagtctatgctcttaacatactattgagatgtcaggaggcaaagaaaaatgaataaatagagaaccatatctaggaagtgaaatatttccaagacaaagaggcctaacccatatacctaagcttcctccatctagttcttaaccaattttccgtttaagttttctgagaggggcaacagcgcttcctctgctctagctaggagtataccagctccatagaaaatttctatccaaacaagaaaggccaagtgaggaataattccataaaactcagttccagtgtcatcaatccttctttaccagttgagggcacaaaataatattgtattatattattattcaaattataawaattttcagatccaatcttctaacaaaatcttttacttacaaagacctcaaaattttctttgttcttctactgctgcctagtgacctaggaaagaaagtaaaatgtgctccacccccaccttcccccaacttctcccttcttctcccacatccccactgtgcctccaaacctagccaatgtatacagtgttgactgggyacacctgtcacttggtctggattcttagctcaggtggagacctgaggctactgacaaaccagggaaagaaagtcatttgatgcaaggactattcactaaagcttttggctccattgtggggcacctcaccccagatccacaccaaagcaagaaagtaggctyaggcggtcaatgttgtagctctttaatggcaaggtggtacacactcactgagtgttaaagcaggtctggggctgcaaggcagtctaaaactgcctttygaccatccaacagtatatgcagtttctaatccacaagttttatctcttctttcttcacagtgatcatttcttagtggcatcattactcttccccacctgtagacaatgtcaaatctttttcaatcaattccaacgtgtgaattctattttgtatgaatataaaaggcactaagccattgatttttttcttcctatgtggtctctgctttatataaaaattgactcttcctctttatatagaaatgctttatatacaaaggaactcttcccctaagatacatagagcttacagggtatgtaatctttaagctctatgtatcaggggtatggatgaaagtttgtagaattctaaccagaatcatgattctgggtttgtaaaaatatacattttttattcacaactggctcttcctcattcataactcccaagtcacattttctctgggggcaattgtgtacacatatgtgcattcctgtaactatagaccattcaggcaatattcccagaacacaggtagaatgtctgcctcaaatgtaaatgactgatttcatgtctaaaatccagaaacaacagctcctcctaaatggaattttctttattaaaacaaaacattaaagtttcacttcaacagggattccattttacaaagaaatgctgaaataaaatacctggtgagactcatcatcttttaactttgcttcattcattcattcaacaaacatattgttgctgggttctttactaatctttagggcagcaaatatgaacaataaactgtctttcaaggagcacacaacacagggaacaaaataaataggtacatgaaattcaatctgataaatgtagggatagagatattaactactgttatttagtcaatagaagtgttaactaccctagtttagggaaatcgaagagaacgtctatttttgttttaaaaagttaaaaattactgaagaaatttaggcttttaaagctgacatattcaccatccgggttgagcagatataaacattattgtcatatttgctttgtatttttaatggatatattatatgtttatttaaagtcccttttgatctctttaaaatattttctccatccttcgtcagaatttacctttataatggatttggtgttatcactttccattcatatatttacatattgcaccatacacttatagccctaatcaatatgtgatatagatatatgtgatatagctctgtgtgtttttgatataatctataaatggtatcagactgtacttaagtttctacatattgcttctacactcagcattttgctttttggggtgtattcatagtgataactatgggctaatgcattgattttaatttttatataaaagtattctaagatatgaatctaccacttttatttatcttttctgacattgaaaaatattctagttgtttctaattttttggtctgacaaatgatgttgcaatgaacattctaagaataagacagataaaaaggtgtgtttgtgcatatgtacatatgtgtgtgtgagtgcatgtatatatgtatatgtgtatgacacacccagcagaaaagacaaaaagcactaagctttgtgcaggatataaatggtggtttggtgatcctgacacataaaacatgaggccgaggatgccaaaagatgtcactggacagaccatgagtggctgcttcatgtggtacaaagtagccttgactttccctctgaggctgatgaggaacgttgaggagtaaataaaatggattttaaaataaatcaccctgtttcctgtgtgaagcatggattctaggggaataaactgaaagtagggaaaggaactagaggcagtgaacaagagaagaatagttgaagacttaaaagggacccaagacttgaactattttagagttaaattttacaaaaatgataccaggttggatgggtgatgaatctgagtgagaatcaggaagagagtagttgaatgtccatgctgccaaataagatcctgcgtgatggggaaatgggtttaggtgacaatgcagtgaagtctgttctgcatatgcagttttagagcagttaattctcaaacctggcttcacattagactcatttggaagaacatttaaaatatcccaatcctcagccttcactgccaagaaaaactcatcaccccagatcaattaatgtgaatcttttttctgtgaactctgcagagaagtaattaatgtgaatataatatgaatctcagatgttgtttgcaggcatcagttccctttggaattctaatgtgtattcacaattaacaaccactgattaagagctgtgtgtctgtgtgtgtgtgtgtgtgagagagacagagagagagactatctatgcagcaaaccattagatgtgtgaatctaaagatcaatgaaaagggtggggtcagcattaggttgatgctaaaacaaaaaatccaacgagaaaacttctggagagagtctcaaatgagaagatccatcatatacatggagaaccctgtggaatatcaagctgatgtgtctgatgaaggaagaggactttattaggaaacagagaaggaacatttagaaaaataagaagcaaagcaattaagtcaccattaacaaagagaaagtcatcaacagtgactcataatccactgtaagaatggaaaagtatttgttgtattttataattaggaggtcactaatgatttcattatgaagtggttcactggagtggtgagttcagaaatcagagtgcaattgaagaggaattaaaggtcaggaagtgaaaatggcaagtttacaatggcaagtttattttgagaattttgtacaatacagggaggagagaaattaaattgtgtccaaagtagaggtgagttcaaagaggaactattagagagaacactataaaagatgcaggtgacagagtgtctgactcataaactaataagcaagacttggagacgatgcaggatgccagttcaagaccctaggtaaatgagctgatcttgaacagggggaagaaccaactgttctaaagctagaggaagaaagtgaggataattacacagcattctacttttctaggcaaaatactagtagtttaattgtaacttgagagagactcctctattttctacctcaggggaaataagtaatcaaaaatagggttttttctttctgaatagactgtttatgccatcccttatttcacataaagtggttggctgcagttatcactatgactagggctataaatggcccgtgctattttcacttctgtgttggctaagtaagcaccctttttgttatttcagaatcagaaatgttaagaaggaatataaaggaaaatctggaaaagtggaagcattgaaaggtaaagaaaaacattgaaaaatttcattctttcacttctttctttattataaaaaagggaaacattcaatgtgaaaaaatttgaaatatgtagataagcaaaagaaaaaagaatataaataacgctatcacttggacattaatcatgattaagaatatgctgtaaaattcttccagatatttcatgaatctattaatttataacagtggtatcatacaatgaaagatgtaatttctctttgtttttaaagattaatctgctatgaacaatattttatatattgtcactgtgaggaaagaacatctagactgaaatctgataaaggttttatactagccggtgaatttacatagtttatatgtactggtgaggttaactaaagcaagatgagtaaaaccattgactatgaattaaatttcacaagtcaatatcctataacaaacctaagttataatttgaaatgaaaaaacacattttgatacaaaatattctaacatacagttttctataacagacatttaagcaaacatcaaagtgagtagctagatttcatggaggactatttacttttattaaaaataatttttaggagggataaaaatgatttttataaaagacagaagccttaaaagctgaaaaagaagagccatgaaccttccagaagtgtagagttctccgaccattgtgtttatattgcgtgtattttctaataaatacagcatcctctaattcagtcttattcattgcttttagattaggtctttgagaatttaatgtatttgtatgagcaattttattctctctctaggtttctctcatcaaataccatctagagctgtgatttctttctttaatgttagctcaggagatactgaaataattttaaattgattacttaaagttttggagcacattttgaactacctttgtactcatcaagtcatgaacttctttttgtctaaacaaaaaacttctttaagaattttgttcattttaaaaatagcagcaccttaaaaaattaaaagcattggacatcaacacattaaaaatatgattatgaattcaaaccaagtatagctgctctttgggaaatcagggaagaagttgcaatcccttagcctcctcttccttcctcatggagttagtttctggagcacatctgcaacacctttgggacacacttttgaaatcttttatctatggcctacttttcagaagctaagtaccattccattatatggataccacgactaacttattaacacaccaatgtatgagattcaatttgtttccaatttttagtgtaataaaaaatactagaatgaacagccttgttcaatctttgtaaatgtcataaattgtttcttgaatataaatttctagaagcagaattattcaaaggaagcatactttcaagattcttgattcatatttcaaattatttccctctaaaatcataaaaagtcatactcccacaagcaatacataatgaataataatgacaacgacaacaatagcaataaacacttagatttcattgaggatttggtgtgtgcgggaaactatgctaagtgatttacatstaccattttacatttaggcctgtgaaagacatgttaatatatctctcactttgcagatgacgaaactgaggcttctatttaatttttccagttactgtgggtcagtcccaacagccagtatcacttccctcttaccctggaaaacaccgtatactttgcatttaaaaattacaggccaggcatggtggctcacatctgtaaatcccgaagtgggtgtattgcttaaactcaggagtttgaaaccagcctgggcaacatggcaaaaccctgtctctactaaaaatacaaaaattagccaagtgtggtggcgtgggccaatagtctcagctacagggagctgacgtgggagaattgcttaagcgtgggagattgaggctgcagtgagctgtgattgctccactgcactccagtctaggtggcagaatgagatcctgtaacaaaaaaaaaaaattacaaacataaaatttgttaatgtatttgtttagttgtcccaatattatttattaaataaaccatctttctaatacatttgaaaggtcattttattaatctttatttttatattttctttggtccatattagacttctgttctgttccattggtcactatatcctgcaccagtaacatattattttaattattatagttctgtcacatattattttggcaattaggaaaatattgatcattgtgtattttaaagtattgaaatgctgagaaatatgccactaaactaaatagccttgttctatgttgggaccaggcctgtctaatgcctttctgtttatactgttaataatttgttaacaatttgttctaaaaataggcttgctctttgacatatatgaaggtcaaatcacggcaatcctgggtcacagtggagctggcaaatcttcactgctaaatattcttaatggattgtctgttccaacagaaggtgagtaaaaagaaatttctcaaaggcaagatgtcttataatagaatgaggtcaagcatatgcctctcattttaaattttaaatttgatggcttaagagaaataatgtttatctaaagttgtttccaagagctacataattttgaatatacttcatatttctgcaattttataaaaattattatctttattccattgtgtgatatttcagggtagatgtgcagttctataagcatatgtttgtaacaagaataattagtagttcacaaattgtgttcacatatatgcagttctataagcatatatttatgtcaagaatagtagttcacaaatcattttagacatttgtgaacatatgccaatattttcttaaatgagatctatgaatattaatagaatgtattatcttgccaattttatttttaacttctattcttaggatcagttaccatctataataaaaatctctctgaaatgcaagacttggaggaaatcagaaagataactggcgtctgtcctcaattcaatgttcaatttgacatactcaccgtgaaggaaaacctcagcctgtttgctaaaataaaagggattcatctaaaggaagtggaacaagaggtaggagggcatgcttggattaactgacctgccaaccacttaccaaattaaatcatgaccacagaattctcttcaatgatttatttgccctgttatgaataaaatttaggcaaagaggtcccataacaaatatcgactgctttaatgagtggttaaaattgcataatatgaatcattttggattttatttttattttttattatactttaagttagggtacatgtgcacaacgtgcaggttagttacatatgtatacatgtgccatgttggtgtgctgcacccagtaactcgtcatttaacattaggtatatctcctaatgctatccctctcccctccccccaccccacaacaggcccccatgtgtgatgttccccttcctgtgtccatgtgttctcattgttcaattcccacctatgagtgagaacatgcggtgtttggttttttgtccttgcgatagtttgctgagaatgatggtttccagcttcatccatgtccctacaaaggacatgaactcatcattttttatgggctgcatagtattccatggtatatatgtgccacattttcttaatccagtctatcattgttggacatttgggttgttttcaagtgttgctattgtgaatagtgccacaataaacatacgtgtgcatgtgtctttatagcagcatgatttataatcctttgggtatatacccagtaatgggatggctgggtcaaatggtatttctagttctagatccctgaggagttgccacactgacttgcacaatggttgaactagtttacagtcccaccaacagtgtaaaartgttcctatttctccacatcctctccagcacctgttgtttcctgactttttaatgatcgccatactaactggtgtgaggtgatatctcattgtggttttgatttgcatttctctgatggccagtgatgatgagcattttttcatgtgtcttttggctgcataaatgtcttcttcattttggattttaaaagttgcrtattttctcatataggtacaacgaatattattggaattggacatgcaaaacattcaagataaccttgctaaacatttaagtgaaggacagaaaagaaagctgacttttgggattaccattttaggagatcctcaagtaagtgagattatgcatggggaaggaagcaggtcgaatgtctgcaaaatgtcaagttcttttaccactaaaagtggtagagcttycattgtaatgyatcaagagagaacctgctatgtttaactataaatagaagtatattggagaaaaatggctggatggttattattttatggtatttattgtttttcatgctatcttctggatacagttaatgtgaaagagagacatattttatatatcttcattctctgtagattttgctyttagatgaaccaactactggattggatcccttttccagagatcaagtgtggagcctcctgagagagcgtagagcagatcatgtgatccttttcagtacccagtccatggatgaggctgacatcctggctggtaattgttggttttatctcagtgttaccatgatgcaattggggaatttagaagcgaggtctattcccagggtaagagccctgctctcattatggtgatgttcctacattctatagcagtcaggaggacgacaggagtctagttccactgtggaattcctttctggttgtacatttgctaggtagtgacaactaatgaaaaattctgattaccttttttttttagatcagctgtcaattaatttaaacattcaaatctttttttatatatatttaattgaaaaatagacacttattctttagcatcagagtatacagtataccatgtaatttatgtgttttttttttcagaaagtattggaaggtgcagatagactggtgttcatgagcttattttattttaaatttaatttatttgtataaatttaatgagtacaagtaccgttttgttacatggatatattatgtagtggtgaagtccrggcttctggtgtattcatcaccaaataatatacattgtacccattaaataatttctcattccccatccccctctgactctctcacccttccgagtcttcagtgtctattactccacactgtatgtccatgtgtacccattttttagctctcactgataaatgagaacatgcagtatttgactttctgtttctgtgttgtttcacttatgataatagactccagttccatccatgttgctgcaaaagacatggtttcattctcttttatggctgaataatatcatgagttcattttaaatgcatcaattttaatatgtatttcaaatgttaaaatgcacactagatctagttataccctgttgaatacttctcctttgcacttctgagccttggctcctcgtctttctttactagagaaagaagaaatgacccccaatatcttttctcccttgatttctttcattcagatagaaaagtgatcatgtccaatgggagactgaagtgtgcaggttcttctatstttttgaaaagaaggtggggtcttggatatcacctaaggtaaagactttgggaatagattggatttatgtgtttgcaatactggtatatgaaaaaggtggacaattatgaaacagaactggcctcgtgcttcatctctaccatactggattgatcagtgtttcctgaatacttttttttactttccttcctcctgtgtctttacaatgttaatcattggcaacatttcaacatgataaaccaagcctgacttttcacagcaagactacttcatgtgccacttttctaggtagctgttctgtgcagcctaaacctctacctgcttcctacccacattttcctcagctgatccatagaattctgaaatatgttttcattctttcatagggcaaaaaggcaaataatttcagaagccagtatcaacaaggagagaatctaggggcagaaagtaatgataactgtggctaacaaaaaagtgtatatattagtctgttctcatgctgctaatgacatacccgagactgggtaatatataaaggaaagagatctaattgactcacagttcggcgtggctgagtaggcctcaggaaacttacaatcatggcagaagggaaagcaaacacgcccttcttcacatggtggcagcaaggacagatgcagactgaaggcaggraaaagccccttataaaaccatcatatctcatgagaactcactatcatgagaacagcatgagggtaactgcctatgattcagttacctcccactgggtccctcctatgacatgtgggaattatgggaactacaattcaagatgacatttgggtggggacacagccaaaccatattggtgtatatccaggctaaaataattgtttaaaataaccctatggccaaacaaagcatgcatgtgggccagattttctctactagctaatgatatggtctggtataataattattttccctaagaagtctcttcttcctaacattctcagcttcctacatttatctataactatacatataaaactctatatagttccatttacattatatatttgtttgtatattttgtaattgttctgagcttatacattttccatatatagattataaaattttcaaactgatagattactatcatgttagtatttactcatctttttgttccataaagccaagtaaagttgtgctcaacagctaggtgttcaattaaagctcttcttttgtgatagtggtggagaaaatgcaaatgacttatcttttcttttaaatattagtttacataggaatgaaatatgtaacccagaacaaataacatccttcattactcatcacatccccgatgctaaattaaaaacagaaaacaaagaaaagcttgtatatactttgccactggaaaggacaaatacatttccaggtaactcaactatgattacaatgaaatgaaatatgggaaaaaatgttcacattattattaaaataattttctttgtccaatgaatttagactttttcttagttttggccacctgagaagcagaactcaagaggaaggattgagtgccactgatttattgggtagttgcttcgtggaagcaccagcagataatggggacaggagagagggaagggaaggcagccagggaagtctgaattctggagcagattactgtggtaggcaattgaggtgcaatgcccacgggagggaaataaatgaagtaagtgggctcagcgttttgtcaccagaggggtgagtaagctggggttcttacccactgttccctatccattgttgattaagggatgcctacgagagcattaactttctcatccttctggcttactctgaacatgagcttagaatacttccaagtacagaaaaaggacctcaggtaggtgtttttaataagcagatttaccgtgtacaggtgaatgcagaagaggtgttggtggggcataaaggtttctgctacaggtttctctttgtaaggtagccccccattattcacaaggaatagatagttccaagatctccagttcatgtctgaaaccgtggatagaaccaaacctaattgccatcgatcggaaaacatttctgttcatgtcttccacctacacactgaatgccttttccatcttaactaagcacttaacacgcattgtggctgtaacttttgcagtttgaggtgcaacagcaaaagtagcatgaatttcttctgccttcttcacaatttcacagacagaagattcattcttacgttagatcttagcatcagcataagattttttttttccttgttgagaactttcaccttttcacttacaggaagcattttatggcttttctttggcatatccaaattgccagcatcattactcttgcactttgggaaccttattaggtaaaataggggtgccttgaactgcaataccgtgacagttgctctgatatcccagagggctactaagtgacaggtgggtatagctcggttctgctggacaggggatgattcacgtcctgagcctgagcaagatggagtgtgatggcgaaggatttcatcacactgcttacaagggcacacaactgaaaacttatgaattatttctggaattttccattttatgtttttagacagcagttgatggtggataattgaaactgtggaaaatgaaactgtagataaggcaggattactctattttaattgtgcatgtactattttgcagagaaaaacaacttacatagtctacaaaagtgttcaaccctcggttccctgccaactgggtagcagcacccattcagactttgtttgataagaaatcctaaagattacttgctctttgtgtaatgttttctacgtgttaggcactgttctaatggtttcatatatattaactcctttagttctcacaactgttctttctatgagatgggtgctataacttgccctatcttacaaatgaggaaatatatttcagtctcttgatttaaacagcttccctttggtttaaacatctagtttgttaaaggtataactccctatagacctaccttaaataagctcttttgcataattcggtttcattaggcaaatactcaggaattcccagattttagcttcactccccaatgtggcagctctctatgtccttgtagtagcatagaagatggtgttcttctcagatcagtggactatgccatgttattttgttcttggactaaggccctgtgaggtgcaactggtccactttcatttttggtcagagatggagaataaggaattatatgttggtactaccactggaatatgttactttgccagagtctctggtgttgacctcctggcccatggcagcctctttacacagacccaaggcctctgctgtctaatggcatgcttatgtccatttccggacatgggactcccaggtccattgctgccatgtgcgggtcatagggaaacacagtgtttgctacagtctcatccacctctttcctctcaataatgtcattggcccatcctcccacccaaactagaaagtagcatctaagagtcttctagaatcctgcagtctcatgcaagtatctccatagaagagttacccaataaatgtgtactgggaaactattatataaatggcactgctccaggaactagaaataccacattaaataagagatatgtgtctctactctcatggagcctacatctaactagatagggaaaagtagacacacaaaatacacaaaatttttcaacaattgtacactaaaataataaacaaggccagtgagttagagtgatgactggtgtctggctgaggtttatatagagtggtcactgaaggccacaagaagaaaatggtcaagggcactccaagtcaaggggaaaggagaatggctggagggcaatgagtgagggagcagaatggcaaatggaggtgggtaaggctgtgtggatagatggagacaggctcttttggagcctcagaggttgtgttattgactttaaattttattttaaatgcattgagaaagcattgaaagacttatacagagagaagacccagaatataggtagagatatacgtgggtttgtagtgtggaggtgagaagataatggtctttctgattgttcagatttctgcagagaaatctgcaggaagctcataaactgagaatggaagatgaagtgagacagtttgaggatggaggaagaggtcttccttagtcatttcagagaaggagagcattctcatgaaattttgcttttgactactgtgatactccaaggacataattttcttaacaatattatgtattgtcttttaaataagtattaatttacttggtttagttctcaatgtggttttccaaagtatctattcatatttttttgccttagatcttttcagtgatctggataagtgttctgaccagggagtgacaggttatgacatttccatgtcaactctaaatgaagtctttatgaaactggaaggacagtcaactatcgaacaaggtaaagccatttgtataattcacagaaaaccaattcccaaatgatcatgtgtcaatttagtatttataatttcttatgggtgattcacactaagaaatgtgatttcattccaaatttggctctgctgtttgagatgggctgtcattatttcttagcgtcattactaagactgatcacagatcccttcatggcatctaccaagtttccttttggaaactatttcctatcctcagatgttccctgcttcttagataccttcaggctgtgaaaggctcttaattaggggaatgaggtctgaatatattttttaaaaataaaaattgctkttagcttgttaatatacaaaattccactaaagtcttagtggggagaattctcagtatccactcttgtatattttaatgggtgataataatcattgtcattatggagctcctcttatgccagacacttagattaatgtatggctatacattgatatatatgccttcaacattatctttcctataataacctttccaagaagtgtcattggcactggtttacaaatgagaaaatcagacctatgagcagttaagtgattttccccaatcacagatgtaagatacatgtacagatctggtagttcagagctgatgatctttcccctatactactaaatgattgataccttagtagtagatatttaggtgtaatgattggctatttttatgcagaagatttttwaaaaatccctcagaggaatgatactcttgggaatttctttgcttttcaaagattgggcacaatgagatcaccatttttgtgaattattcttttggtatgaattcagtgtattttctcactgagtatagaatatggacatcataacatgtttcttatattgtttgcactgtaaccacaagcaatctaaaactttgttttatttaaaattttaattttttatcaccattggcaattataaaacttaactatagaaagaaaatatagatggcagtggtgaagtataaacaataaatattgaaaaatattgtctaaataattcctttgaattggttataaaaataaaaacaaatgtaaaacttttttttttttttttttttcgagatggagtcttgctctgtctcctaggctggagtgcagtggtgcaatctcggctcacagcaacctccccctcccaggttcaagcgattctcctacctcagcctcctgaggagctcagattacaggcacctgccaccacgcccagctaagttttgtatttttagtagagacagggtttagccatgttggccaggttggtcttgaaatcctgacctcaggtgatccacccaccttggcctcccagagtactgggattacaggcataagccaccatgcctggccatgtaatactatttttaatattactaaggaaaatctgtgatgcctccaggatggcattaatattataatatgtgtgtttgtgtatgtgtgtgtttatagatttcgaacaagtggagatgataagagactcagaaagcctcaatgaaatggagctggctcactcttccttctctgaaatgcagacagctgtgagtgacatgggcctctggagaatgcaagtctttgccatggcacggctccgtttcttaaagttaaaacgtcaaactaaagtgttattgaccctgtgagtaggagagtactgtggttttgttagatcatgaatttcaaaagaggttcaaaccagaagataatttaaaactagaacgcaatatctgacattcctgccacggggtggataaattcagcatttaatttttctgacagtgggaatacctgtatgttcacactcgattaagcttatacgtgcaggtgtgttttgttttcatggtttgataacctggtgtttatatagtaatgccttctggtactgtgtagcatgctagggtattatcttcagaattttagcacctagaatcatgattggcataaggcaggcttggcactcaacaaatacttgtggaatgtcttactaaataaataaaattcctggagattaatatgctaatttttctttattgtttagattattggtatttggaatcgcaatattccctttgattgttgaaaatataatrtatgctatgttaaatgaaaagatcgattgggaatttaaaaacgaattgtattttctctctcctggacaacttccccaggaaccccgtaccagcctgttgatcatcaataacacaggtgaaaagaaaaataaaatttaaatccagaaataagttatttttattgttgaatagcacaggaggtgggggggggragtgaatcataagagaagaaaatgggtatttaaacttcatttatagaaaacaccttatgaggaacagtgcagatttactctgattttggagatgacagggatgatgaggacaagagaaaaagaacttgggtcactgtataacctggaagagtaaagacgtctctctacctgactaccctaagctattacatggcaaataaacttctatattggcacacccgttctattttgagatccctttgttacacagcagcctaacctataccacaaaggcaatacacactggttaccatgtgaagatggcctatctattccccatgccccttcattaagtacaagatacaggaagatgccttattttgttatcccaaacaatgggtaattgrttttgtttttgttttgttttgagacagagtctygctctgtcacccaggctggagtgcagtggtgtgatcttggttcaatgcaacctccacctcccacgttcaagcgattctcctgcctcagcctcccgagtagctgggattacaggcacgtgccatcacgtctgactaattttttttttttttttgtatttttagtaragatggggttttgccatgttggccaggctgtgttgaactcctggcctcaagtgatctgccctccttggcctcccaaagtgctgggattataggtgtgagccactgcgcccggccagtaattgtttttttttttttttttttttcctaaccgcttaattaactttgaagaaggaacttttatgttagtacctcagatgttaaaacaaacaaacaaacaaagaaacaaaaaaaaaatcacagtaagagtcttcccttgctgagttcctcattcatttgattttcccatggatttgcgattcaggcctgcggtgtatgctctttaaacaaagacagtctttccctttccgtttctcattcttgttttccatttgggttttggaaagtaaattttattcacctcactaccttaaatgctaattgtatgtttaatttctgagatctagaaaggtttctttacctatgagctcataagataagtaaattaggtctctcttttcctctttggtcactcttgagggcagtgggcttgtgttaatatatttattttgtctctgtacttaggtattttatggtttaagtttgaagcttctgtgccattttgttcctcttttctcaaaatctgccaattattggtaacacgtttatcttttaatgtgagcatccctgtctgcctaggtgaatgtgggtcaccatatggcattgcacctcaagtgactgtggaggtggagtggggtgtgtggctgctcaaggtgcatggaaagcttattttctatgtgcatgttcctgtatcacttggttgggggatcctaattcatctaaggtttggccttatttttccaatcccagagcccactataaactcccatttcaaaggcaaaaaaaaaaaaaaaaaaaaaaagtccttcttttcctcttattcattccatcttgctcaaattattgtctgcagttacttcaggtttgcccagctgtgctcctcagataaggtctctyagtaagtaaatatgggactgttaccctggggacaactgcggctactgtgtgttctgtgtggaacgtggggaggggcctgacgggtcatcttttcccaggtatacgtcacgaccctgactatagcttcagagcataccttacccccttgcattcatccactctgagttcaggtatcctggaaattggttttaccttcagctgcttgctctggtgtgctctaggctgtgaatttttctcagctcgtatttcacggtcagacgttctcatctgctttcttcttcagggtcatatctaaaagtytgatctgatgatggcatcctttttcatttcctaagaaagattatatttatacaacatacatgtatggaatatgtacgtaaatgtttagaataaagtaaaacatatgtatgtgttatacagacacatatatatttacttgtccattatttggaagaacaaggaagagagaagagtgttatcattggctgttttaggctggacaatctgaagtactcctcataaaattattgtatctccacagattattcaattcaaatgttgttgttgttgttgtttaccaaaagtcatacaatagaattagcttatttttatgattacatgttaatttgcattaaacagatttataaagctaattcattgtggtataagatttgctaaatagaagatggtacagtgtgggtcaatattattattgtgatacccaaagaaagacatttatacatagtattccataaatattaactttaattatgtatatgacttattttaaaagtttgatatgtattttcttacttttctatggccttcycttattaacttcatattagaatcaaatattgaagattttataaaatcactgaagcatcaaaatatacttttggaagtagatgactttgaaaacagaaatggtactgatggcctctcatacaatggagctatcatagtttctggtaaacaaaaggtatgtttgcctttttgcttttatgaaaaaaacaaaaagtactacattttagctgttttaaaactgcagaaattaaagctagtatacagaaacttgactcagaaaaacattctgggttgttatttaataaactgtgaagtttacctaagtttttgtaaaacattttctatcttagttttgttttgaattagataacttttacatttgaaaggatctaaatttaattgtactgtttaaactcaataaaaatattatagcttataattatcaaccaatataattatggatttaaggaattttattcagtagctaactacctgaataaagtttgtttttatatattgagaaaatacattaaatactataatatctacacgaaataactgagaaaaaagtattctcagtctgctaccttagcatatgtcgatttgggtaaaagagtcaagccatagagattcattagagaacaagactattgaaaatactttttttgaggcagagtcttgctgtgttacccaggctggagctcagtggcagtatcttggytcactacacctctgcctcccatgttccagtgactcctgcctcagcctccagagtagctggaattacaagcaggcaccaccatgcccagctaatttttgaatatttggtagagagtgggtttcatcatgttggccaggctggtctggaactcctgaccttgggtgatcctcccgccttggcctcccaaaatgctgggattacaggcataagctaccgtgctcggtttaaaaatacatcttaatgttaagaactcttcagtcttatttgcattctaataaaagcaaggggcctaattaagtgaagctccctctttatttcatgctacaaagtaaatttttaaaaaagaaaagcctttgaagttgtattactgaattccgttctacataaactaaatatgctataaaaaatgtaatcgctttgtgccagttttgggaaattactttgtcagctactacgttacatacctcacatatttactacatgaactagtggtaagatttaaacaataaaccttctaatagattaatgaacattttcctaaacatgaagtacataaatataaagattgctttaggaagtggggaaatgcttctttggcagggtaaggatgaatatttaatgaactccatgcttatctcctatccagaaggccagcattcctttgctgctgctgctgcttttttttttttttttgagacagagtctcgctctgtcacccaggctggagtgcagtggtgtgatcgcagctcactacaacctctgccttctgagtttaagtgattcttctgcctcagccttccaagtagctgggattacagatgtgtgccaccacacctggctaatttttgtattttttagtaaacatagggttttgctatgttggccaggctagtctcaaactcctaacctcaagtgatctgcccgccttggcctcccaaagtgctagaattacaggtgtgagccaccatgcccaatcttcctttgcttcttcatcataaactgacagcatctccttgtcagggagacttttaaactctactaaatgaaatttccccatcagcaaartggagacaaaattatctaaaattagtaatacaaataaaaattcatattgattgtatgctgactctgtgctagagcttaatgtacatgaatagagtgtcatttaagccctataacaacccatttagtatttccttttcatagatgaggaaggtraagctcagaaagtttagttcacttgaagatggacacacaacaagcatgtggcactgttaggatcttttatacataaaccttgcctttgttctttaagaatttagcattaacattatttatttgtttctgttttaaggattatagattttcagttgtgtgtaataccaagagattgcactgttttccaattcttatgaatattatcagcaatgggctacttcaaatgtttaatcacacacaacatattcgaattgagtcaagcccatttcctcttgtaagtattggatttactgagtctaaacaattaagaattggacaaatagcctatgttttctctctttagcttttaaatatccataagtgattgttaagcctgaaaattattattttatcctaatattttcaatgggttatagcaaacaaaacaggattttttttcctgccaagttatcagataattatcgtgagggaatacttttcaatattttgtcagtcttctaggcaatgttttgaaaagttrtacatacttgattgtggaagtgtatgagaaagagaaacagaaaaaagaaaacactgacttggaaatcaggagaacttgtaaccctggttacatataaatctattataattagttagtggaccctccattgactaaatgtgtagtagacagactaatatgaaggagaatctgccagttctggggctatctgttgaatttattcacctactcatagttgctctatgttgtgagggagcctaatacacacaggctgcattggattctgtgtcagttggctatagtctggcttcagacagtttggacactagaaagcagtggtgggagacagaagagcagaggaccccctacattgggctccagtcacatcacctccttctgctgttcctgaagcccagaagcaacaatagcttgcttctcacttcaccatctttgtgggatgctcatcacccacctaaccatgtcataaggaattgcactctaagaacttaacgtagtcatggttttctggttagaccctgcctgataccaacaggggtgtctcaaagctgactccaactgtttcacaccagaagtctgaaacatcaagaagcaggattaggaaatgaagccmtccaaagggaagtccattttgtgacaaaagtgtgaagctcagttttggcttcactgaatcagtggtgctgggagtatatgcaagcacaggttttctgtaagccatgggaacaatggggatgaaatatacagtacttgagatgttcgtgacagacacatacctccgtgagttgagtatgaccgactgatcacgtaaacaggtctgctgcacaggatgactcgagggaaggggtgtctgaagggaattctccagaaagtggaaccagaggagtagcagaaagagacagtgattacccttcctctttggaacgatagcagcatgaacctgtctcactgcagaattattttgagacaggcttatgctgctatccttcaaaagaacacatccacccagctactgaggtttccatctctgggtttgctcagaaagacatgctgctcaggcctgaattatgtgttcatcaaaggtcctaacttctgaattattagcttcctaatgccattgtgtttgctcaggatcaaaatggactgaagcccatagctactctattagaaacctgttccccactcccacttccccatggcacacacctttcctccctcattcctatgatgaaaaacagaatttatagacatagccctcaaagtcttaaataaagttaaataattgtggaattattttgagacaggctcatgctgttatcctgtaattatatccatgaggtggtcctagatgctgctagagtgtccacttggcctagcctcaagtggatgctgatttgggggtagtgatttaaagttcctttccctgaagttaagacaagcagcaacaagttttcttcttggttctgtgcttcagaacacatccacccagctactgaggtttccatctctgggtttgctcagaaagacgtgctactcaggcctgaattatatgttcatcagaggtcctaacttctgaattattgtttttttgttgtggtaataatacatgatataaaattgaccattttagctgtttgcaagtgtacagttgagtagtattaagtatattcacattgttgtgaaatgcatctccagaactttgccgtcttgcggaattgaaactcgatgccaattagctttccccctcccccatcccctggaaataaccatcctattatgtttctatgaatattactagtttagaaaccttatataagtggaatatttgtctttttgtaactggtttatttcacttagcatattttccaggttcgtctatgttgtagcatgtgacaggatttccttcttttttttttttttttttttttttgagaccgagttttgttcttgttgctcaggctgcagtgcaatggggcgatctctgctcactgcaacctctgcctcccagattcaagcgattctcctgcctcagcctcccaagttgctgggattacagacatttaccaccacacctggctgattttgtatttttagtagagatggggtttcaccatgttggtcaggctggttcagactcctgacctcaagtgatcctttttaaggttgaatagtatccattgtttgtatatacatacacattttgttaatccattaatttggacttttgggttgcttccacttgtgagtattgttggtatgaatatgaatgtgagggtatctcttcgagagcttgctttcaattcttttggaaatatccccagaagtaggtcctaaatgacttttgacttctctttgttctttgagttgaagatcagagtcactttccctcccaccttcgtgcctagatggtaatgagctacacctttactttgatttttcaacatttcaaaaagtgcatttttgtggctataattatttgtttcatttaacaaatattcactagtttaagctaccctttatattttcagagccacataggactctggactgggttgccggatggttcctttttcttatttttggttctatgtagcatttctccttatatcaccatgggcagcatcagtgattacaaggtaagaaaaagcagggaaaagaagaaatttcaggaatttcaatatctgtattttgaatgctatgtgttcaaaatgttttcttctgacaaaaacatttgaatgtatgtttaatttagatattgtagctaaaccttattcttggcaagtcagataatttacttctaaaaactcaaaatgctttttattccaaagtcacctgaaaagtacagtgatttttcagagactccaattagtctaaaccttcaaagggaaatattataaatcttttgaccacattatttcccagccacaagaaggaaatcattgatgttgaaatcaaaggccaaatttaagacttgaattccttttccactctggaaattgcaattttatgttatatttgtattcgattatgcccattattcagacaaagcagttaaatctatcaacgttcaccatcctgagccagaaactctccaagatgtttaggtaaaggtaaatgtattatgtcctccaggtcacaaaataatacttttttttttttttttttgagatggagtctcactctgttgcccaggctggagtgcaatggtgcaaaatcggttcactgcaaactccgcctcccgggttcaagcagttcttctgcctcagcctcctgagtagatgggattacaggcttgcaccaccatgcccaactactttttgtgtttttagtcaaaatgggctttcaccatgttagccaggatggcctcaatcccctgaccttgtgatccacccgccttggcctcccaaagtgctgggattacaggcgtgagccaccatgctggccaatacttatttttatagagtttaatgccttgaacattatgaggtccacttttcattattcatgagctaaagttgtgttatgagtcaggcctatcacagtatacattttatttttgatagacaccttgtaaaccatggaactggctctataagcctcatgttactaagcagtatatgcataattttttttaatattagaagattagattatatttatcttaaaaattcttccaatgtgtttgtgtttattttagatttgcattttaattgaatctatatacatttctttctttctttttttttttaatcagaaaaatgctaagtcccagctatggatttcaggcctctacacttctgcttactggtgtgggcaggcactagtggacgtcagcttcttcattttaattctccttttaatgtatttaattttctacatagaaaacatgcagtaccttcttattacaagccaaattgtgtttgctttggtaagtaacacagtacataaaccaaatttcataaagtaattaataataaattttaacattgttattttaagtagttaagatgttttaattcatattttgtaataaaccaaaacaaaaaacatgcaaagtgcatgtatgataaatactaatagtttcagataccaaagatgttttatacttatgccaggttacttgttttttaaaagttgtaatctaatttttccctcagtaatatttgattttttgactatgttattatttcttttatgctcaggttatagttactcctggttatgcagcttctcttgtcttcttcatatatatgatatcatttatttttcgcaaaaggagaaaaaacagtggcctttggtcattttacttcttttttgtaagtatataatacatacaaatagagaaatagtgttattttttaaacttctaatgtaatcttaaatacagatgtctgccttaagacagtagggaaaattaatacttcaaaattacaccatagaaaagagagggaagtgtaacactgttactgaatcaataatatttctaaagaaatcaggtgctacccattgaacagaatttatggagaatcttacagaagacctgacgtctgaaacgtcctgttgagtttatgtctccagaatacagggcttcctgccaacactagaaaattggcttcctaacagttgacattacaacccatctctacagtcttcaagaaggtctctcttaaccttagctgctaatagtttcagatactaaagatgttttatacttatgccaggttacttgttagtataaaagtaaagagcttgtccaaaatcatggaaaactttgctggaaatgtttgctgaaattctagagacaccagagtgccctgagtcctacacttcaggcctcctttaactgatatcctcaactggtgattgaatgtctgtctggaaaacagctctcaactcttggaatgggaatcttgaatccatgagaagaacccaaccaaagatcatctataagaaatgatatatttaatattaggttggtgcaagagcaattgcgttttttttgctatttaaagtaatgtcaaaaccgcaattacttttgcaccaacctatacgacccactgacttctacaagaaattagtctgggactcttttggccagcaggtagctgttgttccttctcagtggacagcacttgggtttgacttctctgggctatatttctttgtattcagcaaacagtgtctataactatatctcttaccaccatcagcacaatccagtggaagtacagaggctacagaaagaacattaggctcaccttactcggaaaaactggctttgaggcagccatgaggatctggtgcacraaaggtctttccatttatcctttccatggagactattttttgttcagtcaacagacttactgccattgtccagtgtaatctcaggtgctagatcagatgtctgtagaagagagtcttactgacacttggttggtttcttttcagtcagcactcttgtatctgtctagcaaaggtgaacaaagaattcacattcattcttagtgtttgccagtagttttagctctgaacgaagtctaccttggaggtgatagccaagaaatgtcagggttattgtccagcgtggttgcgcatgggtctgctcctgccagcctgagtgatgctgcagatgccctagtgagtgcccctcatagatgctttttcagcagcttgtccttcagtcctaagtaaacagcatgctggaatcaagcttccttttgtggcttttgccactccttgtgttgacccttattacacagaaatcattccaaactggaacaaatgcacatctagatggacacattttttgctatgtgcctcatgaaatagttgcccctggcttaccgtatactcacaacttatcccagtttgtatagagctggaaatttctcagacaagagagcattcagcatcagtgatagaaacatacctcagcccttgccttttagcttttagtggagaagctgagcaggtttaatttcctcatggctgcaggctccatagtgatgctttgggttggaaaacattatagacaagattttctcagccaagttccaggatttcaaatctgtgcatcaattccatagactgtgacagaacttctagaacttaataggccagaatcttccaaaacaataagtttcatctctaggcttagagagcagaaaccattttcccattgtggagtaaggagtgagagtccagtgagaggaactttccttcaaaaaatggcagaagacagaatctgcattatcatattatgaatgccccttgtatatacggcagcaagtgaatagakgaacaaaagaagaaatttgactttgttctttctaaggaaagatgataatgcagaaccacttcttaggcttgtgaactaacatggtgattaaggtgttctcactgtgatttgaaaaaattatcacaaataaaagatcacagcagaaaatcagacatgacactgagaaacactgtatttttaaaatcaaaacacatayacgtatgattgcatgccttttatcctttgctgccatttatgcttaagttgttatggattcaaataaggcaagacaatattccagaggcaaggtacgttttggaaaacaaagactgttcaaaatataaaaacaaaattacaccgcagtgtaatagtaaaatatgtatttatatatttgtaatttctgattgtttttcctttgcccttcttatgcttatctatttcagtatatttatttatttcatttttctatcactgaaaggaatctacatatttctagaatggtggaatgtcagacttgaaagaaattcaaaattgtctagtatgatttaccaaattttatagtgttgcaggaaattaaggaactagagagaccgatcgggatacaggagagcttttattttaggtgtatatcggctcagcagacatgtgtcctgaaagtctgagcccctaacaaagaaagcgagcaacttttaagcattttggggcgggaaaaacttgaagcaggaagcaggtttgcagaagtgagaacaaaggctgtttatcatttatgccatgacttgcatcttaggaaaaatatgagttgcaatttaactttcacttacttatcttgtgaccttgcagctgcacagcaagaaaaacagggacttacagaacttacagaatatgtgggaagtagatatggttaatgtttcttgggacagttagtattctcttttaactttaacttcggcggaggtgggggtgcgcaacttaaattcttttcagccttggttaatacagcaattcattctatgagctattgttatttttctgttactataattttcactattattacttatgccattattctgttattttcttaatttcctacttcaatagaggaaaaaatttagtaacttgctcagaaaaacacaaaaagtagtgacaggctcaggaataaacttgaagtctcagaccttatgtcattcctcatgttaaaaaatatgagacagtagcatggttggcaatactgattcagaacttgtgctgatgaacacatcttgatttcagtaggctaaaaagttttaaaattatacctcttcacaaagacctcaagcagtttgcactaaaatttgcatttgcatacaaataacttataatttatttctaaatatgtrttgaaaatatatgttgtgagaatttatcattgtacagctagtatcaacttaaacgatgctagtcctaggactaaggcaatttgtttactcctcacrggatcatatgtcagaaggtatagtatgttgatattcaatgcagttgtcctttggtgatctgggatccatttggaaggacagtgtaggcaatgtttctccatcattgagtgaagccacagtcagtagttaatttgtttctagagtccagtggaattccatacccccagggttgtggtgctttactggtaccctagacccctgcctgataaggaagtatcttttcagcctattatgctgtgtggtggaggtatagtagcacatcttagcacacggagttctggagtatcctctcacactgtcaaagtttagactcctctcttgttccagtggatgagaagagaggaaagaaactgtagaaatatggaggtctggtagaataagaggagtcagctaagtgaactgaaggacttaagagtgaaccccagatttctcatttgtaaagggagagataataaaagtactacattatggagttgtgaggattaaataattcatgctagattattaaaacctggcatttatgtaatattcagtgaatttagcaattatgattctatttttattataatcagtacattaataagatctgggaaagaaagggtagtgctcaatacatacttggctgatcaattgattcttaaaacaaacaaacaaaattatccttattccttcccatttgccagtaaaaaaaattgtaaaataaaataagtccatcacaataaaaatacacaatctcagaaaagtcatttgtttggaatggggaagaaatggagcaggaaggacaatgagaaagctccacagtagtctggttgagagacagtatggattgtttggtttttttttataatagccatgtaactttcaacatatacaggtttttattcattagcaatattgttaccttagccataaaaaggtaatccctctatcctcttgtcttggattaaatttaataatacacgtcaagaagtctatttggtcattttagctttcaccttagtcgccagtctttattaagaattttctattggggatcataatgtattcttgttaacaaaagcttcttccctattgtctctaaaaggagaaactatcattgtcaaatgggtatatctgcatatgggaacattatgatatacatcatgagaacacctgcatcttaaatgttttacaaaatatcaatgggttgagtatgtctgatacaatatatttgaacttgccttgtaggcctccaccatcatgttttccatcactttaatcaatcattttgacctragtatattgattaccaccatggtattggttccttcatataccttgcttggatttaaaacttttttggaagtggtaagaaatgttaccaactgtgtcattaattttgaatatgtagcttattaaagtgcttttcccagatcaagagagacagaaagtagtggaactggggagtaacagcaaatgggcataagagattttggggggatgatgaaaatgttcaaaaggggaatcgtggtgatgcttgcacaactctgtaagcttactaaacatccttgagttctactcttaaaatgagtgaattttatcagatgcaaaattaaatctcaataaaacatttaaacttttgtcctattcactttgcaaaatataggcattgtcaaatgccattcaaatatgggtaatgccagattgggggaaaaatgtgcttggtttgacaggtaatttgttagccgctgaggataaactcatatgcgattccattcaatcattcaaaaatatatatcaaatactattctctgttagtcactgtgctagtaactggggacacctgatgagcaagatagcacagtcctgactttcccaaagcttagtggaggcaaaggcagaccaaacttactcaagttaatacaagraacttaaatgttacaaaggacaagggcaaagggccaagggaggacacacaaggcacagctggtgtgttctagcgagtcagacaattcttctggggacgttatatttaaatacatggctaaaggatgaataataattagttaatgggacaggaggtaagcatgttctgcagaggaaagcaaaggccttgaagcaggaaaagccaggaggcattaaagaaactgaatgtggttcaagtggagaaaagtatacgatgaggccagggcaagaaagttaagtggagaacacactttttggagctctgtaccactctggatgaaatggctttaaggaaagtaaagagggcttctgtaatcaggggtgtccttggcgaactggaaaagccttccatttgcaaaaatacatctccattggctgagcaatgcctgaagttctcgattagaaactaatccctttgcttaaagcattttcctcctaagtagacctgcaaggtgaaatacattcatcttgatctgccatgtattatataggaggaatgagtaactttctgaatgaactgattgatgaagaaagaataacgtgctggaactagttatcattatgggaaaatagtcaccattgggataagaaggggctctgaaaaggcttgtctgtggcacttaagaaaaatattgtcaacccccagaaattttaccagtgccagcacctctctctgctrtgctttcagtaatagcatattactgtttcagtaataacatatgcttcagtaataacatatgctttctgcaaatgttaaaaccaaatttttttaaacaaagaattgaagagaggaacagacataggttacttgcttattgagagacagtaagagttgagtaggaggttctyttttctgtggggaattactttgtcactagtgcacacaaagaaattgagatctatgaggaaaatattcaatatgtgaattttatattatttaagtgcaaatcataaagcagatgaattatcattagtgtgtgtgtgttttgttttgtcttttcagagagaccaggagcactacagagaatttccagaggcaaattttgaattgagtgccactgattttctagtctgcttcatagtaagaagggctttccacctcagcacacattcttttggatgactgtcattcactataacaatttgatcttgtccaaagtgtgccattttgaaagtgtttttatatgatcttagataaagcacttaccttcagacatgtttctaaaccttagagttactttttacatgcttggattggctatatgtgtccaaaagttaatattaaattaattttttgtttgcttatcctgtttactgtccctcctctaaatttgagagagcttgtaaaaaatagagatgcaatataacttacttcctttgaataatagattaaaaaggcaagaactgaataataaaagtgaaagggaaaatgattattttggtgtatttaggctgaagggaactactgtctttgaatcctatgtgtcagtacttttctaggtacaggagaaaataaagacagcggtccctgccctcatggagcttatattctggtggaaggacatggataataaactaaatggataatatgtgtggtgtcagatgggtggtcaggaaaggcttcragaagagcacttcagtaggaagtggcaagagtgaccccggctcaatccagggtcagccaggccagtgtggttgtgactgaatgmccaaggaagagagtgataagaaagatggccacagaagtcatgggataaagcgagaggtcaggagaaagggtcacacagggtaatctagattactctaaaggctttgactctactctgagtgatggaggaggagtcattggagggttttaagcacagtgataagttcaggcttatgtattaaaaaagtagctcaggatactgtattgagaacagatgtttagarcaagaggggcagagatagcccaagtaggaaggggttgcaacaatccaggtgagacattataatgacctaggcctgggtgggagtatcatgagtaggggtgagaaataattgggttatggataattttgaagatagagtagatagaatttacttacaaactgaatatgggtggcgagaagaaaggaaacaggtttcactaacctggattgtgaatgtatagctacatttctcccccagcttatgagaatgatccacaactatttacccaaagacaaaacaccaccaacttaattcaaatatttaaataatrtttgtgaacttatgcctaaatataactgtatttctttgctcatagccctactttcagactttgctattcgtttttgttctaagatgcatggaactaaaatgtggaaagaaaagaatgcgaaaagatcctgttttcaggttggggtgaaatttaactttatacttaatatcatattttaacattcctagatggtgtctgtgctatcatcttgttaatacagatttacatttacagtggaagcacatgttgattgtcattagggaatgtggattgctgccttactgccaagagatagaactcccaggcagagttctggctgtaagcagctgtaagaaaccttcactccatccaaaatttaataaggacccaaatatgccattctctcgtctgagataattgtgcatccttgaaaagaaaagatgggaaggaatcgatttagcaacatagttgagtgttttaaaaatggagggctgtagaaagggtgagcagtaaatgatgttgaaaaaacatctggtgtgatgaagatgagctcagactgagtagagaaaatgagagtgacatgaattttaaagagaaaggagcagtacctgctgacagatttgaaagggtcaaagattcttaccagaagaatggcaacaacatyaagaaaaggattctggctagtgggacaggagttcttggcaaaagcagaagcaatattgacagtcatcatcacatcatcacctgcacattagagaagaggacagtagtaaaatcacaggaatgctgatttttgacacatcttttaacagctagaataccacatgtaacacatttcattttctccatagaatttccccccaaagtagagatgctaagccaaatccagaagaacccatagatgaagatgaagatattcaaacagaaagaataagaacagccactgctctgaccacttcaatcttagatgaggtaaaaaagcaaggggcaaaatggatattaatggagatattcaagaactgtcaagagcaggatttgatacactgggtttcattttgagagtttggagtttggtgcatttctgtattatgcgtccaggacactccaaagaagtatctgcataatcaaggcactccgcttattcagagtgtcctagaagctaaaaagaacacaaaacctaatggttttaatttttcttttgagaaaagtgggctttcataattagggctataattgcaaaaccaacaagacctcatgagttaaataatttaagttagatttgtcgaagaatgcgaagaatgctaaatagagattaagattttaaggkttactctatttgacttagatgtgatggttccatgaggttagccacccctcttctggcaagacaataagctgcttccatgaaactcagtctatttagaagcaagaaatattttctacattaatgaatgcatattacatttagcagcatgaattactctcaactcaaaatatggtttgscttatgacataaggcatgaaaggttccagcagagacctaaagtctctgaaatttaagaggaaaatcatgctgtcatctcttctagaaacctgttataattgccagctgtctacacaaagaatatgcaggccagaagaaaagttgcttttcaaagaggaagaagaaaatagcagcaagaaatatctctttctgtgttcaagaaggtctgtaataatcccttttaaaacttaccattacttttagaactacctaccgaacatctatgtcataggcacagttttactcgctgaagcattcattcatttattctatatatatatatatatatatttagtgtgccagggagtgttttagactctggaaatacaattatgaagccactagacaaagagcatccaggtagaggaaacagtgagggcagggactcagacacatttggaaacgttgtgtctctagccaagaggccagtgaatgcatccataaatggaagggataaagctatagagctgagcagcgccagattaggtacagcttttgaaaacagcaatgagtttgtgttttatacaagttagcataataccattggagagtttttagcggacttgtgtcatatttaatttatattttgaaaagattacagattggctattgtttgtttgtcagtttgggttgggggggacaagttcagaggcttttatatcagttgggatgaaagatgatggtaacttggacagaggtggttgaatttgggatgaagaaaatatccctaacttctcaagtttgagaatcattcatacatgtactcagtgcatcggccatctattacggaaaacagttggacacatttccaactgaaacaagtaatctggggggaaaaggacagatgtattgacatcaaattcattagctttgcagtaacatttggcataattacagaaaataaagaacatgctttggtgacgtggattacatatatgttatcaatctcaaaatggtactaactgaagggtgcagaaatctcagaagatttcactggagcaaaaggtttatgttgttcagtatttcacttccaatattgatagtctgattctttctttcaggtgaaattttgggattgctaggacccartggtgctggaaaaagttcatctattagaatgatatctgggatcacaaagccaactgctggagaggtagtgaggaaatggtttccatttccaaaacagraatttcatgatacgtatagattatatctttgtaagactatactatttttcttttctttttttttttttttttgcctttggataaattttatttttcccctctttaaatttttactgggcatcaggtgtttataacaggacttggaatcttaccagaaaccaattaccttttactcatcagtttctcaagaactacctgagcttattaggtctcttttctyctctgcatgtaaaactatatttttatatttgtactttaaatcattttctgtaataaatatatgaagtaatttctatagtatttatttgatgcttaaacaatttagacgcttatatatgtcagtttctggagtaattacgctattggaataaaggctgcatgcctttctaaagctcttttatttttttaggtggaactgaaaggctgcagttcagttttgggccacctggggtactgccctcaagagaacgtgctgtggcccatgctgacgttgagggaacacctggaggtgtatgctgccgtcaaggggctcaggaaagcggacgcgaggctcgccatcgcaaggtacagaygggacctgcgattcctttgtgtcagaatgcwgggagactgtagcactgatgatgaattcactaataaagaaccgagagtcaatatgctatctccacctttccagagtgtcagtggcagagcagggatgagggacaagacctgacttcctgcatccctgaatgagagatctttaaaamatgattatataaaataattgacaaggaataagtgaacgaatcaccatgaatcgtcatccatttcagttttctaatttaaaaaacctggaaatgaaataatcatccattgtcagtttctcattcagaattctagtttttcctaaaactgtttatgaggcaaaaaaaaaaaaagtctttcatgttccaaaataaaccaatctcttttttaaaatcatgagttaggattttgacaataatattactaaacttccctctaatgctgttactgttctgtgtgcttggattttccaaaaaccttgtcttgaccagatattctcattctgttttctgtcagattagtgagtgctttcaaactgcatgagcagctgaatgttcctgtgcagaaattaacagcaggaatcacgagaaaggtacgtgyggtgtgtgatgctctatggagagctggtgtggtatggcagcaaacaggggtgtttttctacattgcagttgtgttttgtgctgagcctcctgggaaactcacctgtcttgctcctggatgaaccatctacgggcatagaccccacagggcagcagcaaatgtggtgagcatcattataccccagagctgcgagcatgcacattagggaaggttgcatattttaactggtcttggaaaatcagccctcaaacccactagttcctgattcagtggaaataatttatattatcaggaaaacaaatatttaaccagtagatgatctaatctgcatgatgttcacgtggtattcaggttaaaaagacccaacattttcttggggttttaggtttttaatgtggactgttaaaatacaaaaatattttgccttttaattattgagatgtctataactgtttcttcttttttcccttctactttgtttcctgggagactattaacttcctgacacaattttcctgtttgttttttttcctttttaatgtgacctgtcaaatttgttcctccagtttttctcgggtttattcttttacttacttttcccatctaggatttaccctttggaataataaaatcttcaatctagtttcatattggtcactgtccgatacttttccaactttaacaaaaactttgttatggtaattttatacaaatgtagagaatcgcttatgaatccattattcccatggacaagtttcagcaggtatcaatagaaccaatctcctttgatctatatctccacccacttcctttctccaccctccaattattttgaaggaaatacaaagcaacatattctttaatttataaatatttcagttagtatcttcagaagataactcaactacaatatgattagcacatctaaaaatacttaaaaatgttatttatgttatcaaaaacctagtcagtacttacattgcactatttttttgcattaggatctgaatatgattcatatattgtattttatcttttttttcttctgcacttagttattttaaatactgttaatttttttgctcactgcaggcaggcaatccaggcagtygttaaaaacacagagagaggtgtcctcctgaccacccataacctggctgaggcggaagccttgtgtgaccgtgtggccatcatggtgtctggaaggcttaggtgggtgtctctccgaagcctgcatttgatgctcaaaatgagatttcccatggaaagggcaaaaatccctgtgtgtggctggagcccttccgtttggcttccttggtgacaccttttcttctacatttgaaatttaagaataacattaaaaaattaagggcaatattttttccaacatattctctttcttgcccatagatgcattggctccatccaacacctgaaaaacaaacttggcaaggattacattctagagctaaaagtgaaggaaacgtctcaagtgactttggtccacactgagattctgaagcttttcccacaggctgcagggcaggaaaggtgagacgggcttttgattatggagaaatatggagggtttatccactcagtggtttcctttttgctgtgtgagaacttcatagtgatttggcttcataataaaagttagggacctcagaaaaggatttgttcagtattccagattataagagattgagacctacccaggaagctgtgtcccctggggcagaccaggcacactctcctcggccatcccaggctgatccccagctccagaggggtacttggaaagacttgggagaaggaacttctaatgactcaaacccacacaggaccacaatggtgtccttcctgggcctcctcataaaygcttaacatatataaatatttaaaatttaaaagatgtaaatatttagggtgaattttccccataggaaacaaatggcaattgagataatcaaagagtctttctttaatggaattttcataccttaaaatagagagtggaaaggggtatgtgtgtatgtgtgtgtgcatgcccacatatctgtgtgtgtgtgtgtgtgtgtgtgtgtgtgtttgtgtatgtctgtatgttatttgggggagggcaagaaggtggagcagaaactgaatttgaaattcccgtggagagataagtacatcaaaaaataggacataaaagctactattttattttagcacagtgtaaatgtaattaaattttctaagatagatatcagaacatgtaactttgtcccattcccagacgtttggtgtcacaaatcagagaagtggttctgatataggtgggaagatcaaaaatgataaaacagaaagagcagtggctggtctgaaaagggccaatcttggacatctggtcaaccttagtgccacctgggagcaccaaacccctgtttgggaataagctgggaatagggcatgagggtttacagccagaagtagcacacggaagcaagatgccccaaatcaattacgtctcttccttagaggtcaggaagtattttgttaaagtgttttatgtccttcctctactgcaatctccaactctcccaacctcatattattctttacaagttagacttctgggaggagggggaatcaaggagattccgaggttttttggttggcagcccaagctctattgatttccttacttctagattgccctagggcctagaaaaagccttcagaataaatatgtcttccttacagatctttcgccaatatcaacctccatctccaagatttgccactatttatggttttacaaaatagtcctgaatttacttttgtttaagtgtttatattttccattgtaaatgtaaagcaaattgctggaaatgtaagaaataaagaaaaaattcattcattaaaaaaaacaaaacaatgaattagctttctgatgacaaagatgaacatttattttggggttaattcccaacctaattcgaactaatcaaagggaatagttcagaatacctgattttcaacacgcaaaggttttgcataagctgagcacatatataattatgctgagttattaccaggagarctgtctgcaacagccagataccaaaaagcaattcaaaacaatgctgtgatttcatatttaagccatacattaatttgcattacttttattttaagaagaaaattgttggtaatatcaatatttattctgatgctcattttctccccttgaaactcagagctgaaaacgacatcttcctgttttcaggtattcctctttgttaacctataagctgcccgtggcagacgtttaccctctatcacagacctttcacaaattagaagcaggtaagagtgaccacattcaaataaatcttttgaagaatcaactaatactaaaataataatttaatggaagctaattgtgtaacaattttttaaaatagggctgtagggcatgatttttaagaattctaactgtaggtaatggtgagatttaatcccaatttaggttactctgactctgtgaaaagaggttaatctccagtgcagggaccgaagctgcaggaaacacacatgcttaactgttcttactgtgaaaccatggcatccccctctaaaagcccctctgtgtggcctgctttgcctacatgtatataatccattcacaccaagtgtcccaaattattactttactccctttctttccttacatatccacctccttcccacttttatccctcagttgatgcccttgctttatatttcactaataaaatagaagcaacagagaaagtttccatccatccatcaacctccttgtgtctgtgcaggtgtatttggccttcctatttgaatgatagctttgaccgtcccctgcattgtgtgtaactccttttgctggttgtaattgtccacactctctctcctgtcatcattttctctgctttcaaccccgtcattcccaacagcagaccattgggtgtaatttctcagcacagcataatggtgaagagctcaaactttagagcccatctttctgggttctcagcccaggcatgctgcttactagctgggtgacgttgggtgaggtactcaatccctgcatatctagatggttcgtctctgcaatgatggatactattagtgcccacttggccatgttgttaggattaaatgagtaaatattttaagtgcctagaacagtgcctagctcattgtgtttgacataatatatatcataatatatatctctgctttgttccttccatgctagatagatgactttctagttcttcctaaatgctgccagacatgtaagctcctgcctcaggactttgtacttgctaatccttcttcctggaattctccttcctaaacatccaggcttcttcctcccattttcagatgttggttcaattattaccttattagtgtggccttctctgaccatccggtaaaaaagagtgcctagcgctccctatttatttttaccaactttatttttctttaaagccactatcatcattaactttatcatatatgcagtgcttgtgtatttaatgtcactaattcctcccactaaaatgcaaactatatcaaggcaggagtacttgtctattttcttgactgttctgtttctgccatctaagagtgcctcacaygtagcagattcttagcgtataaatggtgaagtatgcacatgtggatatgtgaatctggtgacaactgtcatgcagactttttggtggggaagtccagcagagaggtgatataacagatgaactggctgaagggagttttgagttctcttaaagaggatgggataggatcttcctcatgtgtaagaatattttgatcaatgatgtagttcttcaaagaacatatgtatcttccaaagacatacgcacgcaataccaaaacaaatattattgaaacataatatgagaaaataacatcaatattaacatagtatatatttatattaattctgtatggctttcattatttcatccttacatcaagcattggcttattcrgctttatttatattaatgatttacatttttattctttatgattttgaaaaaattcttggtaataaattgtaagcatctactattaatactagtcttttttttcctccagtgaagcataactttaacctggaagaatacagcctttctcagtgcacactggagaaggtaagtcaagtggtttgactttgtatcatctggtaaatttcacatgaaagcaacatrcattttcctgttcatttggaagaccaacaacttgataatctctcttccttctttccttcttctttgtctcctaattaggtattcttagagctttctaaagaacaggaagtaggaaattttgatgaagaaattgatacaacaatgagatggaaactcctccctcattcagatgaaccttaaaacctcaaacctagtaattttttgttgatctcctataaactyatgttttatgtaataattaatagtatgtttaattttaaagatcatttaaaattaacatcaggtatattttgtaaatttagttaacaaatacataaattttaaaattattcttcctctcaaacataggggtgatagcaaacctgtgataaaggcaatacaaaatattagtaaagtcacccaaagagtcaggcactgggtattgtggaaataaaactatataaacttagaattttttaaaaatatgacttttttaccttttacaaaacattctcttgctgaaatatgtgaagggtatattcagtagccaagagttgcatgactacttcacaccagttcatgatacaacaggtatacaggttttcttttataaccaactacaactcaagagtcttctgaaagtgttccagaaattgctttaaaactcaaaagtaaggggccaggtgcagtggctcacgcctgtaatcccagcactttgggaggcygaggcaggtggatcacaaggtcaggagttcgagactagcctggccaatatggtgaaactccatctctaataaaaatacaaaaattagccgggcgttggcatttgcctgtagtcctagctattcgggaggctgagggaggagaattgcttgaacccgggaggcagaggttgcagtgagccatgtgctagtgcactccagcctgggtgacagagtgagactctgtcaaaaaaaaaaaaaaaacaacaaaaacaaaaccaaaaaacctcacaagtattaggaggtccttggacacacaagtagacaagcactcatgttgaaaagtagttccattataccttttgaaaataaagggagtcacagtagtatttgttcagattttttaaattttgcatactcttaacaacattaacttattgttttcagggggtgctaattttccttgtcatctttgaatagttttatgggattttatattttttaaaatcatttctcccttatataagtgtatgtgcatgtaggtgtatctatatattttccacatatcttttatattatttaatttttaaaatacctgtcagtttaacatattactttattctttcccttaaaaatagctatttcattctgaatatcaccaaaaaaaaaaattcaaagaccaagcagtattccttctgtgattttttggtgttcacatattgtacataataaggggttcaattcaacaagaggagttaactatcctaaatatatatgcacccaacattggagcacccagattcttaaaacaatgatttctagatgtatgaaaagacttagagagccaaacaatggtagtaggaaacttcaacaacccattgacactgttaaattgaccactgaggtagaaaactaacaagaaattttggacttcaatttgacacttgaccaattggacctaacaggcatctagagaacacttcactgatcagcacagaatatacattcttctcatctgcacacagaacatactccaagattggccacatgctcagacataaagcaagtctcaatacattttaaaaagttgaaatcataccaaccatactctcagaccacagaagaataaaaatagcaataccaagaagatctccccaaatcatggaattacatggaaatttaaaaactttctcctgaatgacttttgggtatgatgaaattaaggcagaaattaaaaaaaattttttgaaataaatgaaaacagagatacaacataccaaaatctctggaatacagcaaaagcagtggtaagagggaagtttatagcactaaatacctacttcgaaaagttagaaagatgtaaaattaacactctaacataacacctggtggaactagaagaacaagaacaaaatcccaaaactagcagaagaaaagaaataactaaaatcagtgcagaactaacaaaattgaggcccaaaaatccacatgaagaataagtgaaaccaaaaattggttttttgaacagataaacaagatcgatagacaactagctagactaaaaaagaaaaaaaagagagaaaatccaaataagcacaatcagaaatgacaaaggcgacattacaactgatcccacagaaatacaaaagatcctctgagactattatgaacacctctatgcacacaaactagaaaatctagaagaaatggataaattcctggaaacacacaatctcccaagatccaaccaggaagaaattgaaaccctagcagaccaataccaagttccagaattgaaccagtaatgaaaaatctaccaaccaagaaaagacccagaccagatggattcacaactgaattctatcagacttacaaaaaagagctgagcaattttactgaaactattctaaaaattcacagatgagggactactccgtaactcattttatgaagccagcatcaccctaataccagaacctggcaaagacacaacaaagaaaactacagaacaatatccctggtgaatatagatacaaatatcctcagcaaaatgtaagcaaactgaatttaacagcacatcagaatttagtttaccatgatcaacttgccttaactcctgggatacaaggttggttcaacatacacaaatcaataaatgtgatttaccacataaagagaattaaaaataaaaccatatgagtatatcactagatgtgggaaaagcctatgattaaatccaacatcccttcatgataaaaaccctcaacaaaataggcattgaaggaacttacctaaaaataataggaaacatcaatgacaaacccatagccaacattatactgaatgggcaaaagatggaaccattccccttgaaaactgcaacaagacaaggatgctcactttcaccactcctattcaacatagtactgaatttcttgccagagcaatgatgcaagaaaaggaaatagaaagtatccaaatagatggccacacaaaaaataaattcctaggaatacatctaacttatctaaccaaggaggtgaaagatctctgtaagaagaattacaaaacactgctgaaagaaatcatagatgacacagaaaaatatgacatgcttatggattgaaataatatagttaaaatggccatactccccaaagcaatctacagatttgacactatttctaccaaactattaatgtcatttttcatggaattagaaaaaatattttaaaatttatattaaaaagcctgaatggccgaaacaaccataagcaaaaagaacaaagctggaggcatcacattacttgacttcaaactatactataaggctacagtaaccaaaacagcatgatacttgtacaaaaaaggcatatagaccaatggaacagaatagagaacacagaaataaagccacacaccaatagccatctgttctttgacaaacagacaaaataagcaatcgggaaaggactccgtatttaataaatggtcctaggatagttagctagcaatatgcagaataatcaaagtggacccccacctttcaccatatacaaaatttaactcaagatgaatcaaagatttaaacataagacttcaaactgtaagaatcctatgagaaaacctaggaaacaccattctggacatctgccttaggaaagaatttatgactaagtcctcagaagcaattgcaacaaaaccaaaaatggacaagcgggacctaagtaaactaaagaacttctgcacggcaaaagaaactatcaacagagtaaatagacaacctagagaacaggagaatatattcataacctattcatctgacaaaggtcaaatatcaagtatctataaggaacttatttcaacaagcaaaaaaccagtaatcccattaaaaagtggtcaaaaaacatgaacagacacttctcaaaggaagacatacaagcagtcaacaaacatgaaaaaatgctcaacattgctaatcatcagagaaatgcaaatcaaatccacaatgagataccttattataccagacagaattgttattattaagaaattaaaaaacagcagataccagcaaggctgtggagaaaagggaacactgccactgtggaaagcagtttggagatttctcaaagaacttaaaatagaactaccatttgacccagcaatcccattattgggtatataaccaaaggaaaatgcacacaaactagaaaacctagaggaaatggataaatttccaaaaaaacatgacctcatatgttaatcacagcagtattcacaatagtaaagacatggaatcaaccgagatgcccgtcagtggtggattggataaaggaaatgtagtacatatataccctggaatcaaaaggaatacccagccataaaaaggaacaaaatcatgtcctttgcaacaacatggacacagctagaagccattattctaatcgtagtaatgcaggaacaaaaccaaataccacatgttctcacttataagtgggagctaaatattaagtattcatggacataaagatggcaacaatagtcccccaggggactaacagacgagggagggaggcaaggagaaactaaccattgtttactatactcactatctgggtgactagatcatttgtatcccaaacacagcatcatgcaatatactcatgtaagaaaccttcacatgtatctcctgaatctaaaataaaagttgaaattataaaaataaaaatatttttatagtcaatgaagaaaatttgtataatagagaaaaatatagaaattaaataaaattgaataaaagaatcaccatgtcaaggagagaatggagcaagatggtagaatagttctcaccagtgattgtccttctataaaaacatctatttgaataactatccacaaaaaggtcttcacaagagctaagaaaaccaggtgataaatcacaatacctggttatagcataataagaaaagaggccaggcatgatggctcatacctgtaatcctaatgctttgggaggatgaggtgggaagatcacttgggaccacgagttcaagaccatcctgggcaacatagcaagaccctatcactacaaactacaaaaaaaaaagtaaaagttagccgggtggtatgtgcttgtggtccaagctacccaggaggctgaggtgggaggacagtttaagcccaggagtttaaggctgtctctgtctccttcagttttactctgatcttagttatttcttgtcttctgctagcttttgaatttgtttgctcttgcttctctagttcttttaattgtaatgttagggtgtcaattttagatctttgctgctttcttgtgtgggcatttagtgctataagtttccctctaaacactgctgtagctgtcccagagattctggtatgttgtttctttgttctcactggtttcaaagaacttatttatttctgccttaattttgttatgtacccagtagtcattcaggagcaggttgttcagtttccatgtagttgtgcagttttgagtgaatttcttaatcctgagttctaatttgattgcactgtcttctgagagactgtttgttatgatttccattcttttgcatttgctgaggagtgttttacttccaactatgtggtcgattttagagtaagtgctgtgtggtgctgagaaggatgtaatttctgttggatggagggtggagagttctgtagatgtctattagatctgcttggtccagagctgagttcacgtcctgaatatccttgttaattttctgtcttgttgatctgtctaatattgacaatgcagtgttaaagtctgccactattattgtgtgaaagtctaagtctctttgtaggtctctaagaacttgctttatgaatctgggtgctcctgtattggatgcatatatatttaggatagttatctcttcttgttgcattgatccctttaccattatgtaatgcccttctttgtctcttttgatctttgttggtttaaagtctgttttatcagagactaggattgcaacccctgctttatttgctttccatttgcttggtaaatattcctccatcccttcattttgagcagcctatgtgtgtctttgcatgtgagatgcatcctgaatacagcacactgataagtcttgactcttcatccaatttgccagtctgtgtctcttaattgggggcatttagcctgtttacatttaaggttaatattgttatgtgtgaatttgatcctgtcattatgatgctagc

SEQ ID NO: 12298 - DNA, 167676 bp, Homo sapiens
aagaaaacctgcagaatataattctgtccagtgcaacaaatattacggttgattttctttgtgcaaggctgtatttgtctgtttggattgctgtaaaggatacctgaggctgggtaatttataaagaaaaaaggtttaattggctcacagttttgcagcctttatacgaaacacagtgctagcatctgcttctggtgaggcctcaggaagcttacaatcatgacagaaggtgatggggagctggtgtgtcacatggcaagagcaggagcaagagagagacaggagagatggcacatactttctttttaattttaatttttatttctggggtacatgtggaagatgttcaggtttgttacataggtaaacatatgccctggtgccacatgcattttttttttcctgctcttacacttttctttctttttaaatgctttaagttctgggatatatgtgcagaacattgttacacaggtatacacgtgccatggtggtttgctacacccatcaacctgacatctacattaggtgtttctcctaagctatccctcccctagacccccccaccccccgacaggccctggtgtgcgatgttcccctccctgtgtccatgcgttctcattgttcaactccaacttatgtgtgagagcatgcggtgtttggttttgtgttcctgtgttagtttgctgagaattatggtttccagcttcatccatgtttctgcaaaggacatgaactcatccttttttatggctgcatagtattccatgttgtatatgtgccacattttctttatccagtctatcattgatgggcatttgagttggttccacatccttgctgttgcgaatagtgttgcaataaacacacgtgtgcatgcgtctttatagtagaataatttataagccctttggtatatacccagtaatgggattgctgtgtcaaatgatatttctggttctagatccttgaggaatcgccacactgtgttccacaatggttgaactaatttacactcctaccaacagtgtaaaagtgttcctatttctccacatcctctccagcatctgttctttcctgagttttaatgatcgccattctaactggcatgagatggtatctcattgtggatttgatttgcatttctctaatgaccagtgatgatgagctgtttttgatatgtttgctggtcatataaatgtcttcttttgtgaagtgtctgttcatatcctttgcgcactttttgatggggttgtttttttcttgtaaattggtttaagttccttttagattctggatattagccctttgtcagatggataggttgcaaaacttttctccaattctttaagttgcctgttccatctgatgatagtttcttttgctgtgcagaagctctttggtttaattagatcccatttgtcaattttggcttttggttgccattgcttttggtgttttagttatgaagtctttgcccatgcctatgtcctgaatggttattgcctaggttttcttctagggttttcatggttttaggtcttatgtttaaggctttaatccatcttgagttaatttttgtataaggtgtaaggaaggggtccagattcagttttctacaaatggctagccagttttcccaacaccatttattaaatagggaatcgtttccccatttcttgtttttgtcaggtttgtcaaaggtcagatggttgtagatgtgtggcataatttctgaggcctctgttctgttccattggtctatatatctgtttgggtacaagtaccatgctgttttggttactgtagtcttgtagtatagtttgaagtcaagtagcgtgatgcctccagctttgttctttttgcttaggattgtcttggctatactggctcttttttagttccatatgaactttaaagtagtttttttccaattctgtgaagaaattcaatggtagcttgatggggatagcattgaatgtataaattaccttggacagtatgaccattttcacgatattgattcttcctatccatgagcgtggaatgtttttccatttgtttgtgtcctcccttatttacttgagcagtggtttgtagttttccttgaagaggtccttcccatcccttgtaagttgtattcctaggtattttattctctttgtagcaattgtgaatgggagtttactcatgatttggctctgtttttctgttattggtgtataggaatgcctgtgatttttgcacattgatttttgtatcttgagacttttctgaagttgcttatcagcttaaggagattttgggctgagatgatggggttttctaaatatacaatcatgtcatctgcaaacagagacaatttgacttcctctcttcctatttgaatccctatattgctttctcttgcctgattaccttggccagaacttccaatactatgttgaataggagtggtgagagagggcatccttatcttgtgccagttttcaaagggaatgcttccagcttttgcccattcagtatgatattggctgtgtgtttgtcataaaatactcctattattttgagatatgttcaatcaatacctggtttattgagaggttttagcatgaagggctgttgaattttgttgaaggtcttttctgcatctatgaggataatcatgtgttttttgtcattggttctgtttatgtaatggattacgtttattgatttgcatatgttggactagccttgcattccagagatgaagccaacttcatcatggtggataagcttgttgatgtgttgctggatttggtttggcagtattttattgaggattttcaccattgatgttcatcagggatagtggtctgaacttttttgttgttgttgttgtgtctctgccaggttttggtatcaagatgatgctggcctcataaaatgagttatggaggagtctctgtttttctattgttgggaatagtttcagaaggaatggaaccagctcctttttgtacctctggtagaattaggctgtgaatccatctggtcctgggctttttttggttggtaggctattaattactgcctcaatttcagaacctgttattggtttagtcagggattcgacttcttcctggtttagccttgggagggtgtatgagtccgggaatttatccatttctccaagattttttagtttatttgcatagaggtgtttatagtattctctgatggtagtttgtatttctctcggatcagtggtgatctcccttttatcattttttattgtgtctatttgattcttctctcttttcttctgtattagtctggctagtggtctatctattttgttaatcttttcaaaaaaccagctcctggattcattgattttttgaaaatattttgtgtctctatcttcttcagttctgctctgatcttagttttttcttgtcttctgctagcttttgaatttgtttgctcttgcttctctagttcttttaattgtgatgttagggttttgattttagatctttcctgctttctcctgtgggcatttagtgctataaatttccctctaaacactgctttagccatgtcccagagattctggtacgttgtgtctttgttctcattggtttcaaagagcttatttatttctgccttaatttcattatttacccagtagttattcaggagcaagttgctcagtttccatgcagttgtgtggttatgagtgagtttcttaatcctgagttctaatttgattgctctgtggtctgagagactgttttacttccaattatgtggtcaattttagaataagtgcagtgtggtgatgagaagaatgtatattctgttgatttggggtggagaattctgtagatgtctagtaggtctgcttgatccagagctgagttcaggtcctcaatatccttgctacttttctgtctcattgatctatctaatattgacagtggggtgttaaagtcttccactgttattgtatgggagtctaagtctctttgtaggtctgtaagaacttgctttatgaatctgggtgctcctgtattgggtgcatatgtacttaggatgggtagcacttcttgttgcattgatctctttaccattatgtaatgcccttctttgtcttttttgatctttgttcatttaaagtctattttatcagagactaggattgcaacccctgctttttttttctttccatttgcttggtaaatattcctccctccctttattttgagcctatgtgtgtcttgcacgtgagatgggtctcctgagtgcagcacaccgatgggtcttgactgtttatccaatttgccagtctgtgtcttttaattggggcatttagcccatttacatttagggttaatattgttatgtgtgaatttgatcctgtcattatgatgctagctggttatattgcccactagttgatgcagtttctttatagtgtcaattgtccttacaactgggtatgtttttgcagtggctggtactcatttttcctttccatatttagtgcttccttcaggagctcttgtttaaggcaggcctggtggtgacaaaatctctcagcatttgctggtctgtaaaggattttatttctccttcacttatgaagcttagtttggctggatatgaaattctgggttgaaaattcttttctttaagaatgttgaatattggcccccactgtcttctggcttgtggggtttctgcagagatatctgcttttagtctgatgggttacctttgtgggtaaccagacctttctctctggttgcccttaacattttttccttcattttaaccttaatgaatctgatgattctgtgtcttggggttgcttttctcgaggagtgtctttgtggtgttctctgtttttcctgaatttgaatgttggcctgtcttgctagcctggagaagttctcctggataatatcctaaagagtgtttttggtacatacgtttaaacaaccagatctcctgagaaatcactcactattgggaggacagtgccaagccattcatgagggaaccatgcccatgatccaaacatctcccaccatgcttcaccttcaactctggggattatatttgaccatgatatatggaggggacaaacatacaaattatatcaaaggcatagcatggctactgtgaaaggagggtaaaaacacaaagatgacatcaccactgacctcagggagtgcccagtagactgagggagacaagtacatattttcctgaaggagggcactggattgatggcatgtttagaatgtggaagtagagcggccacagaaaggcagcccggcagagtgctcgcacaaagactgggctagagactccccactgcatgtgatgtatctgaggaaagtcattaaaataggtgatggtcactttccatcaagtccctggtatggtccatggaggcagggttgtcaatgtcatttcggcatttcagaggcctctcagggtttggatatggcagaagacaaccagcaatgattatgcattgcagagatgcaggtgagccccaatttcttgccagctgggaagtcggtgctaaggggccttgctgtctttccttggaacataggataccaatttctttctggacagagagtatttggttggctaaagttaaaatctaaattttgctttgggatgaattccaaaaatattagctttattcaaatttactttcactttatctttctgaatcttcaaggtcctaaagcattgcttagtaattttgtttctaaactcacgttacagcactgggcatgatctgtccaaggcagagactataagctactcttatagtactcttatgagatacatacaagtaggtatctcaaaaaatgatactcatgtattcctgttcttatgagtaaatcattggcagtgagtgtgattttttttttttttatgacaggataaatacacgccctctattggggtcaggttttgtgcctgtagttcttccgcctactgtatcatagcagcttagaatcccagctgctggctcgggctgcagttctctcatggctcgcacagggtggaccagccccattcccctatgtgtttstctgctgctgacctgtggctttgctgaggcagggaagctgctggtagtgcccatggatgggagtcactggttcaccatgcagtcggtggtggagaaacttatcctcagggggcatgaggtggttgtagtcatgccagaggtgagttggcaactgggaaaatcactgaattgcacagtgaagacttactcaacctcatacactctggaggatctggaccgggaattcatggatttcgccsatgctcaatggaaagcacaagtacgaagtwtrttttctctattwmtgagttcatccaatggtttttttracttatttttttcgcattgcaggagtttgtttaatgaccgaaaattagtagaatacttaaaggagagttcttttgatgcrgtgtttctkgatccttttgatrcctgtggcttaattgttgcyaaatatttctccctcccctctgtggtcttcrccaggggaatagsttgccactatcttgaagaaggtgcacagtgccctgctcctctttcctatgtccccagaattctcttagggttctcagatgccatgactttcaaggagagagtayggaaccacatcrtgcacttggaggamcatttattttgccagtatttttccaaaaatgccctagaaatagcctctgaaattctccaaacmcctgtcacrgcatatgatctctacagccacacatcaatttggttgttgcgaacagactttgttttggactatcccaaacccgtgatgcccaatatgatcttcattggtggtatcaactgccatcagggaaagccattgcctatggtaagtcacctctcctttagcacattaggaataatctggctttggaaattaaaaaaagattccttactgaattgtgatttgacattttcatttgttgcatttcaaatttctttccagtttaacagattattttgtgccaatttatgtactcatcagttatcaaattttataaaactgcccttcttgaaggtgtgtgtatataatttaaaaattgtagatcgtattcagcttacatttttgagtaccatgtttagaaaagtaccaaaaaccacagtaagaaattgaactttccttttttgctaattctatgtgaccccctagagcaaatgctcttagcagttttgcatacattcttttcattaaaaaaagtattttaggtgtatatatttaatttaaaaattatagatcatatttagcccacgtttttgagtaccgtgtttagaaaagtaccaaaaaccacagcaagaaatgaaactcccctttttcctaagttttctgacccctagaggaaatgctcttatcagttttgtgtatattcttttcagtataaaaaaagtttcatttatatgcaatatctaatgtaaattctcatacctattttgttaaaataaacttttatgctgtgctggacatattcttctttaccttgcattttttatttgccaataaattgtagattcctttatacaccaatacagacagatttgacaagttcttttcataattgcataaaagtctttactttggatgctatgtagttttttaaaccaattaatattgatatatgtttaggcattttccatttttgcttttatgaataaggctgtgtaaacattctttaataatttccttgtgtgaatatatttctatattcttgcttttatcttagtagactagagtcctacatgtagggttagagggttttcctgaattgagaagattggcatctttttgctattatatcttcctgttcaggaatatgtgtgtctcactatttattcaggtcttgttttatatacataaataaaaattttcactatataagcatttatgtttgttattaacatttattccttggcattttatgatttttgaaactatttttttacagggtaatttttccatttctacaattaactgactattggtaattaaagttttggtttttgcgtatgtatcttgtatccagccacattactaacttttcttattattttgtagtatgcattagatgtacaatatgcaataccatctgcaagtaattcccttctctgatatttatactgcttcttttgctttgctggagcatatacttccaaaacattattgagtaatattgttagagtagccagtttaaatagggatttggtagcttgtgactgaaaaatccttgaaaaataccagaataagattcttggcaaacgcatagttgctaaatccagatgaaacacctggtgtctcatctcattatattattttattagggatggagtatacatttttgtctattgttctggcttcttataaggttcagtagactttgtaacagtcatatctgtcattggcagatggttggtgaaagagtgaccgttcagccatctcacaggaaagtgaaataatgctctttctaaaaagcaggaagactacagttgtaggcctttcaaaattaggcatgactttcagctcacggcaagatcaggtgaagagatgcaagttgcaggactctaagaggttggacgtatcaaagcacttttctcctcattatcctccattaattacagtaccaagcaccacccatgtgttgcctgcaccctacaccctttggccgagtgtgaggctctgccacttcctgaacccacactgagtttattgtggcccaaggggtcacccagaggcctttagagatataaaaamgtatatatgattttatatcacctacgatagggagatatccataaaaaaaggaaacattaaactctacatggtttcagttattttgattataaatcttttatgagatatgaaataaatgtgtttctatatctattaaagaatatatatgtatgaaagtttttatacttgcagaaggttatgtgtattaatgtatatatttatgattatatgcataaagccagcagaattctcacagaggaattcagatctgaaagagggctttctgtcaaagagccttggatatggcccaaccacaaaagtaaaagtcaactgtcatcgaaagaaggatggacactgcgtattgctccttccttgtttcagatgccaggatatgtctgggaaaagcatgcagttggttacatcttgctgggaaacaagattcagagtgtgagtctcatctgcctgatgagaaggaagcattacttagtgatagagtatgtgtttgcacatgtatgtgtttgtgtatgtgcaggtgtgtttgygtgcagtgtcccagaccctgcacaggggatttcttgaagatctcctgtaacaaaatctccttgagtctatccaggagaattacatccagggatgtaattaaatactttaacaaagatggcagatggccccatctccaacgtcagggatcaaatttcaacgtgagatttggaggggataaacttttaaactttatcttttggtatggtcattgttttacatttcagtattccaatgtgtgtgtgttgattaaagatgtgtaaataattcagcagaacagcgaaatagttttaatgagaaaaagaggaagtcactcctagtctctttgaatttttggtgagttccaacagaattgatgactggttttaggtgaaaagaattcgggcttcgtctataccatccatggtaggttcagctctgcagacctggggatggaatatggttacagagcaagaaaagatctgtgcttcccccattcctctaagtttctggctccagtttaagatccaaattcaaagktagcttttggtggacaagactaaggcctcccactaaaattgtttacttcaagtatttattttcaaagttttccaacctatacaaaggagagacttagtgtcatgaccacccatatatcaatcttaggttaaataattttcactattttgctgaactgattcatctatcccttttttctgtctttttaaagaaaacttttaaagagaaatttgtgtcaatctttttttaaattatactttaagttctagggtacatgtgcacaacgtaaaggtttgttacataggtacacatgtgtcatgttggtttgctgcacccatcaactgatcatttacattaggtatttctcctaatgctatcccttcctcagccccccaccccatgacaggccccagtgtgcgatgttcccctccctgtatccatgagttctcattgttcaactcctacttacgagtgagaatatgcactgtttgattttctgtccttgtgatagtttgctgagaacgatagtttccaacttcatctatgtccctgcaaaggacatgaactcatccttttttatggctgcatagtattccatggtgtatatgtgccacattttcttaatccagtctatcattgatgaacatttcggttggttccaagtctttgctgttgtgaatagtgctgcaataaacatacgtgtgcatgtgtctttatagtaccatgatttataattctttgggtatatacccagtaatgggatcactgggtcaaatggtatttctagttctagatccttgaggaattgccacactgtcttccacaatggttgaactaatttacactcccaccaacagggtaaaagcgttcctatttctccacatcctctccagcatctgttctttcctgagtttttaatgatcgccattctaattggcatgagatgatatctcattgtggttttgatttgcatttctgtgatgaccagtgatgatgagcattttttcatatgtctgttggctgcataaatgtcttcttttgagaagtgcctgttcatatcctttgcccacttttgatggggttgttttattcttgtaaatttttttgagttctttgtagattctggatatgagccctttgtcaggtggatagattgcaaaaatgttctcccatttcataggttgccttttcactctgatgatagtttcttttgctgtgcagaagctctttggtttaattagatcccatttgtcaattttggcttttgttgccattgcttttggtgttttagtcatgaagtctttgcccatgcctatgtcctgaatggtattgcctaggttttcttctagggtttttatggttttaggtcttacatttaaatctttaatccatcttgagttaatttttctataaggtgtaagaagggatccagtttcagctttctacatatggctagccagttttcccagcaccatttattaaatarggaatattttccccatttcttgtttttgtcaggtttgtcaaagatcagaaggttgtagatatgtggtgttattcctgagacctctgttctgttccattggtctatatatctgtctgggtaccaatacgatgctgttttggttactgtagccttgtgatttagtttgaagtcaggtagcatgatgcctccagctttgttctttttgcttaggattgtcttggctatatgggctcttttttagttccatatgaaatttaaagtagttttttccaattctgtgaagaaagtcaatggtggcttgatggggatagcattgaatctataaattaccttgggcagtatggccatttttgtgatattgattcttcctatccatgagcatggaatgttcttccatttctttgtgtcctcttttattttgttgaacagtggtttgtagttctccttgaagaggtcttcgcatcctttgtaagttggattcctaggtgttttattctctttgtagtaattgtgaatgccatctagtcattttaaaaagaaattcttggcatgtcattccatcaccgaatacttaattaaatataaaaaataagaaacatttgttacatagccacaatatcattatcatatctatgacagtaaaaattttttaatattatctcatttccagttcataattaaatttcccccattttcttgaacaacatctttccatgtagatcaatggaatagaatggagaattcagaaataaacccatwcgttctkggccaattgacargatgtcaaattttgataagggtgtcaagawcattcaaatgggaaagaatagtctcttcaacagaagacccaccctggggtccttaatctccagcatcagactccaagaccatttgcagagatcatccagacagctcccatcatgcctctgatgaatccttcaccatgtgcatccacaggggtcctgcaaatattttctcacagtccgttgagtgacttttcttacaaatactttattttagaataaatagaggtttatagcaaggttgcaacaaatagttcagagaattcttatctaccctgtacccggtttcccccattgttaaatgttatgtttctatggcacatccatcacaactcattcaccaatatgacacattatgatgagctaaagtctgtttccttcagatttcattgatttttacttaatatccctgttcttttatgggatcccattgataccacctgaaatgtagtcatcatgtctccttagtctcctccagcctgtgacagtttctcagactttccttgtttttggtgacttgggcagttttgagcagtcctggtcaggtgtcctgtagaatgttcctctagaatgtcagtgtgtgtttgcctgacatttttatcatggttaaactggggttataggtttttagtaggaagatgcggaggtcttttcttgttttcttgcatgtgaatattcaactgtagaaaagagtggcctttcctccaatgcacttcttgtacctttgtaaaaacttggctgttcatacatctgtgcatgtatttctagactttgtattctgctccattgaaatatttgtgaaatatttgattactatagctgtgtaataatcttgaaatgaggtagtgttacctatttttttcaaattgtttttgctattgtaggtctgctacattaccacatggattttagaataagtttgttagtttgattttgattgggattgtattgaatttatagatcaactggggagaaacaacatcttagcaattttgaattttccaattcattaacatatctatgttaagtgcctcatcagtgttctgtagttttcagtgtacagtctttcataatttttgtcagatatattcctaagtatttcatgtttttgatgctatttaagtgatatttttattccaatttttaattgttcattgctagtatagttgacccctgaacaatgtgggaatgaaggggaccaacccgtgtgaagtagaaaatccacacagatcttttgattctcgaaaaacataactactaacaaccatttaccaaaagccttaccaatagtataaacagtcaattaacacatattttggatgttattagtattatatcctgtattattacaataaagcaaactagagaaaggaaaatgttatttaaaaacataacatatgaaaaaatgcccaacatcactaatcatcagagaaatgaaagtcaaaaccacaatgagatatcatctcacaccagttagaatggctgttattaaaaagtcaagaaacaatagatgcttgtgaagctgctgagaaaaaggaccacttgtacactgttggtggtgggaacgcaaattagatcatcccctgtgggaagtagtttggagatttgacaaagaagttaaaacagaactgtcattcgacccagcaatctcattacattactggatatatatattaaaaaaatcattttaccaagaaacacatgcactggtatgttcattgcagctctattcagaatagaaaaggcatgaaatcaacctaggtgcctgtcaatagtggattggatgaagaaaatgtggtacatatacaccatggaatatgcagtcataaaaaaagaatgaaatcatgtcctttgtaacaacatggatgcagctggaggtcattatcctaagggaatatatacaggcacagaacaccaaataccatgtgttctcacttagaagtgggagctaaatagtgggtactcatgggcataaagatggcaacaatagacactatggactactaaaggggagaggaagggatgcaggagttgaaaaactattgggtaatatgctcagtacttgggtgatgggagcaatcatgccccaaacatcagcatcacacaatatactcaggtaacctgcacatgtactcctgaatctaaaataaaagttgagtatgtataagaggaagtcattcatcataaaggtctccatcctcatcatcttccattgagtgrgctgtggaggaggaggagtagatgttggtcttactgtcttagggtggcagaagcagaagaggtagaggaggtggaagtggaggcaggagaggcaggtgcacttggtgtaaatttatggaaatacatcataattactgtctgtttttttctctttgatgtatttaaaaatgcttttatacagtactaatccttcttccccatttgctttagtttcagtgccyataagggttcatgttgtaatagaagtcaatagcagtcttaaataactggaagcctttccatgaggcttgtattgtgtaaggccattttttttttctggcactgcttcttctacatcttctttctcatcaagtagtgawtggaaagcactaatctctatcaggtcatctattaattcctcgagtgtggtgtctattgactcttgaatttctccaagattcatattttgaaacactttatcccccaccttatgttgctgtatccataatccctttcatgacttccttgattggctctgtcttaaatcctgtgaagtcattcgcaacatctggtcacagttttctccagaagaaatgaattgtttggggcttggtggctttcacagctctgtctataacaacaatggcatcttcaatggtgtaatccttctggactttcatgacattctctatccagattctctttcctagtattgacaatcttttccatagaaaactgtgtgtaatgagttctaaagttccttatgacccctgattgagagactgaattagagatgttgggtttggaagcaggtagaccactttgacaccttcagtgttgaactcatggattctgggtggctagcattgtccaatatcaaaagaattttaaaagacagtcccttactggcaatgcattttctgccttcagggacaaagcgttgatggaaccaatccagaaaaagtgttcttgttgtctaggccttcttgttgtacaaccaaaaaactgtcagtgggtgttgatcttgtcccctcaaggcttaaggtttggcagttctacacatgaggtcagtcctgagtgtaaacttgactgcatttacacaaaacagtagagttagcctatcccttcctgccttgcattctggtgcttggtttacttccttgctaataaatgtcttttgtgtcatcttgtttttgtttttgtttttttccagaatagggcaytgtcatctgtattaaaaccctgttcaggcagatatgctttcccctcaataattatcttcatggcatctgggaactcatttgtctccttttgcttggcagaggctgcttctcctgttatcttgacaattttaaagctgaacccctttctaaaactagcaaaccatcctttgctgccattaaattttccagttttagattcttcacctctcttttgctttaagttgtcatataatgactttgcattttctcaaatcacattggcatctataaatacgcctttcttatagcaatgctacacccaygttaaagctgcattttcaatatgagacaaaaacgtatttcagaaaaaaatgcaaggtttggctcctgctggcatagctgcagcaatgtcttcatgaatctcccttccttccttcctttcttccttccttccttccttccttccttccttccttccttccttccttccttccttccttctttctttctttcttttccactggtccttatctagcttcatttattttgaaatggcaggcattcaccacggtagagctcagcctatggtcccaatcaagcaattcgacttttttggttatgtcatgatttctttttgcttcttgggagtaattccagcatcattaggggcactctgtagtcccatgactgtattcaagatttacaatattgcaccaaacatgatgaaaaatacagtagagccatgagagatcactttttactctgacatgcaatttattggagagatgaaatgctcaaacagagagtataartgttatatcacatgcacttaagccacacttcagctcactggaatagcaacaggaggtagctacaaaattattacagtagtgtagtatatactataggtaattttatgcagttaagatttaatgctgcctctatatgtttgtatttctttcctgtgctaatgatgcaatgtacactttggaaatgtttgtgtgtggtttaataaattttttattgatttgtgcatattttaaagtaataaataataacatggtatctgcacatggtttctgcagtcatggcatagctttaaaaatttttagatatttctagtttatgtggtttatatatatattttttcaaactgttagaaatttcttaaaatttttgcaatatatttatttttaaaaatctgcatataagtggatccacacagctcaaaaccctactgttcaatgtcaactgtatatagaaagaagattagtttttaagtattgtatcttgcaaccatgctaaacttacgtatttgttctaggagatttttgtagtttgttattattcctacatagataaacttattgtctgtgaatgagaccttttttattttttctttacaatctggacactttttacttctatttcctccctgactgcactggctggaacctgaagaacaatgttgagtagaagtggggagggcccctgtcctcggcatgtgtttgccttgaggagtggagcattcagtctttcaccatcaaggatgatattaactgtgggtgcctccaagatgtccttcattagtttaagatacttccctttattttccgagtttkttgagaattttttatcacaaatcgattttggatttttgtcaaacactttttccatacctattgagataattatatgcttatacttttttagtttatttatatggtatgttactttaattgatttataaaattatttatttaatcattaattgtggtgaaaacacatagcataaaatatatcatcttcatcactttaggtgcacagttcagtattgagtacgttcacattgctgtgcaaccaacaccaccattcatctctagaactcgcttcatcttcccaaactgaaactttggacccattaaaaaagaatactccattcccccctcctctcagcccttgccaaccagcattccactcttttattctacgtatctgactattttagatacttcatataagtagaatcatacagcatttgtcattttgtgattagcttagttcactctgcacaatgcccttaagtttcattcatgttagcatatgtcagaattttcttcctttctaagggtgaataatatttcatgctgtatacatacaccacatttttgcttgggttgtttccacttcttgtctgttgtgagttatgctgctatgaacatggtggcacaaccttgattaattttctaatgtcaaaccagccttgcattcctaggataaaccccacttggttatggtgtctaatctttttgtgtagtacctattttaaaatattacagactttgacttgccaatattttgtttaaaatttttgcatctaagctcatgagggtctgtaattttcctatcttttaatgtctttttctggttttggtactgtgataatgctggtctcataaaatgaattaggaaatcccctaggcttcagtttttgggactagtttgtgaataattggtattatttattcttcaatgtttgctggattcatcagtgttgtcatctgagcttcactttgttttgtgtgggaaggtttgaattacaaatacaaattcaatttaaaagatacaggttacttctattggggttatgcatttattcttgtgacaagtctggcagtttgtgtctttaacaaaatgtgtccattctatctaagttgtagacttttttttggcataaacttgttcatgttattctcttaacattttaacatctgtagaatctatggtgataccacctctctcattcctaatattgataatttctttcttctctctttttttttcagatcaaggtggctagagctttaccaaattaattgatctcaacaaaycagctttggtttcattaattttctcaacaaaccagctttggtttcattaattttgcctgttttttaaatgcattttccatttcattgatttctgttctgaagtaagcctccaggggaggtagatcactgaccatcatgtttatttttcaaggacagtcatctgcaagtgccccagtcaccaaaagaaaaggtgactaagcaaatgtctagtaccagttagggtgtcccgaaaggagccatcttgtgctcctacaaggattataccccgaggttgtctgcagaatctctcactaaatgttccttaaggtgttgcctgacacacactgcttagctcrtccatgaaggtatcaagaaaacctgcagaatataattctgtccagtgcaacaaatattcyggttgattttctttgtgcagggctgcatttgtctgtttggattgctgtaaaggatacctgaggctgggtaatttataaagaaaagaggtttaattggctcacagtttggcagactttatatgaaacatggtgctagcatctgcttctggtgaggcctcaggaagcttacaatcatgacagaaggtgatggagagctggcatgtcacatggcaagagcaggagcaagagagagacaggggagatggcacatacttttttattttaatttttatttttatttctggggtacatgtggaagatgttcaggtttgttacataggtaaacatatgccatggtagcacatacttttttttttttcctgctctaaaactctttttttttttttatactttaagttctaggatacatgtgcagaacatgcaggtttgttacataggtatacacgtgccatggtggtttgctgcacccatcattccttcatctacattaggtatttctcctaatgctttccctcccctaggccctcaccccccgacaggccctggtgtgtgatgttcccctccctgtgtccatgtgttctcattgtccaactcctacttgcaactccaactccaacatgcagtgttttgttctctgttcttgtgttagtttgctaagaatgatagtttccagcttcatccatgtccctgcaaaagacatgaatgcatcctttttaatggctgcatagtattccatggtgtatatgtgccacattttctttatccaggctatcattgatgggcatttgagttggttccaagtctttgctattgtgaatagtgctgcaataaaatacatgtgcatgtgctttataatagaatgatttataatcctttgggtatatacctagtaatgggattgctgggtcaaatggtatttctggttctagatccttgatgaatcgccacactgtcttccacaatggttgaactaatttacactcccaccaacagcataaaagcgttcctatttctccacatcctctccagcatacgttctttcctgagttttaatgattgccattctaactggcatgagatggtatctcattgtggttttgatttgcatttctctaatgaccagtgatgatcggctttttttgatatgcttgttggttgtataaatgtcttcttttgtgaagtgtctgttcatatccttcgaccgctttttgatggggtttttttttcttgtaaattggtttaagttccttgtagattcaggatattagccctttgtcagatggatagattgcaaaatttttctcccattctgtaagttgcctgttcagtctgatgatagtttcttttgctgtgcagaagctgtttagtttaattagatcccatttctcaattttggcttttggttgtcattgcttttggtgttttagttatgaagtctttgcccatgcctatktcctgaatggtattgcctaggtttttttctagagttttcatggttttaggtcttatgtttaagtctttaatccatcttgagttaatttttgtataaggtgtaaggaaggggtccagattcagttttctacatatggctagccagttttcccaacaccatttattacataggaaatccttgccccatttcttgtttttgtcaggtttgtcaaaggtcagatggttgtagatgtgtggcataatttctgaggcctctgttcagttccattggtctatatatctgtttgggtacaagtaccatgctgtttttgttactgtagccttgtagtataatttgaagtcaggtagcatgatgcctccagctttgttctttttgcttaggattgtcttggatatacaggctattttttagctccgtatgaactttaaagtagttttttcctattctgtgaagaaagtcaatggtagcttgatgtggatagcattcaatctataaattaccttcagcagtacggccattttcacaatattgattcttcctatccatgagcatggaatgattttccatttgtttgtgtcctctcttatttacttgagcagtggtttgtagttctccttgaagaggtctttcccatcccttgtaagttgtattcctaggtattttattctttttgtagcaattgtgaatgggagtttacaatttggctctctgtttttccattattggtgtataggaatgcttgtgatttttgcatattgattttgtaacctgagacttttctgaagttgcttatcagcttaaggagtttttggactgagatgatggggttttctaaatatacaatcatgtcatctgcaaacagagacaatttgactttctctcttcctatttgaataccctgtatttctttctcttgcttgattgccctggccagaacttccaatactatgttgaataggagtggtgagagagggcatccttatcttgtgccagttttcaaagggaatgcttccagcttttgcccattcagtatgatattggctgtcggtttgtcataaataacttttattattttgagatacgttccatcaataactagttcatcaagaatttttggcatgaagtgctgttgaattttattgatgtaatcatgtggtttttgtcattggttctgtttatgtgatggattatgtttattgatttgtgtatgttggaccagccttgcatcccagggatgaagccgacttgatcatggtggataagctttttgatgtactactggactcagtttgccagtactttattgaggatatttgccatcgatgttcatcagagatattggcctgaaatttttttggttgttgtgtctctgccacatcctggtatcaggatgatgctggcctcataaaatgagttatggaggagtccctctttttctattgtttggaatagtttcagaaggaatgataccaggccctctttgtacctctggtagagttcggctgtgaactcatctggtcctgggtgtttttggtgggtaggctattaattactgcctcaatttcaaaacctgttattggtctattcaggaattctgcttcttcctggtttagtcttgggaggatatacgtgtccaggaatttatccatttctcctagaatgtctagtttatttgtgtagaggtgttgatagtattctctgatggtagtttgtatttctgtgggctcagtggttatctcccctttatcattttttattgtgtctattgattcttctctcttttcttctttattagtctggctagtggtctatctattttgttaatcttttcaaaaaaccagctcctggattcattgattttttgaagggttttttgtgtctctatctccttcagttctgctctgatcttagttttttcttgtcttctgctagcttttgaatttgtttgctcttgcttctctagttcttttaattgtgatgttatggttttgattttagatctttcctgctttctcctgtgggcatttagtgctataaatttccctctgaacatagatttagctgtgtcccagagattctggtaggttgtgtctttgttctcattggtttcaaagaacttatttatttctgccttaatttcattatttacccagtagtaatgcatgagcaggttgttcagtttccatgtagttgtgcagttttgagtgagtttcttaatcccgagttctaatttgattgcactgtgatctaagagactgtttgttatgatttctgttcttttgcattttctgaggagtgttttgcttccaattatgtggtcaattttagaataagtgcaatgtggtgctgagaagaatatatattctgttgatttgggttggagagttctatacatgtgtattaggtttgcttggtccagaactgagttcaagtcctgaatttccttgtgaattttctgtctcgttgatctgtctaatattgacaatggagtgttaaagtctcccastattattgtatgggagcctaagtctctttgtaggtctctaagaacttgctttatgggtgctcctgtattgggcgcatatatatttaggatggttagctcttcttgttacattgatccctttaccattatataatgcccttctttgtcttttttgatctctgttgatttaaagtctgtttttatcagagactagattgcaacccctgattttttttgctttccatatgcttggtaaatattcctctatccctttattttgagcctatatgtctttacacgtgaaatgggtcttctgaatgcagcacactgatgggtcttgactgtttatccaatttgccagtctgtgtcttttaattggggcatttagcccatttacatttaagattaatattgttatgtgtgaacttgatcctgtcattatgatgctagctgtttattttgcctactagttgatgcagtttctttatagtgtcaattgtcctgacaattgggtatgtttgtgcagtggctggtaccggttttttctttccatatttagtgcttccttcaggagctcttgtaaggcaggcctggtggtgacaaaatctctcagcatttgcttgtctgtaaaggattttatttctctttcacttatgaagcttagtttggctggatatgaaattctggattgaaaattctttcctttaggaatgttgagttttggtccccactgtcttctggtttgttgggtctctaaagagaggtctgctgttagtctgatgaacttcttttcgtgtgtaacaggacctttctctctggctgcccttaacatttttccttcatttcaacsttggtgaatctgatgattatgtgtcttggagttgcttttctcgaggagtatctttatggtgttctctgtgtttcctgaatttgaatgttggcctgtcttgctaggctggggaagttctcctgaataatatcctgaagagggtttttggcattttttaaaaaattatactttaagagatctgggatacatgtactgtcgtatacttttaaacaatcaaatctcatgagaaatcactcacaattgggagggcagtgccaagccattcatgagggatccatgcccatgacccaaacacctcccaccatgcttcatctccaacactggggattatatttgaccatgatatatggaggggacaaacatacaaactacgtcaaaggcaaagcatggctactgtgaaagaagggtaaaaacacagagatggcatcacctctgacttccaggagtcctcagcagactgagggagacaagtacatattttcctgaaagaggtcactggagtgatggtgtgtttagaatatagaagtagagcagtcacagagaggcagcccagcagagtgttcgcacaaggactgggccagcaactccccactgcatgcaacgtatctgaggaaagtcattaaaataggtgatggtcactttccatcaagtccctggtatggtccatggaggcagggttgtcaatctcattttggcatttcagaggcctctcagggtttggatatggaagaagacaaccagcaatgattatgcattgcagagatgcaggtgagccccagtttcttgccagttgggaggtcagtgctaagagccttgctgtctttccctggaacatgagatgccaatttctttctggacagagagtatttggttggctaaagtcaaaatctaaattttgctttgggataaattccaaaaatattagcattattcaaatttactttcactttatctttccgaatcttcaaggtccaaaagcattgctgaataattctgtttctaaactcacttgcagcgtgctctccctccaaggcgaagaccataatctactcttgtctggaaatcatacaagtaggtatctcagcaaatgatactcgtgtgttatcgttcttatgagtaaatcattggcagtgagtgtgattttttttttttttatgaaaggataaatacacgccctctattggggtcaggttttgtgcctgtacttcttccgcctactgtatcatagcagcttagaatcccagctgctggctcgggctgcagttctctcatggctcgcgcagggtggaccagccccgttcctttatgtgtgtgtctactgctgacctgtggctttgccgaggcagggaagctgctggtagtgcccatggatgggagtcactggttcaccatgcartcggtggtggagaaacttatcctcagggggcatgaggtggttgtagtcatgccagaggtgagttggcaactggaaagatcactgaattgcacagtgaagacttactcaacctcgtacactctggaagatcagaaccgggaattcatggttttcgcccatgctcaatggaaagcacaggcacaaagtatattttctctattaatgagttcatccagtggttttcttgacttatttttttcgcattgcaggagtttgtttaatgaccgaaaattagtagaatacttaaaggagagttcttttgatgcagtgtttctggatccttttgatacctgtggcttaattgttgctaaatatttctccctcccctctgtggtcttcaccaggggaatattttgccaccatcttgaagaaggtgcacagtgccctgctcctctttcctatgtccccaatgatctcttagggttctcagaygccatgactttcaaggagagagtatggaaccacatcgtgcacttggaggaccatttattttgccagtatctttttagaaatgccctagaaatagcytctgaaattctccaaacccctgtcacggcatatgatmtctacagtcacacatcaatttggttgttgygaacggactttgttttggactatcccaaacccgtgatgcccaacatgatcttcattggtggtatcaactgtcatcagggaaagccattgcctatggtaagtcacctctcctttagcacattaagaataatctggctttggaaattaaaaaaggattccttactgaactgtgatttgacattttcgtttgttgcatttcaaatttctttccagtttaacaaattattttstgcgaattcatgtactcatcaattatcaaattttataaaactgcccttcttgaaagtatatgtaataatttraaaattatagatcatattcaggctacattttaaaatacgatgtttagaaaagtaccaaaaaccacagcaagaaatgaaacttccgttttttgttaattctatgtgaccccgtagttgaaatgctcttaagttttgtgtacattcttttcattgaaaaaaagtattttaggcatatgcaatatctcatgtaagttcccatacctatttagtaaaaataaaatctagtattgggctgaacatattcttctttatcttgcatttttcacttgccaataaattatgggtacctttatagagcaatacagacagatttgacaagttcttttaataattgcataaaattctttactttggatacaatgtagttttttaaccaattaatattgatatatatatagccattttccactctttccttttgtgaataaggctgtgtaaacactcttcaatactttccttgcgtgaatatatttctatattcttgcttttatcttagtagactagagtcctacacgtagggttacagggttttcctgaattgagaagactggcatctttttgctattaagtcttcctgttcaggaacatatatgtctcactatttattcagatcttgttttatatacataaataaaaattttcactatataagcattttatgtttgtttttaacatttattccttggcattttattactttagaaactattttgtacagggcaatgtttccatttctacatttaactgattactggtaattaaaattttggtttttgcatatgtatcttgtatccagccacatcactaacttttcttattattttgtagtatgcattagatgtacaatatacaataccatctgcaagtaattcccttgtctgatatttgtactgcttcttttgctttgctggagcatatacttccaaaatattattgagtaatattgttagagtagccagtttaaatagggattcggttgcttgtgactgaaaaatccttgaaaaataccagaataagattcttggcaaacgcatagttgctaaatccagatgaaacacctggtgtctcatctcattatattattttattaggggtggagtacacatttttatgtattgttctggtttcttacaagattcagtagactttgtaacacagttatatctgtcattggcagatggttggtgaaagagtgaccgttcagccatctcataggaaagtgaaataatgctctttctaaaaagcaggaagactacagttgtaggcctttcaaaattaggcatgactttcagctcatggcaagaccaggcgaggagatgcaagttgcaggactctaagaggttggacttatcaaagcacttttctcctcgttatcctccattaattacagtaccaagcaccacccatgtgttgcctacaccccacagccttyggccgagttgaggatctgccacttcctgaacccacgctgagtttattgtggctcacagggtcacctagaggcctttaaagatataaaaacctatatatgattttatatcacctgtgatagagggatatctataaaaaatgaaacattaaactatatatggtttcatttattttgattgtaaatatcttttatgagatatgaaataaatgtgtttctatatctattaaagaatatacacatgtatgaaagtttttatagtttgcagagggttatgtatattaatgtatatttttatgattatacctgtaaaggcagcagaattctcacagaggaattcgatctcaaagagggctttctgtcaaagagccttggatatggcccaaccacaaaagtaaaagtaaattgtcatcaaaagaacgatgaacactgcatattgctctttccttgtttcagatgccaggatgtgtctgggaaaagcatgcagttggttacatcttgctgggaaacaggattcagagtctgagtctcatctgtctgatgagaaggaarcattacttgatgatagagtatgtgtttgcacatgtatgtgtttgtgtatgtgcaggtgtgtttgcgtgcagtgtcccagaccctgcacaggggatttcttgaagatctcctgtaacaaaatctycttgagtctatccaggagaattacagccagggatgtaattaaatactttaacaatgatggcagatggccccatctccaatttcaacatgggatttggaggggacaaacttttaaactatatcaattggtatggtcattcttttacatttcagtattctaatgtgtgtgtgttgattagtgatgtgtaaataattcagcagaacattgaaatagttttaatgagaaaaagaggaagtcactcytagtctctttgaatttttggtgagttccaacagaattgatgactggttttaggggaaaagaattcaggcttcatctataccatccatggtaggtgcagctctgcagacctggggataggatgtggttacagagcaagaaaagatctgtgctttccccattgctctaagattctggctatagtccaagatccaaattcaaagttaacttttggttgacaagactaaggcctcccactaraattgtttacttcaagtatttattttcaaagttttcaaacatacaaaatgaaaagactatagtgtaatgtgcamctgtatatcaatccttaggctaaataattttcagtgttttgctgtattaattcatctatccccttattctgaccttttaaagaaactttttggctgtcatttttttagtggaaattcttggcttgtcattccatcattgaatattttattaaatataaaaaataagtaaaatttgttacacggccacaatatcgttatcacacctaacacaataataatactttaatattatctcatttctagcccataattaatttacctccaattgcctcatacaacatctttttatgttgatctatggaacagagaattcagaaataaacccatacatccttggtcaattgagtaagttccaaattttatgagggtgtcaagaccattcaaatgggagagaacagtctcttttttaggctgcaaatgctgttcttccatagtccaacagtgaccctccccaatttaggggccaacccagggatctaggtccatgtaacctcctgataggccaacaatcttaggtagggccaactctatacccttggtcagtaggaagcagttggaagatgagaccttcactcacatgccaaagatttgtcattgttgctatgtcaggggggaaatgtggagccctaattagggaaaaagagctaggctggcaggaccaggggaaagcaaaaaagaaaaagcagatgaactataagtctccctttcttcatggtctaggacacatagccctcctgcaaaaataacataatcttcctgcacccagcgatcaccagaccctcagctgatagaaaaatgcaagttatctcactgcaaccttggcattatcaatactgcatctagctctctgcagcacaagcaccatcctataaaatcctcagcaagcctttgtctccttgcagccagctcttctcttgctgactatcttgcaacatattttcctactttctctaataaatctgcctttctttacctacaagtatcttggtaaattctttttacctcccatgccacaccagtctcagagagttgccacccatgacagttaccataaggcttgcaaatactatcttataaaccttattttaacctgataacaacttaacactatttgcataaacaaacacacagcaagaagaaaactaatagaaactagtcttaactttgctccctactttttaactctttgtgattttcatttatatcttgttgtactgcctatatcttaaaaagttgtttagttattatttttgatttgttcattgtttagtctttatatgtaggataacagtagtttgcacacacagttacaatgttataatattctgtgtatttctgtgtacttactattaccagtgagttttgtaccttcagatgatttcttcttgctcatgagcttccttttctttctgattgaagtactccctgtagcatttcttgtaggatcggtctggaattgataaaattcctcaacttttgtcttggaaagtctttatttctccttcctgtttgaaggatattttcaccagatatactattctggggtaaaaggtttttttttcttcagcactttaaatatgtcatgccactctctcctggcctgtaagggttccactgaaaaggctgctgccagatgtattggaactccattgtttgttatttatctcttctcttgctgcttttagaatcttttctttatccttgacctttgggagtttgattattaaatgccttgaggtagttttctttgggttaaatgtgcttggtgttctctagccttctcatacttgaatataggtatctttctctaggtttggaaagttttctgttattatccctttgaataaactttctactcctatctctttctctacctccactttatgggcaataactattagatttgcccctttgaggctattttctagatcctataagcatgcttcattgttgtttattcttttttcttttgtctcctctgaccatgtattttcaaatggcctgtcttcaagctcagtaattatttcttgtgtttggtccattctgctattaaaggactttgatgcattcttcattatgccrattgcatttttcagctccagaatttctgcttgattctttctaatgatttcaatctctttgttaaatttatatgctggaattctgaattcctcctctgtgttatttggaatttctttgagtttcctcaacacagctattttgaattctctgtctgaaaggtcgcttatatctgtttctccagcgttagtccctggcaccttatttaattcatttgatgaggtcatggttttcctgaatggcgttgatgctagcagacattcttcagtgtctgggcattgaagagttaggtgtttattgtagtcttcattgtctgggcttatttgtagccgtccttcttggaaaggctttccagatatttgaaaggacttaggtgttgtaatctaagctgtttctgctttagggggcaccccaagcctagtaacgctgtggttcttgcagacttgtagatgtattgccttgatggtcttggacaagatccaagatacttctctggattccagcacatactcttgctttcttcccttacttcctcccaaaaatacagagtctctctctctctctcactctctctctctctctctgtctctctctctgttctgagccacctcaagctgggggtggagtgacacaagcatccttgtggccatcaccactatgactgtgctggatcagacctgaaaccagcacagctctgggtctcacccaaggcctgctgtaaccacctcctggctactgcctatgtttgctcaacgcccttgggctttacaatcagcaggtgatacagccagccagacctgcatccctcccttcagaatggcaaggtcccccaggccctgggtgggtccagaagtgccatctaggagtcagggactagagtcaaaaaccttagcattccacctggtattttattgtattgcagctgagctggcactcaaaccacaagatgcagtccttcccattcttccctcttatttgcaaagacagaggagcctcaccttgtagccactgccacccctggccatggacagtactgccagacttctgctggtgttcccttaaggcccaaggtcttaagtcaacttgtggtgaatgctgcctggcctgagacttgcccttcaaggcagtgggctcccctctatcccaggggagctccagaaatgctgtccgagtcaagtcctggaatcagggaccccaaaagccctcttgatgctctatccccctgcagcagtgttggtacctaagttataaggcaaagtcccctttacctttccttgtgctttcctcaagcagaatgagttttgctccatagccatcacagctgrgaatgtgctgaatctcacctagagccagtaagtctcagaggctcaccaaggcccttgacgtagtacgaggtttcactgctggtattcaggttccaaggtctcttcagttagcaggcgatgaacgctggcaggactgggccctttcttttaaggcagcaggttcccttctagcccagggtgtgttcagaaatgtcatctggaagctagggcctggcacaggggcctcatgattctgaccagtgccctatcctgctgtggctgagctggtctcctaaatgcaagacaaagtcctccccacttttccctctcctctcctcaagtagaaggaaagggtctcttttggagccgcaagctgtgcatcctgggattaggggaggagtgatgtcggtactcccttggctgcttcagctagtgtttcagtatgtcatactcccctttacccagttcactgtctctgggcctagtacagccctagaactcacctaagagttgcaatctttatggactagactgcctttcaagtttacttgaggccaagaccattttggccctcggtggtgaggtctgtgggcattcaagttcagacctctgagatcagcaatttccctcagcctagggctggtttaaatgctccctcaatgctgggcacggtggctcatgcctgtaatcccagcacttagggaggctgaggtgggtggatcacttgaggccaggagtttgagaccagcctggccaacatggcgaaacccaatctgtactgaaaatacaaaaattagccaggtgtggtggtgcatgccggtaatcccagctactcaggaagcagagattcgcttgaacctcggaggcagaggctgcagtgagccaagatcataccactgcactccagcctagatgacagagtgagactccatctcaaaaaataagaataaataaataaataaataaataaacgctctctcagtgggtgggtgtcagctgagtttggtctgggtttcctttctgctctaacagaatagcactgmtttcagtgcctcccaattgtctcccaccagggctcagggattctctttatgccacaccgccactgtgggttcagggggttgggtgacataggagatgcagaacttttttttttctatttcttcagtgtctctgagttatataaaatgaaaaccaggtactatgagtgctcacctgagttttggttcttatgaaggtggtttttcctgtgtagatagttgctaacttggtgtcttctctgtccagattcttttccagtattgacaatcctttacatagaaaactgtgtgtaatgagttctaaaggttcttatgacccctgattgagaagctgaattagagatattgggtttgggagcaggtagaccactttgacacctttagggttctgggtggctagggacattgtccaatatcaaaagaactttaaaaaacaatcccttactggcaatgcattttctgccttcagggacaaagcatcgatgaaagcaatccagaaaaattgttcttgttgactaggcttcttgagagacttattcactatcaagagaacagcatgggaaagacctgcccccatgattcaattttcccaccaggatcctcccacaacagtgggaattgtgggagttacaattsaagatgagatttaggtggggacacagccaaaccatatgattccaccctggtccctcccaaatctcatgtcctcacatttcaaaaccaatcatgccctcccaacagtcccgcaaagtctcagcattaactcaaaagtccacagttcaacgtctcatctgagacaaggcaagtcccttccacctatgggcctgtaaaatcaaaagcaagttagttacttcctagacacaatgagggtacaggtattgggtaaatacaccattccaactgggaaaaattggccaataagggggctacaggccccatgcatgtcagaaatccggcagggcagtcaaatcttaaagctccaaaatgatctcctttgactccatgtctcacatccaggtcttgctgatgtaagaggtgagttcccatggtcttaggcagctccacccctgtggctttgcagggtacagcctcccttccagctgctttcacagagtggcattgagtgtctgtggcttttccaggtgcacagtgcaaactattggtggacctaccattctgaggtggagggatggtggccctcttctcacagttccactaggcagtcccccagttgttgctctgtttgggggcttcaaccccaaatttcccttctgcactgttctagcagaggttctctgtgagggtcctgcccctgcagcaaacttctttctggacatccaggcatatccatacagcctctgaaatctaggcagaggttcccaaacctcaattcttgacttctgtgcacccacagtctcaaccccacatggaagctgccaaggctcggcacttgcaccttctgaagccatggtgtgagctgtactttggctccttttggacacagctggagcagttgggatgcaagacaccaagtccctaggctgcacacagcagggggccctgggcctgtcacacaaaaccattgtttcctcctaggcctccaggcctgtgatgggagggactgctgtgaagacctctgacatgccctggagacattttccccatggttttggggattaacattcggctcctcattacttatggaaatttctgcagccggcttaaatttctcctcagaaaatgggattttcttttctatcacattttcaggctgcaaattttccaaacctttatgctctgtttcccttttaaaactgaatgcctttaacagcacccaaatcacctcttgaatgctttgctttttaaaaatttctcacaccagttaccctaaatcatctttctaaggttcaaagttccacaaatcactaggtcaggggcaaaatgctgccagtctctttgctaaaacataacaagagtcacctttcctccagttcccaacgagttcctcatctccatttgaaaccacctcagtctggactttattgtccatattgctatcagcattttgggcaaagctattcaacaaatctctagggagttccaaactttcctacattttcctgtcttcttctgagccctccaaactttgccaacctctgcctgttacccagttctaaagtcccttccacgttttcaggtatcttttcagtagcaatccactctactggtaccaattgactgtattagtctgttttcatgctgctgataaagacatgcctgagactaaggaatttacaaaagacagaggtttaattgacttagagttccacatggctggggaggcctcacaatcatggcaaaagtcaagaaggagaaagtcacatcctccatggatggcagcaggcaaagaaagagagcttgtgcaggaaaacttccatttttaaaaccaccagatctcgtgagacttacttactactatgagaacatcacgggaaacrcccagccccatgattcaattatctccctccaggttccttccatgacacgtggaaattgtgggagttccaattcaagatgagctttgggtggggacacagccaaaccatatcattattgaatttgatttgctgaaatattgttttacattttcgtatctaaggtcatgaggatctgtagtttttgtatcttgtcacatctttatctggttttggtattgtggtaatgttggtctcacagaatgaattagggcatttcacatccttctgttttccggactagattgtgagaaattggtattatttcttccttcagtgtttggtagaatttatcagtgaagtcatcagaactttaccgttttgtttgtgggaacatttgaagtcaaaattcaatttgaatttaaaaggtacagattatgtcatttgtgttattaatttcttcttgtgtaaagtctgacagcttgtgtcttttaagaaatttgtccattccatctaagttgtagattttattggcatgaasttgttcatgtttcttattgttttaatacctgtagaatttatggtgatactactgctctcattcctgatattggtaatttatatcttctgtcttttttcctaatcagtctgggtagagatttatcargttaattgatttgccccaaaagctagctttggtgtcattggttttctccattgtttttctatttcctatttcattgatttctacactgaagttagcctccagggaaggtagatcactcactgcccatggatgggagccactggttcaccatgtggtcggtggtggagaaactcattctcagggggcatgaggtggttgtagtcaggccagaggtgagttggcaactgggaagatcactgaattgcacagtgaagacttcttcaaccttatacaccctggaggatctggamcaggagttcatggcttttgccaatgctcaatgggaagcagaagtacgacgcttattttctctattaatgagttcatccaaatgtttagaatttaatttttcacattgcaggagtttgtttaatgactgaaaattagtagaatacttaaargagagttcttttgatgcggtgtttctggatcctttagatatgtgtggcttaattgttgccaaatatttctccctcctctcggtggtcttcgccagaggaatactttgacattaccttgaagaaggtgcacagtgccctgcttctctttcctacagtcctagatatgtctcagggttttcggatgctgtgactttttattattattattatttttatttatttatttatttttgagacggagtcttgctctgtcacccaggctggagtgcagtggcgtgatctcggctcactgcaaactgcacctcccgggttcacgccattcctctgcctcagcctcccaagtagctgggactacaggtgcctgccaccacgcctggctaatttttttttgtatttttagtggagacggggtttcaccgtgttagccaggatggtctcgatctcctaacctcgtgatccgcccgccttggcctcccaaagtgctggaattacaggggtgagccaccacacccagcctggaygccatgacttttaaggagagagtaaggaaccacatcttctacttagaggagcatttattttgcccatattttttcaaaaatgccttaaacatagcctctgaaattctccaaacacctgtcatggcatatgatctctacagccacacatcaatttggttgctgcgaatggactttgttttggagtatcccaaacctgtgatgcccaatatgatcttcattggtggtatcaactgcaatcagggaaagccagtgcctatggtaagtcattgctcctttagcacattaaaagtattctggatttgaatatttaaaaagattccttacggaactgggatttgacatttgtgtttgttgcatctaaaatttcttttctgtgtaaaaaattattttgtgccatccacgtgtttgttggttagcaacttttatataatggcctcgttaatatgtatgtgtatacgattggttaattgctcataatttccactgcatttttaaaattttgaaacagagtattgctatggtgccctggctagactcaaactcctgggctcaagtgatcctcctatctaagccttccaagcaattatgacttttttagtatttttggaaaagtatttaaaagcacaataagaaatgaaaatttcatttttaactaacctgtactacctgctgcagtaaaatgttctttgcagttttgtatgcatgtgtttccatctgttgaaattatatataagcatatatgtaaatatttatacttattttatgaaaatcaaatcaactatcaggctggacatgttgttctttactatgcgtttttacttgccagtaaaccagagacatcttcacagatttgacatgttcttttaataattgcataaaagtctttactttggatgcaacatagacacaagctttcccaggtgtttttctgctaaagatttggctaacttcttcaaaacaacaatgataagcagatgttatctttctttgaccctgaagaaagtataaagcagaatgcccttagccacccaaaaaactgttaccatgatgtttggtcttgtccagtctgcttttgatttgactggatcactttcatctcttggtagccattgctttgcttgtgctttgtcttcattatcatactggtaaatctatgtttcatcttctgttacaatctttgaagagatacttcaaggttttttgtttgtttgtttgttttgagacagagtttcactcttgttgtcgaggctggggtgcaatggtgcgatcttggctcaccacaacctctgcctcctgggttcaagcgattcacctgcctcagcctcctgagtagctgggattataggcacatgccaccacacccagctaattttgtaattttagtagaagcagggtttctccatgttggtcaggctggtctcgaactcctgacctcaggtgatctgcctgcctcggcctcccaaagtgctgggattacaggtgtgagccaccgtacctggccaaggtctggatcccacttgtttataatttccattgaagggtttgttcttgtctgcagctgatctggctgcaatgattttggcacccaacaagtagaaaatttgttcaactgaaatttttgtcagaattgtgtaaactgtcctgactgagatatctattgtgttggctattgtttctgctgttaattgtcagtcttcttcagttagagcatgagcaagatgaattgtttccttgcaaattggtatggatggtctgctggtgtaggctttatttgcaaccttgtcctgtcccttcttaaaaggaattactcatttgtaaactgcaaatttcttttgaccatttttcccattaacttttttttaaagcatcagtgatttcaccattcttccactcatatctcagcataaattttatgctattgcttcaattgctgcagaattcatgttgttttgatgggggcttttttccaactgatgtcctatccttcttagtgcctcaaactagatcctattcagacatgttttaacaagttagtaaaagtttgtttggcacaaagaaatttgaaatccatgcttaagtttttcataatatgaattttcatgaattgtttgatgatccctcatctattacttttttagcaatggaccatgcaattttggctatgttctggcttcttacaaggttcagtagactttgtaacacagttgtatgtctcacacatcggcagctgtttggtaaaggattgacttttagccaactcatgggaaaatgaaataatgtaaaaaacaggaagactacagttttagacctttcaagtgaggcatggctttcagctcttggcaagaacaggcgaggagatgcaagcctctacaaggctagacttttcaaagtgcttctctcccctttaccctccttcagttacagcaccaagcaccacccaggtattacctgcagcctcaccctctacccagttgtgggatcctgccacttcctgaacccacactgagttccttgtggctcacagggtcacccagagggcttccgagatacggaaagctatgtgtgattttatatcacctatcatgttaagatatgtataaaataggaaacatattggccatatatcattttatatattttkggttttacatgtctaaaaaatacatgtttttttgtatgtattaaaggataggtatgtataagaggttttatagaagtggaaagttatattttttgcatatctttatgaattataataaaggaaggaaaattctcaaagaggaattcagatatcaaagagtgccctttgacaaaragccttggttacaacatacctacaaaagtgaactgtcattgaaagacctatggacactggatttctctttccttatttagaagggcaggctgtgtcttggaaaagcatacagtttgttgtatcttgctggacaacaggagtcatagtctgaagtgtctgatgagaaggaagcatcacttgatggagtgtgcatctgtgcctgtgtgtgtccacgcgtgtttgtgtgtgtgcatgcacacatgtgtcagcatgcagtgtctcagatcctacataggggtttttcctgaaggtctycagtagcaaaaactcattgagtctatccaggggaattacatccaatgctgtaattaaatactttaacmaagatagcagatcatcattcaagagaacatcaagatagttttaattaagaaaaaaaaaaggaatcactgccaggcttttttagtttttggtgagttccagcagaattgatgactaggtccagtaggaaggaattcaggattactctttaccatccagggtgagtgtagctctggagaactggggatgggaggtgactgcacagcaagaaaagatctgggcttcccccattgctctaagatctggttccattgtgagattcaaattaagagtaagctgttaatgggcaagtccaaggcctctcaccaggattatttatttcaacttttttttgtcaaagttttcaaatgtatagcaaggagagactacagtgtaatgagcacccatatatccatctttgtgttacataattttcaatattttattatactgattcatgtatctgctcttttgttctttttttaaaaataaattttggctataattttttaatggaaatgctggagatatcattctatccccaaatacttcactaaatgtaagaaataaggaaaaaaggaaaatttgttacatagccacaatatcattatcattcctcacaaaatcaataactctttaatattgtctcactcataatgcataatgaaatttcccctaattgtctcaaaaatgtcttgtacatgcagatcagtagaacggagttgagaatccagatataaacccatacatccttggccaattgatttttactgtggtgccaagactgttcaaatgggaaagaataatctcttcaacagaggtcgctgagacagctgcatatccacatgcaaaagaatgaagatgcacccttatatgcaaaaactaacttgaaatggatcaaatagctaaatagaaaagctagaagtgtaaaagtttagaaggaaacatttggggaagtatttatgacccagatttggaaatggtttctgtgatgtgacacacacattgttgtgtatgagaaacaacaacaacaaaaaacacagacatcaaaataaaacacttttgtgtgtcaaggacactatcgagagagtgaaaagtgaacccacatggcctctctaagatgtgcaagtaaacatgtacgtgcctgacatggaggctcctgggaggcaaccacagtcccaaaagacctgaaatttcaaaatcctgaatgttaagagcctgagagatcaacgtcctacaaatgtaattccagaaaaaataactttaaaaattatttatttgaaagataatctgtttacgttttaaaaggggatttatttgaaaaacatataaaaacacgacagaccacttcataggccactttacaccataaaataggtaataayaacatacaggtatctttgcaagcgtaaaccctcaggtgtactaatgaccttcatataggtgtatcaattgtgagaagatgaatcatattcttaaagtaataggttaaaaaaggaaaagtatcaatatttattactgtggttggtaatcttgtgcactcaggtttgcagctttgatcatctgaaataccatgaaaaatgacctgagacttatcatgaggtcagtcagaaacctctatgggtcaccaccgcatacacagttgcttaaagtgcccaagtcttgagaaattttgttttgttttgtttttttgagacagagtctcgctgtgttgcctatgctggagtgcagtggtgcgatctcagcttactgcaacatctgctgcccgagttcaagcgattctcctgcctcagcctcctgggtagctggaattacagatgcccaccaccacagtcagcaaatttttgtatttttagtagacatggggttttgccatgttggccaggttggtcttgaactcctgacttcagatgatctgccctyctcagcctcccaaagtcctgggattacaggcatgggccaccacgcccggccaagaaatgttatctttcacagatgcagatgtrcaaaagggacatctcttcattattgaggacatttcaacatttgtacgtacatgcctaatgcttacacacttactcttgtgctaatgcacttccatggagtcaaatttgtgagcataaaatgaattagaattctccataagtctatacacagtctctgccttcagtattggraatgatatgaagatgaaatacatagcatagcaaattgtaaaaataatgctgacaatttaaccttgtgaaaaaacctaaaaagaagaaaaagtaaaagaaaaaaaggaaaaaaacctccaaattaacctattctgtgattgtgatttttgggattttagctgttagagagtttagatttcagggagttagaccttagggatttggatccttagggaatcaatatttcagaattcaaccttcaggattatgtgttttggggttatgtctttcaggattgtgatccaaaccctatagcatcttgtttcttagcataacctgtactaatcgtagatatatctctgtactccagcagagcatcataaaattaagtagtttacagcagagagtctcaacctatcagtgattaaggaatagaaaaaaacgttttctgcagttgattatatattcataattgtttgtaatatataacaaaaatgaaaagctagaaagtgaaatgaaataaaccacagccctataaaatgcaaaactactgatgattgcttggcgacatagcaacaccaattgctacaggaatttctaagcatttcctgcagggtctgcacccatgctgaggtggttaggtaacacaacgagctgcaaaccacatcttgaacagactgttttagacccagtccagtggctctatgtgagtagtgtttaatcagaaataaggcccagcacagtggctcacgcctgtaatccctgcacttagggaaactgaggtgggcggatcacctgaggtcaggagttcgagatcagtctggccaacatggcaaaaccccgtctctactaaaaatacaaaaattagcacagtgtatggcgggcatctgtaatcatagctactcgagtctgaggcagaagaatcacttgaacctggaagatggaggttgcagtgagccgagatcataccactgcactccagcctgggcaacagagcaagattctctctcaaaaaaaagaaagaaagaaagaaaaagtaaacagaatactaaagaaagaaagaaagaaaaagtgaacagaatactttctgttttgttaatgtgctaattacatggtcacaaacagtgactaatttgtgatcaccagggcaaagtctattatcagctacctgttttccttgtaaccttgtgttttgggaacctagcaactctactccccactaagtgacaacccatgcaggtttgcccagattattcccagtttaacactggaartctcacgtcctgggagactcttcattccccaaggagcagggacagcaggtcactgtcactggagcactggaagctggccacatcattagcagattcagaaggggcacgacttaaggaggctcatgcttctcttgtcttctgccttaggctgtcatttccaatgggtgacaagttccttccatgcagaagccaggccaggagataaagtcatcttgtcctagaaaaactgttagaaagaagggaaactgtctagtgtgtttcgccaaaagagtttcacagactcttctcttgtaggggatatgggggtgggtgatcactgtcctggtctccctgaagcaaggacgcctctctggcctcagggtgcctgtcaggcaagtctctcctgtccctggaggttcacagagcmgcatccctgcaagagcaatgctaagtggggttggctttgagccccagccattctcttaacaattcttttagttaagtatcagttcccccatcccctcactccagcattttttgcctcttgctatgatcagttttctcactttcacttttacacctctgatcactgaaaaattacagaattataagtttggaaaaggagtctatatttcttggaaaaggttacaaccttcaaggtggccatctagctggctgggaagcatgacctctggcaaataccagagacaggcccttgaaaggagaagggatggggtaggagctttatgctgaacaaacagggtaaacatacatattcaccaggttacagaaggagctatgaatatttatgaaggccatcctgactcatgcgtattgaacacacatgcatgttacatatgacccgtgttcaccctggggtggagacatcatatttaaatggattacaattaggccctatacatcaaaaggtctcttcagggcacaaaggcactcaaattcacagtctccgtaaactggccagaaccagtctgtgatcaccagtcactggtcttcttaccaggagaaagttactgaaatcagcctcttgtccaatgaaagcagtatttgtggcttatggaacaaggaatggacgtcagttagtcagtgtccggtggaggtgcacttgtttaacattgtttttctctagacctgtgcttatttagctgctagagaaaaagaaaaactctgtggcagttggaacatagtttattctttaagtgtaggcgcccatgactcaactcttgcctggcgtggtttgaggtcttgtgtgtagttttgtatctgattgccacaaaaagtccactgagtccatctcatctctattttaacactaaagtgggtcagttgtgtttaaaccacaaaagggagggagtgtgacgaggcgtgtccagccttctgtcccgtcgtggctgtgactcagttttgaaggtttctttggggtcccgctggccaggagggttygattcacttgttgtgggagacgggcggcacttagtattttcttttcagtttacacgttcctgggcatccctattaagatgtgcagataaacasgcacatgcttcatgtggcatctccyttagttaaacatcttttttttttttcctttcctgtgagtcttcctgaaacaggtgagcccaggtggagcctccgcctgcgttaggacctaacctttctacgtctttatgaaatccctggtgtcagttactgctgcttcccctcaccagcttctttcctttggtctaccctaagaatgtgatacccaacacaatacaccgtctctttggcccactcaagacattctggtgatgccctgtggcctgctggcccccactagctatcaaggtcccccatcatctcacctttcctggctcatgggctttattttatgccactcttcatgctcagaagcacctggcggtttagtttttttgtgttgytctaaaggaatacctggggctgggtaatgtataaggaagagataatatctggccctcagttctgcaggctgtataagaatcatggtaccaacatctgtttctggcaaaagacttgggctacttccactcatggcagaaggtgaatgtggaaggtgctgatcacaaggtgagaaagaagcaagagaaaaaggaggggttgccaggatctttttaacaatcagttcttgcaggagcaataggacaggaactcacccattatcgggaaaaacatactaggtcatttgtgagagatccatccctgtaacccagatacctcccactaagccccacctccaacattagggattaaatttcaacacttgacttgagggagtcagatatctaaactatatcatttgatatggtcagtctttttgattgcagctattctaatgggtatgtaaattaaattgcaattttaatttgattttcctatttaaatatgatgttgagcatctttatgtgtgactgtttgccatctgtatatgttctttggtaaatgttcaggtctatgccactttttaagaaattgggttttctcttcattattgaggtttaaaagttatttatatattctggatatttatactttatcagtttctgggcttttttccatgaaactttttattttagaagaaatttagatttatgcaaggttgcaagaactagcacagagaattttcatatcctgtgcctagtttcctcctcttttttttttttttttttgagacaaagtgtcactctgtcacccaggctggagtgcagtggggcaatcttggctcactgcaacctctgcctcctgggttcaaatgattcttgtgcctcagcctcctgagtagctgggattacaggtgcacaccaccatgcccagctaatttttgtatttttagtagacacagggtttcaccatgttgaccaggctggcctcaaactcctgacctcaagagacccacggaccttggcctcccaaagtgctgggattacaggtgtgagcaatggcacccatcctcccctatggttaaatgttacgttactatagcatattatcacaactcattaaccaacatttgatacattatgatgaactaaagtctrtgttctctgcagatgtcattaatttttacctaatgtcctttttcatttctaggatcccatcctggataccaaatgacatttagcccatcacgcccccttcatctcctgtaccgtgtgacagtttttcagactttccttgttttcgatgactttgacagttttgagcagttctggtcggatgttctgtagaatgtttctcagtcttggtttgtctgatgttttgatcatggttagactggggttataggttttaggaagtaagaccacaaaggtaatgtcttttcttgctttcttgactatggatagccaactcttgaaaagagtagtcttttctccactgaattgtctttgcacttttgtaaaaacttggttgttcatactgctaaacatctatttctggactttctactctgttccattgatccagttgtgaaatatgtgataattatagctttgtaatgtcttgaaatgagtagtattagctctctaatttttttcaaagttgtttttgctattgtaggttttctacatttctgtatgaattttagartcagtttgccaatttgcacaaaaaaaagcctgttgggattttggttgaaatcatatttaagttacagttcaactggggagaaacagcatcctaacaattttgagttttccaattcttgaacatatctctatattcagatctctcctcagtgttttagttttcagtgtagtctttcacatctttgatcagatttatccctaagtatttcatgtttttgatgttaagtggtattttcattcaatttgcaattgttcattgctagtacagttgacccttgaacaatgtggagattagggataccaacctcgcaggtaktctaaaatccacatatcattttgacccccataacttaactattaatagcctactgtatagcagaagccttaccaataacgtaaatagccaatgaacacatatttgatatgctttatgtgttatatactgtattattgtaataaagtcagctagataaaagaaaatgttattaagaaaattttaaggtttgagaaaaaattttagggttgagaaaaaatgtattaagtattcattaagtggsagtggatcatcataaagatcttccttttgattgtcctccactgagtaggctgaggaggaagaggaggggttggtcttgctttttcagggatggcagatgaggaagaggtggaggaggtggaaagggaggcaggagaggcaggcgcactcgatttaacttaatggaaatacatcataattactgtctgacatttttgctctttcagttctttaaaaatgcttgatatagtatgaattcttcttcaccatttgctttagtttcagtgcccatatcatagaagggtacaatttgcaaaagaagtcaaaagcagtcttcaataatcggaatccttctgcgagattgtctaatgtcaatttattttctgacactgcttcttctgtatcttcttcctcattgtctggtactgattcaaaagcactcatctcatcaagtcatcttctgttaattcctcaggtgtggtgtctattagcttttaagtatctccaagatctctgtcttcaaactctttatgcccaccttgtttttcttgcctgccatatccacaatttctttcatgagtcccttgattggctctgttttaagtcctgtgaagtcacgcacaacatctggacacagttttctgcagcgataatgtattgtttagggcttgatggctttcacagctttttctatacaacaaggacatcttccacagtgtaatccttctagattttcatgatgttcgccccgctgacattctcttccatagtgttgacaatcctttccatagaaaaccatgtgtaatgagccttaaagtgccttgtaacyccttgttctaatggctgaattagagatgatgtttgaggacatggagaccactttggctccttttgtgttgaattcatggggttctggatggctagaggcattgtccaatatcaaaagtaatttaaaagacagtcctttagtggcaaggtatttctgatttcagagacaaagcrttggttttcatggaaccagtttggaaaaagtgtttctgttgtactggccttcttgttctacaacaaaaagactgggagctggcgtttattttttcccttaaaggctcaaggattagcagctttatagataaggttattcttaatcataaattggactgtatttgcataagacgacagagttagtctatctcttcctggcttaaatcctcgtgcccgcttctcttccttacttataaatgtcttttgtggcattttttttctctagaatagggcacttttgcatgaattaaaaactggctcaggcagatattcattctcctcaatgcttctcttcatggggtctgggaagtcacctgctacctcttgtttggcagaagttgcttctgttatcttgagatttttaaagtcaaacctctttctaaaactagcaaaccatcctttgctgccattaaattctccagctttatatccttcagttttatttagctttatgttgtcatataatgactttgtttttctcaggtcatattagagtatataggtatgcctttcttataaccatcctacacccacataaaagctgcattttttataataaaattttatgtagataatcatgatacagaattactctttgacaaattatctatggatgtaatgactctagtttcagactttttttttctgaaatatgtgagcgttccccaacagtctggtctattttcctaccttaattttctacttttggtcttgaatttgttgatagggcacagaggacttcccatgaggctgtaaagaacttatttctctgtgtgggctgtgcacaccatggtgctgtcattaccattaccaccaggagactccttaaacacttaggatatatgatagttttcacttggttaaaaaatctgccagtttctcagtaagacctttctcactattaatctttaacccacagatggaatcctagttctttttatccattaactctttgaatatccttctttctaccttggcagtggagtccattgagattgaaaagctgcatttttaatatgagataaaaagatattttggaaaaagtgcaaggtttgaagcctgctggcatcactgcagtgaagacttactgaattttctttctttctttctttctttctttctttctttctttctttctttctttctttctttctttctttctttttaaacaaaggtccttatctggattcttttttttttttttaatgatcgccaaccacagctgcagtcctcaacctatggtacatatcaagcaattcaacttttcttgtaatatcatgaatttctctgcttcatgggagcacttgaggcatcactagcgacactttgtatgggtcctatggtattatttagagtttctgatatgcaccaaacatgacaaacaatgcatgagaactgtgagatcagtgtttactgtgatacacaatttactggagggatgaactgtacacatggagatgatcagcctcacacggcgtactgagtggatacttgcaacacttgaactccctgcaatagcaacagggggtggctatgaaattatcacaatagtacagtaggcacagttaactctatgcagttatgacttaatgctgcaaacttacctttgttacttttctcttgactacaaatggtgtcatgtatagtctgtaagtgtttgtgtgyataagttttgataaattttaactatttaaaatagatttgtgtctataatatggtagtaaatgataaaatagactcgttgctatatatattttaggcattcctgacatactcaagtttttcttaattttttcactattgtaggctatgtggcttatctgcaagtttttcaatttgttgcaaatctccataacattttctaatatatttattgcaacaaatctgcccataaatggaccaacaccgttgaaactcttaatgttcatgagtaaccatttatataaatgaaattaacttttacttattgtatcctgcaaccatgctaaacttacttatttgttcttggaggttgttgtagagtttgttggaatttccccatagatgatcatgttgactgtgaatgagatccttttacttttcagatctggatattttaaatttctttttcttgtttgactgcattgaatagaacaatgttgaatggaagtagtaattagcccccattcttggcatgtgtctgatctgaggagtggagcattcagtctttcaccattaaggatgatgttagctgtgggtttttccaagatgcccttcattagctttggaaacttctcttcttttcctagtttgctgagagtttttttttttttttgtcagatatgaattttggactctgtcaaacactttttctgtaactattaagattgctacatggttatacagttttagtttatttatatggtatgttacttagatttatttttaaagcttatttattttatcattaattatggkgaaatacacatagcataaaccttgtcatcttcaccactttaggtgcacagttcagtatccagtgtattcacattgctgtgcaaccaacaccaccattcatctgcagaactctcttcatcttcccaaactgaagcttgggacccattaaacaataattgcccattcccctctcctccaagccctggtgtaaccrcccgggggattcaccttgcctgctgcctagacagagtcaatataacaagacaggggaattgcaatagagaaagagtaattaatgcagaactagccgtgtggtagaccggagttttattattactcaaatcagtctccccaagcaatttggggaacagtttttaaggaatacttggtgggttgggggaatccagtaatccaggagtgctgattggtcagggatgaaatcttaggcagttgaagctgtcttcttgcactgaatcagttcctgggtgggggccacaagagcagatgagccagtttattgatctgggtggtgccagctgatccatcaaggacagggtctgcaaaatgtctcaagcactgatcttaggagtggtttagggagggtcagaatctcgtaacctccatctgcatgaatcctaaaccataatttctaatcttgtggctaatgctagtcctacaaagggaatctagtcccctggcaagaaggaggtctgctttgagaaagggctgttattgtctttgttttaaacaactataaaataagtttctcccaaagttggttcagtctatgtccaggaatgaacaaggacagcttggaggttagaagcaagatggagtcagttaagttagatctttttcactgtctcaggcataattttgcaaaggcggtttcatttgcaaccaccattcctctttttgattctatgaatttctctattttagatacctcatacaagtagaatgatataacttccaactttaagtcatttctttgtccttgcatctaagtgtaggtagttacaagcagccaggccacatctggaatactttactgcttagaaatttcttctgccagataccctaggtcatcactctcaagtttaaagttccacagattcctagagcatggactcaatgcagccaagttctttgttaaggcatagcaagggtgacctttgctcamgttccaaataacttcctcattttcacatgagacctcattagcctggccctcactgctgatttttctatcagtattttggtcacaagcatttaaccagtctctaagaaggtccaagctttccttcatcttcctgtcttcttctgagccctccaaactcttcaaacgtctgcctgctaccaagttccaaagttgcttccaaattttcagtatctttatagcaacatctcagtaccaattttctattagtactattttctgttggtaccaattttctacccttcattacgttgccataaaggaatgcctgagactgggtaatttataaataaaagaggtttaattggctcaagattttgcaggctgtacaagcatggcgctgccatctgttcatattctggggaagcctcagggagtgtttactcatggtagaagatgaagcaggagcatgtcacatgacaaaagcaggatcaagagagagttggtgggggaggtccacacacttgaccatatcttgtgaatactcactgactattgcaaggacaacacaaagccatgagggatccacccccatgatccaaacacctcccaccaggccccacctccaacattgggtatcatatttcaacatgagatttgggtggggacaaatatccaagctataacactgaactgtgatttgacattttcatttgtctcatttggaatttttttccagtttcatgaatccttttgtgccacttcatggacctctcagttaacaaattttataattgtagatcatatccaagttgcatttaaagatactctttttgggaaaataccaaaaaccacagtgagaartgaaacttcccttttttgccaattctatagaaaatgctcttagtagttttgtgtgcatcattttcattttttgaaattattttatgcatatgcagatatctaatgcatattctcacacctattttgttaaaatgtagtaccaggctggacatattgttctttactttgcatttttcatttgccaataaattatagacatctttagaggccaatacagactgatttgacaagttctttcagtaatgacatgaaagtctttactttggatttaatgtagttttttcaaccaattaatattgatatagatttaggcattttccaaatttgtctttttgcacattagtatgtaaacactctttaatactttctttacattactatatttccatattcgtagcctctgatgaattcttcatcatgtgsatccccagcagctttacttctctcattgaaccctgactgctatagaatggaagtagtggctgtggcaaagtagtgccttgtacactttttgacttgaaatacaggaggcagaagcaataggaatgagggtagaggctagaccatagctctactggagtttctgcaggaaaggcaaggtagggcaggagaaacagtttagcattggttggtttgaataatttcagtgggctctgaggtctaagggcaggccctttgctatctgtaataattggctgacccagggaggtgcactgcatccctaccagatagggatttttaagatgcaaaaatataataatatacagaaaatttaaaaatacacacaatacaggaagtattttattcttatggataaatacccaacagtggagtagttgtgatctatggtaggtgtatggttacctttttaagaatttgccagacaatatttacaagcggccagaccaaggtgccctcccaccacctgcatatgagaggtccagctgttcatactcaccaacactggatgtcttagtccgtttgcattgcgataaaggaatacctgaggttggttaatttataaagaaaacatgtttatttggctggtggttcattcaggcgatacaagaagcatggcaccagcatccgcatctggcgagagactcaggctacttccactcatggcagaaggtgagggtggagggtgctgatcacatggctagagagaagcaagagaaaaaggaggcaggtgccaggcttttttttaataatcagttcttgctgaaactaatagatgggaagttcactcattactgggagggggcactaggtcattcatcagggatccactcaaacacctcctgctaagccccactttcaacattagagatcaaatttcaacacttgatttgggagggacagataattcagctatatcatttgatatgctcaatctttttcattgcagctattttaacgggatgtggattaaacctcagttttagtttgattaccctaatcattagttatcttgaacgtctttacatgtgcctgtttgccatctgtgtaccttcttgggttattctctgttcaaatctttgctcattaaaaaacattttttaaaattgaattttaaagattatttatattctggatatttatcctttaccagtctgtagatgttttttttaaagtaaactctttttgtttgtttgtttwtatttttttatttwtattttttattattgtactttaagttttagagtacatgtgcacaatgtgcaggttagttacatatgtatacatgtgccatgttggtgtgctgcacccattaactcgtcatttaaccttaggtatctctcctaatgctatccctcccccctcccccaatcccacaacaggccctggtgtgtgatgttcaccttcctgtgtccatgtgttctcattgttcaattcctacctatgagtgagaacatgcggtgtttggtttcttgtccttgtggtagtttgctgagaatgatggtttccagcttcatcaatgtccctacaatggacatgaactcatcattttttatggctgcatagtattccatggtgtgtatgtgccacattttcttaatccagtctatcattgttggacatttgggttggttccaagtctttgctattgtgaatagtgctgcaataaacatacgtgtgcatgtgtctttatagcagcatgttttacaatcctttgggtatatacccagtaatgggatggctgggtcaaatagtatttctagttctagatccctgaggaatagccacactgacttccacaatggttgaactagtttacagtcccacaaaaacaagaaatggggaaaggattccctatttaataaatggtgctgggaaaactggctagccatttgtagaaagctgaaactggatcccttccttacaccttatacaaaaattaattcaagatggattaaagacttaaatgttagaccttaaaccataaaaaccctagaagaaaacctaggcattaccattcaggacataggcatgggcaaggacttcatgtctaaaacaccaaaagcagtggcaacaaaagccaaaattgacaaatgggatctcattaaactaaagagcttctgcacagcaaaagaaactaccatcagagtgaacaggcaacttacagaatgggagaaaattttggaatctactcatctgacaaagggctaatatccagaatctacaatgaactcagacaaatttacaagaaaaaatcaaacagccccatcaaaaagtgggtgaaggatatgaacagacccttctcaaaagaagacatttatgcagccaaaagacacatgaaaaaatgctcatcatcactggccatctgagaaatgcaaatcaaaaccacaatgagataccatctcacacaagttagaatggcaatcattaaaaagtcaggaaacaacaggtgctgtagaggatgtggagaaataggaacacttttacactgttggtgggactgtaaactttttattttacaataaatttagatttaaagcaagggtgcaaaawattgcactaagaattcccatatatcttttgccagtttcccctattgctaaatgttagtttactgtgcacatttttttttattatactttaagttctagggtacatgtgcacaacatgcaggtttgttacatatgtatacatgtgccgtgttggtttgctgcacccattaactcgtcatttacattaggtatttttcctaatgctatccctcccccatacccccacctctcgacaggccccggtgtgcgatattccccgccctgtgtccaagtgttctcattgtttaaatcccacctatgagtgagaacatgcaatgtttggttttccgtccttgcgatagtttgctcagaatgatggtttccagcttcatccatgtcgctacaaaggacatgaactcatccttttttatggctgcatagtattccatggtgtatatgtgccacattttcttaatccagtctaccactgatggacatttgggttgcttccaagtctttgcttttgtgaatagtgccccaataaacatacgtgtgcatgtgtctttatagtaccatgatttataatcctttggatacatacccagtaatgggatggctgggtcaaatggtatttctagttctagatccttgaggaattgccacactgtcttccacaatggttgaactagtttacactcccaccaacagggtaaaagcgttcctatttctccacatcttctctagcacctatgtacatttatcacaactcattaatcaacactgacacattatgttgaaccaaagtctatgttttctttagatgtcattaatttttacctaatgtccttgttcttttctgggatcccatccaggataccgcatgacatttactcatcacatttgtttcatctcctctagcctgtgacagtttttcagagtttccttggttttgattactttgtcagttttgagcaattctggtgaggtattctgtagaatgttcctcagtttgagtttgtctgatgttttgattatggtaacacaggggttataggtttttaggaggaagaccacaaggtaatgtgttttcccgctttcttgcgaatggatacccaactgttgaagagtcatcttttccccacagaattgcctgtgcacctttgaaaaaacttggttgctcatacttctatttctgggtattctattctgttccaatgatctttttgtgaaatatttgattactatagatttgtaataagtcttgaaattaggtaataattgctctccatttttttttctattttttaaaagttatttttgctattgtaggtcttttacatttccctatgaattttagaatcagtttgccaatttgtacaaaaagatagcctgctggaatttagattggggttgtattaaatttatagatcaactaaggaaaaataacattttaacaattttgagttttctgattcatgaacatatctatttattcaggtctctcaccaatgttttgttgttttcagtgtacaatctttcacatcttttgtcagatttatctgttagtattttttatttttgatgctatttaggtgctgttttcattccaattttcaattgttcattgctagtacatttgacccttgaagaatgtgaggattgaggtaccaacccccgagcagtaaaaaattagcatagaaaggttttgtgggtttctttttgttttttatttttgagacagagtcgtgctgttttgcccgggctggagtataatggcgtgatctcagctcaatgcaacctccgcttcccgggttcaagtgattctcctgcctcagcctccagagtagctgggattacaggcatgcaccaccacctgcagctaattttttgcatttttagtagagatagggtttcaccatgttggccaggctggtctccaactcctggcctcccgtgatacgcccaccttgacctyccaaagtgctgggactacaggtgtgagccaccacgcccagcacacatagaatttttgactccctaaaaatttaactattaatagcctactgtgcactagaagccktaccaataacagaaacagttgcttaacacatatttggcatgttatatgtgttatatactgtattatcayaatgaagtcagctagagaaaagaaaatgttattaagaaaatcttaaggaagagaaaattaagtattcattaagtggaagtggatcatgataaaggtcttcctcttgattgtcctccattgagtaggctgagaaggaggaagaggtgggttggttttgctgtttcaggggtggcagagggggaagaagtggaggaagaaggaggagagacaggtacacttggtgtaactttacagaattacatcataattattatttgacttttttgcctttgcaattctttgaaaatgcttttttacagtactagtccttcttccccatttgctttagtttcagtgcccattcatggaagggtttgtgttgtaaaataagtcaaaagtagtcttaataattggaagcctttgccaaactgtttaataggaatttgttttctggcatggcttcttctatgtcttctttagtatctggtactgattcaaaagcactcatctccatcaagtcatcttctgttgattcctctggtgtggtgtctattcattcttgaatttctcacagattcatatcttgaaagaccatatcccccaccttttgttgctgaattagagatrttgggtttgcaggcaagtagaccactttgacaccttcagtgttgaactcatgggttctgggtggctaggggcattgtccaaaaatcaaaagaactttgaaagaccgtctcttactggcaagatattacctgacttcagggacaaagtaatgatagaaccaatccagaaaaagtgttcttgccgaggccttcttgtacaacaaaaaaactggcagtgggtattgatcttttccctttaaggcttggaggctagcaggcttatggatgggggcagtcctatttgtaaacccaaacatacaaacatacaaactatgtcaaaggcatagcatgggtactgtgaaaggagggtgaaaacacaaagttgacatcacctctgacctcaaggagtgctcagcagactgagagagacaagtacatattttcctgaaggagggcactggagtgatggcgtgtttagaatgtgcaagttgagcggtcactgagaggcagctcagcagagtgctctcgcaaggattgggcgggcamcttcccactgcgtgcgatgtatcttaggaaagccatttaaaataggagacggttactttccatcaagtccctggtatggtccatggaagcagggttgtcagtctcatttcagcattttagaggcttctcagggtttggaaatggaagaagagaagcagcaatatgtatgcattgcagagacacaggcgagccccaatttaggaggttaggaggtcagtgctaagggccttgttttctttgcttagagyatgagttgccatcttctctggacagagagtatttggttgcctaaaggtaaaatctaaattttgctctgggacaaattccaaaaaaaattagctttaatcaaatttactyttactttatctttctgaaccttcaaggtccaaaagcattggttaataattctgctwctaaacttaacattgcagcacagggcatgttctgcccccaaggcaaagaccataagctactgttgtctggaaaacatacaaatagatatctcagcaaaagctactcatatattcttgttcttttgggtaaatcattgtcagtgactgatttttttttatgaaaggataaaaacacgccctctattggrgtcaggttttgtgctggtatttctcccacctactgtatcataggagcttagattcccagctgcttgctctcagctgcagttctctgatggcttgcacagggtggaccagcccccttcctctatgtgtgtgtctgctgctgacctgtggctttgccgaggcagggaagctactggtagtgcccayggatgggagccactggttcaccatgaggtcggtggtggagaaactcattctcagggggcatgaggtggttgtagtcatgccagaggtgagttggcaactgggaagatcactgaattgcacagtgaagacttattcaacttcatataccctggaggatctggaccgggagttcaaggcttttgcccatgctcaatggaaagcacaagtacgaagtatatattctctattaatgggttcatacaatgacatttttgacttatttttttcaaattgcaggagtttgtttaaagacaaaaaattagtagaatacttaaaggagagttcttttgatgcagtgtttctcgatccttttgataactgtggcttaattgttgccaaatatttctccctcccctccgtggtcttcgccaggggaatactttgccactatcttgaagaaggtgcacagtgccctgctcctctttcctatgtccccagaattctcttagggttctcagatgccatgactttcaaggagagagtacggaaccacatcatgcacttggaggaacatttattatgccaccgttttttcaaaaatgccctagaaatagcctctgaaattctccaaacacctgttacggagtatgatctctacagccacacatcaatttggttgttgcgaacggactttgttttggactatcccaaacccgwgatgcccaacatgatcttcattggtggtatcaactgccatcagggaaagccgttgcctatggtaagttatctctcctttagcaccttaagaatacttcacctttggaaattaaaaaaggattctttactgaactgtgatttgacattttcatttgtttcatttcaaatttctttccagtttaacaaattattttgtgccaatgcgtgtactcrtcagtagcaaattttataaaactgcccttcttgaagatatgtatttataacttataaaattgtggawcatattcagcctacatttttaagtaccatgtttagaaaagtaccaaaaaccacagtaagaaatgaaacttcccttttttgttaattctatatgmccgccccagaggaaatggtcttagttttgtgaacattcttttaatgtttttaaaaaagtactttaggtatatacaatatctaatgyaaattctcacacctattttgttaaaataaaatctagtattgggctggacatattcttcttttctttgcatttttcacttgccaatraattataaatacctttatagaccaatacagacagatttgacaagttctattaataattgcataaaatactttactttggatgcaatgtagtttttaaccaattaatattgatatagatttaggcattttgyattttttgtctttatgaatagggccgtgtaaacactctttaatactttccttacatgaatatatttccatattcttgcttttatcttagttgactagagccctacatgtagggttacaggatttccatgaattgagaaggattggcatttttttgctattrtgtcttcctgttcaggaatatgtatgtctcactatttattcagatcttgttttatatacataaataaaatttttcactatataagcattttctgtttcttattaacatttattcctcagcatttcattatttttgaaactattgggtacaggacaatttttccatttctacatgtaactgactatgggtaattaaggttttgttttttgcatatgtatcttgtatccagccacattactaacttatcttattattttgtagtatacagtagatgtacaatatacaatgtcawctgcaaagaattcccttctctgatatttataccacttattttgctttgctggagcttatacttccaaagcactattgagtaatattgtgagagtagccagtttaaattttaaatagggattcaatcacttgtgattgaaaagtccatgacaaataccagaataacattcttagcaaatgtgtagttggctgaatccagattaaacacctaatgtctaatctcagtatattattttggagggatggagtatacaatttatctattgttctggctccttacaaggttcagtagacttggtaacacagtcatattctctcacatattggcagatgtttggtgaaagagtgactgttcagccaactcatgggaaagtgaaataatgctctttctaaaaagcaggaggactacagttgtaggcctttcaaaattaggcatgactttcggatcttcacaagactaggctaggagatgcaaatggcagaaatctaagaggttagacttgtctaagcacttttctcccctttaccctccataaattatagtatcctccattaattrtagtaacaggcaccacttatgtgttgcctgcaccccacaacctttggctgagggtaaggccctgccacttcctgaacccacactgaatttattgtgcctcacagcgtcacccagaggcctwtagagatataaaaacctatatatgattttatatcacctatgatagagggttatctataaaatatgaaacatcaaactatatatggtttcatttattttgattataaatatcttttatgagatatgaaataaatgtgtttatgtgtctattaaagaatatggatgtatgaaagtttttatacttgtggaagattacatatattaatgtatgtatttatgactatacgtgtaaagccagcggagttctcacagaggaattcagaactcaaagaaggctttccggcaaagagccttggatatggcccaaycacagaagtaaattgtcattgacagaaggatggacacttcatattgctccttccttgtttcagatgccaggatgtgtctgggaaaagcatgcagttggttacatcttgctgggaaacaggattcagagtctgtgtcttatctgtctgatgagaaggaagcattacttgatgatggagtatgtgtttgcacatgtatgtgtttgtgtatgtgcaggtgtgtttgtgtgcagtgtcccagaccctgcataggggattttcttgaaggtctcctgtaacaaaatctccttgaggctatccaggggaattacatccagggatgtaattaaatactttaacaaggatggcagatggccccgtcttcaatgtcagggatcaaatttcaacgtgagatttggaggggacaaacttctaaactatatcattccgtgtggtcattcttttacattccagcgttctaatgtgtgtgtgttgattaatgatgtgtaaataattcagcagaacattgaaatagttttaatggcaaaaagaggaggtccctagtctttttgaatttttgatgagttccaacagaattaatgactggttttaggtgaaaagaattcaggctttgtctataccatccatggcaggtgcggctctgggggtgggatatggttacagataaataagagatctgtgcttccccccttgctgtaagattctggctatagtccaagatccaaattcaaagttagcttttggtggacaagactaaggcctcccactaaaattatttacttcaagtttttattttcaaagttttcaaacatacacaayggagagactcagtgtaaygagcacccacttatccattcttaggttaaataattttcactattttgctctactaattcatctatccctttattctatctttttaaagaaaacttttaaaaataaatttgtatgtttttaaaaagaaattcttggcatgtcattccatcactgaacaattcatttaatataaaaaataagaaaaatttgttacatagccacaatatcattatcatatctaagacaataaaaattctttaatattatctcatttacagtccataataaaatttccccggattgtctcacacaacatctttccatacagatcaatggaatagaatggagaattcagaaataaacccatacatatacatccttggccaattgactaggtgccaaagtttgacaagtgtgtcaagatcattcaaatgggaaagaatagtcttttcaacagaagacccaccctggggtccttgagctccagcgtcagactccaaaaccatttgtggaaatcatccagccacctcccaccatgcctctgatgaatccttcaccgatggattcatcagaagcatggttgatgatgaattcactgatgaatcacccctgtgtgcatccacaggggtcctgcaaatattttctcacagtctgttgagtgacttttcttacaaatacttcattgtagaataaatataggattatagcaaggttacaacaaatagtttagagaattttcatctaccctgtgtccagtttccaccattgttaaatctcatgtttctatggcacatccatcacaactcattcaccaatattgaygcataatgatgagctaaaagctaaagtctgtttccttcagatttcattaatttttacttaatttccctgttcttttatgggatcccagtgataccacctgaaatgtagtcatcatgtctcctttgtctcctccagcctgtgacggtttctcagactctccttgtttttagtgacttgggcagtttcgagcagtcctagtcaggtgtcctgtagaatgttcctctagaatgtcagtgtgtgttttgcctgatgttttcatcgtggtaaaactgggtttatagacttttggtaggaagacacagaggtcttttcttgttttcttgcgtgtgaatattcaactgtagaaaaacagaaccttttctccactgcattgcctttgtacctttgtaaaaacttggttgttcatacatctgtgcacgtatttctagactttgtattctgttctgttgatctatttgtgaaatatttgattactatagctgtgtaataatctataaatgaggtagtgttacctctaattttttttttcaaattgcttttgctattggaggtcttttgcattaccatatgcattttaaaataagttcattaatgtgtgcaaaaatcctgctaggattttgattgggattgtattttatttatagatcaactggggagaaacaacatcttagcaattttgagttttccaattcattaacatatctttttatttaggtccgtcatcagtgctctgtagttttcaatgtacagtctttcacatcctttgtcagatatatccctaagtatatcatgtttttgatgctatttaagtggtatttttaatccagttttcaagtgttcattgctagtatagttgacccctgaacaatgtgggaatgaaggggaccaacccgtgtgtagtagaaaatccgcatagaacttttgattctccaaaaacttaactactaatagccaactgtttaccaaaagccttgccaataccataaacagtcaattaacacatagtttgtatgttattagtattatatcctgtattatgacaatgcagctagctagagaaaagaaaatgttattaaaaaacgtaacatatgaaaaaatgctcaacatcactagttaccagaaaaatgaagatgaaaaccacaataagatatcatctcacaccagttagaatggctgttattaaaaagtcaagaaataatagatgctggtgaggctgctgagaaaagggaacacttgtaccctcttggtgggaatgcaaattagttcatcccctgtgggaagtagtttggagattttgcaaagaacttaaaacagaactgtcattcgacccagcaatcccattactagatatatgtaaaaaaaatcgttttaccaagaaacacatgcactggtatgttcattgcagctctattcagaatagaaaagacatgaaatcaacctaggtgcccatcaacagtggcttagatgaagaaaatgtggaacacatactccatggaatatgcagccataaaaaaagaatgaaatcatgtcctttgtaacaacatggatgcagctggaggtcattaccctaagggaatatatacaggcacagaacaccaaataccattgttttcacttagaaatgggagctaaatagtgggtacttttgggcataaagatggcaacaatagacactatggactcctaaargggagaggaaaggctgcaagagttgaaaaactattgggtactatgctcagtacttgggtgatgggagcaatcatgccccaaacatcagcatcacacaatatactcaggtaacctgcacatgtactcctgaatctaaaataaaagttgagtatgtataagwggaagtsawtcatcataaaggtctccatcctcatcatcttccattgagtgggctgtggaggaggaggagtagatgttgattttgctgtctcagggtggcagaggcagaagaggtagaggaggtggaagtggaggcaggagaggcaggtgcacttggtgtaaccttatggaaatacatcataattactgtctgtttttttctctttgatgtatttaaaaatgcttttatacagtrctaatccttcttccccatttgctttagtttcagtgcccataagggttcatgtcttaatagaagtcaatagcagtcttaaataattggaagcatttctatgaggcttgtattgtgtaaggccaattttttttctggcactgcttcttctacatcttctttctcatcaagtactgattggaaagcactcatctctatcaggtcatctattgattccctgagtgtggcatctattgkctcttgaatttctccaagagtcatattttgaaataccttatccccaacattttgttgctgtatccataatcccttcatgacttccttgattggctctgtcataaatcctgtgaagtcatgtgcaacatctggtcacagttttctccagaagaaatgtactgtttggggcttggtggctttcaaagctctttctatartaacagtggcatcttcagtggtgtaatccttctggactttcatgacattctctatccagattctctttcctagtattgacaaccttttccatagaaaactgtgtgtaatgagttctaaatttccttaagacacctgattgagagactgaattagagatgttgggtttggaagcacgtagaccattttgacaccttcagtgttgaactyrtggrttctgggtggctagggaatggtccaatatcgaaagaactttaaaagacagtcccttgctggcaatgcattttctgccttcacggacaaagccttgatggaaccaatccagaaaacgcgttcttattgttgagtccttctttttgtacaacaataaaactgtcagtgagtgttgatcttttcctttcaaggctygaggtttggcagttctactgatgagggcagtcctgactgtaaacttgactgcatttacacaaaacagtagagttagcctatcccttcctgccttacattctggtgcttggttttcttccttgccaataaatgtcttttgtgtcatctttttttttgtttgtttgtttttgttttttccagaatagggcactgtcatctgtattaaaaccctgttcaggcagatatcctttgtcctcaatgcttttcttcatggcatctgggaactcatctgcctccttttgcttggcagaggctggttctcctgttatctggacaattttaaagccaaacctctttgtaaaactagcaaaccatcctttgttgccattaaattctccagttttagattcttcacctctcttttgctttaagttgtcataaaatgactttaatttttctcaaatcacattggcatctataaataagcctttcttatagcaatcctacacccacattaaagttgcattttcaatatgagacaaaaatgtatttcacaaaaaratgcgaggtttggctcctgctggcatagctgcagcaatgtcttcatgaatcttttcttctcttttctttctttctctctctctcttttttctttttctctttctttcttttgcaatggtccttatctatcttcattgattttgaaatggcaggcaatcatagcggcagagctcaatctacggtacctatcaagtaattcaagtttttttggtaatgtcatgatttttctttgcttcttgggagtacttgcagcatcattagttgcactttatagtcccatggtggtattcaaggtttaaaaaattacactaaacatgatgaaaaatacagtagaaccataagagatcattttttactctgacatgcaatttactagagagaagaaacgcgcagagggtataaacgtcatatcacatgcatttaggccacactttagctccctgcaatagcaacaggaggtagcaacaaaattattatagtagtgtagtatgtactagaggaaagtgactaagcaaatgtctagtaccagttagggtgtcctggaaggaaccatcttgtgcttctacaagaattatgccctgaggttggctgttgaatccctcackaaatgctcctcagtgtgttgcctaacacacactgctgagctcacccattaaaatctgcatgatggaattcagcccaatgcaatgagaattcccatggacttcctctgtgcaaggcaaagcaygggtgctgtggaaggaggatgaaaacaggtagaagatgtaatctcatcctcaaggggtgctcggtagaatggaggaaacaatacatagattcctgaagatgagcaccaaagtgattggggtgggcccatagcaaaggcctgcagctctgttcagaatgcagaagcagagtgggcagagagagacagctcatcagagtgcttgggcaagcatagggacggcgactcaccactgcagacaatgtatctgwggaaagccatttaaaataggtgacagtcacattccatcaaatttctggaagggtcyatggaggcagggttgtcaatctcattacagcatttcagaggcctcagaagatttggaaatgaaaaaagacaagcagcacttgtggctcacctgtgtcacaattgtggctcacctgtgtctctgcaatgcgcaagtgagctgtgtattgcagagacacaggtgagccgcaatttcctcccagttaggaggtcaacgctaagacccttgctctctttccgtcgaacatgagatgccaatttctttctgggcagaggacaaaataaaaattgtctataaactttggccaggtgtagtggctcacgcctgtaatcccagcattttgggaggccgagatgggcagattgcctgagctcaggagttcgagaccagcctgggcaacatggtgaaaccccgtctccactaaaatacaaaaagttagctgggcrtggcagcgtgcgcctgtaatcccagctactgaggctgaggcaggagaatcgtttgaacccaggaagtggaggttgcagtgagcctagatcttaccactgcactccagcctggatgacacagtgagactccatctcaaaaaaaaaaaaaaaaaaaaaaaaattgcaaatttttctttgtgacaaattccaaaattattagcttcgttcaaatttactttcctttttatctttcaatgtcgtcaaggccaaaagcattgcttaataattttgtttctaaactcatattgcagcacagggcatgatctgtccccaaggcaaagatgatgagttactcttttcttgaaaacatataagcaggtatctcagcaaaggctactcatgtattattatgagtaaatcattggcagtgaatgtgaatttttttttaaatgaatgaataagtacacgccttcttttgagggcaggttctatctgtacttcttccacktactatattataggagcttagaatcccagctgctggctctgggctgaagttctctgatggctcgtgcagggtggactggcctccttccmctatatgtgtgtctactgctgacctgtggctttgccaaggcagggaagctgctggtagtgcccatggatgggagycactggttcaccatgcagtcggtggtggagaaactcatcctcagggggcatgaggtggtsgtagtcatgccagaggtgagttggcaactgggaagatcactgaattgcacagtgaagacttactcaacctcatacactctggaggatcaggaccgggarttcatggtttttgccgatgctcgctggacggcaccattgcgaagtgcattttctctattaacaagttcatccaatrgtatttttgacttatttttttcaaattgcaggagtttgtttaakgacmraaaattagtagaatacttaaaggagagttsttttgatgcagtgtttctcgatccttttgatgcctgtggcttaattgttgccaaatatttctccctcccctctgtggtcttcgccaggggaatattttgccactatcttgaagaaggtgcacagtgccctgctcctctttcctatgtccccagacttctcttagggttctcagacgccatgactttcaaggagagagtayggaaccacatcatgcacttggaggaacatttattttgcccctattttttcaaaaatgtcttagaaatagcctctgaaattctccaaacccctgtcacggcatatgatctctacagccacacatcaatttggttrttgcgaactgactttgttttggagtatcccaaacccgtgatgcccaatatgatcttcattggtggtatcaactgtcatcagggaaagccagtgcctatggtaagttatctcccctttagcacwttaagaataatctggctttggaaattaaaagatttcttacagaatcataatttatcatttacatttgtcccatttggaatttctttctggtttaaggaattcttttgtaccaattcacttaattgttgggtagcaaattgtataaagcagctcttgttgatatgtaagtgtatacaattgatataattgtagatcatatctaggctgcaatctaaatgctatttttggaaaaatacaaaaaaaccacagtaagaaatgaaacttccctttttttgctaattctacactacccccagaggaaaatattcttagcagttttgtgtgaattgttttcaatttttttgaaattatactatgtatatgcatatatttagggtaaattgtcacttctattttatcaatataaaatctactatcatgctggctatgtttttttatgttagatttttctcttgtcaataagttaaagatatctttacaggtcaatgcatacagatttgacatgttcttttaataattgcatgrtagtctttactttggatgcaatgtagttttccaaccaattaagattgatagagatttaagtgttttccacttttggggtttatgagcaataataagaattcttgtatactttctttacattatatatattttcatatttttgcttttatctcagtagggtatcatcctatgagtatggttgcttggttttcactaaatgagtgagattggccttcttttgctattacatcttcctactcaagaatatgaatccctcattatttattcggattctgttttatttccataaataaaattttgcactttataaaagtatttcatctttcttattaacctttattcctctgcatttcattatttttgaaaccattatgtgcaaggcaattttcccatttctcttttgaattcactatgcataattaatgtactgctttgagttttacacatttatcttgtatgtagtcatattactaaactctcgtattagtatgtaaggtgtattaagtatgcaatatcatctgcaaattattccctcccctggtatttatacctcttattttggcggagcatatagttccaaaatattattaatattgttggtctagccagcttaaattaggatttggtcacttgcaattgaaaaagtcktgacaaatacaagagtaagattcttggcaaatgcatagttgctaaatccaggtgaaacacctggtgtctgatctaagtatattattttgttagggatggagtatacatttttatctattgttctggcttcttacaaagttcagtagactttgtaacacagtcacattctctctcatattgrcagatgtttggtgaaagagtgactgttcaaccaactcatgggaaaatgcaaccaagcgctttctaaaaatcagggagactacagttgtaggcctttcaaatgaaacatgactttcagctcttggcaagaccaggcgaggagatgcaagttgtaggacgctaagaggatagacttgtcaaagtgtctctcccctgtttaccctccatcaattacagcaccagccaycactcaggtattgcctgcagcctcaccctctagccaagtgtgtggcctgccactttctgaacccatgctgagtttkttgtggctcaaagggtcacccaaagggatttagagatgtagaaattatatatgattctataccacctataatggtatatgatagagagatctataaaatatgaaacattgagccatatatagttttacatattttggttatttgtatatcttcagtggtgtataaaatatatgcatttatatgcctttaaggaatatacatatgataggatttatagatgtggaaggttatgtattaatgtatatatttataaatakaaaataaatataattatcaaagaagaattcagatcataaagagtgccctttggcaaagagccctggatatggctcaaccacaaaagtaaattgtcatagaaaaatttatggacactgtatagtgttcctttcttgtttcatatgggcagggtgtgtcttggaaaagtatacagttttttgtaccttgttagacaacaggattcatagtctgcatttcatctgtctgatgaaagcattgcttgatgatgcagtgtgtgtgtatgtggtgtttgtgcacgtatgtgtctgtatgtgcaggtgtgtttgtgtgcaatgtcttaagctctacacaggagattttttttctgaaaggtttcctataacaaaatcttattgagtctatccaggtgaattacatccagggatgtaattaaatactttaacaaggatggtagatcatcattcaggagaacattaaaacggttttgttttgtatttttaatagagacggggtttcaccatgttggccaggctggtctctgactcctgacctcaagtgatccgcccgcctcsgcctttcaaagtgttgagattacaggtgtgaaccaccacacccggacttaaagtggttttaatgagaaaaaaagaaaatcacttccacttttcttgacttgttggtgaattacagcagaattgatggttgaatccagttataaagaattcgrgctgaatctacaccatctagggccagtgcagctctggagaactgggactgggatgtggttacagcaagaaaagatctatgctttccccattgctctcgcattctgtttttgatccaaattcaaatttacctgttactgggcaagcccaaggcctccctccaagattatttatttcaactttttatyatcaaagttttcgaacatataccaaggagaggctatggcataatgtgtacccatatagccattcttaagttaaataattttcaatatcttgctgtactgcttcgtctttctccattttttcttccattttaaagaaaaattttgactttttgttttaaagaaaatcttggcatgttgtctcatcacgaaatacttcactaaatataaaaaataaggaaaatttgtttcatagacacaatacctaagacaatcaataattctttaatattatctcattttcaatccatcattaaatttatcctgattgtctcaaaaaagtcttttatatgtagatcaatggaatagaatttaaagtccagaaataatcctgtacatcctttgccttgattttcatcatggtgccaagagcattgaaatggcaaagaatagtgtcttcagcagagggttctgggacaactgcatatccaagtccaagagaatgaagttgcacccttaccttgtatcatatataaaaattaacttgaaatggatcaaagacctaaatagaaaatctaaaactgtaaaactcttagaagaaaaaattagaaaaatatttgtgaccttggatttggaaatggtttctgagatttttttttttcttgtaccaaaagtacaagaaactaaaacaagaaaaacaagagataaatctgactttatcaaaatgtttttatacaaaagcttttgtatatcaaaggatactatcaagagaatgaaaagacaactcgtgtgggcgcccttattaaggtgtgcagataaacacacgcatgcttgacatggaggctctcccatgaaacatcctattttttcctttcctatgaaactttctgaacaggtgagcccaggtggagcctccacctgcgttagaacctaacctttccgtggctttctgaaatccctggtttcagaagttagtgtggattactgctgctttctttgactgtctctctctctccttcaatctatcttgataatgtgatatcaaacatgatacactacctctttggcccactcaggatattctggtggtgccctctggcctgcaccctcccaccggctatgaaggtcaacctcttgccttccctagcctcactggctttattttatgcaacactccaactctcctctttccacctcccctgttacttttccctacctattttattcctcttttctatctccttccccacctatgtctttcctttctgtcactttttctgcatgattcctgccccagaggggtcaacaagaaagggcatcccactggctgactcatgcagggaagctgtcagtaattaattagcaaggcmgggaagttgtaccccaagtcttggtttcaacactagaggactttaggaggtggttcaatgtagtgtttgagcacgcggaccctggagtcctccaagcctgatttcataagtacttcagctgtgacacttgcrtaaacttgggtaaaaactcagcgttatctagattaaatatgataatacatgcagatgactggcatgtggmtatgaatcagcaatacccgtaattgggtgggtgatatgcattttccagcacaattatctccaacctccacaagattaatgatcttaaccatgcattcagactctcttcagaacaacatggtgagatatcaatrttgtcttcttgatgcaagtttcccttgaatgatttaaacttcagatgggtggactgtctccttagggagaatttgcaaattaaatataataaaagctaacatatattggaggcttaccgtgtaccaggtgctaccctaagtatttacatggaagctggcattattggcagacctatttttcagatgatgaaactgaggcacagaggggttgagtgacttgcccaaggttatgcctcaagtaagtgggggagccagaattcaagmccatacattctttgtaaaaaaaaaaaaaaaaaaaaggaaagaaaaaaaggctgagtgtggtggctcacacatgtaatcacagcactttaggaggccaaggcaggaagatcacttaagcccaggagtttgagaccagcctggacaacatasggagacactgtctctacaaaaaatgttttaaaaattagctgggcctggtggcatatgcctgtggtcccagctactcaggaggctgaggtgggaggatctcctgtaaacccaggaggttaaggctgcagtaagccatgactattccactccactccagcctgggtgatagactaagaccttgtctcaaaataaataaatcaataaatacatgaataaataaaatttaaaaattgatatgtaattcatgtatcgtaaaattcagtggttttctgtgtgctcccagatacaatcaaccatcaccaatatctaattccagatcattttcctcactccaaaaagaaaccccatgcccactggcagtcactccttatttctcccccttcttctacccctcagcactaatttactttctgtctgtatggatttgcctattctgggcatttcatggaaatggaagcctttatgactggcttctttcacttagttttgtggcttawccatgttgtagcatgaatcagtatttcattcctttacatggccgaatattccattgtatggatttaccgcattttttttatccattcatcagttggtggacatttgggttgtttcccattttyagccatgaaaaataatgttgttgtgaacatttgtatacgataaaccctgatgttctaattttcgagcccatgtgcctaacctctatacctgactgcctscctgtgttgacaggaaacttcttgggaaatgtcctatctccatccttttgggaatgtcacatgcagtgaaatgcgcctagagtgggtttgacttacatcacatggtctctaatccctcagcaaacatgagttcatcttgttttggttggtgttacagaataacaccctcagcaaacatgagttcgtcttgtttttgttggtgttacagaataacatgcagctggctcttttttwaaaaatttaatattaaacgtccttcattgaacaaatatctgttgagagtctttgagtgactgggatatggccataatcaaatgaacatggctttgccattctaatggagaggaaggcattgattagctacaaactgtgaaacatactttgaaagaaaaggaygtaaagagagctgatcatagggggccttgcaggataaggagtggcaatcttgggagaagttggggggatggtgtgccaagcarggaagatggcaggtgcagcatgaagccaaatgtttggaatcatagcatgttctttcccttcatccctatgtcccagggtctctttacttcataaacatggscaagtggaaatcctactttatgtctcttctgtataatccctttgtcatggcttaacttagtggcctgtgcccctccccactgctcctggaaccacaacccacattgttacaagcccctgaaggaagttataaacaccttatcttctactaggacaggwgcccctggaactgtctggctgggcaagccatacttacctgcacttccctattccatctgtgagtgattcagacttgactattgttatcayactaaactaaactggggttcactcacccagcacagtaagaccaaacatctacactgagatttgcaatgggagaaaggaaggcatttatgtgcagggcacaaagcaaggagtgttaggaggcttatacttgagacccaatctctctaatggcttgcaagtaaaggtttttaagagcaaggatacattttaggaaaacagaakttacaagaagaaatcgcaaatcaatacgcagaggttacacattggtttggtcatgagaagtgagggcttgcaggtcataggtgaattcagagattttctgatttgcaattagctaaggaagagaagcttggtttaaaattcggggttagcagaaaagaatgtttgctcttgctcatgagtgtgacttcctccaagaacaaagaatggctgtcagagttcagtcgttatttccccttatctgaggtctgcctgccaaagaatccatttggtgggagtccaggtttctgaaaaacaactcggggacatatgttatgatgtgatctgtagtttctataggaaaccaaacatctctggactctaactttcttggatattgttttaggctactattaccttcttgcttatcaagtgccttatttatttctcagggccaggtaggtgcctggaatttccttcgaaagaacccaagattttcctttatttccatgcttggaggaacccacaggcccctaaaagggattctcacttcatctcaccattttggaccttcctcaagatctgggcccagagcattctgacttctgcagccccacctcacagcctatcaaatagattaaattgctcctgcatcttatgtcacatatgtctttgtaacttggtgagctaatctgtagtggattcattgacatgtagttatgtttttatagccatttcataaaatattcataaattcaatgtttgccattttagtattctagattcagcaaatttcttattttaagtctcaaacattttgcaggtcctttgaaatcttgcaggtgggtcctggctccattacttatgggtcgtaggtcatacaagggtctgaaagagtkagcaccttagaagcaaacctctccatagggtccacgtttccagaccttcctattcccaacatgaaattaccttcatgcacatctttgggtctctcctstattcaaaatgccagctatcctccatttactttttgggaaatctgctcttgccaacagagatttgttttatcttaggatctacttctttcaccccactggaatatgtcccaagcctgagtcattcagcctgcagcaatccctgagaaaaaaaaaaaatcggcctttgcctggacactcaagtgatacctgaggacaccttgactcctacagcaccaaccagggcaggcctgggtctccagcggagctactctttagggatcgtcattatgacgaacagacatgccagattcctctggctagtgtccagtgcagacatacacacacacacacatacacacacacacacacacacacaccattcttagtacagtcaaagctcacaggagaaagaaaaatgttttctaataccttcttaatttgcaagaaggtgttaggaattcaagggatggtatgcatagtgatgttagtttcatttcttcagctccttcctccaactcatgttctgtagggacttctgggactaagaacaggacccacatatgagcaacaggattttcagagcaaggctgtggttggaagggctcagaccaacgtccacagcagagtggaggtctagtataaagaatgtgaagtttgtagcatctcttgatcccgctattcctacatgcttgcttaagccattcttcctctagatgaactgttctttgaaggaaacctgcctaatgtctgcctgctcaagaaggtggacctgagctctgttccctttgcaaccttcctggagtcttattgctatctagatgaactcaaagcaagatgctgccgcccccatgactttgatcattgtaagctgscaatcctcttgggaggctgctcccagcttggactgagctgagtcttcgcatgccttgaacaatgaatttgcatcctggttatgttccccatgggggccagccctgtccttggagtggcccctctaatcatgttgctcaggcttcttctcccttcctgggccccagaacacctccrgtgccaaacttgtgggtgggaacaggaactcgcgtgccagccaggtgtgcatgactagctctgggcaagtctgttctagtaattcaaggtaccacctctcactgggacagcctagtttctacacaggtcttgctctgggaccgccctcagcagtgtgrttagcaggcagggccagtgtgaccctccctttctgggcctcagttgagaaacctgaagctcaggagaggagtcactcccctggcagatgggtggctgggccagaagcagataccaggctttctgactcctgctctaggattctcaccacgtactggctagacttatacttctcaaatcttaatttcctaaaggcaagtaacagtttgaatgttgttatattgtgatgtataataagaaatatatgtttgtctttgtttcctggacacagctcctgaaaccataagtggtgggagcgataaacgtgaacaaagaatcttttgttattcaaaacagatccctttcgatcacacctaagtttatgtaaaggagatgtaaagtctctaaggatgagggctagttgccagggaacaaaacccttgcgattagagggaagaaaggagagagagattgaagattgatttgatcaccgatgggcaacaatctaatcaatcatgcctactatgtatggaagcctacataaaaactcagaagggcagggttcagagagctttcaggttgctgaaggtgtggagggtggggcacccagagatggcagatggggctccatggccatacccccatatcttgttctttgtactttttcctctggctattcatccgtattgtttgcaatatcctttgtaataaaccaaacctagtaaataaactgttttcttcagttctrtgagccattctagcaaatgattgactccaagaaagagggtgtgtgaacctctgatttttgccaagtcagacagaagttgtgggtaacctggggacctactacttgcaattggtgtctgaagtgagggcagtcttgtaggactgagcccttaacctgtggggtccgtgctaactcagaattcagttcagaatggaattgaattgtaggatacccagctggtgttasagaataggtccgtgtgcaagaaaaattcccgcacatcatggacataacagacaacgtcaatgatgaggaatccagcaagttcgggatagagaattggcagggggtcctcaggggtctctccaagtcatcttcaaagtgttgctataacttttcagagagggagaagcagacttgtggagctgaagagaaacacccagaagctcaggtgaaagctgacacggccatagttggttcatattaaccatgtgattaaaatggttaaatattaatttgggttcttacatatcaaagggtaaaattcagagcaagggagaggtagacaggacctgtgaaaagcagtggttagtttagggaaaatacctaggagccctgtgatttggagagtgaaaactctttattaccgttgttactttaactctttccaggatggcctgcctccttcgckcatttcagagaatttctgcaggggttttcttcttagcwctttggkgcatggttgtaggtgacaagctgctggtggtccctcaggacggaagccactggcttagtatgaaggatatagttgaggttctcagtgaccggggtcatgagattgtagtggtggtgcctgaagttaatttgcttttgaaagaatmcaaatactacacaagaaaaatctatccagtgccgtatgaccaagaagagctgaagaaccgttaccaatcatttggaaacaatcactttgctgagcgatcattcctractgctcctcagacagagtacaggaataacatgattgttattggcctgtacttcatcaactgccagagcctcctgcaggacagggacaccctgaacttctttaaggagagcaagtttgatgctcttttcacagacccagccttaccctgtggggtgatcctggctgagtatttgggcctaccatctgtgtacctcttcaggggttttccgtgttccctggagcatrcattcagcagmagcccagaccctgtgtcctacattcccaggtgctacacaaagttttcagaccacatgactttttcccaacgagtkgccaacttccttgttaatttgttggagccctatctattttattgtctgttttcaaagtatgaagaactcgcatcagctgtcctcaagagagatgtggatataatcaccttatatcagaaggtctctgtttggctgttaagatatgactttgtgcttgaatatcctaggccggtcatgcccaacatggtcttcattggaggtatcaactgtaagaagaggaaagacttgtctcaggttggtgggtttatttcttttggactgccttgtttcttccaggctctgtcctccctcactcatttggctccttgagccgactgtcccttggaggatttcctggagaaacggtggggggaagtgataccckgctcggagcagcrggaacacataggagacctgaggctgaagtgatacagaggcattcggatgaagacagggctcatgcttggcaagagtaggagatttgcttagttggataatctgggacagtcacatactcattgaatgagccttagaaatgtcccagttcaaacagaggtgaaggcttgactaagggaacaggtccaggttaaaatccattttcccaactctgtcccatgctttgtctctggaccttgagccagggaccagcraactacagcctgtgagcccaatctgcccaaaggcctgttttttgtttttttttttccttttatgttgagacctgtttttatatggcccagagctaagaatggtttttgtagttttaaaacaatttaacaatgaagaatatgtgccacagaagtatttggtctgcaaagcctacacatttactgactggccttttcagcaaaaggggtatggcctctgacctaagacaagtgtttacagatgccctcctgacatgtaggaaaagggcccagagttactttggaaaataaaaatctgtgagttttaaatttcaatgtaaatatttacaactttgaagggcttcaggcaactccctctatcttttatgcctcaattttcttttccagttccttttttatcagagagaaagcctcaaacaggtcccaaagacccttacctctcttctttacacctgctgatttctctgttaacaatttgaacagttggcagtagccactgtgaaaaggcaagggtgaggggatggggataactgaamtggttccagggattctggggcatgaaataaaaacatagaatgtcaggattcttttaattgggacataatatagttgtacacatttggggggttcatgtgatattttgatacacgtatacaatgtgcgatgatcaaatcagggtaattgagatatccatcaccttgaacatttattccttccttatgttgggaacattcccattcttcatttctagctattttgaactgcagtatacattcttgttaaccatagtcaccctactgtgctatcgcactttggacttactcattctatctaatggtgtttttgtgcccattaaccaacccttttcttttcttttttttttttttgagacagagtctcactctgtcatcaggctggagtgcagtggtgcgatctcagcccactgcaacctccacctcctgggttcaagcgattctcctgcctcagcctcctgagtagctgggactataggcatgtgccaccattcccagctaatttttgcatttttagtagaggcggggtttcaccacgttggccaggatggtctcaatctcttgacctcgtggtccgcccaccccagcctcccaaagtgctgggattacaggcgtgagctaccgcgcccggccttcttcttcttcttttttttttgatcaacgtgctttattggccctttagatgtttttctcttttctatcaaagtttttggagtattacaaattttatttcttttttctttttcttttttaaattttaaccaaccattttcacccccccttccctacttacmctttccaccttctggtaattaccaatgaactctctacctccatgagacccacttttttagctccacatataaatgagaacatgtggtatttgtctttctgtgcctagattatttcacctaacataatgacttccagttacatttatgttgctgcacatgacaggtcttcatccttttttatggctgaataattttccattctgtatatgtactatctgtgagtggaaaacaaaaccaacaaaaaactcaaagggtttttcctgttttctcactcaacaacaaacaacgcagaaaacttcagtgaacaaatgtgtggggttttttttctccacacaccaagcaagcaggcaattctgccagataccagctgggtgtcctctaattcagttctgaagatgtccacctgaagatagcatcaggtcccacagacatggggctcagtccctaatttacatttgaagaatgtaaattagtacagccactatgaagaacagtatggagagtcttcaaaacaaaacaaaacaaaaagaactagaactgccccaatatatcccattgctgggtatatatccaaaagaaaaaaatatatattgaagagctatctgcactcccatgtttattatagcactattcacagtagccaaaatatggaatcaacctaagcacacatcagtgaatgaatggataaagaaaacgtaggactgtaatatcgtgaaatatatatttggtcttcatcctcatttccttatacagatctttcacttccttccttaaatttattcctaggtattatatattctttgtacgttttgtaaatggggttgatttccttttcagttttttctctgttggcatttataaatgctactgatttttgtaagttgatcttgtatactgcaactttaccgaatttgcttgtcagttctaacagcttttgggtggaatgtttaaatttttctgaatatattatgtcatctgagaacaagaataatttgacttcttcctttccaacttggatgccctttctttctttctttctcttgcttaattgctttggataggacttccagtactatgaagaataacagtgctgacagtcagcatctttgtcttattccagattttagaggaacagttttcagttttacccttttcagtatgatgttagctgtggatttatcatatatggattttattgttttgaggtatgttccttctgtagccagtttattgagagtgtgtatcataaagggacgttgaattttgttgaatgttttttcagcatctacaacatatgagttctgtcctaaattctgtcaatgtattcatatcaatatatcaataaatgcatcaggattaattatctttttaacatattattggatttggtttgctggtgtttcgttgagatttttgcatctatgttcgtcagagatatgggcccgcagttttctttttttttgttgtgtccttgtctggttttggtatcagggtaacactggtctcacaggatgagtttggaagtattctctcctcttcatttttctgtaatagtttgagtggaactggtattaattcttttaaaaatggttggtagaattcagyagtgaatccatctggtcctgggcttttctttgatgagagactttttattactgcttcaatcttgttacttatattggtttgttgaggttttctatttcttcttcattcaatcttggtagattgtttgtgtttggaaatgtatccatttcctctaggttttctaatttgttggcatatagagttcacaataatcgctaatgatcctttgtatttctgtggtgtcagttgctgtgtttcctttttcatttctgattttatctgagtgttttctctttttcttagtctagctcaaggtttgccaattttgtttatcttttttttttttwwaaaaactttttgtttcattggtctttgcattgtttatttagcctcaatttaatttattttttccctgatctttattatttctttccttctacaaagtttgagtttggtttacttttgcttttttagttccttgaggtgcattcttaggttgtttattcaaaatatttctgctttttggatgtaggcatttattgttaaaaacttctctcttagttctggttttgctatagcccatagattttgatacattgtgtttccattttcattcgtttcaagtaatttttaaattttctttttaatttcaagaaaatctaattaagaagttagtaagcaaaagttatgcatttatttaatgatttcttaccattgattgaatcaaatctattgactccttctcctagaagtctagggtattggaaaaaagtaaatgaaagctatttattcttattacaaagaaatatttggtgtaagaaggaaaaaatatcatttctgcacattggtaccaattatcttattttttcaaaaagttgtactcagttatattgagaaactgggctctaatgaatgtactttttgagccctgtgaccctgtatctggtgcttgaccttgtttgtgtctcaactstattcccagcatgtcgtcctagagaacattctgtattatgatatgtaattatcaacatgcacttttaattattaggaattaaattaaagtgatcaaaatagaatttcttttgtccaataatcaaaccatttcaacactatgaaaaaaaatgtgtctttggacagatggaaatgtctggaaccagatagaggtgtcagttgcaaaacatgaatgtgctgaatgccatgaaattgttcactttagcgtggtgaattttatgtgacttcatcgcaataaattatttaagaaaagaagatatatcacagatcatagaaaatgaagccctgatttatagcttaaaaatgcagtcctcattaggcaaatcacataatcggcaatacataaagtaaacagaacacgagtggccaacaaaactttaagaacatgtttaatttcagaaataatccaagaaattcggattaataaacagtggaattcaattttgcctaacaggttagtaagcatgctttataggtaactattggcccaactataaaacaaatacatttctaaaaaaaatgtgcaaagccttttgaaaaccatagcttggtgaccattttttacataatgctatgattcagaaagaaagagtatcctttctcatggtaacctctgggctcccagcctcgccttgtggaagagtaaggcaggatcacttccctcttattcccatgttggtgtgactttgcgactttgaccaaagccttacctgcctcctctgcccaaggagggacgtggccgtctcagagggctgcttggtttctgtccaagctggcccttggggaagccctttggccacccaggtggtgattcctgctgtaagaasatgagaggctgagccaccaggcagtcccagatgtcctgaaacaacttatcccagccctgcccagggccttctctctagccctgtgcacctcatcacctgccccaaaacagttctacttatgtcagattctcatgggtgccttgcaacctttctgtctgtctctctgatcctcacttcttcttcagaatctcatgctgttgcatgaaaaaaaaacaaaaacgaacttttgtttttaggcccctttcctcttcctataggggcttgaatccaggccagatgctgggacactcttatgctgtcctttttgctattttgttgagtttcatccaccctagggctaacctcttttcttattggtatggctagatttcaaatatctcaattttagaagagaatttagctttgcatttcattattagaagggtcattggagtgttttccttagaacaaaggaggtcagaagtaaatcctagtctcttctacttgtaatacaaagaactgttcaagccttccgaaggacagggccattcacatcatagagccaggtcatggccagagctctggctctaggacatcctttcttcccagcctggtctatagaaaggaatagaatgcaagctcaggcctagagcctagctaggcctgaatacaggctgaaactttctcgctgagaggtgataaaaacaatgaatgtggttttcttgcagcattttttacggagcgttttcccagaaaactagaccccagttcctcaggactagttctgttcccaagtttcctcctctcatattctggagtcatctaaatagtagttctcaaatagaactaatttttcccctaggacagatatgtctgaagacatttttggtgttgcaattggagaggcgaaatagtcagtaggatatacgtagaggccaaggatgctgttgaaagttgtacaatgtgtgaaaaatacccgtcccccaactcccaacaaagaattactctggctcaaaatgtcacgagtgctgaaattgagaaactctgatctaaatcaattccaagtgaatccagtggtgtctacccagcaaggcccccagcctggaggtgtggagggcagcaaggatcctgtgcccaccctctgagctgtttgtctccctataggggtctttacaaggaatgctcattcaggctgaaatctcagcctttgttggctgagctgtgggttcattctaggcaactcagtagaacaaaagccccaaaatgccaagtcattcttaataggcactttttaaaatacgtgacttaggccaatgtctacaatgcctttaaaattctgcctctctttcaaaaccctgtgcttatctttatggctgattatctggggcatttccaggcatgtggaacattttggcagcagtgtttctgttaatagataattatctaaagagtagctgaatgctagaatgattcagctaaaaaaagtattcaacatgagtacataaaagcctagaaacttgactgtctagtaatttagataactctaggagaatgagaataaggggttataaaaatataactttattatgatgcaatttattatgatacaattcactctttttttgggggggttccagtaagatttaatgactttaagtgtttacatatttctacttttcagcacaaattcgtgataatatataaactacactttgaatgtttttttctttttttaaaaattttattattattatactttaagttttagggtacatgtgcacaacgtacaggtttgttacatatgtatacatgtgccatgttggtgtgctgcacccattaactcgtcatttagcattaggtatatctcctaatgctatccctccctcctccccccaccccacaacagtccccggtgtgtgacgttcctcttcctgtgtctgtgtgtgattgttcaattcccacctatgagtgagaacatgcggtgtttgattttttgtccttgcgatagtttgctgagaatgatggtttccagtttcatccatgtccctacaaaggacatgaactcataattttttatggctgcatagtattccatggtgtatatgtgccacattttcttaatccagtctatcattgagggacatttaggttggttccaagtctttgctattgtgaatagtgccgttataaacatacatgtgcatgtgtctttatagcagcattatttataatcctttgggtatatacccagtaatgagatggctgggtcaaatggtatttctagttctagatccttgaggaatcgccacactgtcttccacaatggttgaactagtttacagtcccaccaacagtgtaaaagttcttagagatctacaaagagacttagactcccacacaataatagtgggagactttaacaccccactgtcaacattagacagatcaacgagacagaaagttaacaaggatacccaggaattgaactcagctctgcaccaagyggacctaatagacatctacagaactctccaccccaaatcaacagaatatacattcttttcagcaccacaccacacctactccaaaattgaccacatagttggaagtaaagcactcctcagcaaacgtaaaagaacagaaattatagcaaactgtctctcagaccacagtgcaatcaaactagaactcagaattaagaaaatcactcaaaaccgctcaactacatggaaactgaacaacctgctcctgaataactactgggtacataacgaaatgaaggcagaaataaaggtgttctttgaaatcaacgagaacaaagacacaacataccagaatctctgggacacattcaaagcagtgtgtagagggaaatttatagcactaaatgcccacaagagaaagcagraaagatctaaaattgacaccctaacatcacaattaaaagaactagaaaagcaagagcaaacacattcaaaagctagtaaaaggcaagaaataactaagatcagagcagaactgaaggaaatagagacacaaaaaaaaacccttcaaaaaattaacaattcactaattttaatggtttttggtatagtcacagatttgtacaaccatcaccatagtcaaccttagaacattttcagtcactcccaaagataccttatatctattatcagtcactcttctttctctccttcctccagcccctggcagccattaatcaactttctgtccttatgaatttgcctatttctatggattccattcacaaaatacatgartagctttttccctttagcataaagagttttgtatattgatcttgtacttcaacatttctgaacttgtttatttgttctaatagtttttttttagtggatttcgtaggattttctacattccagatcatgttatctacaaatagagatagcgttacttcttcctttctaataaggataacatktatttcttttgcttatctaattgccctggcttgaacctctagtaccgtgttgaatagaagtggaaagaggagattcttatcttgttcctgatcttaggtggggaagtattcagtcttttagcagattaggtcttaactggagattttttgagtagatgccccccacattatgagattgaggaaattttcatctattcctagctygttgagtattcttatcatacctgaggtgtttggttttgtcaaatgctttttctgtgtctattgaaatgaacatggttttctttttggtcccctattctagtgatatgtgttaattgatttgcaggtgtaaacgaaccttgtattcctagaataatcccacttgattgtgttgtataatccttttacatgttactgaatttggtttgacagcattttattgaggasttttgcatcatatccataagagatattggaagtcttattttcttgcggagccttggtctgtgtttgctatctgaatattactggccttgtagaagaaactggggaatgttctcttctattttttgggaacagtctgtcaagaattggtattcattctttacatatttgatagaattcactagtgaagctgtctgggcctaggcttttcttgcaggaggttttaaaattactaatttaatctttttacctgttatggctttatttagattttgtatttcttcttgattcaatttcagtagtttgtttctttctaggaatttgtcaattttatctaagttatctaattccttggcataaaatggcccagagtgttcccttataatactttctgtttctgtaaggttggtagtaacattccctctttcatttcatatttttagcaattttgagtcttctctcttttttctttgttaatctaactttaggtttatcaattttgtctatattttcaaataaacaattttggttttgtttatttttctctattgcttctctatttctatgtcgttaatttcccctctattctttattattttctgccttcttgctttgtgtttagtttagcttcctggtggagtgacacttatcattacacaatttcccactttattgctagtaatattttttgttttaaggtctatattatcttgcttcatgatactgtgtcattaaaaaagtctattttatctgatattagtataaccaatctgcatttcttttggttgctgtttcatgatatattttttttccaccatttaactttgtaaaatttaagttttaaatataaacttttttttgtttttaaatctcaaatgtatcttctgcagacaagatattattagtccttgtttttaatgcagtctgataatctcttttaattgagttgtttaatccattcacatttaatactattattgatgtagatggatttatgtctaccatcatttttttmttttcttttttttttgagacaaaatctcattctgttacccagactggagtgcagtggtgtgatcttggcccactgcaacctccgcctcctgggttcaagcagttctcccacctcagccgcccgagcagctggaactacaggtgtgcaccamcatgcctggctaatttttgtattttttatagagacagagttttgccatgttggtcagtctggtctcaaactccttacctcaagtgatccacccgcctcagcctttcaaagtactgggattacaggtgtgagccactgtgcctggccccattttactttttatgctctatatctctcatgtatttatttgttcctctgttctgcctttattgcttttttttttttttttgcattgagtgaatattttctagtgcaacatgtaaaatcctttaatgtttttctttccactatttaaaaagttgtgttctgagyggttgttctagggcttagcacatcgattttaacttaccagtatctacttcagatttataccaacttaattccagttaaatattgaaatgtcattcctatatagctctatttcctttctcccctttttatgatattattgttatacgtggtacatctatatatgttacaaactaaacaatacatggtgataatattactttatataaatacacatgctttcaagaatcagagagaagaaagaagagcaagtatgtatttatagagtttgttatattaacctttttgcttatcatttttggttcttttcctttgttcttatggatctgagttaccttatggtatcatttcttagcccaatttgcctttgctcccaactgcctcccttgtgctattattgtcaaatatattacgcttccatatgttatagtcccaacaatataattatatatatgtatattgctttttaggattgcttttaaaatcagttaagagaatagggccgggcacggtggctcactcctgtaatcccagcactttggaaggctgaggcaggtggatcacctgagaccagcctagatcaagaccagcctggccaacatggtgaaaccccatctctacttaaaatacagaaattagccgggtatggtggcaggcgcctgtaatcccagctactcgggaggctgaggcaggagaattgcttgaacccgggaggcggaggttgcagagagccaagatcgtgccattgcacgccagcctgggggacaagagcgagacttcgtctgaaaaaaaaaaaaagagagagagagagagaataaaggggaagtatgcattggtactgccttttataactacatgattactattatcagtgctttttttctgtatgaattcagattattctatggggtcacttgctttcaacctgaagaacttcctttagtatttcttgtaagttgagtttttcagcaacacattctctcaatttttgtcttattacatggggttttgcttttattttgtttgtgcctttaaaatgatactcatcagagacttgtcttcagaggtggctcataacttatccttcagaattgcacatattttttagcagacacacatgaggcaaatttaatgataataaatacctttttaagaatcagggtggggagattaccttcagctgtgaagagcagctggtgatattgcttgtggcaagggatagaaatggtttatggatctgggaaaggctctgaagagagaagaaactgagttgacagttctaggaagttgaaggtcttctcataaattatagttgtgagataatattcacaacgactggtataaaaattcaccagtatattgttatcttttaataccctgagcaggtaggtcggtaacagatcagctgcatactttgagtgtcttagtgcaaaatgccccttgttcaaaaattattaagaatttcaggccgagcacagtggctggagctgaagtgggaagctgaggcaggcagatcacttgaggccaggagttcaagactgccctggccaaaatagtgaaactccttctctactaaaaagacaaaaaattagctgggtgtggaggtgcatgcctgtggttccrgctactcaggaggctgaggtgtgagaatcacttgcacttggacctgggaggcagaggttgcagtgagccgagatcacgccactgcatgccagcctgggtgacagagctagattctgtcttaaaaaaaaaccaagaatttcaggacactgacagcaaagtattaaacaaagcatgagaaccttctaaatgtggaatgtggtgtgtctgcccaggctgctcctccacaaagctggcccaggcaggggcaaatgtgcagctgggagagtgagagaaccagggcagctggattgcccaacctcaggggtggggcccagtgccaggtactatgtagatagtgccttttggaactattcaagctggtgaccctgaaaaaacattcttccaatttaggccattgtacaaaagcagaggccaagtacatttaccactcaaacttcacgtggtctttcagccacagacttggtcaaagcaaatgaccattgaggtttcaccataggctgggtacatgagggtgtccaggctggtgtgatgctgaggattttacagcggcttagaaacacagctttttttctaggtgtttctcaaaccttagggtaagagtggagatgggaggtggacctaagtatgtgataagaagactagagaaatgagtgtttctactgtgtctgtgccccatcactgtaggtctgatttctactccccaccccactccttcttgtcactgaaaagtcatggaattctggaatctcagggttgacagtgactgtgaagcagagtgcygtacactggtatccatctctgggagagaaataccatgcaccaattaggttgggttgccaatcccagggcaggactctaaacacctcagcagtctttactaagattcctagacctggcacttcccagctctggttggaggcattttacaatcctagctgccagagtatgagtctggtgagatggaatgcttgtgcaagtcaggcaaagaaacttgattcttcacagataggcagtaagaatcaacaggaacctaggatccatggtcagccagcccccaaggtagaggaagctgctcaggtggacagagtcccatctgcatgtgctccactttgcatggcagctgagggacccccaaaatactctgcattaggctttctatcccggaggtcactgcagtttatcagcacccagacatccatcctgggtgcctgccctccgttctattccctttccatcttttctctgacttttgtgatgattatttctcttgtgtttttcttcatcagcatttattttaagttccagggcacacatgcaggatgtgcaggtttgttacatagctaaacatgtgccatggtggtttgctgcccagatcaacccatcacctaggtattaagctcagcatccatgagctattctttttgatgttctctctccctcgactatttctttgcttttctttacaattttgccacctaaatttgcatctgtaaataatacagatgattttacctgtttcggtacttaacataaatagaattttactgtttttctttgtcttgccttttttttttttttggttcaaccttatgtttgagagattcatgatgtgtgtttttacaagttgtagtttgtggattgtcagtactgaatatatcccattgtatgaatacaccacaattttatttatccattctactgttgatgggctttgggttgtatctagcttttcactaytgtgaacaatgttacaacgaacattcttttacattctgaaacacatgtgagtgggtttttagagtatatacctaggggtggagctgctgcgttggagggcgtgcatatcattaatttaataagatgtaactatttttcagagtggttgtacatatccctgattgctaaggcattagttatgtacatgactgattatattgagggttttaaaatrtacttatcagtcatttggatttcctcttttgcccattcaagtctattgcccactgggttgtctactcgaattatgtatgcattctggatactagttctttggcagttatagatattgcaaatatcttcccccactctgcatcttgctttttacttttattcaaacgaattagaataaacatcttagtatatgactcactgtgctcctgtgtgggagtttccacaggggagttgccggaaaatggacttactgtgtcgtgcacattttaaatgtcattaggcattaacaatttattcttcccttagcaatgtataagtgtacactttccttcatatccttgccacatgtattatcatcaaatgctttcagtttttgacaatccaataggtaaaaaatatctcaaggttatttgaattttcatttcccttattaattcttcatttaaacgtcttttgtgtgtgtgtgtttactttcatcaagttgtttcaccagtgaagataagaactggtatttaccttctgcatttaatagaattgatgcaactggctgagcgtggtggctcatgcttataatcccagcactttgcggggccgaagcaggaggatagcttgagcccaggagtttgagaccagcctaggcagcatagtgagattccttcactacagaaagtaaaaacctagctggacatggtagcgtgtgcctgtagacctaactactcggaaggctgaggtgggaggattatttgagcccaggagttcaaggttccagtgagctatgtttgcatcattgcacctcagcctgggcaacagagcaagaccctgaccaactccccaccyccccccaaatcaatgcaacctgtgatcactttatttgggcaacttccccaaattcttgactcagtgaatttgttgcagggcttttcttttttaatctcttttattggttcacatactagaacaatctcaggggctatctggttaggtattgcttgctacagagccaaactatgtcaccagaacccatttatatgtttccatttcttgtctctgtttcctcggccrtggcatccttctcagtgtcataatacccaagcagcaggggcttcagcctgagttcttttcccaggattcctagttaaagttcttctgcctcattggctctaatgaagtcacatgcccatctctgaactaatcatggtggccaaggggatgagacgtgctgattggttgaggcctaggtcacatgttctatcctgagctgggagtggatcctcaccagaagtacatttgagagtttgggggaggggtggccgctgggatgagataggaaataacttgtccacgctgtgaattacccttcaattaatgatattttctatttagatgtcagattttttgttactagtttgtcatataaacctattactatatagatttttctgtgtcctaatctaaatttcttttaataatctatgggtgaacactcaataagaatgtcctccagaaaggatgacctgccgacttttaaagcaatcattttggggcttataagtatttagtatttgaagtctctgcctcttgctctcttttaggaattctttttcctactgtgatatatgtaagtacttataaatttaaacttaaaattcaaaaaatataccaggatgtgaaakaaacattattaaatataggtgttttgctgtgagtgtttcttggaataggtagggctttgtatagtaggttttggtcttttggtcagcttgggaaaattttgttcttttttaattgaatgatatgttttcaattgatactactaaaataaacattattggagtattatttacatgcaataaagtgcaccgttttaatgatacatttctgagttgtaatgattttatttagctgtgcagccatcaccacattcaagacacggagcactccattacccagtaacttcccttctgtcctatctcagtcacctaatacctcccctcaccttaggcaaccctggatggtttctgttgctggataacagaattgtcttttctagagtttcatctgaatggaatcatacaattatgaatgaaaaacacacaggtatactgttttgtgtctggcctctttggctcggcataatgtctcttcagatcctttcacattgttgcatgtatcaatatttcattcgtttctatttccgagtagcatttcattgtatagatatatcatcatttgcttatgcatttatttattgatggacatgtggatagtttccagttgttggctattatgaataaagctgctatgactattcgagtacgagtgtttctgagatttcatttttcttgggtaaatacttaaaagtgggattgttgggttgcatggtaggtgtatgtatgacttcataagaaacagtcgaactgtttccaaagcagttatacaattttacattcctaacagcaacgcattagagttctggctgctctgtatttgtgctaagacttgctatttttagtcttttacattttagccatcctaatgggtgtgtagtagaatttcattgggtttgaatttgcattcctcttatgactgatgataatcttttcatgtgcttattgatcatatgcctgttttcttttaaaaggtgccctttcaaaatcttccgcacacctttattggtttgtttgtcttcttatatttgagtagtgagttctttacatattctggatacaagtgctatgtcagatagttgtgtttctgtttacttctggtgtgtggtgtcctttgtttcattttttaaaaaacaacgtctttcaaggagcaaaagttgcaagttttgattaagtcaattttagcaaacgttttgtgttttgtacccctcgtgccctatctaaggaatctttgtctaccaaaaggtgggaggatttgtttctatgttttttaaaaaagttaaacagtttaagtttgtaggtttgggtggaaagaggtctttagaccacttagtctttgtttaggtctttgtttatgtctctgagattggcagaggggaatatacaatcattcagatcaggctattggatgcctttttctatctctgaatttttctggggtgacctcactgacacccatggcttcaatcaccacttatgctgatggctccaagtctatctgtgcagcccagacccctcctcatctccagaccctggaagctgatgccttgggctgctcctcctatttcctgggcaccaggaatatgagctactccctccccacagtcctgctctccccagtgctcccawgtcgctgaaggcaccaccatcttccaagatacatgggcctccccagggtctaggagtcctagacgtgggastagaaattagatgacattggtgtctaaacaaaacaccactgcatggagatagaacaggggagccccctgaatgtggtgagagcaccctcccaggtgtgttccaccctcaccccgggctcatcaggagggtgcttaggatgcatacagttttaagggggttggaggaatagttcagaggctgagatgttgcacccacagctgagaatccctttctagcgctctgtgtcctcacaactccccgggaatcatcctcccctggagagttcccaaagcccttgcaggcctgccttctctgtgccttcctgcctgcgccctctggtggacagctccattcrctgcctgtcccatgggttctgtccaaaggtggaatctattatcaatgtggatttctaatgggggtaacttcctccctaagggaagcctcagcttcaccagcaatggcagacacggccaggcatgtagacacagaggaagtgagatagaaagtgtgcacagcccagagagcctgcccacatcatcctggggcgaccaggacaaggaggcgtcagcaatcttgccaagcacaagtatgagtgactttctggagcaggacgagtctcatgggcgtgagaccattgtgagtgctcagggtctctccattagaaaggcacacgtttaattctccattttgaaatttgaactagagcccccacaaattattctgttctggaggaaccattcttatcagaacttggtgctggattgacttggaaaaaagcctgaccataatcttcaggatgaaataaaggcctggatgaatggacacttcagtctctaagcagacttgcagaagactggagccttcagcattcagaagaggaattcagactgtgcaagatctgaggccaggctccagctcccccggtcccttggtgagcaggagctccctgaacccaccatgggtctttgctagggttgtcttgcacatgtgtgctttagayagcagcacctcttcttccatggtgtagatggagaatcctcaacaaagcctttccaagaatctgatcatcacatcttgagctcagcctccctgcagctttttttatattgacagccacttcagrgagagtcctctttgagctttacaagaaatatcctggtgtgaaaaaygaccaaaaccagatagccagcctccccactccctgtttaaagaaagctggcttagcaatgttgtctgcatyttggatgtgctgtgttacccatatgtgggaagaaagagtattaagagttagcaaatagggtcacatccagcagagaccatatggttggggactagggcaatggtgactcctyagacctcagctgcagcctgataaacgtggttaagagagaagtaggagacagtgacatgaaatgggggttcacagccttgtgttgggaattgaatgagaaacaagagcttgaacttggatgttccccagagcgagygcaaggtcagatgagtttttcaagataggagtgatcggtctttcccagggtggggcccataatgcaagacaattatagattaaygggtaataagtaactggaggagggcactctgtcttcaattacatgttgatttgctaggtgtctcagtgacaaggtaattaagacgaaggaaacaattctaggaggcacaacgtggggtggacagtcagctgtcggtggcttctgctgagatggccacaggactccaggttcccctgccgcagctggccacaggactgctgcttctcctcagtgtccagccctgggctgagagtgggaaggtgctggtggtgcccactgatggcagccactggctcagcatgcgggaggcctygcgggasctccatgcgagaggccaccaggtggtggtcctcacccyggaggtgaatatgtacatcaaagargagaactttttcaccctgacaacgtatgccatttcatggacccaggacgaatttgatcgccttttgctgggtcacactcaatcgttctttgaaacagaacatcttctgatgaaattttctagaagaatggcaattatgaacaatatgtctttgatcatacataggtcttgtgtggagctactgcataatgaggccctgatcaggcacctgmatgctacttcctttgatgtggttctaacagacccctttcacctctgcgcggcggtgctggctaagtacctgtcgattcctgctgtgtttttcttgaggaacattccatgtgatttagactttaagggcacacagtgtccaaacccttcctcctatattcctagattactaacgaccaattcagaccacatgacattcctgcaaagggtcaagaacatgctctaccctctggcyctgtcctacctttgcyatgctgtttctgctccttatgcaagccttgcctctgagctttttcagagagaggtgtcagtggtggatmttstcagccatgcatctgtgtggctgttccgasgggacttygtgatggaytaccccaggccgatcatgcccaacatggtcttcattgggggcatcaactgtgccaacgggaagccactatctcaggtctgtattggtgcctttatccaatcaatgttccaggcaaaacactttttaaaaaatgtatttacttacaagtgcttccatatctacttatctttccaaagatttcatttctgcttctcattgttgtaatagtcttcagtgagataaacttttaaagggtcaatggtagtgcagttcagggtttcaatggccactgagaggaaggagaggcagggacgaggatctgtcaaaggatgggcaagagtggtgtgactcacsgagactgttcgtttgtaaaagcaccatcttcatggctgtggatgtgcttcagctgggcaggagcagggacactacactgagaactgatccatccaatcttgctggcaagattttcagtagaaaggaggaaggaatagaaatttacaattgttgacgtgacaatttttagtggtcccatcttgcaaaagatagagaggtgaccacaggagacctaagcactcagaggaagtagaggtttcaaagaagttgactcagttcagtggaattgggccaatgtaggtgcaatggatgtctgtgatcagagaatgaaacacagagttcagtttccagagagggagtgttggattgtaataggagaatgtttcttgtgaagacactacttaaaaaaaattcttactaggttaacttcatggtctaataccgaagtgtccaatagaaatatcatgtaaaccacatacataatttaaacttttctagtgggcatgttaaacaccagcaaaaagaaaccactaaaattaatgtgaataatgcattttatttaaccagatgtatcccaaatattatcctttcaacatgtgaactgtttaacgtagctttttttgttgttaagtcttcaaaatctagcatatatttgacacttacagtatatctcaatttggaatagccacatttcaagtgctcaatattcatatgtagttagtgacaacaatatggtgaatgtttataaatattccatggataaaactaaaattctatcttttaaatttttctatcttttgagatggagtcttgctctgtcacccagtctggagtgcagtggtgggatcttggctcattgcaacctccacctcccaggttcaactgattctcctgcctcagcctcccaagtagctggaactacaggygcatggcaccacatccagctaattttctttttttttgtattttttatggagatggagtttcatcatattggccaggctgatctcaaatgcctgatctcaagtgattcactcacctcagcctgccaaagtgctggaattacaggcgcgagccaccacacctaggcaatttttctatcttttaaaagaccctctactgaatctgcccaattctgtgaaggatgtcttttaaaaaatccccttacataacaaattctcctccagttatattttggctcttgaataggttttgctttatacatagtgattagattggtgcatgtaggtttgaggtttgagacttatattttcttcacwgtttgctgttatcattaaataataatccttaaaatacattttatctgatatcagtaatgtgactcctatgttattttttgaattccccatctcttttaatttgaaaatgatttgtgtgcaagtgggtagctcacacctgtaatttcagccctttgggagaccgagggaggaggattgcttgagcccaggagtctgagagcagcctgggcaacatgctgagactccatctctacaaaaaattaaaaaattatccaggtgtgatggygcacacctgtggtcccagctactcgggaggctgaggcaggaggatcacttgatcccaggaggtggaggctgcagtgtgccatgttcacgccacctcactccagcctgagtgacagagcgaggacccatctcaaaaaaataaaaatttatttggaatgtgaaaatcttgttttaaagttagaaaacatttttttaaaactccaatatgaaaagctgggtgcagtagcttgtgcctgtggccccagctacttgggaggctcaggtgggaggatcattgagctcaggagtttcagctcttgtggtttgttgactgactgactgattgactgattgattgatttaaaacacaacaaaacccaaaatgactttaatctgatagtttcttttgatgtcagcattctgattctgtccattcttagttgtattctttccactgagtgtaagctcattcctttaacagaaatttagtttttccatcttagttttggaattccatggcccttttccatttccatggagatgcagtgcagcatcttcaagtctctaattcttacatctgtctctttcacttgcaagagcccttgtgattacattgtccygcccggacatccagcataatctccccatgtcaaaacccttaatataatcacatctataaagtctcttccacctgtaatggaatatattcccaggtttgmgcaactacaatgtagatactttgtggggctgtgattctgcctaccacagacactaagcttaaagtgaaacccacatcttattcaaaacttggaggttttccttcatttggccatttaaatttaatttttgtttctgtcctccgtagtcttctattctccaggcttcagagctctcagcttaccattcaattatctcctttctctccttatattccttttttcattttttaaaaacaatactttcaaagagcaaaaattttagaatttgatgaggtttattctagtgaagtttttatcgtttgtactttttgtaycctaaggaagctttgtttaccccaagatatagtttctacattctcttaaaaacactaaagagttccagtttatatgtttagctctgtgagattgggagaggggagctagatcactcaggtcaggctttcgggatgcctttttctgtctctggacgttgctggggtgacctcactgacacccatggcttcagctaccacatatgctgatggctccaagtctatctgtgcagcccagacccctcctcatctccagaccctggaagctgatgccttgggcagctcctcctatttcccaggcaccaggaatgtgagcttctccctcccyacagtcctgctgtcctcagggcccctatgtctctgaaggcaccaccatcttccaagatacatgggcctccgcagggtctaggagtgccagacacgwaaccagaaatcagatgacatcactatctaaataaaacaccactacatggaaatagaacaccactacatggaaatagaacatgggagccccttgaatgtggcaagagcaccctcccaggcatgttccaccctcaccccgggctcatcaggagggttcttaagatgcagacagytttaagggggttggaggaatagttgagargctgagatgttgcaccyacagctgagaatccctttctagcactctgtgtcctcacaaatccccagaaatcgtcctcccctggggagttctcaagcccttacagacctgccctctctgtgccatcctgcatatgcctcccttgagctgggtgtccctctgatggacgcatccattcactgcctgtcccatgggttgtgtccaaaggtggaatctgttatcaatgtggatttctaatgggagtaacttcctccataagggaagcctcagcctcaccagcaayggcagacatggccaggcatgtagacacagaggtagtgagatggaaagtgggcacagcccagagagcctgcccacctcatcctggggcraccaggacaaggaagcatcagcaatcttgcgagcacatgtaggagtgactttctggagcaggacgagcctcatgggcatgagaccattgtgagtgctcagggtctccccctagaaaggcacacatttaattctccattttgaaatttgaagtagtgcccccacaaattatgcagcccgttctgttctggaggaaccattcttatcagaacttggtgctggattgacttggagaaaagcctggccataatcttcaggatgaaataaaggcctggatgaatggatacttcagtctctatgcagacttgcagaagactggagcctttggcattcagaagaggaattcagactgtgcaagatctgaggccaggctccagctccccaggtcctttggtgagcaggagctccctgaacccaccgtgggtccttgctagggttgtcttgcccatgtgtgctttagacagcagcacctcttattccatggtgtagatggagaatcctcaataaagccttcccaagaatatgatcatcacatcttgagctcagcctccccggagcttttttttatattgacagccacttcagagagagtcctctttgagctttacaagaaatatcctggtgtgaaaaaagaccaaaaccagatagccagcctgaacactctctgtttagagaaagctggcttakcaatgttgtatgtcttttggatgtgctgtgttattcayatatgagaagaaagagtttcaagggttagcaaatagcrtcacattcagcagagaacatgtggttggggactagggcaatggtgactcctcagacctcagctgcagcctgataaatatggttaacagagtagaaggcagtgacatgaaatgggtgtccacagccttgtgttgggaattgaatgagaaagaagagcttgaacttggatgttccccagaggcagcacagggtcagatgagyttttcaagataggcgtgattggtctttcccagggttgggcccataacgaaaggcarttatagattaatgggtaataagtaactggaggagggcactttgtcttccaattacatgctgatttgctaggtggctcaatgacaaggtaattaaggcgaaggaaacaaatgtagcaggcacagcgtggggtggacagtcagctgtcggtggcttctgctgagatggccagaggactccaggttcccctgccgyggctggccacaggactgctgctcctcctcagtgtccagmcctgggctgagagtggaaaggtgttggtggtgcccactgatggcagcccctggctcagcatgcgggaggccktgcgggagctccatgccagaggccaccaggcggtggtcctcaccccagaggtgaatatgyacatcaaagaagagaaatttttcaccctgacagcctatgctgttccatggacccagaaggaatttgatcgcgttacgctgggctacactcaagggttctttgaaacagaacatcttctgaagagatattctagaagyatggcaattatgaacaatgtatctttggcccttcataggtgttgtgtggagctacygcataatgaggccctgatcaggcacctgaatgctacttcctttgatgtggttytaacagaccccgttaacctctgyggggcrgtgctggctaagtacctgtcgattcctgctgtgtttttttggaggtacwttccatgtgacttagactttaagggcacacagtgtccaaatccttcctcctatattcctaagttactaacgaccaattcagaccacatgacattcctgcaaagggtcaagaacatgctctaccctctggccctgtcctacmtttgccatrctktttctgccccttatgcaagycttgcctctgagctttttcagagagaggtgtcagtggtggatcttgtcagctatgcatccgtgtggctgttccgaggggactttgtgatggactaccccaggccgatcatgcccaacatggtcttcattgggggcatcaactgtgccaacgggaagccactatctcaggtctgtattggtgccttcatccaatcaatgttccaggcaaaayactttttaaaaaatgtatttacttacaagtgcttccatatctacttatctttccaaagattttattttggcttctttataacagataaactgttgaggggcctagtgtatttcaagttttcagtggtcactgagaggaagaagaggcacggaygagggtctgtcagaggatggacaaggactgctgtgactcacggacastgtttgtaaaggcaccatcttcatggttgtgcatgtccttcagctcggcaggatcagggacactacattcrgaactgatccatcctggggtttttgcttgcctgattttcagctgaacggtgatgcaacagtaaattagaattgtggacatgataatttttagtggtcccatcttgcgaaagatacagaggtgaccacaggagacctaggcactcacaggaagtagaagtgtcaaagaggttgactcagttgagtggaagtggggctgtgaaggtgggatggatgcatgtgatcagagaatgaaacatggagttcagtttccagagagggatctgtcctgagaaaagtttttctgaccaggagttgggggtctggtgtatgatgtggggacatcgtagagtttggaaggtatggtgatggttgcatgtcaaaagggtcttctacttggaatgctgaaattatcaagagtgggtggaagggactagggaggagataagaccgtgaatctataagcccagtgaagctgggaccagtgatgaatggacatgtgtccaagaagggaagtgtttctcaggtgaagctgatcatatcaccaaactcaccctatcccactccaagtttctatagtgggatctattctttttccaaaaatttcagaggtgactttcattaatacagaatatttgggtttcattgaaatagtactctgggatgtgaaaaaccaaattcacacaccaatgaatttggtttctaaatccattaagggagccatccttttttttttttttttcttgagactgagcctcgttctgtcrcccaggctggagggcagtggccggatctccgctcactgcaaccttcacctcccgggtttaagaaattctcccacctcagtctcctgagtaactgggactgcaggcatgtgccactgctcctggcaatttttttttttttttttttagtagagatgaggtttcgcaatgttagccaggctggtcttgaactcctgacctcatgtgatctgcccgcctcggcctcccaaagtgctgggattacaggcaagagccaccaagcccagtgagggagccatctttcttgtgagagaattgagcccttttttgtcatattcactgaatttatatgaacttccatgagtttaggtcctttgtattcttatttctgtacttctttttattagtgtaggtattattgcaaaggacactaaactttatttttgtttttgatcaaaccacaagatatttgttctactggttttcttttccccttatgcaatgtagttactgaattgtaaaaaatatatatgttctttagctttgtaaaaatgtggaaaattaggaaggcatttgaatagtgattgtggctcttttcttgtggtttttcactatgaatatattctttagactgaactgcactggctcaaatcttcactctcatttttctagctatgtgacctaggacaggtaccctaagcattgtggttttaatgttgttatagtgagcacccaataaatattatctgttatcattcttattattttagtttaattgcatttattttatgctgaatttcttccagagccataggtaawttttttcttcagtttcttctgggatatctttttcttctgtgcaacctcatcctcaggtttaggaacaatttgttccttatcagtaaagatcatcttgaatgtggcagtggggggtcatgtaagggttaatccaataatgagctctgcaagacgcatggctcatcttggatgctttgtttacttggataagcttaatgatgagagaatctacatctaaattgttatatttagcattattctctgcattttaaagcacrtgcagcaaaaatccagcaccctatttgggccaccgaccttgtgtccagccccactgctcggccctgggcacacttgccagcccctccattgcaatatcgaaatggtgcacactgcttccataaagtgacatccttcagacacttggtggctctttgtatatgcatacattgatggcctgggtagtttcacgaatgtcctttaagtgaacaggaaaactgaaacctcttgaattgcatgattttgtggtgtttctgggtcaagtgaataaagaagaattttcacagatcaccttaggcctcttagaggaagagctatcatcatcattagtagagtttaagactcctgcaggacaagatgtgtcacctggagacctttgccatgttcgtgccaatttactgagtgcatgaaagatcatttacaccaaaatctttatcatgtattatctgtgacagacaygccattatcatttttattacattgatttcctttgttattttgtcacccttacttacttggtttggttgacccttagatttgaaatttttctacaaatatacaagactaaagttgaaatcttacgtttcttctccctctctttctccttgatttaaagtttatggataggttgaattatttgattggtcttctcaaagaaataactgtggaatttgtatattcttttcactgtttcattttccgtttcgttaattgcagcttatttttgccttaatgatttcatcctagtttcttttggttgatttgtagctgcttttgcaacttcgttagaggactattacacttctttacatttgatttttcttaatgaagcattgagggctcgagtaaaagatttcttttacttaggttttggtaaaaattgctgttcttttcattgcttttagataatttaaatatcagtttttaaatttctcctttgatgcagtgactgtctataaggctgttacctaattctgatattgttaataattttgtagtcatctccctcttattttttcaagttattttgtattataataagaatgtttcttttttttttttttgaaggaaaaaataaatttattgctcattaagtggaagtggatcatcataaaggtcttcatcctcattgtctccatgctgagtgggctgaggaggaggaggaaggggagggattggtcctgctgtctcagcgtggcagaggcagaagaggatgagaaggtggaagggccagcgggagaggcaggcacactcggtgtaactttatggaaatatatcatcatttttgtttgacttttttcctttctcatttctctgaaaatgtttctgtacagtaccaattcttcttccaccatttgctttagtttcagtgcccaaaccatagaagggtccatgtggtaaaaaaagtcaaaactgacttttttttttttttttgagttggagtcctgctgtcacccaggctggagtgcaatggcacgatgttggctcactgcaacctctgcctcccaggttcaagcaattctcctgtctcagcctcacaagtagctaggactacaggcacacgtcaccacacctggctaatttttgtacttttagtagagatggggtttcaccatactggtcaggctggtctcgaactcctgacctcaggtgatccacccgcctcagcctcccaaagtgctaggattccaggtgtgagccactgcacctggtcaacaatcttttttttttttttttttttaatttatttttttattgataattcttgggtgtttctcacagagggggatttggcagggtcatgggacaatagtggagggaaggtcagcagataaacaagtgaacaaaggtctctggttttcccaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccgggcagaggggctcctcacttcccagtaggggcggccgggcagaggcgcccctcacctcccggacggggcggctggccgggtgggggggctgacccccccatctccctcccggacggggtggctggccgggctgaggggctcctcacttcccagtaggggcggccgggcagaggcgcccctcacctcccggacggggcggctggccgggcggggggctgacccccccacctccctcccggacggggcggctggccaggcggggggctgaccccccccacctccctcccggacggggtggctgccgggcggagacgctcctcacttcccagatggggtggctgccgggcggagaggctcctcacttctcagacagggcagctgccgggcggaggggctcctcacttctcagacggggcggccgggcagagacgctcctcacctcccagatggggtctcgccgggcagaggcgctcctcacatcccagatggggcggcggggcagaggcgctccccacatctcagasgatgggcggccgggcagagacgctcctcacttcctagatgtgatggcggctgggaagaggcgctcctcacttcctagatgggatggcggccgggtgaagacgctcctcgctttccagactgggcagccaggcagaggggctcctcacatcccagacgatgggcggccaggcagagacactcctcacttcccagacggggtggcggccgggcagaggctgcaatctcggcactttgggaggccaaggcaggcggctgggaggtgtaggttgtagtgagcsgagatcacgccactgcactccagcctgggcaccattgagcactgagtgaacgagactccgtctgcaatcccggcacctcgggaggccgaggttggcggatcactcgcggttaggggctggagaccggcccggccaaacagcaaaacccggtctccaccaaaaccagtcaggcgtggcggcgcgcgcctgcaatcgcaggcactcggcaggctgaggcaggagaatcaggcagggaggttgcagtgagccgagatggcagcagtacagtccagcttcggctctgcatgagagggagaccgtggggagaggcagaggcagaggcagaggcagaggcagaggcagaggaggcagaggcagaggaggcagaggcagaggaggcagaggcagaggaggcagaggcagaggcagaggcagaggcagaggcagaggcagaggcagaggcgcctggtcaacaatcttaagtccaataagaatgtttcttatgaagacactacttaaaaaattcttaataggttaccttgatggtctaatacagaattgtccaatagaaatataatgtaagccacatacataatttaaacttttctagtgggcatgttagaaaccagcaaaaagaaaccactgaaattaattttactaaggcattgtttaaccagacatatcacaaatattatcctttcaacatatattcgatataagattatgacttaactatttgacatagttttttcttgctaagtcttcaaaatctagcatatatctgacatttacagcatatctcaatttggaatagtcacatttcaagtgctcaatagtcatatgtagttagtgactaccatatggtcaatgtttacaaatgtaaacattgtaagagacttacattttcttcacatagtttgttgttatcattaaataataatccttaaaatccattttattggataccagtattgctactcctatgttattttttcaattccccatctcttttaatttgaaaatgatttgtaggcaggtgggtggctcacacctgcaatttcagccctttgggagactgatgcaggaggattgtttgagcccaggagtctgagagcagcctgggaaacgtgctgagactgcatctctacaaaaaatcaaaaaattatccaggtgtgatggcgcacacctgtggtcccagctactcaggaggctgaggcaggaggattacttgatccgaggaggtggaggctgcagtgtgccatgttcacaccacctcactccagcccgagtgacagagtgaggccccatttcaaaaaaataaaaatttctttggcatatggaaatcttgtttaaaaagtttagaaaacattttttaaaactccaatatgaaaagctgggtgcagtggcatgcgcctrtggtcccaggtacttgggaggctcaggtgggaggatcattgagctcaggagtttcagcacctgtggttttttgatttatttatttaaaacacaacaaaaaccaaaattgcttccatctcatagtcttttgatgtcagcattctgattctgtccactcttaatcttattctttccactgaatgtaagctcatttctttaacagaaatttcctttttccttattaattttggaatttcatggtacttttccacttttagggagatgcagtgcagcgtcttcaagtctcccactcttacgcctgtctccttcacttgtaagagccctygtgattacactgtcctgcccagatacccaggacaatctccccatcttaaaactcttaatttaatcatatctgtgaagtctcttccacctgtaacggaacatattcccaggtttgaggaagtacaatgtagatacttttgtggggctgtgattctgcctaccacagacactaagcttaaagtgaaacccacatcttattcaaggcttggaggttttcctctattcgrccatttaaatttaatttttgttccttttctccatagtcttctattctccaggcttcagagctatcagcttaccattcaattatctccttttttcctgatcttccttttttcatttttaaaaaacaatacctttcaaagagcaaaagttttagattttgatgaggttctttctagcaaagttttatcatttgttgtttttgtaccctaaggaatctttaccccaagatgtgaagattagtttctgtgttctcttacaaacattaaagaattccagtttgtgtgtttaggtctgtgagattggcagaggggaacaagaccacacaggtcagtctttcaggatgcttttttctgtctctggactttgctggggtgacctcactgacacccatggcttccacatatgcggatggctccaagtctatctgtgcagcccagacccctcctcatctccagaccctggaagctgatgacttgggcagctccttctgtttcccaggcaccaggagctcctccctccccatagttctgctatccttagggcccctaggtctctggagtaccaccgtcttccaagatacatgggcctcctcagggtctgggagtcccagacatgtgacaagaaatcagatgacttcactgtctaaataaaacactactacttggaggtagaacatgggagcccatgaatgtgggaagagcacactaccaggcgtgttccacccgtcacctgggctcatcatgagggtgcttaggaagcatatagttttaagggggttggaggaatagttcagaggctgagaggttgcacccacagctgagaatccctttctagtgctctatgtccttacaaattcccaggaatcatcctctactggacagttcccaaagcccttgcagaccttccttttctgtgccatcctgcgtgtgctgcccttgagctgggtgtcccccagtagacgcttccattcactgcctgtcccatgggttctgtccaaaggtggaatctgttatcaatgtggagtaatttcctccctaagggaagcctcagcctcaccagcaatggcagacacggccaggcaagaagacacaggggcagtgagatagaaagtgcacaccccagacagcctgcccacatcatcctgaggtgaccaggacaaggtggcatcagcaatcttgtgagcacagcacatgtgggagtgactttctggagtaggataagcctcattgggcttgaggcccttgtgagtgctcagggtctctcctttagaaaggcacatatttaattctccatcttgaaatttggactagggcccccacaaattgtgcagcccattctgttctggaggaaccattcttatcagaacttggtgctggattgacttggagaagagcctgaccataatcttcaggatgaaataaaggcctggatgactgaaataaagactggagccttcggcattcagaagaggaattcagactgtgcaagatctgaggccaggctccagctcccccagtcccttggtgagcaggagctccctgaacccaccrtgggtcyttgctagggttgtcttgcccatgtgtgctttagatagcagcacctcttcttccatggtgtatatggagaatcctcaacaaagtcttcccaagaatctgatcatcacatcttgagctcagcctccctgcagctttttctatattgacagccacttcagagagagtcctctytgatccttacaagaaatatcctggtgcgaaaaacgaccaaaaccacatagccagcctccacgctgttcagagaaagctggcttagcaatgttgtatggtttttggatgcgctgcgttactcatacatgagaagaaagtttcaagggttagcaaatagggtcacatccagcagagagcatatgactgggggctagggcaatggtgactcctcagacctcagctgctgcctgataaacatggttaacagagaagtaggagacagtgacatgaaatgggtgttcacagccttgtgttgggaattggatgagaaacaagagcttgaacttggatgttccccagagtgagcacagggtcagacgtgtttttcaagatagtcrtgatcggtcttttccagggtggggcccacagtgaaaaacagtgatagattaatggttaataattaactagaggagggcactctgtcttccaattacacgttgatttgctaagtggctcagtgacaaggtaattaagaygaagaaagcaaatgtagcaggcacagcgtggggtggacagtcagctgtccgtgtcttctgctgagatggccacaggactccaggttcccctgccgyggctggccacaggactgctgcttctcctcagtgtccagccctgggctgaragtggaaaggtgttggtggtgcccattgatggcagccactggctcagcatgcgggaggycttgcgggagctccatgccagaggccaccaggcagtggtcctcaccccagaggtgaatatgcacatcaaagaagagaactttttcaccctgacaacctatgccatttcgtggacccaggatgaatttgatcgccatgtgctgggccacactcaactgtactttgaaacagaacattttctgaagaaatttttcagaagtatggcaatgttgaacaatatgtctttggtctatcataggtcttgtgtggagctactacataatgaggccctgatcaggcacctgaatgctacttcctttgatgtggttttaacagaccccgttaacctctgcgcggcrgtgctggctaagtacctgtcgattcctactgtgttttttttgaggaacattccatgtgatttagactttaagggcacacagtgtccaaacccttcctcctatattcctagattactaacaaccaattcagaccacatgacattcatgcaaagggtcaagaacatgctctaccctctggccctgtcctacatttgccatgctktttctgctccttatgcaagccttgcctctgagctttttcagagagaggtgtcagtggtggatattctcagtcatgcatctgtgtggctgttccgaggggactttgtgatggactaccccaggccaatcrtgcccaacatggtcttcattgggggcatcaactgtgccaacaggaagccactatctcaggtctgtattggtgccttcatccaatcaatgttccaggcaaaacactttttwaaaaaatgtatttatttaaaattgcttccatatttacttatctttccaaatatttcatttctgcttctccttgtcataatagccttcagtgagataaactgttaaggggtctctagtagcgtatttcaggttttaaatggtcactgagaggaagaggaagtagacacgaatgtttgtaaaaggatggacaaggactggtgtgactcatagagactgttggtttgtaaaggcaccatcttcatggttgtgcatgtccttcagcttggcaggaacagggacactacgtttggaactgatccatcctggattttttgctagcatgattttcaggggaaagatgatgcaacagtaaattacaattgttgacatgataatttttagttgtcccatcttgcaaatgatagacaggtgaccacaggagacctaggcactcacatgaaatagaagtgtcagagaggttgactcagtggaagtggggcaatgaagttgggatggatgtctgtgattagagaatgacacacgaagttcagtttccagacagggatctgtgctgtcaagagattttctggtcaggatttggggtctggtgcatgatgtggggacatctcagagttcggaaagcaaagtaatggttgcatctcaaatgattcttctacttggaatgctgaaattatcaagaaatggcggaaggggctagggaggagataagactgtgaatctataagcccagtgaagctggggacagtgatgaatggacatgcgtccaagaagggaagcatttctcaggagaggctcatcacatcaccaaacccaccctactgcactccaggtttctatagtgggatctactcctttaccaaaaatttcagaggcagctttcattaatccagaatatttgggtttcgttgaaatggtactctgggacctgaatattgtttcttattccttgctgtgccatgtacatcgtgagagaatcagcctttttatgtcatattcaccgaatgtgtatgaacttccatgatttagatccttttgtattcttatttctgtgccttttttataaatgtaggtattattgcaaaagactctaagcttcatttttctttttgatcaaacgacatgatttttttatgcaatgtaattattcaattataaaatacgtgtttatttagatttgtaaaaatgttgaaaagtgggatggcatttaaatagtgactgttgcccttccagtttttctttcttttttttttttttattatactttaagttctagggtacatgtgcacaaattgcaggtttgatacataggtatacatgtgccatgttggtttcctgcacccaccaactcgtcatttacattaggtatttttcctaatgccatccctcccccagtcccccaccccacaacaggccctggcgtgtgatgttccctggcctgtgtccagtgttcttgctgttcagttcccacctatgagtgagaacatgcggtgtttggttttctgtccatgtgatagtttgctgagaatgatggtttacagctttgtccatctccctgcaaaggacatgaactcatccttttttatggctgcatagtattccatggtgtatatgtgccacattttcttaatccagtctatcattgatggacatttggattggttccaggtctttgctattgtgaatagtgccacaataaacatacgtgtgcatgtgtccttagagtagtatcatttataatcgtttgggtatatacccagtaatggtatggctgtgtcaaatggtatttctagttctaggtccttgaggaatcgccacactgtcttccacaatggttgaactaatttacactcccaccaatggtgtaaaagtgttcctatttctccacatcctctccaacatctgttgtttcctgactttttaatggtcaccattctaactggcgtgagatggtatctcattgtggttttgatttgcatttctctgatgaccagtgatgatgagcatttattcatgtgtctgttggctgcataaatgtcttcttttgagaagtgtctgttcatatcctttgcccactttttgatgaggttgtttgtttgttttttttcttgtaaatttgtttgagttctttgtagattctggatattagccctttgtcagatgggtagattgcaaaaattttctcccattctgtaggttgcctgttcactctgatggtagtttcttttgctgtggagaagctctttagtttaattagatcccatttgtctattttggcttttgttgccattgcttttggtgttttagtcatgaagtcctggcccatgcctatgtcttctaggccatgcctatgcctaaatgatattgcctaggttttcttctaggatttttatggttttaggtctaacatttgagtctttaatccatctggaattaatttttgtataaggcgtaaggaagggatcctgttccagctttctacatatggccagttttcccagcaccatttattaaataaggaatcctttccccattgcttgtttttgtcaggtttgtcaaagatcaaatggttgtagatgtgtggtgttatttctgagaccactgttctgctccattggtctatatatctgttttggtaccagcacccatgctgttttgttactgtagccttgtagtacagtttgaagtcaggtagcatgatgccaccagctttgttttttttttttttttgcttaggattgtcttggcaatgcaggctcttttttgattccatatgaactttaaagtagttttttccaattttgtgaagtcattggtagcttgatgggtttggcattgaatctataaattaccttgggcagtatggccattttcacgatattgattcttcctatccatgagcatggaatgttcttcsatttgtttgtgtcttcttttatttcgttgagcagtggtttgtagttctccttgaagaggtccttcacatcccttttaagttggattcctaggtattttattctctttgtagcaattgtgaatgggagttcactcatggtttggctctgtttgtctgttattggtgtataggaatgcttgtgatttttgcacattgattttgtatcctgggactttgctgaagttgcttatcagcttaaggagactttgggctgagacaatggggttttctaaatatacaatcatgtcatctgcaaacagggacwatttgacttcctcttttcctaattgaatgctctttatttctttctcttgcctgattgccctggccagaacttccaacagtatgttgagtaggagtggtgagagaggtcatccttgttttgtgccagttttcaaagggaatgcttccagttttcgcctactcagtatgatattggctgcgggtttgtcataaatagctcttattattttgagatacttccatcaatacctagtttattgccagttttaggcatgaagggatgtttaattttgttgaaggccttttctgcatctgttgaaataatcatgtggtttgtcattggttctgtttatgtgatggattacatttattgatttgcatatgttgaaccagccttgcatcccaaggatgaagccgacttgatcgatgtggataaactttttgatgtgctgctggatttggtttgcagaattttactgaggatttttgcatcgatgttcatcagggatatttgtctaaaattttctttttttgttgtgtccctgccaacctttggtatcaggatgatgctggcctcataaaatgagttagggaggattccctctttttctattgattggaatagtttcagaaggaatggtaccagctcctgtttgtacctctctggtagaattcggctgtgaggaaggggaacatcacatactggggcctgttgtggggtagggggagcggggagggatagcattaggagatatacctaatgttaaatgacgagttaatgggtgcagcacaccaacatggcacatgtatacatatgtaacaaacctgcacattgtgcacatgcaccctaaaacttaaagtataataataataataataataaaaagaatttggctgtgaatccatctggtcctggactttttttggttggtaggctattaattattgcctcaatttcagagcctgttgttggtctattcagagattcaacttcttcctgctttagtcttgggagggtgtatgtgtccaggaatttatccatttcttctagattttctagtttatttgtgtagacgtatttatagtattctctgatggtagtttgtatttctgtgggatcggtggtgatattgcctttactattttttattgcgtctatttgattcttctctcttttcttctttattagtcttgccagaggtctatcaattttcaaaatccatctcctggattcattgatttttttgaaggtttttttgtgtctctatctctttcagttctgctctgatcttagttatttcttcccttctgctagcttttgaatttgtttgctcttgcttatctagttcttttatttgtgatgttagtgtgttgattttagatctttcctgctttctcctgtggggatttaatgctataaatttccctctacacactgatttaaatgtgtcccagagattctggtatgttgtgtctttgttctcgtcggtttcaaagaacatctttatttctgccttcacttcgttatttacccagtagtcattcaggagcaggttgttcagtttccatgtagttgtgcgattttgagtgagtttcttaatccagagttctaatttgactgcactatggtctgagagacagtttgttgtgatttctattcttttacatttgctaaggagtgctttacttacaatcatatggtcagttttagaataagtgtgatgtggtgctgagaagaatgtatattctcttgacttagggtggagagttctgtagatgtctattaggtctgcttggtgcagagctgagttcaggtcctggatatccttgttaacctttggtcttgttgawctgtctaatatygacagtgggatgttaaagtctctcattattattgtgtgggagtctaagtctctgtgtaggtctctaagaacttgctttatgaatctaggtgctcctgtattgggtgcatatatatttaggatagttagctcttgttgttgaattgctccctttaccattatgtaatggccttctttgtctcttttgatttttgttaaagtctgttttatcagagactaggattgcaacccctgctttttttttgctttccatttgtttggtagatcttcctccatccctttattttgagcctatgtgtgtctctgcatgtgagataggcctcctgaatacagcataccgatgggccttgactctttatccaatttgccagtctgtgttttttaattgcagcatttagcccatttacatttaaggtaaatattgttatgagtgaatttgatcctgtcattatggtgttatcgggttattttgcccgttaattgatgcagtttcttcacagcatcgatagtctttacaatttggcatgtttttgcagtggctggtactggtgtttctttccatgtttagtgcttcctttaggagctcttgtaaggcaggcctggtggtgacaaaatctctcagcatttgcttgtctataaaggattttatttctccttcacttatgaagcttastttggctgcatatgaatttctgggttgaaaattcttttctttaagaatgttgaatattggcccccactctcttctgtcttgtagggtttctgcagagagatctgctgttagtctgatgggcttccctttgtgggtaacccgacctttctctgtggctgcccttaacattttttccttcatttcaactttggtgaatctgacaattatgtgtcttggagttgttcttctcgaggagtatctttgtggtgttctctgtatttcctgaatttgaatgttggcctgccttgctaggtttgggaagttctcctggataatatcctgaagagtgttttccaacttgtttccattctccgcatcactttcaggtacaccagtcaaacgtagatttggtctttccacatagtcccatatttcttcaaggctttccttgtttctttttactcttttttctctaaccttgtcttctcactttatttcattaatttgatcttcagtcactgataccctttcttccagttgctctaatcagctattgaattttgtgcatgtgttatgaagttcttgtgccatggttttcagctccatcaggtcatttaaggtcttctctacagtgtttattctagttaggcattcatctaaccttttttcaaggttcaaccttccttgcaataggttcgaacatgcacttttagcttggagaggtttgttactaccaaacttctgaagcctacttctgtcaactcgtcaaagtcattctctttccakctttgctccattgctagcaaggagctgtgatcctttggaggagatgtgcttatgcgctatggtttttagaattttcagcttttctgctctagtttccccccatctttgtggttttatgtaccttaggtctttgatgttggtgacctacagatggggttttggtgtagatgtcctttttgttgatgtttatgctgttcctttctgtttgttagttttccttctaacagtcagatccctcagctgcaggtctgttggagtttgctggaggtccactccagatgctctttgctttggtatcaccagtggaggctgcagaacagcaaatattgcagaacagcaaatattgctgcctgatccttcctctggaagcttcataccagaggcgcacccacctatatgaggtgtctgttggcccctactgggaggtgtttcccagtcaagatacacagaggtcagggacccgcttgaggaggcagtctgtccattctcagagctcaaatgccatactaggagaacgagtgctctcttcagagctgtcagacagggatgtttaagtctgctgttccccacatgttcagaakttgtctgctgccttttgttcagatatgccctgcccacagaggtggagtctatagcggcagtagcccttgctgagctgcggtggactctgttcagttccagcttcctggatgctttgtttacctactcaagcctcagcaatggcggacacccctcacccagccaggctgccgcctcacagttcaatctcagactgctgcactagcagtgagcaaggctccgtgggcatgggagctgctaagccaggcaggggagagaatctccttgtctgccagtttataagaccttgggaaaagcacagtatttgggtgggagtgtcccgtttttccaggtacagtctgtcatggctccccttgtctaggaaagggaaatccctcaccctcttgcacttcctaggtgaggcgacgccctgccctgcttcggcttgccctcagtgggatgcacccactatccaaccagtcccaatgagatgaaccaggtacctcagttggaaatgcagaaatcatccatcttctgcgtcgatcatgctgggagctgcagatcggagctgttcctatttggccattggtgctgaagcttccgttctcctctccaacacctcctttttttttccttttctcttccagtttttcaatgtgaacatattctctagagttaactacattggctcaaatcttcactatcatctcagtggagcagaacaaattgggaactgtggcacaggtcactcttgctatgccccttaagaattccacattaacaaagctaattttcgagtgtggtaaagaacaggctagtgtatttagtagtgagtccattgactgtttcccaacatgaggtcacactagatttaatatggtttggctctgtgycccccaccaaatctcatcttgaattgyaatccccataatccccacgtgttgaggacaggacatggtgggaggtccccacctcctmatctcatcatagtgagtgagttcttatgagatctgatggttttataaggggcccttatcccttcacttgcaagctattcctctttctctctttcatgtaagacgtgtctttgcctctctctcactttctgccaggattataagtttcctgaggcccctccagccacatggaactggagtcaattaaagctctttcctttataaattacccagtcttgggtatgtctttatagcagtgtgtgaatggactaatacagtaaattggtgtcatggagagtggggtactgctataaaactacttgaaaatgtggaagtgacttggaactgggtaacaggcagaggctggaacagtttggagagctcagaagacaggaagatgtgggaaagtttggaacttcctggagacttgttgaacggttttgaccaaaatgctgataatgttgtggacaatgaagtccaggctgagtctcagatagagatgaggaatctgttgagaactggagcaaaggtcactcttgctaagctttagcaaagaaactcgtggcatttttgcccctgccctagagctctttggaactacgaacttgagagagatratctgaaattggaacttatgtttaaaagggaagcagagcataaaagtttggaaaatttgcagcctgaccatgtggtagaaaagaaaaacccattttatggggagaaattcaagccagatgcagaaatactagctaaagaaatttgaataaataaggaggarccaaatgttaatcaccaagacaatggggaaaatggctccagggcatgtcagagacctttgcagcagaccctcccatcacaggcctggaggcctaggaaggaaaaatggtgttttaggctgggtccaggcccccactgctgtgtgcagcctcaggacttggtgccctgtgtcccagtggctccagccatggctaaaaggggccaaggtagagctcaggccattgcttcagagggtgcaaacctcaagccttggcagcatcgatgtggtgttgggcctgcgggtacacagaagataagaatttaggtttgggaacctccacataaattttagaggatgtaaggaaatgcttggatgtccaggcagacgtttgctgcatggatagagtccttatagagaacctctgctagagaagggtggtaaagaaatgtgaggttggagcccccacasagagtctccactggggcaytgcctagtggagttgtgagaagaaggccacagtccttcagaacccagaagggcagatccaatagcttgcactgtgtgcctggaagagccacagacatcaatgccaccctctgaaagcagccaggacgagggctttaccctgcaaagccacagggttggagctgcctgagaccgtgggagcccatttctggcatcaccttgatctagatgtgagacatgaagtcaagggagattattttggagctttaagatttaatgactgccctgcctggttttggacttgcatggggcctatagcccctttgttttggccagtttctcccatttgaaatgggaacatttacccaatttctgtacccccattgtgtcttggaagttactaacttgtttttgattttacaggctcatgggggaagggacttgacttgtctcagatgagaccttggactatggacttttgagctagtgctgaaatgagttaagactttggaggacagttgggaaggcaygattggtttttaaatgtgaaaagacatgagatttgggatgggccagagggcagaatgatatgatttgactgtgtgtttccacccaaatctcatctcatattgtaatttccataatccccatgtgttaaggttggtacctggtgggagctgattgaatcatatcggcagttttccccatgctgttcttgtcatactaagtgagttctcatgagagctgatggttttataagggactctttctcctttactcacaagcttttcctctctgtctctcgcctgctgccatgtgagacatgcctttgcttatctctcaccttctgtcatgattgtaagtttcctgaggcctccccagtcatgtggaactgtgagtcaattaaacctctttcttttataaattacccagtctcrgctgcgtctttatagcaggctgagaatagactaatacaagattggtggtgattgaagttatactgaaagggtttaaaggagagtctgagaaaaggaaatgaatctgcatttattgagaaagttgatgagaaagtggaattagaaattcctagaaaggtaagttgttgtgtgaattatttcccaaaatggggaagtctctctacctgtttggagacagaaagtggaatcagaggagaagaagatgatggacagaaaggatcattccctcttccagatgctttccagtgtgtgatgtaagctgaactaaaatcagctgtgttgaactccagccagaaaaaatgtccggcattttgttttttgggaccctaatgaaatggttacaggtctccaggtctcttggggctcacagggtcatgcctttccttgcccagtgtacttggtragaaggtacaggtgtttccatggagggtgttcattttagggatttcaagagggtcatctttgcaccacaggaaatgcccccttttacactctgaaaaccttatcaaaccgttgtataaaagatgaatacccacataacaggctctagcactgttctgtttttgagctgagacattttaaaaggagatttttcaattctaaaaattctttaaataaaatgctcttgcagggacaacatagtaggtcaacattgttcccatctccacaaaaagttttttttttaattagctaggtgtggtagcatttctgtagtcctagctactgggaatgctgaggaggaaggatcacttgagcccaggaattcgtggttacagtaagctatgatcttgcctaggtaacagctacagagcgagaccctgtctttaaaacaaacaagcaaacagacaatcaagctttacacttctataaaagcaacactttccatttatgacagcactaatccaggatatatcaaaactgaacttgtgtttgctttcaactgttaaaactagccagagttgttacagacccactacctctgagtgacactggtatgccactctttgctgaccactgaacaatgggatttatgtacccaattgtgtagatacacaccaactcattctactctacccagagtagtgatttccaacacacaaaaccacaatgaaactgcccatgcctttctaccactttgaaactcctttcatccctgaactgctccaaaagcaaacctactcagcaaactactcagtgagtatcttcacacatgtaagttccctcgtctgatgtacaaaaaactgaactcatttttcaaaagccttaacagtctgtcttattctgatacttcttktatggttattgtatgagaatcaactacccaggcacctcggagyatgttgatttcagagttcagtgtcagaccccatgagcccctgtgggatggtgccagctgactgccatgttcctgctgtttattgcttgggtgccattacatgcagagtggactctgagggttctagagcatatccaaacccatatcacactctttgttggttaatgatgtgttcaggccatgatttttctgtaaaaaattaccagcatgctgctcttaatttttttcagcctatccagttcagttgccttttgctctcatgccttatgcaaacctttcctcagaggtgaccctagaagaagggaccctttgtgatggaaaaggtcytcatttggggcataacctgtgccaacagaaaggtactttctygttgtgtttatggtgcctcacccaaaaaatattacagatacacttggctttcatcaacctaatttgatatgtcccaagcatagcaataggatagttctgtgtggccttatggagatcctttttttacatttccaggacccactgccaagaccagcttggtcgtggagaccctaacccagcagcgctagacgaattaaagacacacacacagaaatatagagtgtggagtgggaaatcaggggactcacagccttcagggctgagagccccaaacagagatttacccacatatttattgacagcaagcctgtgataagcatcatttctatagattatagattaactaaaagtattccttaygggaaacaaagggatgggctctggctaattatctgcagcagaaacatgtccttaaggcacagatggctcatgttattatttgtagtttaggaacaccttaagcggttttcctccctgggtgggccaggtgttccttgcccttattccagtaaactcacaaccttcagcataggcatcatggctatcatgaacacgtcacagtgctgcagagattttgtttatggccagtttaggggccagcttctggccggaattgggggcttatccccagcaacctaccatagttggagaaccacgttcaggctgaagacagtcctagtataccaccgaccaaccatgtaaccccaaggtttgtcctcagccttcagagggaacatgcttccaccgatttcagctcagtgatatgggattcaaatgtctgacctccaaaatattaagataataaatgcatgttgttttgaaccatcattaaattaagccagaagtattgatattatttgtagatttcaccactacacactaaacaataaagtcaaatgatttagagcaaaccacctggctcacactttcccaacggaaaaaggtaatgctcaaagtgctgaactgaacattctgtcctaccactagcaaataatcattgtctgcctcaggcttaagtttaataaatagcaaattgcatacagatattttacaaygatygaaagacaaacagaggtcctatccgtgyagtcccaacrataagaacaggyrttggcatraagtgtttataaattcttgggtacagctgttctgaaagtaaagttcactttcaatcctaaaaaaagtccgctattcctccagatgtgcttaaagtcaaatgtggactggaattacttggtgtcaatgsggagyaactgctctwtgcyrtttattatgaaggactttaactcaactctccatcttcctccacttccaccctttcttggccattctcaatgattctcttggtggtgatttttttaccatcaactatttcagtggaagtcgacatggacttgaagctgcctgtcccatcactaccgtaggacatgcagaaggaagaaaggcccccacttcccagggagccaaaggaacgaaatcctgtatcaaaagaagaaaaamcacccccaaaagctggaaattcactgaaggcagagaaaaggggtgcagacgctctgcttctgcttccccagcagttcctcygaccccccmaaaatattctccagcgggtttcccaagaggtcaaaggagaatgggtccyggccgccgaagaaytccctgaagacstcggctgggtcgcggaagctgaagacgtactcgaagggktcctcgaagggcctgccgcctgtgcagccgccctccgcscccgcctcgccatagcggtcatagatatcgcgtttcttggcgtccgacaacacctcgtaggcctcggccacctgcttgaatctcctctccgcttcctccttgttctcagggtttttgtcggggtgccacttgagcgccagcttgcggtacgccttcttgatggcctcggatgaggcctgccggggcacgtccagcacctcgtagtagtccaccatgctggatggccagaacggcccaccaggcactggcacagcgagcggcaaggctgccagcacccaggygcaggcccgagtgctcggagacctgggccgcctggagagacgccccttatgacgcagccacatctcattggtcgaggcctatgagcgcctcgcatcccaagatgcagtgcttctgggactggccctgctctctgtgaggctctgtgaggccctgtgatgctccaagaccaggccccgcccactccggcctccaaccagccatggtctccaaaaaggatgggaaaaagaggttggggaaaagagagggccttgactttggctgcctgaagaactgtttttcttaaagtaggctttatatcagtctttttcctcggccacaggagggaagagggtggtgggagtgagtttagtctgactggggctgaagacatcctgttgtttaggactgcagttctccaacgttccagccccggtgcccatttgcttttgttcatgtggattatatctatcatacgtactgcattagagattaaaacagaattaaaaagacatattaattgggcaatttagtaagaataaacccatgacacaatagcaaatcttatttttatgtaamttttattaagacaaaatgtagtgagaagagtggcatcgttttacagtttttgcatctctctttagtacttggctctatagagaggtggattctcatgtcagcttctgtattcaatctactgtgatattacacatcacccatgtagcttctggaaaactccactgtacacttgtgagagaatgacggtgaaaaaatcaagtagcattattatggaaatagttttaactttgcaaaattctcctgaaaaattcttggggatccctaggatttcctggctcatactttgagaatcgctagtctagcagagtagtccttggtattctgaagggattagtttaggacaaccctcctctccataccaaaatctagatgctcaagctccttttataaaatgacacagtatttgtatataacctaccaatatccttctttaagcctctagtcatctcttgattacttttacctaataaatgtaaatgctatgtaaatagttgttttacagtattggttttttatttgtattatttgtattgttttttcattgctcttccccccaaatatttttaatctgctgttggctgaatctgcagatgtgaagcccaagtatatggagggtcaaatgtgcatgttattcacttttcttgactgctaaaacaaccagggagatcctctcagacaaaaggaaatacagcactatttactgtatcgaaaccattaagacttgcaggccgtgtgtatagcactggggataaacgtgggatgcagtgattatttccactagaactgctatatcatgaccatgaattttgggggaatttttttgagatctgagttctcttcacctccttattctctttttgacactggattcttttctttgataaattgtgaggcaatacactagtaaaggtcactcagttctaaggggaaaatgattaaccaaagaacattctaagatttcctatagggtattaggtctaatggggatgtgttatgtcaccagaacaaacttctaagtttatatagcctctagtgacataacctgagacccggacttggcacttggtaagcacacaatgaacagtcatagaaagctggccgagggtagagttcagtgtgaacaaagcaatttgggaacatcaaagcaagtttggagaacaacaagtgatccagaatggctggagggtaagaggcagagggagggggcaagcagaaggggtggagaggaggaatgagcttagacaggggggctggggtctatcccagagttttgagagcaaggcagaggactctgaattttcttctgtgcccaggaagctgctgaccaaggttccagaagtgttggtggggtggcgtttttcagggagcagctgaggcagtgattcagaagggacagctgggggttgggcaactgggggacaggggccctgaaatgggaccatgacagctgggtctgagagacagtggtagaaacatccagattcagcacttacttgctggcttggatgcagggtctagaacgaaaagagaagaggagtcacttctatacagaaacatgtccagagtgcttactgtctgcaaaactgtggactggcacctgagtgatagcatgattccaaagccaaaatcttgcctgtaaggaatatatgtataggatatagctatactctaatagcaaggacagatatgcaaactgctaaaagatacaaggcagaacagaacaaaacgctgtggggattcaaggaaggtggctttgtttcccttggagggccctgtagatgatctacagggcaatggacatgtttatgttgctcctttagtaacaagtcccttcattctgatttgatgaaaggagctgggagtgtgtccaatggtgacctattaacttatgtcttcagcttaaaaagaaagtaccttcaaaagggttccagaaacactttccatggacatgtcactcttyagtagcccccaaagcaagaccatcatattgctgccctgctgtgtgacttcttagcccctagagcaccacaccctgtaattgcctagttgtgagtttgtctctgttcacctgacccctcctttcaggcaaggaccatttctaacttggctttctgtccckagttcctagmatagtaggtagggctcacacattccataaatatttggtggataagggaattagcaatggattctgctttggttccaaagcagagattaattggattgcttagtagtggttttctgttgtaattcatgagcgtgaatgtggattgcctactattgcctaccactgttggggacctctcagacctcagctgcagcctgataaacgtggttaacagagaagtaggaggctgtgacatgaaatgggtttccacaggcctttgttgggaattggatgagaaacaagagcttgaacttggatgttccccagagcgagcgcagggtcagatgagtttttcaagtaggagtgatcggtctttcccgaagtgggacccataatgaaagacaatgattggttaatcggtaataattaactaggaggagagcactctatcttccaattacatgatgatttgctaagtggctcagtgacaaggtaattaagatgaagaaaacaaatgtaggaggcacagcgtggggtggacagtcagctgtccgtgtcttctgctgagatggccacaggaccccaggttcccctgctgtggctggccacaggagtgctactccttctcagtgcccagccctgggctgagagtgggaaggtgctggtggtacccattgatggcagccactggctcgcatgcgggaggccgtgcgggagctccatgccagaggccaccaggcrgtggtcctcaccccagaggtgaatatgcacatcaaacaagagaaatttttcaccctgacaacctatgccatttcatggacccaggatgaatttgatcgccttgtgctgggccacactcaactgtactttgaaacagaacattttctgaagacattttctaraagtatggcaattwtgaaaaattcatctttggtctttcataggtcttgtgtggagctactgcataatgaggccctgatcaggcacctgaatgytacttccttcgatgtggttttaatagacccaatttacctctgtggggcagtgctggctaagtacctatcaattcctgctgtgttttttttgaggaacattccatgtgatttagactttaagggcacacagtgtccaaatccttcctcctatattcctaagttactaacgaccaattcagaccacatgacattcctgcaaagggtcaagaacatgctctaccctctggcccygtcctacctttgccatgctctttctgctccttatgcaagccttgcctctgagctttttcagagggaggtgtcagtggtggatcttstcagccatgcatctgtgtggctgttccgaggggactytgtgatggattaccccaggccgatcatgcccaacatggtcttcattgggggcatcaactgtgccaacaggaagccactatctcaggtcggtgttygtgccttcatccaatcaatgttccaggcaaaacagtttttaaaaattgtatttacttacaattgcttccatatctacttatctttctggtgcttttatttctgcttgtcgtaatagccttcagtgagataaactgttaaggggtctctagtagcrtatttcaggttttaaatggtcaatgagaggaagaagrggcagacatgaatgtttatcaaaggatggactaggactgatgtgactcatggagactgttcgtttgtaaaggcaccatcttcatggytgtgcatgtccttcattgggaaggagcagggacactacattgagacttgacccatctggattttttgtttgcacaattttcaggggaaagatgatgcaacagcaaattacaattgttaatgtgataatttttagtggtcctgtcttgcgaatgatagagaggtgaccacaggagacctaagcactcgcaggaagtagaagtgttaaagaggttgactcagttcagtggaagtagagcaacgaacgtgggatatatgtctgtgattatagaattacacactgagttcagtttccagagagggatctgtgctgacaaaagatttttctggtcaggatttggggtctggtgcatgatgtggggacatctcagagttcggaaggcatagttttggttgcaggtcaattgggtcttctacttggaatgctgaaattatcaagaaattgtggaagggtctagggaggagataaaactgtgagcgtataagcccagttaagctggggacggtgatgaatggacatgtgtccaagaagggaagtgtttctcaggtgaagctgaacatatcaccaaacccaccctatcccactccaagtttctatagtgggatctacttctttaccaacaatttcaaaggcagctttctttaatccagaatatttggggttcattgatgtggtactctgggacctgaatattgtttcttattccttggtgtgccatgtatttcatgagagaattcagcctttttatgtcatattcactgaatgcatatgaacttccatgacttgatccttttgtatttttatttctgtacttctttttattaacataggtattattgccaaacactctaagcttcattttttaaaatcaaaccacatgatttttttattggtgattttctcccttatgcagtgtagttattcaattataaaatatgtgtttattagatttgtaacaatgttgaaaagtgggatggaatttaaatagtgactcttgcccttttcttccagtttttcaatgtgaacatattctctagtgttaactacattgctcaaaacttcactgtcatctcagtggagcagaacgaattgggaactgtggyacagatcactcttgctatgccccttagagaattagagaacactagcaaggctaattttcgagtgtggtaaagaacaggctaatgtattcaatagtgaggccactgactctgtctcaacatgaagtcacactagrtttatcatgatttggctctgtatcccccaccaaatctcatcttgaattgtaatccccataatccccacgtgtcaaggacaggatctggtgggaggtgmttggatcatgggggcagtttcgcacctgctggtctcatcatagtgagtgagttcttatgagatctgatggttttataaggggccattgtcccttcacttgcaagctcttcctctttctctctttcatgtaagacgtgtctttgcctctctctcactttctgccaggattataagtttcctgaggctcccccctccagccacctggaactgtgagtcaattaaagctctttcctttatgaattaccgagtcttgggtatgtctttatagcagtgtragaatggactaatatattaaattggtgccatggagagtggagtactgctataaagatacttgaaaatgtggaagtgactttggaactgrgtaacaggcagaggttggaacagtttggagagctcagaagaagacaggaagatgtgggaaagtttggaacttcctagagacttgttgaatggttttgaccaaaatgctgataatgttgtggacaatgaagtccaggctgagtctcagatggagatgaggaacttattgggaactggaacaaaggtcacccttgctatgctttagcaaagagactggtggcattttgcccctgccctagagatctgtggaactttgaacttcagagagatgatctgaaattggaacttatgtttaaaagggaagcagagcataaaagtttggaaaatttgcagcctgaccatgtggtagmaaagaaaaacccattttatggggagaaattcaaaccagctacagaaatactggctatagaaatttgcataagtaaggaggagccaaatgttaattgccaagacaatggggaaaatggcttcagtgcacatcagagacctttgcagcagaccctcccatcacaggcctggaggcctaggaaggaaaaattgttttgtgggctgggtccatgctccccctgctgtgtgcagcctcaggacttggtgccctgtgtcccagtggctccagccatggctaaaagaggccaaggtagagctcaggccattgcttcagagggtgcaaacctcaagccttggcagcatcgatgtggtgttgggcctgtgggtacacagaagataagaatttaggtttgggaacctccacataaatttgagaggatgtaaggaaatgcttggatgtccaggcagaagtttgctgcatggatggagcccttatagagaacctctgctagagaagggtggtaaagaaatgtgaggttggagcccccacacagagtctccactggggcactgcctagtggagttgtgagaaggcggccaccatcctccagaatcccaaatagtagatccaatagcttgcactgtgtgcctggaaaagacacagacactcaatgccagcctctgaaggcagccaggaggagggctttgccctgcaagccacagtgtccaagttgcctgagactgtgggagcccacttctggcatcagcatgacctagatatgagacatgaagttaaaggtgataattttggagctttaagatttaatgactgccctgcctggttttggacttgcatggggcctgtagccccctttttttggccagtttctcccatttggaatgggaatatttacccaatttctgtacccccattgtgtcttggaagttacttttgattttacaggctcatgggggaagggacttgccttgtctcagataagactttggactatggacttttgagctagtgctgaaatgagttaagactttggaagattgttgggaaggcacgattggttttgaaatgtgaaaagacatgagatttgggaggggccagagggcagaatgatatggtttgactctgtgtttccacccaaatctcatctcaaattgtaatctccataattcccatgtgttaaggatgggacctggtgggaggtgattggatcatgtgtgcagtttcccccttgctgttctcatcctactgagtgagttctaatgagagctgatggttttataaggggctcttcctccttcactcacaagtgaactcttcctctctgtttctctcttgcttgctgccatgtgagacatgactttgcttatctctcaccttctgtcatgattgtaagtttcctgaggcctccccagccatgtggaactgagtcatttaaacctttgtcttttataaattaccccgtcttgggtatgtctttatagcagtgtgagaacagactaatacaagattggtggtgattgaagttatactgaaagggtttaaaggagagtctgagaaaaggaaatgaatctgcatttattgagaaagttgatgagaaagtggaattagaaattcctagaaaggtaagctgttgtgtgaatgatttcccgagatggggaagtctctctacctgtttggagacagaaagtagaatcagaggagaagaagatgatggacagaaaggatcattccctcttctagatgctttctagtgtgtgatgtaagctgaattaaaatcagctgtgttgaactccagccagaaaaaatatctggcattttggttttttggaccctactgtgatggtcacaggactccaggtctcttggggctcacagggtcatgcctttccttgcccggtgtgcttggtgagaaggaacaagtgtttccatggaggaaattcattttaggggtctcaagagggtcatctttgcaacagaggaaatgcccctttttccattctgaaaacctgatttatcgaacccttttataaaagatgaatacccacatataggcctctagcagtgttatgtttttgagatgagacattttaaaaagcgatttttcaattctaaaaattctttaaataaaatgctcttgctgggacaacatagtgggtcaacatcattcccatctctacaagattttttttaaaaaaacattagctaggtgtggtagctgttgtcttagttactgggaatgctgaggaggaaggatcacttgagcccagaaattcatgtttactagtggggtatgatcttgcctaggcaacagctacagagagagaccctgtctctaaaacaaacaaacaaacaaacaaacaataaccaaacaagctttacacttctgtagaaggaacacttcccatttatgacatcagtaatctaggatatatcaaaatttgaactttgtgttagctttcaactgttaaaactagccagcgttgttacagatccacctctgagtgacactggtatgccactctttgctgaccactgaacaatgggatttatgtaaccaattgtgtagatacaaacccactcattctatcctacccagagtggtgatttacaacacaaaaaactaccatgaaactgttcccatgccttcctcccacctcaaaactccttttattcctgaacggctccataagcaaacccatccccagcaaactactcagtgagtatcttcacacatgtaagttcccttatccggatcactaaaaaatgaactcatttttcaaaagccctgacagtctgtcttattttgatacttcttgtatagttattatttaagaagcaactacccaggcaccttggagcatgttgatttcagagttcagtgtgagaccccgtgtgcccctgtgggatggtgccagctgactgccattttcctgctgtttattacttgggtgccattccatgcagattggactctgagggtactagagcatatccaaacccattgtcacagtatttgttggttaatgatgtgttcaggccatgatttttctgtaaaaaattaccagcatgctgctcttaatttttttcagcctgtctagttgttgcccttttgctctcatgcaaacttttcctcagaggtgaccctagaagatgggaccctttgtgatggactaccccaaggcaatatgccccaaaaggtcttcatytggggcataacccgtgccaacacaaaggtactttctcaattgtgtgtatggtgcctcacccaaacaatattacagatgcacttggctttcatcaacctaatttgatatgccccaagcacagcaataggacagttttgcgtggccctttggaaacgcttttctttacatttccaggacctaccatagttggagaaccacgttagggctgaagacagtcctagtatatcattgaccaaccacataaccccaaggtctgtcctcagccttcagaaggaacatgcttcttacaccgatttcagctcagtgatatgggattcaaatgtatgacctccaaaatattaagagaataacgtgtgttgttttaagccaccaagtttgggtaatttgttacagccatgataggaaacgaatgcatccactttgccaggtttacctgcttttataaagcctgggtttaaccttttatctaaataatggtcaactcttcctacatcacgagcatttatgtgcaattaaaagccatcattaaattaagccagagtattaatatattcatagatttcaccaccacacagtaaaacattgaagtcaaatgatttagagcaaaccacctggctcacactttcccaacggaaaaaggtaaggctcaaagtgctgagatgaacattctgtcctagcactaggaaataatcattgtctgcctcaggcttaagtttaataaatagcaaattgcatacagatatttacaatgatcgaaagacaaacagaggtcctatccgtgyagtcccaacaataaagacaggcattggcataaagtgtttataaattcttgggtacagctgttctgaaagtaaagttcactttcaatcctaaaaaaagtccgctattcctccagatgtgcttaaagkcaaatgtggactggaattacttggtgtcaatgsggagyaactgctctwtgcyrtttattatgaaggactttaactcaactctccatcttcctccacttccaccctttcttggccattctcaatgattctcttggtggtgatttttttaccatcaactatttcagtggaagtcgacatggacttgaagctgcctgtcccatcactaccgtaggacatgcagaaggaagaaaggcccccacttcccagggagccaaaggaacgaaatcctgtatcaaaagaagaaaaaccaccctcaaaagctggaaattcactgaaggcagagaaaaggggtgcagaccctctgcttctgcttcccagggagttcctctgaccccccaaaatattctccagcgggtttcccaagaggtcaaaggagaatgggtccyggccgccaaagaactccctgaagacctcggcggggtcacggaagctgaagacstactcgaaggggtccttgaagggcctgccgcctgcgcagccgccctccgccctcgcctcgccatagcggtcatagatatcgcgtttctacgcgtccgacaacacctcgtaggcctcagccacctgcttgaatcttctcaccgcttcctccctgtcctcggggtttttgtcggggtgccacttgagcgccagcttgcggtacgccttcttgataccctcggacgaggcctaccggggtactcccagcacctcgtagtagtccactatgctggactgccaaagagcctgcggggcactggcacagcgagcggcaaggctgccrgcacccgcgcacaggtcagaggcttggcgacctgggccgcctggagggccgccccttatgacgcagccacatctcattggccgaggcctktgagcgcctcgcatcccaagatgcagtgctcctgggactggccctgctctctgtgaggctctgtgaggccctgtgatgctccaagaccaggcccsgcccactccggcctccaaccagccatggtctccaaaaaggatgggaaaaagaggttggggaaaagagagggccttgactttggctgcctgaagaactgtttttcttaaagtargctttatatcagtctttttcctcggccacaggagggaagagggtggtgggagtgagtttagtctgaccggggctgaagacatcctrttgtttaggactgcggttctccaacgttccagccccggtgcccatttgcttttgttcatctggattatgcctatcatatgtactgcattagagattaaaacagaattaaaaagacatattcattgggcaatttaagaagaataaacccatgacacactaacaaacctttttatgtaactttttttgagacaaaatgtagtgagaagagtggcatcgttttacagtttttgcayctctctttagtacttggctctatagagaggtggattctcatgtcagcttctgcattctatctattgtgatattacacatcccccatgtarcttctggaaaactccactgtacacttgtgggagaatgacaatgagaaaatcaagtaacattattacggaaatagttttgactttgyaaaattctcctgaaaaattactggggatccctaggatttcctggctcatactttgagaatcgctagtctagcagagtagtccctggtattctgaagggattagtttaggacaaccctccttccccataccaaaatctagatgctcaagctccttttataaaatgacacagtatttgtatataacctacccatatcctcctttaaacctctagtcatctcttgattacttttacctaataaatgtaaatgctatgtaaatagttgttttacagtattggttttttatttgtattatttgtactgtttttttttcattgttgttccccccaaatattttcaatctgctgttggctgaatctgcagatgtgaagcccaagtatatggagggtcaaatgtgcatgttattcacttttcttgactgctaaaacaaccagggagatcctctcagacaaaaggaaatacagcactatttactgtatcgaaaccattaagacttgcaggccgtgtgtatagcactggggataaacatgggatgcagtgattatttccgctagaactgctatataatgacgatgaattttggggggactttttttgagatctgagttctcttcacctcctccttattctctttttgacactggattctttgctttgataaattgtggggcaatacactagtaaaggtcactcaattccaaggggaaaatgattaaccaaagaacattctaacggttcataaagggtattaggtgtaatgaggatgtgttatctcaccagaacaaacttctgagtttatataacctctagttacataacctgaaacccggacttggcacttggtaagcacgcaatgaacagtcatagtaagctggccaagggtagagttcagtktgaacaaagcaatttgagaacatcaaaggaagtttggggaacagcaagggatccagaatggctagagggtaagaggcagagggagggggcaagcagaagggctagagaggaggaatgagcttrgacaggtgggctggggtctatcccagagttttgagagcaaggcagaggactctgaattttctgtgcccaggaagctgctgaccaaggttccagaagtggtggtgaggtggggttattcaggtggcagccgatgcaatgattcagaagggacagctgggggttgggggacaggggggctggggccctgaaatgggaccatgrcagctgggtctgagagacagtggtagaaacatccagattcagcacttacttgctggcttggatgcagggtctagaacgaaaagagaagaaaagtcacttctatacagaaacatgtccagagcgcttactgtctccaaaaccatggactggcacctgagtgatagcatgattccaaagccaaaatcttgcctgtaaggaatatatatatatatatatatatatatatatatatatatatatgtatatatgatatagctatagtctaatagcaaggacagatatgcaaactgctaaaagatacaaggcagaacagaacaaaatgctgtttttctgggattttggaaattcaaggaattcaagggattcaaggaaggtggctttgcttcccgggagggtcctgtagatgatctacagggcactggacatgtttatgttgctcctttagtaataagcctgtcattctgatttgatgaaaggagatgaaaggagctggkagtgtgtctgatggtggcctactaacttatgtcttcagcttaaaaagaaagtagcttcaaaagggttccagaaacactttccatggacgtgtcactctttagcagcccccaaagcaagaccatcatattgctgccctgctgtgtgatttctcagcccctagagcaccatcccctgtaattgcctggtcatgagtttgtctctgtctacctgacccctcctttcaggcaaggaccatttctaacttgactttctgggcctagttcctagcatagtgactgccatccagtagggctcacacgttccataaatatttggcagatgagggaattagcaatgggttctgctttggtttcagagcagatattaattggattgcttagtagtggttctctgttgtaattcatgagcatgaatgtggattgcccactattcagattagtaagtatttcttggtcaagggcagagctgtggccacaaaccatccaggtacacagcagaagcagcctcaaaaagcttggaagctctgcatgatgcaggaaagtcataaaatcattacagtggtgacttatgtgtttatagcccctttactgtctataatctgcaaatgaactcacacagcattgggactttggaagaattatcacccttaaggtttaaattaaactgtgaatttcagaatttctaataaggacacaacaaagagtgaaagcattgctatgtctattctgcttgcccagaatcttggtcctaaaaaatgaagagtgtttgggtgtggggaggagcttcagtgtgcatgtgcatgcaaagtacctactctaaggagaagaatgagagggtaccctaattacctgttaatatgtcccataggacaccaaaactctagttagctgtttctctatgatcctctaagcacatccccaagtatggctggccagtgatgtgtatggttcaaatgttgggatctgtgcagttatcttggaattgtatagtacagcagtatatcccccccaaaaagagtgtaatacttccaattctggctgcacaatacttgccccatagtccatggtcaataaatacaaatttgagttgtttttgctcatctttcccttttgacttcaamtcagtcatcagaatttccccaaatgcctttcccctggatcttgggccagtggaatgagtacaatttaacttaattgaatttgcttatctatttggtttcctgttgtgaacaaaagttctctgaaaaggaatttggaagaaagagactttgttctagtgaacagtttgcaaaccagggagttacagcctctggtacgcaatgaaggtgagttccacagaacacaaggcaggcaggtttcacggcaaaaagttccttcccaggttcccaatcaggtccatttatgcaaatgaaggatggaaacttgcttagttcttattggtcactgcagctgcattctgattggttgatgaagctragccctgagtggctgaggtgggtgagctttaattggttggttcaggtgagcgctgaaaatctcaactataaaaaggtacaggttttcaggatactcagagtaaccgtgtgacctgtagtaagcaaagggccagttggctctattttaaatccaggcccagttagccactcaagatctatcttacaggactggctctttcaggttcacactaataaaggcctgtccttggggaagacttctgttcacatgcgctccagtgaatttccctttctggtcattctctaccccagcacgccccccacccccgmcccgccccacccacccacctgttcatttccttcttagcatgcttcacgatttctaagttcctgctcatgtgtttaaattgtgagtctggctcacctcatggcgcgtgctcgtgtggtgggctctgctgcagcctcaagaccccacactgtgctggactcaataaatattgttggacgaaggaatgaaacacatgatacaagtgagcaggcagtaccgggggagctgtggagtgggcactcttacaggtttccatggcgaaagcgggggtacagttgtgttcttttctttctaaaaggctttctaaaaagccttctgtttaatttytggaaaagaagcctaacttgttcactacatagtcgtccttcttcctctctggtaacacttgttggtctgtggaaatactaatttaatggatcctgaggttctggaagtactttgctgtgttcactcaagaatgtgatttgagtatgaaattccagccagttcaactgttgttgcctattaagaaacctaataaagctccaccttctttatctctgaaagtgaactccctgctacctttgtggactgacagctttttatagtcacgtgacacagtcaaacattaacttggtgtatcgattsgtttttgccatatatatatatataagtaggagagggcgaacctctggcaggagcaaaggcgccatggctgtggagtcccagggcggacgcccacttgtcctgggcckgctgctgtgtgtgctgggcccagtggtgtcccatgctgggaagatactgttgatcccagtggatggcagcsactggctgagcatgcttggggccatycagyagctgcagcagaggggacatgaaatagttgtcctagcacctgacgcctcgttgtacatcagagacrgagcattttamaccttgaagacgtaccctgtgccaytccaaagggaggatgtgaaagagtcttttgttagtctcgggcataatgtttttgagaatgattctttcctgcagcgtgtgatcaaaacatacaagaaaataaaaaaggactctgctatgcttttgtctggctgttcccacttactgcacaacaaggagctcatggcctccctggcagaaagcagctttgatgtcatgctgacggaccctttccttccttgcagccccatcgtggcccagtacctgtctctgcccactgtattcttcttgcatgcacwgccaygcagcctggaatttgaggctacccagtgccccaacccattctcctacgtgcccaggcctctctcctctcattcagatcacatgaccttcctgcagygggtgaagaacatgctcattgccttttcacagaactttctgtgcgacgkggtttattcccmgtatgcaacccttgcctcagaattccttcagagagaggtgactgtccaggacctattgagcyctgcatctgtctggctgtttagaagtgactttgtgaaggattaccctaggcccatcatgcccaatatggtttttgttggtggaatcaactgccttcaccaaaatccactatcccaggtgtgtattggagtgggacttttacatgcgtatattctttcagatgtattactttggatcgattaactagccccagatatatgctgagyaagcattctgagataatttaaaatgccctcttttgttaatttttgactcctaggtttgagtctgtctttggcatcatcttctggatgatttcttggtatctgagatttcgggaaagcattccttggacattttactctgtgtgctccagtggatagtaatcaattagaaacaacaagctgttaaatgccataggcacagaatgctgggtttggggcaccctgcagaaaactcagttgaagcctgcaccttgccctggattcagtcaggcaggcaatgttcaggactgatgaaatcattctttgatgatgatagatcctggaaatgaaagttgcctttgtgaccctggttaaagctccagtttctaaatattctgataagaagctaaatcctgcagtccgttctcttctaatgagtgaatcaccagacagtcaggttctgacatgatacagaaaggttgtaggtttcattctcaagctattaggtttatttttcccctacagagtttgaagtatgcaaaaagtagcattcacatcctcatcgaaatctcagcagaggatagaaaagaacaggagaggctccttcagatggagcgttagggaattactctttgaggaggtgacatttcagagagcgttcattcacttatcctgcaaagattggctgaggatctactggcagcccaggcacttcccaggtgctgcgtctggctcccattaaggggactgatatcaccttcggaggtgaccttatttccactatacctccaatgtgatttgtattttattttttttaattttctgtgcattttccttcatagcacatcaaatatggcagccatttcacttagatagttgttgattgtccgcttcacatcatgagccatgtggggacctgtgtgactttgcattaatcacatccactgtatgcggcgtcctcaacacctgccaatgggtctgcatgtatttggcgccccataaatctcagcacctaaggcacagaataggcacccaccgaatatgtgttacattaatgaatgagaagaaaggtgccaaccgaggtctagttaatgggtcgagagtaatccacaatagctctttttagttctttgtactccagctattacataccaatatgtatatagaaacatatgtaaaattttttggttgctttttctacaaaatagagtaacagtgtattcccactgcccacttaccgataatgtcatggatatcactccagttttaaatgctattactttttaaactatgaaatagtatttcatggtacttgtgtaccacagtgtattctgctggagatctagtctagttccccacagaggaacattacaatttgtattccaggagttttgttgttgtgacctcaaacacttcctttaaaaagataagctattttgtagtttaaaaaacatttgttctgtttctttctcattcatcttttcttaagtattttacacggttttttttttttggtcactactgtgaatgtgttatttttttgcatttctatctctagctgattatctactcattactcagctatctcatcaaaatattgattttcataataaaaaataataggcagtcatttgctgataaagaaattttggtttcttctcttataaattccatgccaaatatcagggctattgaatttattagaatctctaaaaacagttgaataattctggcaataggaaagatgcccgtcttgctgctattttagtggaaattgattatcatttcattattttgcattatgttagccattgttttctgaacaggctttattgatttagataatttccttctttgcgtgaggatgtttgtaggagaggcaccgaactttatcagctgcctttctggcatttattgatataaccataaaagtctaagtggtgaactgtgttgactacatatttgttgttgccttgtttggtgcagtcaggcttaggtgtgaaaatatgtttttaaattgtaccttttagtaacctgttttgtcttgttgcatgttttaatctgaaattccactttttggatattaatattaccacttctgtattatttttgtttacatttccctagcacatctttagtactcctttgtcttcaagctttcttcctttttaaacaacatggcactggtatttttaatccagtcaggcagttgctttaataagtgcattttgcctatttgaatctaacaattaatagatttgattgtaactctctcagtttactttatgtttagttgactttgccattctcctttttccggatttctactggttggtcaagttactgttcttattttctctttcttcctttgttaactaaaaatgccactctgcactaccattcctcttgtgttgatggtcctattctcaatactcttgataaaactcctgaactttaagaataaagataaaacttttattgcacaaagaagtccatagagaaagcacaacctggcattggcgtgtctttggtgtgtctgaaggaaaagagatagtggaacaacattgggagaaaaggaatgaaactcaagaattccaagatgttcctcccctgccagggtaagatagcagtggttcacagacaatcgcaatgctgggtctgagaaaaataactaaacagaagattagtgaggaccaaggcttcgagatggccaggagaggaaagcttgggagcagggaaggttgagatatatgtgggttactgggaatgcgtgatgktgaagtcacagatgacccacatgktgtctaagtgctaaagaagaattctgggaaaatgaaatgcatttgggaagggaaaatckaattaaaagcctaaactaaaaatacaaaattcttggtaaagtttaggagttatgttaaatgtctcattttggctggtgaagtctcatcagaacagggaaattctctcattcaggggcatctcatcttttctttgaagggaatcaatggtgggggattggagtgttattttcagttaatatgttgcttcactctttggtcattccggtaactgtgaagtcagggtgaagtttaagggaagctttgccaagtaggggatggacttcacctttattgagcctcatagtagctggctcaggtaggagttggccgtgatgacaacttctctgcagtttgccctgcgtgaatctccagatgaacttttgtgccatttaaactttcgtgatctcctgctatttaacttcgaatgtttatggacctgtgggttcaattttgtgtgaatcacatcctgctgattgctgagtgggcgtgtgggagggtgtgcctggaggagaacttagactcggccttttccagatragcttcagtgtaagagtgggtttcatgaagagcaaaggtcctaggaaatttaagtaagccatttaccaaygctcagaagaaagaacttgaagagcacttggaaatgagctgtgtctccccaagaaagagggagagaaagaggggagagatgtggtgcagaccctagggaggaaggagttcagaaaaaccatcctcagggtgttcttgctacaaaccaaaaaaygcagcatggtggtggggaggatgactctgtcctccctgacttttagatgagssmaagggaaaaggcaaagacaaagcccttaagagccagaggactcacgagggcctggggctggtgagagtggcsgggagagagggctcaccttgggagaaggatggtcagtgtctggggctttcctggtcatgttccaaawyaggcttggcaggagtyctgctgkgcaaattgcgtttgctgagccctgtcagaggtctcctgtgtctcacatytagggtgaccagcatcctggcttcctcaggactgttcaggttttagcactgaacatcacatgtcctagggaacccctcagtttgggcaagccctgccacatcacacaatcatattagtgccctcagtattctttgcaaacataaaaccatagactcagtaatcccattactgggtatatacccaaagaaatataaattattctactataaagacacatgcacatatttgtttattgcagcactattcacaataacaaagtcatggaaccaacccagatgcccatcaatggtagattggataaagaaaatgtggtacatatacaccatggaatactatgcagccataacaaggaatgagatcatattctttgcaaggacatggatgaagctggaagccatcatcctccacaaactaacacaggaacagaaaatcaaacaccgcatgttctcactcataagtgggagttgaacagtgagaatgcgtagacgcagggaggggaacaacacacaccagggcttgtggsggggtgaggggtgaggggaggaacttagaggataggtcaataggtgcagcaaaccaccatggcatatgtatcccagaacttcaagtaaataataataataataattaataataataataataataaataaacccataaagccatttgagagattcttgggggattcattggaccactgaaaatctacagtgagaaaagaattgccatgttgatgaaacaggaaractttccttgtccccctcacagagcatgtgacagcgggaggggctcactttctcagtgcgccactgctcaaacctctaggggagcatacagacgggcaggttgtggggctctgacctcaccggcagtgtytagaggtggatgtttacagctcctgaagctccagtgggcgkgggttatggccttcttttagttttgccctctatagtcagcttgtgttaaccagctcaattacaccctctaccttgtcgcaaggacagagggctttctgtatcctgggggcttgccttggtgtaccagaagaatcgaatcccacctgggcttggagaatgagtgcaaggatttattgagtggatgtagctctcagcagatgggggaagccagaaggggatggaatgggaagggtttcccctggagtcagaccgctcagtggcccgggctcggtggccygggctcggtggcctgggctctcctccgactgcctcagccaaactccgcgttgttctgctggtcagtggcctgccggtgcctgttggtgagttcttctcaatgtccagctgtycttgcgtccctccgctgatgtgctcctcccgatgtccagctacctgtgtgtctgcctgctagggtcttggggtttttataggcacatgatgggggcgtggcaggccagggtggttttgggaaatgaaacatttaggcaggaaaacaaaaatgcctgtcctcacctaggtccatgggcacaggtctgggggtggagccctcgccagggaccacaccctcttctacccagcacttcccttccctacttccatatcatttaaagggaccacgcccttcccagctcttcccttctgtatcactgatgccttgctctgtgttctctaagtggaattatcactgtgtgtatgtacaggtgtgtgcatgtgtgtgcatgtacctgtgcttttcttttggaaaactagcacattacctggattttgcatctcaaggataattctgtaagcaggaacccttcctcctttagaaggaagtaaaggagaggaaaatgmtgtaaaacttacatattaataattttttactctatctcaaacacgcatgcctttaatcatagtcttaagaggaagatatctaattcataacttactgtatgtagtcatcaaagaatatgagaaaaaattaactgaaaatttttcttctggctctaggaatttgaagcctacattaatgcttctggagaacatggaattgtggttttctctttggratcaatggtctcagaaattccagagaagaaagctatggcaattgctgatgctttgggcaaaatccctyrgacagtaagaagattctatacyatggcctcatatctattttcacaggagcgctaatcccagacttccagcttccagattaattctcttaattrgaaccttagatttggcttttccctgccacttcccaactattaatccaaaggttttttttgttgttgtggttgttgtcattgttttcaatttgactctcaaatactctattaaactatgatccaccacactcagaagtatcattttctctaagagactcaaaagtgtattagggagaatttatttaaaaataaaataaatgggatattgtttcttcatrttaaatagaagtatttctccaaaaagctgttggttagaacactgaatttatgtcttacatttctgctcttatagttcygcatccacttgtttcattaagcaaactttcccttaaagtgcaggaaagtgaaaaaatcctaagtgcacagcttgataaattatcacaaattcacgtagtgcatacacccttgtaactaaacctccaaaacaagatgccggaagttgccagtcctcagaagccttcacagttactgatcctcccactctgttaaagactgttccttcagaggaccccygttttctagttagtatagcagatttgttttctaatcatattatgytctttctttacgttctgctctttttgcccctcccaggtcctgtgryggtacactggaacccgaccatcgaatcttgcgaacaacacgatacttgttaagtggctacccyraaacgatctgcttggtatgttgggcggattggatgtataggtcaaaccagggtcaaattaagaaaatggcttaagcacagctattctaaaggattgttgagcttgaaaatattatggccaacatatcctacattgctttttatctagtggggtatctcaacccacattttcttctgcaaatttctgcaagggcatgtgagtaacactgagtctttggartgttttcagaacctagrtgtgtccagctgtgaaactcagagatgtaactgctgacatcctccctattttgcatctcaggtcacccgatgaccsgtrcctttatcacccatgctggttyccrtgktgtttatgaaagsatatgcaatggcgttcccatggtgatgatgcccttgtttggtgatcagatggacratscaaagcgcatggagactaagggagctggagtgaccctgaatgttctggaaatgacttctgaagatttagaaaatgctctaraagcagtcatcaatgacaaaaggtaagaaagaagatacagaagaatactttggtcatggcattcatgataaaattgtttcaaatatgaaaacatttacgtagcatttaatagcgttgtttcaaatataaaaacaaatacataaaaatctggatttttatttcttcyttttttttttttttttttttgagatggagtcttgctctgtcacctaggctggagtgcagtggtgcaatcttggcttactgcaacctccacctcccacgttcaagcagttctgcctcagcctccgtgtagctgggattacaggtgtccaccaccacgcccggttaatttttgtattttttagtagagaaagggtttcaccatgtttgtcaggctggtcttgaactcctgacttcaggtgatccacctgcctcggcctgccaaagtgctgagattacaggcatgagccagcgcgtctgacctggatttataaataagataatttagaggttattattcactttataaaaggattctttagtttctatataatttatcatataatttatttagaattttatttcccccattagatttaaaactccaatttayataaaaagttgccataatagacatctgatccataagtttcctgcacagaaagaaatactccattataagaagcatagtatctttaagagaaaaacaactcaaatgcttagaagtacagctttttgcagcactggaacctgtgagaaattttgtccatggagtttatgaatgaaggagctataagatatcacagacaaagtcttagaataagagcaaaggaaaatttgctcaaatgtggccctgaaaacgattcaaagggcaaatgatttctggattaaagttagtatattactgtcaagctcactggtaataggcttattagaaccttatgggaagaagtggtggccagtggtagatttcatccgacaatagatactgtgtgcatatgtgcgtgtgcgtttgtgcatgtggctgtgctcatgtgtgggtgcacacgtgtgcattcatatgcgtgtgtgtgtgtgtgcgtgtgtttatgagagtgtccattgctttctcccatggttacctcctttagaaagaagcagcagtcaggaagacagatgtgaagagctggagcatgttcagatgagaggagacggaacacggggacacaccagcttgagcaagggacaacaggggaggactgatgactgacttcccacctttgaggtgctaatgtgtgtgtggtggcactggataaaagatcaatgttggctaggcaccatggcacacgcctgtagtcccagccactctggaggctaaggcgggaggattgcttgagcccagaagttggaggctgctatgagccgtgatcatgccactgcactccagcaacctgggcaacagagtgagaccctgtctcaaaaaaaaaaaaaaaaatgaaaagtccacataacctgagcatcatgtgcccagagcgttgggtggtgtggtcccattccttccttccagcggcttcttctggccacctcaatgtcaggatgtcctgctcacatatcaataccattaaaacctgacttctttccckgcactgttgaagctccttcttgaggctcacattatggatataattttgattctttcttcagtggtatagataactacttgtaacctaagaacaacttggtgaaagtcctctaatacattattttttaaaaaaacacaaatcaatgagctcaacttattaactaactttcatctattcatttttgagccatccctgtctgattgtgaatctccatgattccaacactctgagctggggatagtgcctacacaaaataaaaagaagtggaaaattttcaaacatcagtttatgctgacaaccaggccataataggtgctcaattactattgaatgaatgaatgaaagttctggccaggtacggtggctcatgcctgtagtcccaacactttgggaggccgaggcaggtggatcacttgaggttaggagttcgaaaccaacctgaccaacatgaagaaaccttatctctaccaaaaaaatataaaaaaattacccaggcatggtggtgtatgcctgtaatcccagctatttgggaggctgaggcaggaaaatcacttgaacctgagaggcggaggttgcagtgagctgagattgtgccactccactccagcctgggcgacagagtgagactccgtcttacttaaaaaaaaaaaaaagaaggttccaagaaaattcatcttaaggtttatgtaaaaggaagatgatatttaacatgattcatggccaagtactaatattacattataataatgtttccaaataacattatagatatgtttaaagacagtgtattaggctgttcttgcattgctgtaaagaaatacccaagactgggtaatttataaagaaaagaggtttcattggctcgtgtttctgcaggctgtacaggaagcttagtgctgacatcacttggctgccgggggaacctcagggagcttttactcatggcagaaggcaatgcgggagcttgcatgtcacatggcaaaagcaggagcgagagagagttgggggggaaggtgccacacactttttaatgaccggctctcacaataactcatgaaaactcactatcaggaagacagcactaaagcacaagggatccgaccccatgatccaaacacctcccaccaggccccatctccagcactggggattacaattcaacatgagatctgagtgtggacaaatatccaaactgtatcagtcaacagcgatcataattagtcctgaataggagtgcctttttttttctttcttctcccttttcttttctacttcctcctccttttccctctcctcttcaatctcctcttcattcctgtagcaccaagggttgaagcacctaacccgttttggattgagatgttctgattgggcaatgaacactgtccagaataaacagaaatccattttgcactaagtggctgcacagaccctgcctcatgctaaatctagcacccagatagtttaatgtttcaatgactgaattacaaatatatcatcaccttggatttggcacttacaaatggctgttaatttggccagaggtggttgtttacaacttcaaataggagactattcataatttctgacgtgacattttcctttctttattttactgtatgaaaatataatgaaatttctcacaaaatatcactaaaaagaaaagaagaagagtaggaagcaaggttaaaatatttctaaaatataattttggtctttctttttctcccttccttcctccgtccctctctcctttcctctctccctccctccctccctcccttcctcctttccttgcttccttccctccttctcttccttctttttcaagagatcaataacatttattaagaataagtttcttaattataacctttcaggtgataatagtaacacagcctgggcaacacaataagaccttgtttctacaaaaaatttaaaaattggccagacatagtggtgcatgactaattccagctactctggaggctgaggcaggaggatggcttgmgcccaggagttggaggctgcagttagccatgcttgtgccactacactccagcccgggcaacagggcaagactctgtatctaaaaacaacaacaacaacaataatagaaacaggtttcctttcccaagtttggaaaatctggtagtcttcttaagcagccatgagcataaagagaggattgttcataccacaggtgttccaggcataacgaaactgtctttgtgtttagttacwaggagaacatcatgcgcctctccagccttcacaaggaccgcccggtggagccgctggacctggccgtgttctgggtggmgtttgtgatgaggcacaagggcgcgccacacmtgcgcccygcagcccacgacctcacctrrtaccagkaccattycttggacgtgattggtttcctctwggccgtcgtgctgacagtggccttcatcacctttaaatgttgtscttatggctaccggaaatgcttggggaaaaaagggcgagttaagaaagcccacaaatccaagacccattgagargtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctcyggtgtctttgatcaggatgacatgtgccatttttcagaggacgtgcagacaggctggcattctagattacttttcttactctgaaacatggcctgtttgggagtgcgggattcaaaggtggtcccacsgctgcccctactgcaaatggcagttttaatcttatcttttggcttctgcagatggttgcaattgatccttaaccaataatggtcagtcctcatctctgtcstgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattctatttaagtgttttcactggtgtcgcatttatttcttgttaagttgcattttctaattacaaaagtaatgcatgattatgacagaaagtttggaaaatatagaggttcacacacacacgccttcattgcgtgtgcatgcataaatgcatgagaaaagaaaaataaccagtaatcacatcgcccagaaataaccccagttacaattgtggcaaatacacatacttataaatattgcagatatattaagtatacctagtatttgctaacactctttcttctactctgtcatgaagattctcccaaggtgtttttgtataatatttaattcattttcagtggccaagcagtattctacttcatggatataccaggatttatttaaccataacttctggttggattcactcttattattttgtttaattaaaaaaaaaagacctcggctgggcacagtggctcatgcctgtaatcccagcactttgggaggccgaggtgggtggatcacctaagatcgggagtttgagaccagcctggccaacatggcaaaaccccgtctctactaaaaatacagaaaattagccgggtgtggttgccagcacctgtaattccagctaattgggaggctgaggcaggagaattgcttgaaccggggtcagggggttcggaggtcggaggttgcagtgagtccggatcatgccactgcattccagcctgggtgacacagccagactctgtctcaaaaacaacaacaacaacaaaacaacaacaacaacaacaacaaaaatctcactggacatcctagtagctaaggctttccacatattcatgattacttctgttggaaagtgctttacaacaaattgctagttgtctcagtctgggttcccctgagatgaggattcaagggccaggagtttatttaggaagtaaaggaaacactgatagaggagtggcagagtgagaaggggtgatggtcatccacagctggctctcttgtggtcaatcggagcttaatcctgctgggtgactctgggagccagtggagaaaagacaccccagacttatcccaatgaggaacacggctgttgggtgcctgagtacttgcctcgtcagggattgaaacgtactcccaggtagtagtaatttctctgcccttccattaggccacaaagggggctctgacagagagagctgacgagaaaaaacacacgcccttgtcactgaagaggtacacaggggatctgtgtggggcaccacctgcactgctaccctggacaaatagcttaagaaatccccacactgcatccccaaacttactatcagcgtgtgagggagacaggttcccacaccctcattagcacaaagtactatcttgaaaaagaaagcctgtcagtttgataggagaaaagcaggatcttgtttacaatgtgcttttattattgttattattagagattgtatttcttttcaagctgatgagccgtctgtgtttattttttggaggataccctttgcccactttcctattggagtgtattaccctgaggatttggtaagagtgcttattgcattcaccagaatgtcctttttgtcatttactgtattttctctacttttttttttttgccttgttttactttttttgttttgtattacaagcagaagttttaaatttgtaagcttcaaattggagctggggtggtgcagagcgaagatttcagctggttccctgaccccagctccatctccttccctaggcagtggctggaacacattctgtccactatttccctctctacatccttgaggctgtgcagtcacccctcaactacgttcaccctccttcaaagcccttcctggtccacccggggaccatctcccggcctcactgcccctagctccttgacgccccaacctctctcagggaccccaagttgccatgacctctagccagctcatgttcatttgcaccttcgtgtctgcagcactgaggcactcttgtttacaagtgagagaacccaactcgggataccttaagcataaacagtatttttgtaaggagacaggcttctgacgacgcgaggctcatagccaggcctgcgctgggtggagcctccccttctcactcctgtccctgttgggtcagagtgccagctttcctcttccctctcctccgggtcttttcggcccctcagtccccatattcctctgccctagctcccaagatcccacaagagacagactggattctctctggcctggagtgccaccttcctgaaagtcagaatctgattggtccagctggatcaggtgtcctctccctgtccaatcatcaatgccgagagggattacggagagaaaaacatggctcccaccatcccattgctgtggctgcttgggccacgggagagggaaccttgtgagccgggcagaatccaccctgtagagactgcctctgggtgagtcatatggtttggctgtgtccccacccaaatctcatcttgaattgtaattcccattacccccatgtgtcattagagggacctggtgggaagtgatttgaattatgggggcagttatctccatgctatttgtgtgatagtgagttctcacaagatctgatggttttatagggggcttttccccctcttgctcatacttcctcttgcctgccaccatgtaagatgtgcccttgctcctccttcaccttctgccatgattgtgaggcctccccagccatgtggaactgtgagtccatgaaacctctttttctttataaattacccagtcctgggtatttcttcatagcagtatgaaaatggactaatacagtcagcttctgcacaatatttccattttcccacattatgtcttgggccttttgtgtatttaagctcacaggatgctacgaataaagcgttttcttatttcctgggtagttcccatagaagtagtggtgcaacgtgccatagagtgacagcacctaagagaagctgattttgtgagtggattgtgagttcaatattgttgtcataatcagaaaaaaatgtatttactttttttttttttttttttgagacggagtctcactctgttgcccaggctggagtgcagtggtgtgatcttggctcactgcaacctccgcctcctgggttcaagtgattcttcctacctcaccctcctgagtagctgggattacaggcacatgccaccccaccacacccggctaatttttgtattttttagtagagacagcgtttccccatgaaaaaaagtattttcaatttggaaagccaagcagagcccccttcttcctccttggtctcactgtcttcatgtcctctgtagataacatgctcaggggcctcttacttttggccatggcttacacactcgacctgtgtgtaatttaaaaatgacccctttctccactcctcctgattgccatatccttcacaatgtgactttgcaactcttctcatgaaaaggaggaatctatttctccagcctgtgggtcctggctggcctgtgacctgccctggctgacagagtgtggcaggtgatgagcactggtttcaagtctaggcctcaagaagccttcatattcccgctcactgtctcagaaccctgtccagctgctatgagaacagcctgggtgagccctgctgcacaatgtccccatcaccctagtcatttcagccaatagcgagccaatggccagccctctagctgtctgagatacatgggtgagactctagttgtgcttggctggacagagcacagatccacagacccacgcaggtgactcatacacttgtgaactataataatcggttgttttcagtcattaagttttgaggtggtttgttacacagcaattgctgacacattcacttctggctctaaatgtatcacttttcatgtgttgagtctgaagaccttcagaggacagagatgtgttccacctaccctatatccactgcagcatggaaagccatgcttagctgcacacagtaggcgtgcagtctgggcctgtggaatggacttggcaaccacatcacctcagtgatctttcaaacggaaaagaaggctcagtggggagtgggaggaggtagtgcagaggggcagtcctgtgaaagaaggggcatgggatagctgcttgtgtctatttcatgttgatcaatgtatctccaagtgcagaacaaggaataacgcaggaattttatgaggaagaaatgttgggcatgataagaaagctcattttctaaccatctgaattccatgaagtagaaagaggctggtcctgagagtaatgagctccctcgtattggaggtgtccaagcacaggctgaggaactcccatttggctggatgggcaaacttggagtggaaattccacttaagcaaccttggccctagatgtctctgagttttgttcctgttgtcttgcagtgcatagaaagatttcccaaaggccaatatttcattgttgtacctatgatctggatcatctctcctagctataaatgacagggaaatcctttgggctccacttttggtttaggaaatcagggtgcctcctctcctacctgtctttgatgttctttatcttgtaagtattgtgctagtggaaatccaatttcttatcctgcaagtcatccagtccccgggaaggaggagtgctctccccagggcctctcagtctgcccctcctctcctctccaactgtcctgaccacacctccccacccagggctcacatgactgtgttcccctgggacttggttgtaagccatccccacttctaccatctccctttcccaaacaggcccctgtacttcagcacacacatgtgaataacagaaatgttgaatgacaacatgatgtggagttttcaccccagagccctgtgcactcttcaaagacctgggttgatagagactcagggaggcagttggatctcaaagttccgagggtctgggatctaacggtgatagttctagtgaaaccctcccacccttccaggagacccattcctataagaaatatgactgaagagcccagctgtctcactttgataaccaattcttccatttgcatttccattgatgtgtattgggccaagagcagagctttttcttgtggttaatatctgtttaatccagaagaagaccctaaggaaaggtcagtatttaggtcccagagtagctctttaaaatcctttaaaggaaaagagagtatgggatagtaaagggccatgggatggatctttgaggatcaaggaacttgggacaggaggagaaaggatctgagagcctttcttccaccatctcgacatctatgttggtgtttctcaatttttaagaagctgtggatgttgagagaaccccttaaaggagttatgagagatactgatatgaatttctcattagccattaattatcagtgtgtagaagagagggcgagagggctctattaaactaaggatattatctattgctgtgtaacaaattatcataaactcagtggcttaaaagaacatccattgattatctcacggttccactggccaggagtctaggcatggctttccttggtcctttgtttagggtctcagagactgcagtcctttctggagttcagcttcctcttccaagctcatgtgcttattggagaattcagtttcttatggttgtaggactgaggccctcagttccttgctacgtggccctcaccacaggcagtttgcatcatggctgtttacttttcaaggccagtagaatgtttctgttcaatctgataagagggaatctcatgtggcatagtgtgatcatgggaatgacatcccaccatctttgccatatgatgtaatccactcgagagagggtcacccatcacctttgccatattctgttgattagaaggaagtcacaggttccacccacacaccctcaaggggatggctttatggaagggtgtgggtcgttggggtcatcttaaggtgtgt

SEQ ID NO: 12299 - DNA, 40310 bp, Homo sapiens
tttaatcctcacagcaaccctatacagtagctacaattcttatacccattttacacatgtggaaacttagcctcaaaaaggttaagagagccagacgcggtggctcacacctgtaatcccaacactttgggaggctgaggtgggtggatcacaaggtcaggagttcgagaccagcctggccaagatggtgaaaccctgtctccactaaaaatacaaaaaaattagccgggcacagtggcagacacctgtaatcccagccactcggcaggctgaggcaggagaattgctggaacccaggaggcggaggaggttgcagtaagccgagattgtgccactgcactccagcctgggcttcaaaaaaaaaaaagactggcccaaagtcacagagtgagtgagccagggggagtggcattacttgcagctcttgaatacaggaactggactcctggactcagctctatactgggaatgggtgagtgtttcatcagaatggctctttaccaggcacagtggtgcacgcctgtagtcccaactactcaggaggccaaggcrggaagattgcttgaggccaggagcttaagaccagcctgggcaacatctctacaaaagcgagaccccrtctctacgaaaaatttaaaaattctcgggcagggtggcatgtgcctatagtcctagctactagtgaggcagaggcaggagaatctcttgaggccaggagttcaagaccagcctgggcaatatagcaagacacttacctctaaaaaaattaaaatattttttaaaagaaaagcactttatttattctgtcacagagacattgttggaattgctcttagcagaggcaggatatgtggttcccacagaggtaatatagcagacactcttttgggtaaccagcatgcctttctttgggtaatcatccttatcccaactccacaggatcctgaaggagtggctaatcacagtgtcctataggaatgaccgtgtcggccgggcgcagtggctcacgcctgtaatctcagcactttgggaggccgaggtgggcagatcacgaggtcaggagttcaagaccagcctagccaacatagtgaaaccccgtctgtactaaaaatacaaaaattaactgagcatggtggtgcatgcctgtagtcccagctactcgggaggctgaggcaggagaatcacttgaacccaggagacggaggttgcagtgagccgtgagctgagatcacgccactgcattccagcttgggtgacagagagagacttcacatcaaaaaaaaaaaaaaaagaaaaaaagaaaagaaaaggctgggcacggtggctcactcctgtaatcccagcactttgggaggccaaggcaggtggatcatgaggtcaagagattaaaaccatcctggccaacatggtgaaaccccgtctctactaaaaacatgaaaattagttgggtgtggtggcacacgcctgtagtcccagctactcgggaggctgaggcaggagaattgcttgaacccgggaggcagaggttgcagtgagccaagatcgcaccactgcactccagcttgggcgacaaagtgagactccatctcaaaaaaaaaaaaaaaaaaggaatgaccatgtcatccagactgggccaatcagagcacagagtgattagtttaggagtatatgacccagacagagtattttctggaactaggaaatggatactatggggtgggggtggtattttgcagctaaatttaaaacatagaagccaggagcagcccaggtgcaaactggataaactcatttgctcctcataaaagcactacatttatcatctccatttcacaaataggaaaactggggcccagaagggttagggtcacacagttaccaagtggtggggctaggatctaaactactcaggcagtttggcagtacagtcagcagccttaaccactaatgaaaactaagccgcaggaaaaatgacagaggaaaggcaagtgttgcagaggaaaggcaagtgttgcagaggaaaggcaagtgttgcaaaggaacttggttactttgtaaaagaggaagaaagaggatgtgtgcattargaggagggccactcaccatgcaggcctgagccaggctcatggccaggcggaaccgggcagacatggcaagaggcagcagagggctgaggccagagcccaccgcagggttgatcacacgcaggcagcggaccacagcctctacaaccagctcagtggtgaaggcgcgcaaggtctgcacatctggaggaactgccctgaagaaggggaccagcttgatcgcaggaatagtcaggcaacagggatcaggctgagccctgcagccttttggaaacactagtaccagggtcggggcagggaggatgcctacagttcagacagatcctggatgttggtgactgtgacttccatttggaaaaccaggaactagggaaatcctcaagtcctaagatcttggagtaggagaatggtgggtggaagagaactcagtttagaaaaatatcaaaatttgggagtctgggaaggtgaaagggtccaggtggcacaatctctgggtttcttggttcccagatagtatgttctttgcatacatattgagctgctagagttttgagaagactagattttaggaggctgctgttttcagaagttccaaatgtcagggtccctgggtatcaagatccctgaatatcaagaccacctagtttcaagcaatacaaaaatcagactccctagatgttggcatcctgggtttttagggcctctgaacggaggagtcttcgtgcgtcagggtgaccaaatgctgatgtcagattttagaattctgggtttttttggctgggcgtggtggctcacacctgtaatcccagcactttgggaggcggaggcgggcagatcacttgaggtcaggagttggagaccagcctgaccaacatggtgaaaccctgtctctgctaaaaatacaaaaattagccgggcaaggtggcgcacggctgtaataccagctacttgggaggctgaggcaggagaatcacttgaacctgggaggcggaggctgcagtgagctgagatcaccccactgcactccagcctaggcgacagagcgagactccatctcggaaaaggaaaaaaaaaaaaagaatcctgggtttttttaagccccaggtgtttggggaactggagtttgaaggatcccaagtatctggtccagggattttttggagtccccgagtgccagggtcctggggttttacgctccctggttcttagggcacaggtgtcttagggtctccagataacagggtctcagggaactgatgttaagattccccagattacagggttccgggtcttgaggtttcaaggttgtaacgtctcaaggtgtctgggtcccagagctttgggtgtaccaaatatcatggttaaaggatttgggaggcctctgatgtcggtgtcagggagggcggtgtgtgtgtgcgtgtgtgtgtgtgcgtgtgtgtgtgtgtgtgtgtgtgtgtgtgtgtaagggggtgagggtcttaggatcctggagttggagccctgaatgtcaggatcccgggttttaaggttcccgggaaacggggtcctgggctttagagtcccggatgtgggcttcgggggtgggcgggggctctgtccttacgtgccggcctggcgcagcgaatggatgaggattcggtccgcctcctccatggtggagccgtgtcggagtcgggggctgggtccaggaccgggtccgagaaagtggggagcagctgtagaaaccctgctccgtgctcgcggtccacagagtgtcacgggtcgtgtggggagagttggaaagtgtagttctgtgagcgagcacggcgcatgccggatgtgaggcctggggtgagtgtgcacggaggttgagcttgcaatagctgctgggaactgtagttcttccacctgcagtccagtgggctcttccaagggaaaaaggaacaacccgtgtggtggggagtggaggggccggacagaaaggggcttcctgactcattcgtttaaggcggcattcatcttctaggctataaaagtgtacacattaagggcagaattttaacacaaagcgactacttccctgtgtcttagtctcctcatctgtaaaatgggactattgacagtacctgctttttaggattaaaacagaattaatttatataaagcacgttgtactatgtgcctgacacataagataagaaagcactatgtaagttatagttactagtgtccatgcattcaataaatgctttaatatgatacacatttgtacactccaaagaataattacacagcaaatatctatgtaaccggctgggtgcagtggctcacgcctgtaatcccagcactttgggaggccgagtcgggtggatcacctgaggtcaggagttcgagaccagcctggccaacatggtgaaaccccctctctactaaaatgagaaaaattagccaggcatggtggcacatgcctgtagtcccagctactcgggaggcttaggcaggagaatcacttgaactggggaagcgaaggtggcagtgagctgagattgcgccattacactccagcctgggcaacagagcgagactccgtctctaaataaataaataaagcaaaagaaatctatgtaaccatttcttgaacagccgacgcgcacctgcaatcccagcagttttggaggccaaggcgggaggatcgcttgaggtcaggagtttgagaccggcatgggcaatacagcaatacaccatctcttaaaaaaaaaaaaaaaattgacacttgtccaagcagacgtccccagcagagccagccagcatgaccgagcgccgcgtccccttctcgctcctgcgggaccccagctgggaccccttccgcgactggtacccgcacagtcgcctctttgaccaggccttcgggctggtcgcagtggttgggcaccagctgctggccccgctacgtgcgtcccctgcccccgccgcggtcgagagccccgcggtggccgcgcccgcctacagctacgcgctcagccggcagctcagcggcggggtctcggagaatcggcccacagcggaccgctggcgcgtatccctggacatcaactacttcgcctccgacgagctgacggtcaagaccaaggatggcatggtggagatcaccagcaagcacgaggagcggcaggacgagcatggctacatctcccgatgcttcacccggaaatacacgctgccccccggtgtggaccccaccaaggtctcctcctccctgtcccctgagggcacactgaccgtggaggcccccatgcccaagctagccacgcagtccaacgagatcaccttggagtcacgggcccagcttgggggcctaggagctgcgaaatccgaccagtctgcagccaagtaaaagccttagcccggatgcccccggccgccgccactagccgtgcccccgcacccacctgtgtgttcttttgataggtttatcttctgttgttctcaaataaagttcgaagcaacccaaaatttaaaaaaaaaatagttgggcatggtagtgcacacctgcagtcccagctacagaggctgaggtcagaggatcacttgagcacaggaattcaacgctactgtgagctatgatcacgccactgcactccagcctgggtgacagagcaagaccctgtctctaaaaataataataattgataatatttgatcttttttccatagagatattgcacatatattaggtttttcctayatacttcgaattccatatactactggaaaatgacatcgtttttcttattttagtttgactgtttgctgcaggtatatatttggtaaatatttcatctgttgccaggctctggcccacaaacgtcccatttgcacccccaccgccaccctcccatacaacactgttattgccccgccctgcggccttaatccctccaaagctgggggaagagaggggggttgtgtgcagatggcccttcaatctcgaaagaaagatgtcggaatctgaaggcgggaaaggtgagagaatccttccatccctgcagacccttggagcaaggtagagcccctctgacccacccattgcccacccagaccccacccccagagagcctctaggggacaagaaccacatcaccctgttccccatcccagccagccccaaacagcctctctgccaccagagccctaacgctcagcctgacccagacaccaccccccatggcctctcagcctcatccacagccttagttcccaaaggaaacccaacctcaatcctggctctgacccctatccaaacgcccacctgaaacctaacacaaactctaccagccagaaggcaaacccctgttagagtctaaaccccaccccagatacagacctaaagtgacctaacctcaacctcaaccccgggatgtcaatactgttagtgattgcagtctctgactttccagaaagtgcacagaccctttaaaaaaaaaaacaaaaacaaaagagagaaagagagagaagacatacttgatggtggtagtaagccatgagggctctagagttagactgagtgtgactccccattcagccacttcagcaagtcacttaactttttcttctcaattttctcatctgcaaaatgggaataactctatgtgccaggcattcttttgattctgaactcatttaatcctcataacaccgctatattttaggtactgttattatcatccttattatacagataaggaaactgaggctcaaagagattacataatttgcccaaggcaacacatagctaccaagtggtaaagtcaggatttaaactcaggcagcttgtttcatccaaagctgggaatcttaaccaggccaatctaccgccctctgaggctgaaacgagaccatgggaactgggagtggccttagctgaaaaccccaatgcaaaattcaagtcccactcaaaactcaacttcgaccctaacctgtatcctaattctaattccaattcaaaatacccagtcctaacccttagacaaaactccactcctacctatgtctaaacccatccccaccctaacccaaaacccaccactcaaatttaaccttaaattcgcccaccccatggcaatttaaactctacccccaacttaaacaccaaaccstacttcacttggaaatgtaatctcaccttcactcccctataarctctcactstaatcttaattcgaacactcttacttcccagtccttaacccagctactcccagttctccctaattttccatgctcttctctccttccttcaaacagagggacaggatcaggtaggaagcagccacaattgccccaataccctgtccctccctgacacagtttctccatatagacaccaccccagagcycagtccagccaatggggcaggccctggtcccgaatgggggctgtgccccgggcccccagctgtggaaggtgaaagcagtggrgcatcaggcctagggacccctaagygaagaaaccagcacagcaagcacaagacagtggcagtggccagtgcccagcggtcacctcgggcactcttcygcctcaccctggccaatcctctgcgacggtcctgcatcagcatcgtggagtggaagcatcctggaaggcaggggcagggcccaggggtaagggtcatcagggtaccaggagtaaagaattgggtcagggctggaacagaggagggctgagatcatcaaggtcaagagtcaagaactgggttggggggcaggttcagaaaggcaaaggtcaccagggttcaagagtcaaggactgaatcacagcaagagttggggatggttaaggtttccaggagggacaaagtcaaggccttgtcagggcaggggtcgagaatgccaggacctgtcaccttgggcgtcaagggtcagcactgggtgggaggttcccaagggagtaggggggttccaatgccactctgccagggtccttgactgtgtccacctgaggcccttcgacatcctcatcctgctgaccatctttgccaactgcgtggccctgggagtttacatccccttccctgaggacgactccaacactgccaaccacaacctggtaaggcccgccccgccccagccagttcccagccaaatagagccccagtagagctcactccttccagccagaccccgccccctctctgacccggatggccctgcctggctcagccccaccctcggtcctgactatgctccccacgcccccgtcaaacctcgccttcaaataactccccgacttcccgacccgccccccggtcccacccccaggagcaggtggagtacgtattcctggtgattttcactgtggagacggtgctcaagatcgtggcctacgggctggtgctccaccccagcgcctacatccgcaatggctggaacctactcgacttcatcatcgtcgtggtcgggtgcgcgtctgcgggaggcaccccaccctagtcgccttyctaccgtcaggcccgctgaattctgggctcaggaaagcgactctttcagaccgcccccattcggcagccagaatcaggaatattattaaaacccatttctatttctagttacagggacttgtgcttttctgagaaggttagggtggaggggggaatcccaaggcctgacctccgcctccctgcccggtgctcccccatcaggctgttcagcgttctgctggagcagggccccggacggccaggcgacgccccgcacaccgggggaaagccaggaggcttcgatgtgaaggcattgagggcgtttcgggtgctgcggccactgaggctggtgtctggggtcccgagtgagtggcacatcccccgaggtcggaggtggagggtgggggtggggctgagctgaccccgcccttatttctgcctccccctccctccccgcaggcctgcacatagtgctcaatyccatcatgaaggctctggtgccgctgctgcacattgcactgctcgtgctcttcgtcatcatcatttatgccatcattgggctcgagctgttccttggacgaatgcacaagacgtgctacttcctgggatccggttagtctgcccgcccctcctaggcagaacatgccccctccttcggttcctagatccaatgctgcactcagggaaacccactgaaatgcacaagattcggcccccaggctcaggttccatccccagataaccaagtcccacccatatattcaagactctgccctaaatcagactacaaccccacctcgctaatagctccgccccatcacgagactgtacccacaggctaaggtcctgccccgcacttaagacttaagtgcaagtgccccgcacttaagacaagactctgcgcctgtaatcccagcactttgggaggccgaggcgggcggatcacgaggtcaggagatcgagaccatcctggctaacacggtgaaaccctgcctctactaaaaaaatacaaaaaattagctgggcatggtggcgggcgcctgtagtcccagctactcgggaggctgaggcaggagaatggcgtgaacctgaggctgaggcaggagaatggcgtgaacccaggaggcggagcttgcagtgagccgagatgcgccactgcactccagcctgggcgacagagcgagactccgtctcaaaaacaaaacaaaacaaaacaaaaactctgcgccttggcttacacctgtattcccggcatttgggaggccgaggcgggaggatcacttacgcccaggagtttgctaccagcctgtgcaaaatagtgagatccagtctccaaaaaataataacaaaaacaattttaaaaaactttatcctcggctgggcgccgtggttcacgcctgtaatcccagcactttgggaggccgaggcagatggatcacttgaggtcaggagttcgagaccagcctggccaacatagtgaaaccccatctctactaaaaatacaaagttgagccgggcgtggtggtgcatgtctgtaatcccagctactcgggaggctgcggcatgagaatcacttgagcctgggagatggaggttgcagtgagctgagatcggatcgcaccactcactgcgctccagcctgggcgacagagtgagactcggtctcaaaaacaaaacaaaaacaaaccaaaaaaaagctttattctccacgactgttctcatacactcagaccatttacccagactcccgcccatgccttgcccctcccctattttcaagagacgcgtccaaattcacaagactccgcccccaggctcttgcctcattgttatttacaagactccacgccaggatttaaatcccggttggtgggatccctagcttcccagtggttcagaatacggagctcgcagggttctgccctagaagtggagctaagtgttgccttagaaaaatctaggactggccgggcacggtggctcacgcctgtaatcccagcactttgggaggccgaggcgggcggatcacaaggtcaggagttcgagaccaacctgaccaatatggtgaaacccccgtctctactaaaaatacaaaaaaaattagccgggcgttgtggcacacgccggtaatcccagctactcaggaggctgaggcaggagaattgcttgaacccgggaggcggaagttgtggtgagccgagatcgtgccactgcactccagcctgggcgacagagggagaccccgtctcaaaaaaagaaagaaagaaagagagaaagagaaaaatctaggacccaagtcgagcttcctaagtgggcggggcttcagggtggcagcgactgagagtgggcctgcttcgaagccccaagctccagtcttcctgcagacatggaagcggaggaggacccatcgccctgtgcgtcttcgggatcagggcgtgcgtgcacgctgaaccagactgagtgccgcgggcgctggccagggcccaatggaggcatcaccaactttgacaacttcttcttcgccatgctgacagtcttccagtgtgtcaccatggaaggctggaccgatgtgctctactgggtgaggtggactgtgggcacagagctcaaaggctgcacctgcctttcctccctgacactcacgcaggagtgtctgcctaccctgagggatgcatgccttttctctccccagatgcaagatgccatggggtatgaactgccctgggtgtactttgtgagccttgtcatctttgggtccttcttcgtcctcaaccttgtgcttgrcgtcctgagtgggtgagrgacctagacactccytgcttcccacccctcagccactgcccacttctttgtgcctggcaaactcctagacatccttcaaaacccatctgaaatactccttcattcaatcatgagcatctattgtatgtgaggcaccattttaggagtggaacaaaagacaaaaatctctgccttcctggttttacattctgatggggagagacagaaagtagcaacatatgcaataaaataagtgtgtgcatttatatattggcacacacatatatatagtgttttatatggaatatgtactgtggaaagaaaggaaagataaaagataagaatggagagatcttgtgattataaatagggatgtcaggaaaggctgtcttgacaaggtgttatttgagtaaaaatgtgaaagaggccaggtgcagtggctcatgcctgtaatcccagcactatgggaggccaaggcaggaggatggcttgaggtcaggagttcgagaccagcctgggcaacatagtgagacttcatctttacaaaaaatgaacaaaaatagctgggcatggtggcgcacacctgtagtcctagctactcaggaagctgaggtggaaggatcgcttgagcccaggaggtcgaggctgcggtgagctatgatcacaccactgcactccaccctgagtgatagagtgagaccctgtatctggggaaaagaaaaaaaaagagatgaggtgggtgcaccatgtggttatctgagggaaaagcattccaagcaaagagaatggtcagtgcaaaggccctgaggctagaatgtgcttggcatattcaaagagtagctaggaggctagtgtggctggagtgatgaaagcaaggtgttcagattggctcctccccctagccctctatcctcctccctcagggagttctccaaggagagagagaaagcgaaagctcgcggggacttccagaagcagcgggagaagcagcagatggaggaagacctgcggggctacctggactggatcactcaagccgaagagctggacatggaggacccctccgccgatgacaaccttggttctatggctgaagagggccgggcgggccatcgtaggcaactccaatctggcccattccctgcatgccttagatgtggtctgccctcctgagacccacccaggcctgatctgcaacaactctagccccagcccccaagttatggctcaaaatgcagaatcaagaccagcctcagctataaagactccaaatgacacccctaccctagacatggccctaaccctgcccccagtatgtcctccctaattgtcctttctctccctgcagggccayagctggccgagctgaccaataggaggcgtggacgtctgcgctggttcagtcattctactcgctccacacactccaccagcagccatggtgggggtccagccaggctggggtgggggtgggtaggcagaggtgaaagccaaagattggacctcggggtcttcaggtcctgaccactatccccaccttgcctacagccagcctcccagycagtgacaccggttccatgacagagacccaaggcgatgaggatgaggaggagggggctctggccagctgtacacgctgcctgtgagggcccccagcccctgacccagcccagaagccagtccaaaccctgactcaagtcctttctttagcctcaagcctcgatctcagtccttgacctctggccccagtcactgacaccccttctgccctttaygacacacacctcccatcccccttctttttcagaaacaagatcatgaaaaccagagtctggtgagttgggaaagttgtgcaaatccttgactccataactttgaaaccccccacctccaagccctcatgacctttggatcccccacctgagccccccagggcaggcttaggtaggtgatctcagcctgtgggctccccttcccccagccgccgcctccgccgagccaaccgggtccttcrggcacgctgccgtcgggcagtgaagtccaatgcctgctactgggctgtgctgttgctcgtcttcctcaacacgttgaccatcgcctctgagcaccacgggcagcctgtgtggctcacccagatccagggtacacccccagcctgctagtcgtctcccccagcctcctattccttctaccccagaagcttaaatccaaaacctctagggcgcctcagcccccaagacactgccttcccccctacccaaataaatccagagcccttagcctgtcccatcccaccttgtagcttacacaggtagcacttgctgtgtgcctcaagctcctttctcagcacctttctttatgtgtactgacaatttcttcaccacaaccttatgcgaattaaatactaaggcacagaacactgagcatcaaggcactgaggggttaagcgactaatctcgggacccagctagcgagtggcagagccagaattagaacccaggcagcctggctccagaatccaggctcttatcatcacactgtctggaaaagttctccacatctacaaaatggagatgatagatagtagtatccacttcatgaagcagcgaagaggagtaaatgatgtaaagtgaaaagtgcttaggacattgtatggcccaccatatagctaacactttataagtgtcagctcttactattattcattataatctcagccccagcctgaataccgagcacatttctaacccataacccacaaaccagccccagtcccgaagaaaccctagactctaactctacttgtgaatttgggtcttctggactcatagacactgactctggcccccaccccgactctgcccctcatccccatctccaagcccctcaaaacttcacctactctgacctacaaactcaccccaatccctagccctaagccttccctcagccagcacctggcctgataccagctaccgtgggtcaccccatggtccctagttacctccccacatgtcaccacagaaactggccagcccgatcatccctgcctctctccccacagagtatgccaacaaagtgttgctctgtctgttcacggtggagatgcttctcaaattgtacggtctgggcccctctgcctatgtgtcttccttcttcaaccgctttgactgctttgtggtctgtgggggcatcctagagaccaccttggtggaggtgggygccatgcagcccttgggcatctcagtgctccgatgtgtgcgcctcctcaggatctttaaggtcaccaggtttgtattaggggagggggaagacaagggcctcaaacacagcctcaacacccccacccaagctccaatgataacttcatctgcttcaccattcattgagcagacatccattgagtgcctgctgtgtgccaggcaccctaccaagccctagggaaacaccaggaatcaaagcagacacaagttcctgtcttcatccactggggagaatgtctactccatttccattgccttcctcaacctcaactcctgctctaacgtttttccccaaccctgtctccgatttcaatgccatactattcccagcccaaaccccatcccaacccccaaccacaataccatctctgatcccaacccccaaccacaggtcacctatgagcccatttacaacgctaacacccattcccaagcccaactccatctcccacctcatccctaactcccagccccatccctgtcactaaccaccaaccataataccatcctcaatccccaaagagaactcccacgtccctaacccttaaccatcaccctatcttcaactgcaactccatttccagcctcagccccagtctcatcccatcccctcctctatcccagccctcaaccacaacttacccttaactccatctccaaccccaaatacatcacaaccccatccccaacaccaggcccagtcccaagctgaaacccaattctagcttcaccaacttccattaaacctccatcctaggctggacgcggtggctcacgcctgtaatcccagcactttgggaggctgaggcgggtggatcacaaggtcaggagttcaagaccagcctggccaatgtagtgaaaccccgtctctactaaaaatacaaaaaaattagccgggagtggtggcaagtgactgtagtcccagctactcgggagkctgaggcaggagaatcgcttgaacctggaaggtggaggttgcagtgagacgagattgtgccactgcactccagcttgggcaacacagtgagacttcatctcaaaaaaaaaaaaaagataagaaaaaaaaaaactccatcctaacctcatctcccagtctcccattatacccctaccaccaaccctaaccccaaactctcaactttcccctacctctttacttcttcttctttttttttttttttttttttttttttttgagacagagtctctgtctatcgcccaggctggagtgcagtgcaatcctggctcactgcaagctccgcctcctgggttcacgccattcttctgcctcagcctcctgagtagctgggactacaggcacctgccaccatgcctggctaatttttttttagtagagacggggtttcaccgtgttagccaggatggtctcagtctcctgacctcatgacccacacgccttggcctcccaaagtgctgggattacaggcgtgagccaccacagggcccagcttcccccacttcttactctcatctcaccccaactccaaaatcatttctaaccctgacaccaaagcctatttgagcccaacctgccgaggtgcatctcaagctggagccctgccctggctcctgatgctccagccatgtccagtggacatggcatcgaccctgccccctcccatttctgctgcagacactgggcttctctgagcaatctggtggcatccctgctcaattcaatgaaatccatcgcatccttgctgcttctcctcttcctcttcatcattatcttctccctgcttgrcatgcagctgtttgggggcaagttcaactttgaccagacccacaccaagcgaagcacctttgacacgttcccccaggccctcctcactgtctttcaggtaggatctggagaccatgggatgggtgggtcggggagaccctggagttggagggggtccaagagctccacagtgacttcccacccccagatcctgacaggtgaggactggaacgtggtcatgtatgatggtatcatggcatatggtggccccttcttcccaggaatgttggtgtgcatctatttcatcattctcttcatctgtggcaactgtatccttggagctttgtggggctggatgatggtggagtcggggtgggtaaggggaactgggtggtctataggcagggtgcttctccatcctttgcagcctaagctcatcccagacatcctgttgaacgtgtktcttgccattgctgtggacaacctggccagtggagatgcaggcactgccaaggacaagggcgggtgagatctggctccacccctaacacagtctctctctgggatccctgactgggaacccctcagacacccccaccaccagagatgcctctagtcaccctggtaatccccatctccagataccatctgccagtcctcattcattcaacatgcatctattgactgcctactgtgtgccaggtcctgttctagatgctgaggagacaacaggggtcaaggcagacaagagtccttgccttcatggaactaacattctagttgaggaaggcaagaaaaataaaacaaatgaatatataatatatgttaataatatgtaataaagagaaaacagaatgaaaggatagcaagaaatgaagattgctctttggggttaaggtcagcaaggaaggtctctgtgaggaagtgacatttcaccagagacctgaatgaagtgagggagtgagccatgcaaatatctgggggaagagtattcaaggaaggggagtggcaagtgcaaagcttctggggcgctaatgttcttagcactttttttttttattctgatatggagtttcactcttgtcatccaggctggagtgcagtggtgctatctcagctcactgcaacctccgccacccaggttcaagcaattctcctgcctcaacctcctgagtagctgggattacagacgtacaccaccatgctcagctaaatttttttgtatttttagtagagatggggtttcaccatgttggcaaggctggtcttgaactcctaacctcaggtgatccacccgcctcagcctcccaaagtgctgagattacaggcgtgagccaccgcacctgaccacattcttagcactttcaaaaaataccagcgatgcccgggagcagtggctcacgcctgtaatcccagcactttgggaggccgaggagggtggatcacctgagcttaggagttcgaggccagcctggccaatatggtgaaaccctgtctctactaaaaatacaaaagaaaattagctggacaagctcgcttgaacccaggaggcggaggttgcagtgagccaatatcgcaccactgccctctagcctgagcaatagagtgagactccgtctcaaaaaaataaaaacagtgaggctggaatggagtgaggaaggaggagagtggtatggagtgaaggtcagtggaggaaatggagggccagattgagggcattctgggccagggtgaggactgtagtttttcctgaattaaggagacrtgggagggttgtgggcagagttgggatatcccagacagggtttaacaggctccctctggctgctttgagaacggactgttgggaggggcagtggggaagagcggaagcaagaaagttctatgggacccaagaaaggtctgttctgactgtagtgatcycccttagcccatctgcagcaatcacccctatttcctcgcacagggagaagagcaatgagaaggatctcccacaggagaatgaaggcctggtgagttagatgcctgggcactgtctacacctcccactcccaccactacctgtctatgtgtgcatatctgtttttttgttgttgttgttttattttgagatagagtctcactctgtcgcccaggctggagtgcagttgtgccatctcggctcactgcaacctctgcctcctgggtccaagagattctcctgcctcagcctcccaagtagctgggatttacaggcatgcgccaccacactcggctaatttttgttatttttgaaagagacagggtttcaccatgttggccaggctggtctcgaactcctgacctcaagtgatccacctgcctcagcctcccaaagtgctgggattacaggcatgagccactgcgcccagccatatgtgcatgtctttaaccttcatcctctgcctattctttyccctattattacatttcttccatgcctcccctgtgtccattccctgtgtctccctcaccattgatgactcccgtcttcctgtcctcaggtgcctggtgtggagaaagaggaagaggagggtgcaaggagggaaggagcaggcaagtgggcagggccaggtggagcaggtgtgggaccttggggaaagagctcaggcagacagctcctgacccctgagaccctcctctccagagatcagccttttccaagatcatcctgaaaataacagacttggtatgtggtcagcaacatttgggaacattgaggttaaagaagggaaatgcagcctgggcaacatagcaagaccccatctctaaaaaagaaattaattagccaagcatgatgatgcaagcctgtagtcccagctactcaggaggctaaggtaggaggattgcttgagcccagaagttcaaggttgcagtgagccatgatggcaccactgaagtccagcctgggggagcagagtaagaccctatctttaaagaaaaacaagaagaagagaaacacgttttgtttactgctgaacttctcagagcctttattataaaatagtctgtatatacaacattctttcaacacacatttactgagctcctactgtgtcccaggcactgttctaagtgctgtggacatagcagcatacaaaacagactaaaataccttcctggaggagctgacattctagcagggaaatgggaagaattgaccacgtggcaaacactgttctgggtgctttacatcaacttgctcaattaatttttttttgcttttctctggtgccagacatggaggaggaggaggaggaggaagaagaggaagaagaggaagaagaggaagagggtgcagggggtgtggaactcctgcaggaagttgtacccaaggagaaggtggtacccatccctgagggcagcgccttcttctgcctcagccaaaccaacccgtgagtgccggaagtggcagggggtgaggcaggaggggctagggcaggtggaggagcatggaggagcagccaaggtgggagtgggggcatgggtgttgtgtcagggccagaactgtatcccttggaatccctgaacaattctgtggtcctgagttctgaccatggcccactccctctccacaggcygaggaagggctgccacaccctcatccaccatcatgtcttcaccaatcttatcctggtgttcatcatcctcagcagtgtgtccctggccgctgaggaccccatccgagcccactccttccgcaaccatgtragcctttggctgggagctaggagctgaggggacactcccaggggtgtcctagtgggcacaagctgggtcagggtggagataaggagaagagccctaggtgagccgagagaggggctcattaacgcagctgatgcaatgccagcctttacggcatgtgcaacacacggggaagcaccagggaggagatcaatatttgactgaggaggaagctgtgctcagagaggttaagcaggccaaaggcgcccatgtagctgggtagaggcagaagggtccaaatttgaaccctaatctttctgatggccaagccttttgagaagtcacctaggatccccctcagccrtgactcagtggctccccgctctttctcacaccccagattctgggttacttcgattatgccttcacctccattttcactgtggagattctactaaaggtgactaatgggaccccagtcctaccctcagttgccctggcactctccccaccggttcttgcagcccacctctcctgtccccatccccacctcccccaacccccaccatccccaggtctgagtctagcctcttgtcctgtccccagatgacagtgtttggggmcttcctgcaccgcggctccttctgccgtagctggtttaatatgttggatctgctggtggtcagtgtgtccctcatctcctttggcatccagtaagtgacagatccccagcccaccccattcctctcacagccagggcccagccagggccaatgcctgaggattgccccttccccagctccagcgccatctcggtggtgaagattctgcgagtactccgagtactgcggcccctccgagccatcaacagggccaagggactcaaggtaaccccaccccacccaaacccacaggacccaggccctgccctgcccctggggccaggatcactgatcaaactgaccatttgcacggatgcatgaccatacggcctggaccygacacataaatacacatctctgaccactagccatgtggcctgacccatgttccttccaagtgaccatatgtttctaccagtggccacatttctcagacccagctccctgacaggtggccacagatccccacccggcaaacacttattcctggtggatgcccacaygtctctagcccataacactgcctcttgaacacatgttgctaaccatacatccctgacccatcaccacatgtccccagcccaagtccctcagctgcatctatgaccagagtccctgccccatgaccactgtggcctgtagtgttcagtagccatatgcttgggtgcccgcagcatgtggtgcagtgtgtatttgtggccatccggaccatcggaaacatcatgattgtcaccacacttctgcaatttatgttcgcctgcatcrgggtgcagctcttcaaggtggggcaaacactggagggaatgccaggcaggggtctgggcgggagtgtgatgaagggtgaacctacttgacagacatcctctctacaggggaaattctacacctgcacggacgaggccaaacacacccctcaagaatgcaagtgagtgcccaagaccctgccgtccacggagctcaggacccctcccaaagactttagagcctctagatctcaccaaggcccaaagatatagtcccagaattgtcccaagaactgcagaggccctcagatctcaccaagtcttcggcggcccccgatacctcccccaaatccctctccgcattccccaagtgacctacattccactccagacccattagcaatcaccattcccaccctgagcccccagcttccatcttgagactcctgtagagggtagtagctaaaagcctgggctgtgaagtcagacattacggttcaaatccacttcatgagacttaggtacatttcttaaacttactcagttccatttcactcaactgaaaaacggggctaaacagtgcctatctcacaaggctgttgtgaagagtaaatgagctactacatggaaaatgtactttgtacaatgtaaagttgctacacagaaaacctagcttgggccgggcgctgtggctcacgcctgtaatcccagcactttgggaggccaaggcaggcagatcacctgaggttgggagttcgacaccagcctagtcagcatggtgaaaccccgtctccactaaaaatacaaaaattagctgggcttggtgttgtgcacctgtaatcccagctactctggaagatgaggagggagaatcgcttgaacccgggaggcggaggttgcagtgagccaagatcatgccactgcactccagcctgggcagagtctttttcaagactccgtctcaaaaaaaaagagagaatagaaaagaagagaagaaaaagaaaatctagytcagtgcctggcatatagttactgctaataaacgttggctattattcgttttactttttcctggtgggcgatgatgaggatgataatggtgatgatgaaatgatgccaactatgtgccagacactagtctcatttattgacttgtgacatttattaatccttgtgacaagccaggaaatcgattctgttattatccttatttcttagaatggggaaacagaagcacagaaagggtaaatgcgcaaggtcacccagccaggacatggagggacaggatttgaacctagaacatattgctccaccactatgtcctgctgcctccatgctggagaccccagaccctttccccagttcctcacccctcctcacccatctaacctgtttgcacatccacaggggctccttcctggtatacccagatggagacgtgtcacggcccctggtccgggagyggctctgggtcaacagtgatttcaactttgacaatgtcctttcagccatgatggccctgttcactgtctccacctttgaaggctggcctgcgtgagggacagggccctgggtttatcaggggatgaggcaggggtctctgcaggaytgggttgggatctcctgggaatgggtgggagtgtaccttggggatgtgacgaaggtctctcgagactggatagggttttctggagagtggtgggtgtatcagaggactgtagaggtggagttcccagaagctgggtgggggttctttggggacttgagtgaggggtctccaggaattggacagcggtttctaagggactaggtagctagatagaagcctggaaaggattggagatggtttggggggacagagtggaggtctgaggggactgggattggtctctgaagagatgaagcagggattcagcgatttctagaaagctgtgcaggtctttgggatactcattgtggggctctgtggggagatggagtggggattcaagttgatgggacagggataaatttacagatcgttgggggcttgtgtggaagttctggggaggcgcatgggggtctccaagtggttggagaaggggatttgaaggtctgtggaaacttaggggatttctgggtctttgaggttctgaatggagattctctggaggactctatgggggtttctgagggcatgggacagaggatttggactctttgagggcctggtagaggtctcttagagtatgtatggaggtcccaggtggttaggtcaggagatttaggggtctttggggtgccaggcaggaaactctggggtgtctgtgataagtagactgggggcaggtctgagggggctgggatatcccctcacctgcccccacctctaccccccctctggctcccacagactgctatacaaggccatcgatgcatatgcagaggaccayggccccatctataattaccgtgtggagatctcagtgttcttcattgtctacatcatcatcattgcgttcttcatgatgaacatcttcgtgggcttcgtcatcatcactttccrtgcccagggcgagcaggagtaccaaaactgtgagctggacaagaaccaggtgacctctgacccctgaccccctatggatggtcaccaacccttccctccttgcctcaggaccccactgctcactcatgccctgccctggtatgcagcgtcaatgtgtggaatatgccctcaaggcccagccactccgccgttacatccccaagaacccgcatcagtatcgtgtgtgggccactgtgaactctgctgcctttgagtacctgatgttcctgctcatcctgctcaacacagttgccctagccatgcaggtctgagatccctgcctgacccccgccagactcctgaccctattatctccacataatcccttgggaaccattgggaacatttaaggctgcaaataacaaaccccctgccaactaacagcaacttaagctataaagacatttgccacatttctttaagtctatggccagtacttgtaagttgcattctgatttcggagatgtaagaatgtggaaaaaaaaaaaaaagtagccagtggccattgtaagttgccatttgttataaaatgcgccccaatttcagagattctaaaatgtaaaaagatgtgcctcctggagtcaatgaactgtggtaattacctcatgtattgagaagtgcagaggtaggctgtttgttcattgttcatccgggacccatgctctatctttctgcttcaccattcttagcaagttggcattcattttcatgattgttgtttcatgatcacagctccaggcatcaaaaccacactcaaggcagggagagctgcacctggggcctctccttatttgatcctttcatcggaaagcaaaattttttttacacaagctgctaaccaacagcagatttatgtttatgtctcactagtcaacctggccttgcctaactacaagaaaagctagtaatcaagaactaaactttccagtatccataatgggaggcagacagtgcaagaggtttgaccaatacacagtgcaatcaagtccccagactcgyctcagcccaggccagggaatatttggttgggtgtggcggcatctctgcctcaggctccatctcaacctgattttctcctgcagcactatgagcagactgctcccttcaactatgccatggacatcctcaacatggtcttcactggcctcttcactattgwgatggtgctcaaaatcatcgccttcaagcccaaggtggccccccttctctagccccacccaccagtggatgaattccttgggagtggagctcattgcagagctctggggttggcgatgcgggcagcagccagggagtgtgagtctagggagtgagagggactcaggtgcaggcccatcgtgtgatccaagcgaagccctgcccccctccggcgccccctactactactggccccctaccctggcttgcgagctttgagaagacagggcactgcttttctcctacttgcagcattacttcactgatgcctggaacacgtttgacrctcttattgtggtgggcagcatagtggatattgccgtcactgaagtcaatgtgagaactggcctttccactaatccactctcgccctatacaccttccctcacctctatcccggggttccctttcacgtgggtgggtggctcccacgcacatcctccctactcctggagactcagtcctcattctagctctatctcttctgagtccctgttgggttcagcaaaagtccccctctactggctttctcattccattttgtaacctatctactggctccacyatctcctgaaatgcctctcctgttatttctgttatctctttcattgcctctacatcccccatccattggctccgtcatgttcactggctcctgctttggctccatcttttctgatgacttcattggcttcatttctccaccaacttcatcatctctgacactggctctttcatggctctgtcatcaccattgactatatcattggctccatcacctccattgggtactacatggttctgtcacctcaactgacaacgctgctggttccctatctccatcactggcttctccattggcttctccatcggttctctcatctccatcatctctatgacaccactggttccatcatttcctctattggctccaatgtctctgatccatcacctcctttactctctcctctcccttccattcccattacccactttttcctaatcctaatccactaccatataaactttcccattgtcccctgtgtaatgaccccaccatcaccccctatatctgctccatcatatctcaccttgttcatttgggcctatgatgtcatcatctcctgtatcacctttttcttggccatatctccctccagaatggtggccaccttggcgaggtagcccaccctaataacagggactctctgcttcttttcccatgtccctctgtccctccatccctccrgattaccctagggcctgagtgatttgggtactgggagggccaaagcatgagatagggagatagctggagtaaatgcaaactgagcatccctactgcacccctcaccccagagctctgaggacagctcccgcatttccattaccttctttcgcctcttcygagttatgcggctggtcaagcttctcagtaagggtgaagggatccgcacattgctctggacattcatcaagtccttccaggtaatcccctaccccatccctttgaccatacctcgcccccatttcacacttctcagcctgcccctttaccaccctcagaactacatctcccaacatgccatacccatttccaaattattattccaattttctcttttttctgggctctcagtttccaacacacctctggtctcactgaccttactctatctacttaacactatgttcacatttgagagacaccacagtccttggcactttggagatggactgcatctcccagtaggcccaggccagggaaagcagtgcattctggggcttatagytctttgcctgagcctgtgcatctattctctgcccccctcccccatccctataggccttgccctatgtggctcttctcatcgcaatgatattcttcatctatgccgtcattggcatgcaggcaagtggggaccctaggaagcatcccttaagcactcctctgctggcaggggatgggttaagaatagccccaaagtaggggtggcaggtagacagacaagctggacggccctgggtcaatctacacatctgtgaaatgagatcagcagtgatgccctgtttgtcagggttatgaggctcctttaggtattaggaggtgtgaaatgggtggggcatgggttcaccccactgacacagccttgatgtgtccacagatgttcggcaaggtggctcttcaggatggcacacagataaaccgaaacaacaacttccagacctttccacaggctgtgctgcwtctgttcaggtgacatctactcactcccctgccaccttatgcccgtgggtgcccacccaccctctctgagccccagactgcttgagctatgggaataatatggcagcatggggctccatacagcccgagatgtttcctgsctatgatgtgaggagtctgttagagtattctagcctcagccattttctttctgactgtaagacgcctccccttctcaggtctcagtgcctcatctgtaagatgcaaacatgactgtcgtcaacatggccacactggctgttaaaatattgaaatgttatctgtgccagatgtagcccctggtgagaagtaggtcatctcctcattccccagtcctcccccaactccatttaccatgacttcatagcctccccttcaggatgctacccctgtgtgactcccaccaggtgtgccactggtgaggcatggcaggagataatgcttgccagccttcccggaaatcggtgtgatcctgagtctgacttcrgccctggtgaagagtttacctgtggtagcaattttgccatcgcctatttcatcagcttcttcatgctctgtgccttcctggtgagaaccatttcctcacaaccaccaccaccgtcacgggggctggccctgaggggctcagggatgtgacgtgggcagcccagatcttcatagtgggtgagagggctggtctgatgacaagatcaacccagagactcatgaccatataagcccgccccagcctcccaccatccgtccatgacagtgttctgcccttcacctaactgctcccttgctcactggcccacagatcataaatctctttgtggctgtgatcatggacaactttgattatctcaccagagattgrtccatcctgggcccccatcaccttgatgaattcaagagratctggtctgaatatgaccctggggccaagtatgccctctatacccttacctagaatccaggggacaatgtattgccctacacagtcccctagcccccaaacctccgactgctgcatctcattacccagtcaatagatgccccaaagtttccactgccccatcctctgccctctctgactgccctccagttcttccctggcaagctctggggtattggtaggaggaggtagtgatgagctggtggggccttgagaaagggctagtgggggcatcgccaatccagtggtacctccccaactcctccaggggccgcatcaaacacttggatgtggttgccctgctgagacgtatccagccccctctgggatttgggaagctgtgccsacaccgagtggcctgcaaggtctgtgcacctgcccacccccaggctcctgagagaactgtctatcacatggcaagggtgggaagggatctgccttgggtggggaggggtgtttgatcgcatcctcagaggtttctgccccttgacattcgttcctgcatacccggcattttcccagagtgggtttcatgtctctcgtgtttgcagagacytgtggcaatgaacatgcccctcaactcagatgggacggtgacattcaacgccacactctttgccctggtccggacatccctgaagatcaaaacagaaggtgtaggggaggggcaggagtgggatcgttcctggggagggtgcaaggagcaaactcattgaatcatgggccccactcctagctctgaaccccagaatgggtgacaggattctccaggcctgtttccccccaccccgtccaatgggggcggtgtgcatctgcggtagcagcttgtgaagttccccccacccaacagtgagggggcagctgtggaggttcttcctattggctcatgccccacatcctcctccaacgcagggaacctggagcaagccaaccaggagctgcggattgtcatcaaaaagatctggaagcggatgaaacagaagctgctagatgaggtcatccccccaccagacggtgagctatccccgccccagttccccgcgccagcccctgaatggcagatgatcgctctccaccacaaaaccagcgctgggcagagggcgaggggaagtccatgctggtgggtagagaggcggcgaggtgggctgggtcagagggcccctgtgtgatcttgccttctctcccttgcccctagaggaggaggtcaccgtgggcaaattctacgccacatttctgatccaggactatttccgcaaattccggcggaggaaagaawaagggctactaggcaacgacgccgcccctagcacctcttccgcccttcaggtcttcggggcagggcctagtgtggatgggcacgtgtggcagtgctgtggctgaggctgacccccattttgatcttgtgaaacccatgtcacagataaggaaactgaggccccaggcctcacggagggccagggtggctgaaggactccttcccccaccctacccgcctgcaggggaaacagagggaaagttcagaccctgagctgcctgcttacctatttctccacccccacaggctggtctgcggagcctgcaggacttgggtcctgagatgcggcaggccctcacctgtgacacagaggaggaggaagaagaggggcaggagggagtggaggaggaagatgaaaaggacttggaaactaacaaagtggggacaagttttcactctcccaggaacttgattgtaaaatacttcgtcaatcccctgagtgattttgacactgcttctgggaagaagctcccccagagaagccccctctgcaatagaaaaatatttatttgaggctgggagtggtggctcatgcctataatcccagcactttgggagtccagggtggaaggatcgcttgaaccctagggttcaagaccagtcctggcaaaatagtgaaaccgcctctctacaaaaaaatttaaaaattagctaggagtggtggtgcaagcctgtagtcccagctacttgggaggctgaggcaggaggattgcttgaacctgggaggatgaggccacagtgagctgtgatcatgccactgcactcccgcctggtgacaggacaagaccctatcgcaaatatttatttatttatttacgtatttatttatttgacatttaccattgctgttggagggcaaggcccacattcatggacctgtgggggagacatgttatatgaccaaatgacttagccacaaagtgcatgcaacactcagtcctgtgactctccacaggccacgatggtctcccagccctcagctcgccggggctccgggatttctgtgtctctgcctgtcggggacagacttccagattcactctcctttgggcccagtgatgatgacagggggactcccacctccagtcagcccagtgtgccccaggctggatccaacacccacaggtattatcaagtgtctggaagtagattgtgagggaaggcaaggactagacactggatagaggcaattcaggaggcaggaagttgaggggggtgggagggagggcctagaggccttcaagcagaaatttgggaagaatggaggtgtttcaagggctcaggtaagaatagagggtgataagagattcatatgagaaaggcaatacaaaggtttaatgcaaaaagcacattgtgtgaaaccaagagtttcagttcacattctgcctctgccatttgctaagtgaccttgagctaatcacttttttttttttttttttttgagacagagtcccgctctgtctcccaggctggagtgcagtggcacaatttcggctcactgcaacctctgcctcccgggttcaagcgattctcctgcctgagcctcccgagtagctgggattacaggcgtgcgccataatgccaggctaattttttttttttttttcagtagagacgaggttttgccatgttggccaggctggtttcgaactcctgacctcaggtgatctgcccacctcagcctcccaaagtgctgggattacaagcttgagccaccgtgccctgcctagtcacttcgtttctatgagcctcagtttcctcacctgtttaagggggatgacaaagcacttacttcacagggataaagaaaggatgaaatgaggtaatgcatgtcaaacacttagctgctagacaatacataagcagattaaagaaaaattttaaaaaaaaatttcagagtgtctagcttgcctaggcacggtggctcacactcgtaatcccagcactttgggaggccaaggtgggaggatcgcttgagcccaggagtacaagaccagcctgcacaacataatgagaccccgtccatacaaaaaataaaaaaatagccgagcatggtggcgcatgcctgtagtcccagctacttgggaggctgaggtgggaggataaattgagcctgggaggttgaggctgcagtgagctgagatcatgctgctgcactccagcctaagtgacagagtaagacctcgtctcagaaaataaaaaatagaaataaaaaaataaagtgcctagcttttacaggctccccccactcctaatacatgcccagttttgtgttcaaggtgtctctctacaggtcaactttgatttttttgaaactttcagtcctaattagatgaacatctattaaacaaaagcccatggtcactttaaaatggttaatggttaattttatgtgacttgtcctcaacaaaaaaatccaaaagcccagtgtttctgtaagggttggggcatgggatgagaggaaccaggggtccagggccacatattgagggatctggtctgcctaacgtgcctccctttccccaggagaggctctggggctctcattttcaccatcccagaagaaggaaattctcagcccaagggaaccaaagggcaaaacaagcaagatgaggatgaggaagtccctgatcggtacactggccatgccacatgggatgaacccatgagctggggtggaggaggggtgggaactgggtcggggaggactgtttgtgccccatctcccaggcccaggtccaggcccagacccaagttcacccctggccctcccacccacacaggctttcctacctagatgagcaggcagggactcccccgtgctcagtccttttgccacctcacagagctcagagatacatggatgggcacctggtaccacgccgccgtctgctgccccccacacctgcaggtgagagcagggatggatccaaggggcccccacgggcctgcaggacagagatctggggaagcactgacattgctatttgcccctggtgccccacccacccccaggtcggaagccctccttcaccatccagtgtctgcagcgcmagggcagttgtgaggatttacccatcccaggcacctatcatcgtgggygaaattcagggcccaatagggctcaggtgaggctgtggaggtggtgctggggtctggggtctggagagatgggggcagcctaggctgaatttctcaaacacagcacatatcaggcccttttttttttttttttttttttttttttgagacagagttttgctctgctgcccaggctggagtacagtgttgagatcttggctcactgtaacccctgcctcccgggtccaagcaattctcctgcctcagcctcccaagtagctgggattacaggtgctcaccaccatgcctggctaatttttgcatttttagtagagatggggtttcaccatgttggccgggctggtctcaaacccctgacctcaggtgatccgcctgtctcagcctcccaaagtgctgggattacaggcataagccaccgcgcctggcctcagagccttctgaagaacaggacacatatgaatgaatgcacacaatgctcactgtacttgtgaggaaactgaggtcctgagaggtttaccccagatcatgcagctagtaagtggcagagcygacatttaaacccaggcctcctgcactcttacataaataaactcaagcctgacttatacccattcaatttcactccagttgtatactgagggaaagaagtaggcacagcggtgagtcctagaccctcataccctrctcatccatccctgcccctctgatgtttattctggctcagggttcctgggcaacaccacctcagcggggtcggctcctgtatgccccgctgttgttggtggaagagggcgcagsgggggaggggtacctcggcagatccagtggcccactgcgcaccttcacctgtctgcacgtgcctggaacccactcggaccccagccatgggaagaggggcagtgccgacagcttggtggaggctgtgagtccagagggcatatagacaagacggatgggggagaaggggaggaggtgggtactggaggaggayggaaaggagtccccaggtcctgtgttgtgcatgtagatatccctttgccctacgacctctgctcacccctgtcccccactgacttccctacatgccctcatgggcacgtcatttatccacactgaaccttctgtgcacactgtgccgtccgtcaacactgatcccacctgtgcccccaggtgcttatctcagagggtctgggcctctttgctcgagacccacgtttcgtggccctggccaagcaggagattgcagatgcgtgtcrcctgacgctggatgagatggacaatgctgccagtgacctgctggcacagggaaccagctctctctatagcgacgaggagtccatcctctcccgcttcgatgaggaggacttgggagacgagatggcctgcgtccacgccctctgaattcccacccctccccaactgctcaataaacctcctgccctcccctccccagcaggaggcaggcatggaccacatccctggattttgttgtctttgcactgggggtctggggctgcccaggggcccccatccatccatcccctgttctagccctgagccactgcccacacacgggtatttccagaaaccaggacagccaggcctgattattcagcgtcagggaaggagggaggaggaggaggaggaggaagagacagcagccaaaaaaagctggaggcagagtggaggaggggggagggggagggcactggacagagatggaggaaaggggagagagcgggtgtgaggggtgcttggacccagagaggaagagaggcagagatttcaccagggctcagccaggtcaaactaggaagggtagacggatgagaaggaaaggacaaggaaacccagagaagaatcctgccaggggagaggcctggaggttggaatcggcctggtatgtgatgcatcttaggcagaggggtcctctgacggcaacaggaattttagggtggctaaattgagatcgctctgtctcccatctcccactttctgcctgagaaagaaaagaaaacctaaatccatcagtagacaacataggtgacagcaaaggtcagggctcccagccctggggaacccactcagggcccacctggctttcctgagaccacctaacagtaacctactcttatcccacacagatcccagaggtcctctctgcttcttgccccagctttactcttcacccagcctttggggttacattcgctcactgaaggcttatcaggcatttactatgtgccaggcaccggctctgggtttctctcggggcaaactgaactggttgaaacacgggacaggtctcatccaaagtgggagtcagccccactccagaggaattgaaggtagcattgggagtggtgcaggatgagaccaccagtcggggaggaactcttcccagctcccagaacaggggtgtctcatttgtataatctgcgccaatcaagccaggactgaaatttgagggaagccagaattggagactaggactgagaagattgagttacattaggccttgaaacaaaggcttaaagtggttgggctggagttaggtgagaacagcaagtcatgggcagggcacagagagtgaagggagactgttgagggatgaggtgggagaagccactgaggccagatcaggtggaaccttgaatgccaggtcccaaactctgggatttttcctataagcagtggggagccatgggagggatttgagtagggtagtgacatagttaacattgcattttaaatagatgttctgacggctrtgctgaaaacagaagggagggggaagagactggagatgctaaaattggcaggaatgatggtcgccttagccagaggaggtggcagaggagatggtgagaagtgagtggattccagagatgtgtaggaggtaaaatgaaccatttattgggccctgtgctaactgcattacagtgatcatctcgttgaatcagtgcaacaaccttataggtatcattttaaaccatcttacctgtccagggtcaaacaagaagtatcagaggtggcattcaaattcaagcagtttgatgccaagatccatgcttttaacccctcctgtgtactgcttccccaataaggcaacaacagggaagtatccattacatatatgtgtgaattttcatgtttaaaaaaacaggtattgagctgggcatggtgactcatgcctgtcatctcagcactttgggaggctgaggcgggaggatcacttgagcccaggagttcaagaccagcctgggcaacaaagtgagacctcgtctctacaaaaatatttaaaaattagctgggcrtggtgtctcacgcctgtggtcccagctacataggaggctgaggcaggaggatcgcttgagcccaggaggtcgaggctgcagtgagccatattcatgccactggactccagcctgggcaacacagggaaaccctgtctcaaaaaaaagatattcattcagatggttcaaaattcaaaaggtaggccagatgcagtggctcacacctgtaatcccagcactttgggaggccaagtggacagtggatcacttaaggtcaggagttcacaaccagcctggccaacatggcaaaaccccatctctactaaaaaaaaaaaaaaaaaaaaaaaaaaatagccggacgtggtggtttgtgcttgtaatcccagctactcaggaggcagaggtaggagaatcgtttgaacccaggaggcggaggttgcagtgaactgagattgcaccactgcactccagcctgggcaacagagtgagactctgtctcaaaaacaaaacaaaacaaaactactgagatgctgtttttcatctttcagggtggtgagtatcaaaaagtttgataatgttccatactggcaggttggccagaaacaagcgttctcataaatcgcttgtggaagtttcattggtataacctgtgtagaaggcaactgggcaaaatctagaaaaataaattcatttactgttttgttcagcttcatacttctaggaatttcttacaggtagactcatatatgtgctaaaaggtgtatgtataagatgatacactaccaggctgtttatttttttattttatttgagatggagtctcaaaaggtacaaaggggtataaagtgaaaagtttccctaccctctggaagcaaatagtattatcaggtatctttcacagacatacaagatggtgtgctgaaaaaaaaaagatggtgtactgataagttagcacagtggctaagagtaacaggtgctggagccagacttcctgggttcatatcctggttctaccaatttaccagctgtgtgaacttaggaaaattcctctccgcctcttagtttattcagctgtaaaacaaagatagttgtcgtacctgtcacatagggttacagtaagaatttaagtgagtaatacaggcaaagttctctaaagagtacttgacagaaaacagccacaatttaaatgttagctattctctgtctgatataacccttctcttctctttgtacacaattaccacacagtttgacatcttgcattttttacttaactaaatatcttggcaatcattccatagttccatgttattataatgacagcggcatagtatcagagtttatttaaacaggctaccaacaatgagcactttgggagtgtccattctttatcctattataaacagccctggcctggcccagtggctcacacctgtaatcccagcactttgggaggccgaggcaggcagatcacatgaggtcaggagttcatgaccaccctagccaatatggcgaaaccccatctctactaaaactacaaaaaaaaaaaaaaaaattagatgggcgtggtggtgaatgcctgtaatctcagctactcagggagggtgaggcagggagaattgcttgaacccgggaggcggaggttgcagtaagcggagatcatgccactgcactccagcctgggcaacagagtgagactccgtctcaaaaaaaaataaaaaataaacagcccagtcatgtattatcttatacatatatcttttagcacatgtatgagtctatctgtaagatgaattcctagaagtatgaaggtgaaccaaacagtaaatgaatttgttattttttttttttagattttgcccgattgccttctacacgttataccaatgaaacttccacaggcgatttatgagaacgcttgtttctggccaacctaccaatacggaacgttatcaaactttttgatactcaccaccctgaaagatgaaaaacagtatctcagtatttttgtttgcttgtttgtttttgagatggagtctcgctctgttgcccaggctggagtgcagtggtgcaatctcgcctcagtgcaacctccgcctcctgggttcaagcaattctcctgcctcagcctcccaagtggctgggattacaggcgcctgccaccacagccagctaatttttgtatttttaatagagatggggtttcactatgttggccaggctagtctcaaactcctgacttcaagtgatccactgtccacttcggcctcccaaagtgctgggattacaggcatgagccactgcgcctggccgaagttgagcatcttaagccccaactgtattttggattttgcatcatagccatcactgttgaccttgatgggcctagttttagtcgcaggaaggagggttattccaattaagagagagctaaggaataaataggtaaagtggtagagttcgagtaggcattaatttgacaaagaggaagaaagaaataagggagatggctagatgggggcaggagtttcagggtgtgcttaaaatgcagactatgaaaaaggaacctggaaggccttgaaccgtgtttaaactgcagggactctgggcactgccagctagtagctggctgaccttgtgagagtcacttaagctctctggggaattattttcctcgtctgtaaaaacggcctaatagtccctacaacgtaggacttctgtaagcattaaatgagtgaacatgtttaacaaactcagaaaagagcctggcaaagttgtcacactgtaggaccgagcagggaggtctcctctccccggccctcgacttgtgttttcccaacgcatattcccgcacgctctcacggctccagcctccgggccggaatggctgccggtgagactgtggtacaacccgctgtgcgcaggcgcgtggcgggcaaggagggggcgcgaggggcggggctgcagccgcctgggctgttccaacgagcgcgcgccgcccccgccgcgccccgcgccgcccttgctagccgagcctcccgccccctgcattgctgatgctgctgctggcggacatggacgtggtgaatcaggtacgcgctccagcaccgtggacagagcccgccgccgcccggctgcctaggccgggtcgctcaggccagccgactctgggaggtggtggccagggtctggcagcggagacccggtccccggcgctggggatgggggtctgcggcaggtgaaggggaggaagggggaggtggagaaaaggagtgcgctctttgccgcagcgagggccgtcctcactgccgcagcgggggcccccggagccccgtttattactggcgaccgcgaggggaggaataggggcctgggggctggagtgagggcaagggacaaggggaggggagagtggaaggaagatggggggtgctgcggataagctaggaaatagagcgacagaaggtgtgggggcggggatgggggagagggctggcacccgcccctcccaaacagagactgtacccccataggcgaccaccccttcccccagagcacacctaggggacaatccggttttactccttccaaaacccccagcctcctcacccccaacacatagcgactgaagccgtgtcccagccctcccccaccttaatcagtccagaccctctccgccatgtctctcgtctttgccacctcagaaactcacccccaatcagtcccaacccttccccatccccatcacctcaaatatctaccgccaccgccgtctaacacacctttacccctgcagacccttcccccacctgagccaaaccgactcctgccccgttatgactcaccttcaccatcacaacccccccacccgaatgcaccccactccatccccattctctacccgaaccccttccccatccgactcgcctttacgtttcaaacctgctccccctccttaactagtcctgacctcatccccatctccctcacccccgacttcctctgccatctgactcaccatctcttcagaccttcccaccagtccttggaccctggggctcacaccatccccaaggtgtcactttctccttctcaccctctccccgaggtcacatgctccatcccctggggtcattgatgggcagccttgccgctcacctccctgtacctccaacaacc

SEQ ID NO: 12300 - DNA, 13057 bp, Homo sapiens
ttacatggcaaaggggaattaaggtttcaggtagaatgaaggttgctaatcggatgaccttaaaatagggtgattatcatggatcattacactggcagccactggggccaatgtcatcacaagggtccctaacagtggaagacagaggcacaggaggtcagagggagacacgactgccgacaaaaggtcagcgatgccatgtgagagagacttaacccccgcggctggctttgaagagggccccattctaaggggccacgagcccaagaatatgggcagcctctgagagaaggtggaagaggcaaataaactcacccagagcctccagaagaatgcagccctactggcaccttggctttagcccagagagacttttgagctctggaaccgtaagataataaaaatgtgtgttgtttgaagccactctgctgttggtaacttatgttagcaataggaaactgatatgatatgtgaaaaagggactccaactggttaccaggtttctttctttctctttcttcctttctttcttgacagagtctcgctctgtcgcccaggctggagtgcagtggcgcaatctcggctcactgcaaactccacctcccgggttcacgccattctcctgcctcagcctcccgagtagctgggactacagccacccaccaccatgcctggctaattttttgtatttttagtagagacggggtttcaccgtgttagtcaggatggtctcgatctcctgacattgtgatccgccctcctcggcctcccaaagtgctgggattacaggcgtgagccaccacgcctgcccttccttccttccttccttccttccttccttccttccttcctttctttcttcctttctttctttttttctttctttctctctttctttctctttctttctttccttctttcttctttctttcttttcttttttttttaagacagggtttcgctctgttgcccaagctggagtgcagtggctcaatcttggctcactgcagcttcgacctcctggactcaagcaatcctcctaccttagcctcccaagtagctgggactacaggcacctgccatcatgcccagctgatttttgtatttttttgtagagacagcatctagccatgttgcccaggctgctctcaaactcctgggctcaagtgattcccctgcctcagcctccaaaagtgttgggatgataggcatgagccactgtgcccagccgactaccagatttcttatctgcatttgaaactagaagtttctagacctgagaaaaggggactgctagcctaaaatctcctggctaagatatcattcacgtgggagggcaaaatgagggcatttctaccagaagtggttcaggtgtgtgtctttctaaactaatcctctctgatacctcctgagctgtttttttttttaaaatagctttattgagatataatttacaggccataaaattcccccacttaaggtgtgccattcaatgcttttagtaccttcacagagttgtgcagccatcaccactatctaattttagaacattttcsccacccrcacccccttggcagtgtattcatttgctcgggctgccataacaaaatgccgcagactgtggttaaacaccagaaatcgatttgctcacagttctggaggctagatgtccaagatcaaggtgtcagcagggttgatctctttttctgagacaggatctcactctgtcacccaggctggagtgcagtggtgcaatcttggctcggttcactgccacctctgcctcctgggctcaatcagtcctcccatctaagcctccctggtagctgggaccataggcgtgtgctaccacactcagctaatgtttgtattttttgtggagatgcagttttgccatgttccaggctggtctcgaactcctgagctcaaacgatccacccacttcaggttcccaaagtgctgcgattacaggcgtgagccactgtgcccagacagttggcttcttctgaagcctctctccccacctttcagatggctgtctcctggcacccttacggggtcctttcctctgtcttgctgtttctctgtgtgtctgaatcttctcttcttgtaaggacaaccatcagatttggattacggcaccctaatcggcctcattttaacttaagtatctcttttttaaaactcctcctgaatctccctagaaatatattttgaggtactatggggtacctcaaaggagcttcaacgtatgaatttgggggaagaaaattcagtccataagaggcaattattccccattcccccgctagctcccaacccagacccaagcaaccgcaaatcactttccatctcaatggatttgatttgcctattcttgacattttatataaatggatgagacaatatatggtcttttgtgaccgtcttctttcacttaacaatgttttcaaggttcattaatattgcagcctgtatcggtactttcttcctttttactgccaaataatattccatcgtatgaatataccagttttgtttatccattcatctgttgagggacatctgatttgtttccactttttgactactattaaaaatgcttctatgaatatttgtgtacaagcttttgtgtggacttgctaggtcatactgtaactttatgttgaaactttttttttttgagacggagtctcgctctgtcgcccaggctggagtgcagtggcgcaacctcggctcactgcaagctccacttcccaggtccacgccattctcctgcttcagcctcccaagtagctaggactacaggcacccgccaccacatccagataattttttgtatttttagtagagacggggtttcaccgtgttagccaggatggtctcgatctcctgacctcgtgatccacccgccttggcctcccaaagtgctgggattacaggcttgagccaccacgcccggcccctatgttgaaccttttgaagaactgccaatctgtttttctatgtggctgaaccactttacaattttaccagaatgtatgaggggttccaatttctctataacctcacttgttattttctttaaaaaaaaaaaaattatagccatcctagtgggtgtgaagttgtatcccaatgtagttttgatttgtactttcctaatatctgatgatgttcagcttctttttaggtacttgttggccattcatattatatcttctaaggagaaatgtctatttagaccctttgctgacttttttttttttttttttttttgagacagagtctcgttctgtcacccaggctggagtgcagtggtgcaatatcagctcactgcaacctccacctcccaggttcaagtgattctcccacctcagcttcccgagcagctgggactacaagctcgcaccaccacgcctggttaatttttgtatttttagtagagacggagtttcaccatgttggccgggctggtcttgaactcctgacctcaagtgatccgccggcctcggcctcccaaagtgctgggagtacagttgtgagccaccgcgcctggcctttgctgactttttaattgggctctttgtcttttatttttgagttctaagagtgcattatatattccggatacaaacctctttgctatactttgaatgtttgtttccccaaacttcatgttgaaatttgactcctagcgttggaggtgggctcggtgggaggtatttgggtcgtgggttgggaatccccatgaatacgttaatgccctccctaggggaggaggactgagttggttcctgctccatcagttccagagagagcccgttgtcaaaaggagcctggcccctccccctctctcttgctccctctctcgccctgtgatctttgcacctgtgggctcctttcaccttccaccatgaatgcaagcagcctgaggctctcaccaggtccccagtcttccagccagcagagtcgtgagccacatttatccagcctcaggtattcctttatagcaacagtaaacagacaaaaccagatcttatcagatatatgatatttgcaaatattttctctcattctgtgggttgtcttttcactttctagatggtatcatttgcagcaaaagtgtttaatactaatgtggtccaatttatttattttttctttggtcacttctgcttttggtgtcatatctaaaaagcctccgccaaactcaaggttatgaagattgcatgtatgttttcttctaagagttttatagttttagctcttatatgaaggtctgtgatccattttgagataaagtttatgaatgatgtaaataaggtttcaactttagtcttttgcatgtgggtatctagttgtttcaacaccatttattaaagcctgttctttaacttggcgcccctgttgataatcaattgactgtaaagttaagggtttatttctcaactctctatcctatttttttttctttgagatggagtcttgctctgtggcccaggctagagtgcagtggcgtgatcttgactcactgcaacctccgcctcctgggttcaagcgattctcccgccctcagtctcccgaatagctgggactacaggcgcatgccaccacacccggctaattttttgtatttttggtagagatggggtttcaccatgttggccaggctggtctcgaactcctgacctcaggtgatccacctgcctcagcctcccaaagtgctgggattacaggtgtgagccaccactccctgcctggactgtctattttattccatcaatgtatatacctgtacttattctttttcaagactcttctggctattctatggtcccttgcatttccagatgaattttaggatcagctttctaatttctgcacaaaataaaagtggaagcagctgggattttgacaggaattgcatcgaatctgtaggtcaatttgggctctcttgccattttaataatattagctctttcaacccataaatggatatctttccgtttataggttttctttaatttctttcggagtcgtttcatagttttcagtgtacaagtcttacactttttttgttaaattcattcataagtattttattgttttgatgtcatgtaaatagaattgttttcttaacttcattttcagattcttcatagcaagtctatcgaaatacaattgatgtttatatgtttatcttatatgcttggaccttgcagaacttgtttattagttctgatagtttttgagtgggttccttaggaatttctataggtaagataatgtcatctgaaaataaaaatggttttacctgtttttgtcactaaagttctcttggaacacagtgacatccactcacatatggtctatggctgtcttcaagtcaaaggccaagggaagtagttgtgttcccggaagcaagtcaggtccagctgcctcttcttgagtcccaataatgagaagcagacaaactagcgaagaagggaattggccaggtgcggtggctcatgcctgtaatcccagcactttgggaggccgaggcgggcggatcaccaggtcaggagatcgagaccatcctggctaacatggtgaaaccgcgtctctactaaaaatacaaaaaaaaaaaaaaaaaaaaaaaaaaaattagcctagcgtggtggcgggtgcctgtagtcccagctacttgggaggctgaggcaggagaatggcgtgaactctggaggcggagcttgcagcgagcagagattgcaccactgcactccagcctgggcgacagagtgagactccgtcccaaaaaaaaaaaaaaaaagggaatttattgctgtaaccggatacaggcagaaggccagagataattccaccagaccaactcaaagtgttagaattgcttatacaggttggagttatgtgcctacgtgcagcacaacattcgcctaagtctattggtaactaattttgtttcaactagaaggtcagaggcaaaaaaaagcttgtgggagacaggcccttgggggtggaggtctttgatttcataagaacctgagaaagatttttctaagatatgtgtaacacaccaacttactgtgacctgggaaaggctgctgaggatgtcttcaacaaaggatatggctttggcatggggaagatagacctgaaaaccaagtcctgtagtgcagtggaattttctacttctggtcatgcttacactgatacagggaaagcatcaggcaacctagaacccgaaygtaaggtctgtaactatggacttaccttcactcaaaaacggaacacagacaatactsttgggacagaaatctctttggagaataagttggctaaagggttgaaactgagtcttgataccatattggtaccaaacacaggaaagaagagtggggaattgaaggyctcctataaatgggattgttttagtgttggcagtaatgttgatctagatttttccggaccaaccatctatggctgggctgtgttggtctttgaagggtggcttgccggctatcagatgagttttgacacagccaaatccaaattgtcacagaataatttygccctgggttacgaggctrcagacttccagctgcacacacatgtgacygatggcactgaatttggaggttctatctaccagaargttaatgggattgaaatgtcaataaaccttgcttggacrgctggagtaacaacacccattttggcattgctactaagtacaagctggattgtagaacttctctctctgctaaagtaaataatgccagcctgattggactgggttatactcagacccttcgacccggagtcaaattgaccctttatcagctttaatcgatggaaacaacttcagtgcaggaggtcacaaggttggcttgscrtttgaactgcaagcttaatgtggtttgaggaaagcatcagatttgtccctggaagtgaagagaaatgaacccaccatgttttggccctacaatccttctgtgaaatttcaaaagtgtgaactttttactcttccaaaaaattgtaatcctccccacactgaagtctaggggttgtgagtccctcctgaggggaggcgctggaaagcatgcctggaagctgtcctgtttgtgccacgtttcggttcagttctgcagtgttattaaatgtgttcctcggcgacagtgtggtgtcatgttagaggagacgatctgaacctccagtttgtacctcgtgtcctgcatgttcacaccatttttttcatgactctgtaatatattggtctctgtgctattgtggaatctttgattttgcatcagagtaaaataaaataaacccatcacatttggaacataaaaaaaaaaaaacaagctaagtctgattaagctgtgtgggccccagtaccttcaaggcctgtctcctgtggtaccagagtgattatttctatcttatctcctttacagcttggtctggagtgctgccttagactctctgatgaatctattcaaacagctgcctctgttaccttgactcgtctcagattttgtcgacccgaggcaggtcctggcactaggaatgttagattctattattttgacttgctccaggttagggagaagcccatgcaaggcttctactgaccgtatgctttatttgtagctttgatgtctgggcaccgattgccctaggtttaactatttgctcagtgttaaggcagcgctgtggaaatctgtgtaactggggtgctgtgcaggcctgtctgtcgactgtcatacaggcccgtctgtgtgattgtcagggagaattggcctgccacagttgtgacagaccacatggctttgaaaaagccaaaactatttaccagctggtcctttgcagaaagtgtactgacccttgttctgcaggagtgtcttttgtttttcactgcctctaattaatttcttaattttgaaataatgtattttctattctcaagatttttttgtttgttttccaattgctcttaggcaagatcttcttgactctcctcatcacttctctacgattccctcctttagacatgccacattctgactgcgcagcctggcgggaagaccgtgcctccctgggtggggaggctgcagcctttaaacttcccaacaccccgacccctgacacgtctgctcgcattcggatgcccgggcctcccggcctccttgcgaatgaagtgccggcggctcccacaaaggcctggctgccacagtccccacggtaattgcgagacagcaggcaggagaagtgagcgggaagtttcttccccaaagctgatggtgaacgggcccccaagctgggacccgatgactagctgggagtgaggagagattttggctttcctaggtgtgagctggatggggcttcccttcccagtggcctcagggctcctgggaaggggcacgggctccagggggacccttaggcctctctaggatggctggctggttgtcccaggcatgtacttggcttagttttcttcttcaattaagtggagacattaagttcccataaagtgggaacactcagacttggctgcagaacagcaggcctgctcccgcccagccctgtgacacagccaggtgggagcaggtccctggagaaactccagccagcctgcccactgagggggagcctcgggaagttcacaaggtttgcagcagggaggagcctggcccctccccttcctgcgtggaacccgggattccgactgccaggccgggcgggaagcgctctagcggagggactctggccttgcgagaggaaaaccagaaaattctgtcatggggctctggaacccccatgctcacccgctcccgccctggggagtatacttctgctgtcaataaatctctgcttttattgcttcattctttccttgctttgtttgtgtgttttgtccagttctttgttcaagatgcgaagaacctggacaccctccaccggtaacactaggtcctcctttctccttgcaaacagtggcactaagaagttgccctccacaagacaggtagcaaagattttcccccagccccgtctggccacgcttcttattgatgggtccagatctctaagtcaccccagcagaaggctggagtgctccccggtatgactatagggccctcatcccagagtcacccctcctgccttcaaagccagtaaaacatgatcttagggaaatcacttttgagtgggggagcccgagagaggtgaaattaaaataagctccaggccgggcacggtggcgcacacctgtaatcgcagcactgtgggaggccaaggtgggtggatcacctgaggtcaggagttcaagaccagcctggccaacatggcgaacccccatctctgctaaaaataaaaaaattaagctgagtgggcatggtggcgggaggctgaggcaccagaattgctagaaccaaaaaaaaaaaagctccagctttgacccacaggccatcttcaaggtgtggaagccaaaatggaccagaagtaatttctatttcctgccagatagaacacaagcaggagccgtagttgccaaaaatgcccgcgcacacaggctagtggtctctgaccctcccagggcactgcttgggttggaatggcggcgctcacgcaggattccttcaattctgcactgtcacaagcccacagggctggagaggctggcagcacaaagaggaatgagactcgcttgctggtctcatgaagttcacagcctagttggggagcctgcaagtaagaagacaatcccgatgcaggagggcaggcgtgtgaccccgaaacagtgtagagaaggagcctgcagcctgtggtgggggagggtggtgctgagcggtccaggagagacctgacacatagcaggattgaagatgatttgccaggcaggctgaggcagtgagcagggcaggagaggaggcagacacgtgccgaggagcgcaaggcacattaaacgaatggatgaatgaaggaaaactagccatgctgtgtttaaggaaaacaactgctggtaataactgagttgggcaatgaaattaatggtgtgaatgaaaaaggggtacagggtcacaggtggtcccccaaacccctgagacatctgtggttgtctaagcgtgctttactttggattctggcatgcatttgtaactcacttatgctggttaatgtgaaccagacatggtctcattggtgaatcatcgaaagcaactgtgtttctttccattatttgtggtgagtttcgttttggcaaacactaagcaatggagaagatggtccatggagctggctcctcagcagtgaccccagggctggaaaaacttcaagaactgggcaggcagtccaaggccttggagtctgcagaaatacatgctcatttggctcttattccagtcacctgtgtgacctcctggggcctcagtttcatcaccctctggacaagtaggttggatgagatgccctttgaagacttgctagctctgttatctgtgactctgtgactatcctgaacccaacaaacagccaaaatcatctttcctgcctcccttacaaatggaaattccagcccaggagcgcttggaggcatgggtcgtcagcctggctgagtgtcctgcacccacacacatcagatgtcatgaaatcactgactctggcaaggaaactttccaaatcctaggactggtgacctccagaaataagtcattcgggggagccacatgtccaaatgttaattttctttttatcagaagaatggaaaacatgaattcatgtacttttaaggaataaagcctttgttcagaaaatgcaaaacgtgccaaatagactgtggtttcaaattatgtttcgttaaggaagaggggaggggaggcgagggggagggtactgaagaagggcagaaaaggcctttctcgggatctactttgtgtggacatcggcatctcatctgagcctcagcagcacctgccagatgggctttaggattcccacctgccagaggaggaatggaggtcagagaggtgtgagctggaggattaacacaaggagcctctgactccccaagcatcccagggtctgtcagacaaagaccaatgcccactcaggtggaagcagggcacaggataggatgtgagtggtcccaatctgtcgtctctcagctcctcctgcagctcatgaagccctctgatgaacaaacatcagctgcaagaaacaacctctccaggagcaagacggtaacaacttgtcagacttcagggcagcagggaaaatacctgatctggagatcagagtgggccacatgctgaaagagcatcaataaaccaggctgcaaacaagcaggcctgtatcccaaggtctcagcacaggactttgataggcagtgaccaggggttaaccttgcctttccatagcacagctggaatgtccccaggtgacctgaggcttgtgcattttagtaaattttaggatgcaacaagactctcctgtagcaaagagaccactcttgaacttgtgaagagagggacaaatgaggttatgagagggtaccaccctcaggggctgctaccagggctgtaggagatcatggtaccctttcaggtttgacaactctgggcttaaacaaatacaggaaggaaagtggaggtgctacaaccaatcgctagggaactctaaatacctgtacacggtgagggaggtacaaggagacagggagagagagaagcacatagagacccaaactgcagcccatgacactgatgttcaaccccagcaaactagaacgcatgggcactgggattccgagtcagaaaaacgctgcttgagacttggctccaccatttactatatcttggacaaaactgcttaacacacacagcctctcctcaatcctggacaggaggaaaatagcgacccttcattgccctcctaactgccagacgctgacaaacgccttaaatgctcttgttcagaccgtttttcaaaaggtagctattaacgttctgtgacacggggaagggaggcaatagtgcccatactggtaatgcatgaggaactttgtcttcttttttttttttttttgagacagagtctcactctgtctcccaggctggaatgcaagatctcggctcgctgcaacccctgcctcctgggttcaagcgattctccttctgcagcctcccaagtagctgggattaaaagtgcgtgccaccacgccgggctaactttttgtatttagtaaagacagggtttcaccatgttggtcaggctggtctcgaacttctgacctcaggtgatccacccgcctcagcctcccaaagtgctgggattacaggcgtgaggcactacgccgggccggaactgtgtcttcttacacacggggagtgagaccctggaggatctggggtttccagccaccagtgagattcactaacctttaggaaagatggggatttaaaaaccagagacaacctggacgaactacttgacgctgtgtacggtaaatgtgatttttcacaggctgtggttctggggasccgtgtgggctcttgttgagctgggggagatacttcgaatactgatatcgccccaaagctgcaactctccggccccgccacggctccttatgtacaaagagagggaatcagtcgccggtgacctcgacggccctcggatcagggatgccccgagtccgagcgggcagggtgctcagcagggccaggtgatgggaatcatggggccatcgagcacggaccctggctcccccggtggcctctgtgagctctggggtcaggcggggactggaggagcgtccgcgccgggagggagcgcaccgcgccacgtgcccgcccggcgccccgcccccaccccggccacgcccctcgcgcttccctcaaagccccgcccctcagccccgccactctcgtccgccccgcccctcgcagcctcaagctcagcgctcccggaggcgcggacggtggggccccgcgccttttgtgtcgggctttgaccgccgcgcgcgctcattcacctcagcggccgcgggcgg

SEQ ID NO: 12301 - DNA, 12939 bp, Homo sapiens
gattgatcccagggatgaaagaatggttcaccatacgcaaattggcacatgtaatacatcacattaaaagaaccaagaaaaaagactgcgatcatatcaacagatactgaaaaagcatttgacaaaattcaacatttgtttgtgataaaaaactgggtttagaaggaacatacctcaaaataataaaggcgatatatgacaaacccacagttaacatcatattgaattgggaaaatttcagaaccttccctttaaggtttggaactaaacaaggatgcccattttcaccacttttattcaagcatagtactggaagtcctagccagagcaatcaggcaagagaaagaaataaaaggcatccaaattgggaaggaggaagttatattagtcttgtttgcagacaacatgatctgatagttagaaaaacctaagaactccaccaaaaaaaaaaatgtttagaactaataaacgaattcagtaaagttgcaggatacaaaatcaacatgcaaaagtcagtactatttatatatgccaacagtgaacaatctaaaaaaaaattaaaaagcaaacccatgtataatagctatgaagaatataaaatacctaggactcaatttatctaaagaagtgaaagatctgtaagatgaaaactatgaaacactaatgaaaaaaattgaagacgacacagaaaatggaaagatacttcatgcttattagttggaaggattaatattgttaaaatgacaatacttcccaaaggaatttgcagattaaatgtaatctctatcaaaataccagtgatattcttcaaagaaatagaaaaaaaatcctaaaatttatatggaatcacaaaagacccctaataaccaaagcaatcctgaacaaaaagaacaaaggtggaggcctcacacgacgtgacttcaagatatactataaagctaccgtaaccaaaccagcatgttactagcatagaaacagacacatagaccaatggaacaggatagagaacccagatataaatccacacatttacagtgaactccttttcaacaaaggtgccaaagacatatgatgaggaaaggatagtctcgtcaataaatcgtgctgggaaaactggatatccatatgcagaagaatgaaactagacccccatctctcaccacatacaaaaattcaatccaaatggattaaagacttaaatctaagactcaaaactataaaaccactagaagaaaacattgcggaaacactccaggacattggtctgggcaaagaatgatcttgtgtaagacctggaaagaacaggcaaccaaagcaaaaacagagaaataagattacatcaaactaaaaagtttctacacaacaaaggaaacaatcaacagagtgaagagacgacccacagaaaatgtttacaaactatctatctgacaagggattaataaccagaatatataaggagctcaaacaactcagtggcaaaaaaaaagcaaaaaacccaaatgatctcatttaaaaatgggcaaaagatctgaatatatatttctcaaaagaatacatacaaatggcaaacaggtttgtaaaaaaatgctcaacatcactaataatcacagaaatgtgaatcaaaaccacagtgagatgccatctcatcccatttaaaatggcttttattttaaaaaagacagggaataatagtttttggtgagaatgtagagaaagcagaaccctcattcattgttgatgaatatacattatttttggtggagttcttaggtttttcaaactatcagatcatgttgtctgcaaacaagactaatataatttcctcctttccaatttggatgccttttatttctttctcttgcctgattgctctgactaggacttccagtactacgattgaacaaaagtggtgaaagtgggcatcagtacagccactataggcaacacaatggcggtttctcaaaaaaataaacatagaactaccataaaatccaacctttccactactgtgtatatatccaaaagaaagcaaatcaatacattgaagaaatatctgcactcccatgtttattgcagccctattcacaatagccaaaatatggaatcaatctaagtgtccacctcaatggatgaatggattaaaaaaagtggtactatatgcagtggaatattattcagccataaaaagaatgaaatcttgttatttgcagcaacatggatggaactggaggtcattatgttaagtgaaataagccaggcacaaagacaaatatcgcatgttctcactcatatgtgggagcttaaaaagtggatctcatggaaatagtagattggtggttatgagaggctgggaagggtataggggactgcaggatgaagcgaggttgattaatggatacagatgtatagtttgatagaagaaataagactgagcattagagatcagtaaggtgactatagttttcagtaatctattgcatatttcaaaatagtcataagagaaataatttgaatgtttctggtataaagaaaagacaaatatttcaggtgatgaatagcccatttacactgatttgatatttacaaattataattgcattcaattatcatatgtactccaaaaacatattcatctattatgcataaatttgaaaataataaacactcatataaggagacacacagaagagatctgacacacagatcatgggaggtgacgtgacctgagatgcagagatcaaagtgttggtgccacagaccctgaagccaggagcccccagaagctgggagaggccagacagggtttctcccctggcagctgggagaggccagagagggtttctccctttcctcatctggcaggggaggaaaaaggaatgtcctggctgggtgtgggattgtaggaagtgagggagggggcgggctgatgcggaaggagaacattccagagggcacagtgagtcccaaagccccaagcggggtggcaggagccagcctatctgaggagcacctggggccatggaattagagtggcgagaacaggggaggtcggaaaaattggaccagagaggaaacagaggtcaggtgggacaaattcttccctcagagggtgcgggctgtgcaggaacaagggtggcccatggacagcagctcctccagtagggagtgtgggagatagatagccactgaggagggcgaagggcccaaacagggagccaggagcgggctcaacagcctctgcttgggtgccctcagccaggcaggggccagcctggccccagaggcacaggctcacctaattggcagtgtgggcctttccatcatcagggggataattggaccctggagtccctatgctcatcagaaaaagccacagtggtttctccccagtgcctcaggcagcccacttctcaagagcatgttcaaggctcgtctggtcactgtggccagactgggagttgctggacacaggcagaagccactcttcactcctgcaggcagctgcagccgtttgcagtgaggcttccagacgccccaggtaggatccagcactttccatgttgccgatgggctcctttrgctgtgattttagggtacgttgtattccttgcatggggagagagctcttcttttatgtgtgtgattgacaatccccactccacatgccccccacatacagtctggagcagggactcccctctgcagtctcacggccagcaccaagcaggatggctcatggatgctccataaatggcccttgcatttttgagtactgtgctgggtacatattcacaggcattgggttatgccctgatgtctaacatcatacccagaatcagccagcagcctcaggtggctgaatggggcagacagcatttgctcactcatcattgacgaggactggttctgggtggctctgccaggcaccagggaaggcatcagagtaaatggctgcaggctgatggtaggtgcagccgggaggagctactgcagtacccgtctcacggaccaccccaaaatacatctgttctgtggtacggaaagcttcactttcctctctcagattggagacctaggtttgaatttgtgactgggcaaaaacagtctttgtaacatattggagaaccttgtttacgatgagaggatgccagcctccctcggcagcgtccgcttggactttcagtctgtccacagaaaccagggaggtacagccaagttaaaaaggcagccatgcccgcagcgatggggtaccctggaacagaaacgggcattcgagggaaaaaaagatgaaagccaaagtctggagtttagtccacagtaataccaatatcaatcccttactgtgacaaatataccctcttcatgtaggaagttagccttggaggaagctgaatggaagatctcccagagctctctgcactctctttgtaacttttctgtaaatctaaaattattccaaaataaaaagtttatttaaaagaaaatgcagccattgtctaacaagttcaggggatggatagagtgtgctgtaaagggccctgaatttgtaaagtaacacagtttcaatttaatgaatcaatccggtattaactagccaactcactaatgatcagttaccactatccaaataatcaagagaaatctataggtgcctctactgttctgggttaaaagcacaagaaccaaagctcactacccccaccgccagctctccccagcaaacccagtcaacaggtgggggctgctggccttccaaggagctcctgtggaccccaactttcctccttgtggactttaaagccccctgtggccactcagctgggaagaggacacagtcaccaccctggatggtgtctagagaggctacattcagactcacatcttgagacccctttaatggcaggggttcttattgcttttgttttggggagacagtaggcggtgactggagtgagtagtaaatgcttgtgaaattgatcctaaactctgaactgcacgctggcattttaaggcagggaatggccatgccgccccagtggatgatcttgggttcccacagaatgctcaccctagacggcaggagtacaggtgcgtttccaagtgtaaacctgtccctgggcaattcccttctagaagtttgtttttcagcctgcaactcttccatgaactcgacttgtctagccaaccccctacacgtcaccatgaggctctccagtaagtgccgcgcaccacgcctccccagcacagactccagattattcggcacccacctggccctctcctagtcttctcatcaatttttagcatcctgggccagaaacctggggtcaccctccccagctgtgagctggtggaagtctgccattcaacccacctagactgccaatgaaaagaaccaccagatgccctgtggggcaaggggctgtggctaccctctctctcccccacctgtggaccaggtccccgagagccaggcagccctttcctgggagccctccctgcattcctccggctggttagcccagtttggggttctgccctggtaggctgatagcccctcacctcatgccgaggctgctgccccgacttgcaggaaccctcagatgaaggaccctaaggagggccagctctgtgtccatgcccacttggatcttgagagctgccccaggcacgtgtggactggtagtgcccctggactcagagctttgggttttgcccaccctggagctgcccggctctgttcctcagcatatactctcttcctcattcctacttcatggttatatgtaaatgcaagcacacagaagttttctactttaaaactcagaagatcagcagatcactgctctctcctggtgctctggggagccacgtggcctctctttgcaccaaaactccccatccaagtccagctccactctctctctgcctcagctgccctgcagccctttcctcttgctctttgatgttttgtaggcctgcagctcccaagcacagaggcatgagtggggagaatgtcaccaaggtcagcaccttcatcctggtgggcctccccacggccccagggctgcagtacctgctcttcctcctcttcctgctcacctacctctttgtcctggtggagaacctggccatcatcctcatcgtctggagcagcacctccctccacaggcccatgtactactttctgagctccatgtctttcctggagatctggtacgtgtctgacatcacccccaagatgctggagggcttcctcctccagcagaaacgcatctctttcgtcgggtgcatgacgcagctctacttcttcagctccctggtgtgcaccgagtgtgtgcttctggcctccatggcctacgacygctacgtggccatctgccaccygctgcgctaccacgtccttgtgaccccggggctgtgcctccagctggtgggcttctcctttgtgagtggcttcaccatctccatgatcaaggtstgttttatctccagcgtcacgttctgtggctccaacgtcttgaaccacttcttcygtgacatttcccccatcctcaagctggcctgcacggacttctccactgcagagctggtggatttcatyctggccttcatcatcctggtgtttccgctcctggccaccatactgycatattggcacatcacccyggctgtcctgygcatcccctcggccaccggctgctggagagccttctctacctgcgcctctcacctcaccgtggtcaccgtcttctatacagccttgcttttcatgtatgtccggccccaagccatygattcccwgagctccaacaagctcatctctgccgtgtacrctgttgtcacgccaataattaaccctttgatttactgcctgaggaacaaggaatttaaggacgccttgaaaaaggccttgggcttgggtcaarcttcacactaagacaactaaatgtcctagagtaaaatctgtagtgatgaaacaacattgtatgtggcactttgtgctctttaaattaatttttaagttaaatttaacaaacctacagaactaagtgaaatttaacaaacctacacaactgtgcacaagtaacaagccttcgtctgcatatgttttcacaaaaggactgtgctcatggaaccagctcccagatcaagaactagaagctgccttcacgccctctcccagtcattaacccttctccacaaaaagcactgtcctgacttccaaaaccagatgctagcattggtgtttctgaggggcttacacataaagtatgtgccctgttatgttcagcttctttcattcaccgtgttgcttgagtgaatccttgatgtttttgcatgtaacaataattcatgcattctcattgctatccaatattcataataaataatacatttatactgtataatacacaatgcataatacattcatactgggataatacatatactgggataatgcatatactgtattgtgtattatatatacataatacattatgctgggtgaaaccctgtcccacctgtcccagcaggtgtgagccactgtgctcatccataatttatgcatctaaacacagataaggtaagtcaaaatataatgtcataatcttatgggaccaccatcttatgtgccgttcagttcatcattcaccaaatgtcattgtgtggtgcactactgcgtcagttgagaatatttgtgctggcttatttctggatcctctgttctgttaaattgatctacgtatctatcaatatcacaccctccatccatacaacacagtcttgatttatatgattatgtagtaaatcttaacactggaagagtgactcctcccactttattcttctgcttcaaaattattgtggctattgtacagcctttatatttttatataaattttatagtaagcctgtcaatgtctacaagagaacctcgctgagattttgctagaaattccattaaacctaaaaatcaatttgggaagaactgacttcattactctgttgagtctttcaatccatgaacatagtaaacccctccaattattgaggtcttcattctttaaatcagtgttttgtactttttaatatgcagattctgtgtgtgttttgctggatttagacctaaatattatattttctttgaagcaactgtaaatggtattccatcttttatttcagtttccttctgtttgttgttagtacataggatgcagctgattttcatatgttgacattgcagcctgcaaacttgctgcgctcactcattagttccaggaggtttttgtagattcctttgggttttctatgtgaacagtcatgtcaactaaaaatagacagttttatttcttcctttctgatctgtatgaatttcattttttattttttgccatactgcatggcctattactagaacttccagtgctctgttgaataagagtgggcagagcagatatccttgccttgtttcctccttagaaggcaagcattcagtctttcatgattaagtacaatgatgcagagttttcacgcatgtgctttatcaagctgaagcagctcccctttagtccttatttgctgagagcagtttttgtttttatcataaatgagtatttaattttgtcaagtgatgcagaaaactgcatcaggcaatctggtcatagatttcgtctttcacctgctggtaaggtgtattacattggttgattttcaaataccagattagccttgcatcttctgaataaaccaccttgggttgtggtgtatgattcatttcatatagtgttggattcaatttgctaacatttcgttaaggatttttgtgtctaagttcacgagagatattggtctattggggtctgaagttattttcatgctgtctaatatagtgtggacgtcaaagcgacctcctagagaacattcctagctctcagaacgttctagctggggagggaaaacggaaaaaggggggcgagaagcggagggacggggaagtatatagtaatacttcccttgaaccagtaaaactgtaatgcccaacctggtttttactaactgttttcagactctcccttttcctttaatcacctagccctgtttccacctgaattgactctcccttagctaagagagccagacagactccatcttggctctttcactggcagcccctttctcaaggacttaacttgtgcaggctgactcccaccacatccaagaatgcaattaactggtaagatactgtggcaagctacatccgcagttcccaggaatttgtccgattgataacgcccaaagccccgggtctatcatcttgtaatagtcttaaagcccctgcaccttgaactgtttactttcctgtaaccatttacccttttaactttttgactactttacttctgtaaaattgttttaactagaccccccccccttcctaaaccaaggtataaaagttaatcaagccccttcctcggggctgagagaattttgagcgttagccgtctctcggtcgccagctaataaaggactcttaattcgtctcaaaggtggtgtttttctaactcgctcaggtacaacaaaacatccacgcaaacaggttgtgagaagttacgtctgcgtgctgtgatacctagaggaaccactacgaaaactatacataatgatatttcccaagacattatcagtaaatcaagatggaattctaaaaaaatgtactgtatccattggaaggcacaaaaaaaaaaaaaaaaatgcaaaggaaacaaggcaaaaaacagcagacatgaaccctaaagcttgttaaatggatttcaggtgccctccaggatctaaaaaccagaccctcctgcgttggggaccgggaatccgtatttttgacaaaaagcaattcttcaattatagaaacatccatagaaccggccgtagtttacacagctgcattcccactgttttacaatcgcatgatcatttctgaaaagttgaaaacaaagttaaagaatatttaaggggttaagaacaaaaagcctggggaacacaaaagattataaaaacccttcccaacagcaggcatacttggaaggaaacctcacatgcaaggctccttcgtggagcccagagcccaggtcctgacgggagcacattttaagagatggacttgccggcgcggtggctcacgcctgtaatcctagcactttgggaggccgaggcgggtggatcacgaggtcaggagatcgagaccatcctggctaacatggtgaaaccccgtctctactaaaaatacaaaaaattagccgggtgtggcggcgggcgcctgtagtcccagctactcgggaggctgaggcaggagaatggcgtgaaccagggaggcggagcttgcagtgagcgcgatggcgccaccgcactccagcctgggcgacagagcgggactctgcctcaaaaaaaaaaaaaaaaaaaaaaaaaaaaaaaaaaaaaaaaagagatggacttggagcgtgtgcttttgttttctatgctattcaatgtgttcacagcaggtcccctggatgagaccacttagccttcagctccggaggcgacccaggccggccttgccaggtccctctccctgacaggcgccccgcgacaggggtcccaccccgtccctccgctcctcgccccctctttttccactttccctccccagcgagaacgttctgagagctaggaatgttctctaggaggtcgctttgacgtccacaccgcgcctgggggattctgcggggagcacaggaccctgggacgagacgcagaagtcgctccacgccctgggcggcctcagctcccgcgacaccgcagcaactcagaacccaggcaggggccgggcagccagcatgctgcccscacgttcacctccaactcccacctctcggccctcgccccaacccgcaggaccctggcagcgcactggctgtctccgcggaagcccccgagggcctcggcgcggccccgccccctggaaggttcccgacaggcgccgcgggcaccccggccgtgacgtcacggcagcgcgccggccgcgagagagggccccgtcgcgaccgcgtccccttgggtccttgatcctgagctgaccgggtagccatggccttgcggctcctgaagctggcagcgacgtccgcgtccgcccgggtcgtggcggcgggcgcccagcgcgtggtgagcgggcggcggggtggcagggtggcggggtggcagggtggcggggtggcggggtggggagcagttccacatctcccccggcctctggcggcggctcccaggtcgctctccgggtgggtttgggggacccctcctgcctccggaattgtttggtctttggtcgtggacagacctcagggggccacgagcttctccaggccattttatctcagctttaagcaaaacgctggagcgcggaggtgatcagggccccgaggctgccctgatgcgggaggcccgtgtgcaggtggcaggccgggggcacacgcgcttgtcattagataattcacgtagcagccctgtcaagagccgtttaaaggtcgggccctgctgggtgcttgggtgatgccatgttgagcagacacggagttcagtgcttgtgtccgcttccttttgcctttactctgactgactactctcatttcttagcattttgcccccaccttcttcagtgaaatcgtttcatacatttgtaacacagttggattgctttgtcacattctgccttacatcttgggatccttctacctaatgcgttttttaaaatgtgcatacattgagcgcattctttgtgctataaggttctatggattttttctttgtgctataaggttctataggttttgacacgtgtgtaatagcatgtctccaccattataggttcgtacagagtagcttcactgccttaaaaaattcccctctgctttacctattaaacccttctttttctccaacccctgacaaccacagatctcattaacatttccatagttgccttttctggaatgtcatataattagaatcatacaatatattgccttttcagacgccttgaatacttggaaatatctatgtaagattcacttatgtcttcgtggcttggtaactcatttctttttaatcactgagtaatatctcattgcatggatgtacttcaattcattcagcaattgaagggcatcttggttgcttcaagtttttggcaattatgaataaagctgctgtaatcgtgtacatgcagatttctttttggaaatacatttttatatcatttgggtaatacctggaagagtgattactcatgtagtaagactagttttctaagaagctgccaagccatcttccagagtgactgtgccatttgactcccaccagaagtgaaggctctccttgttgctctgcgtgctcgccagcatgcggggctgtcggttactttggattgctatccattctgatagctgcgtagtggtatcttgtttcaactttggaatatctcatgatatacagtgttcatcttttcatatacttatttgctatctgcgttaatttcatttgcgagaggtgtttacatcttttgcccatttttaaattgggttgtctgctttgccttgttttgtaacttgtttcttccttactcttcagttatcaaatcaagatcgaaaaatatcttgatatttcatattctcctgttttatttaaatttcactataaagtattttaatatttttgtgtttttctgagtacttagtattccataatatggatatgccttaattttgtttaactattcctccgttgttggacatttaagggtttctatttgcatttttggtgttacatcatacttcattgagcatccttataggtcaatcttatgtatatactctttgaatggattcctaatgctgtagacccagc

SEQ ID NO: 12302 - DNA, 29233 bp, Homo sapiens
aggtctgtgatccattttgggttactttttgtatgtggtttaaggtccaacttcattcttttgcatgtagatatccagttttcacaccaccatttgcagaaaagactgttcttttcctatttaatggtactgacacccttgtcaaacatcatttgaccacatagaggtttatttttgggctctccagtctattccattggtctttatgtttatctttatgccagtaccacactgtttttattactgtggctttatagtaagttttgaaatcaagagacctctgactttgtttttctttttcttttttattatactttaagttttagggtacatgtgcacattgtgcaggttagttacgtatgtatacatgtgccatgctggtgtgctgcacccactaactcgtcatctagcattaggtatatcttccaatgctatccctccccctcccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccacaataaacatacgtgtgcatgtgcctttatagcagcatgatttatagtcctttgggtatatacccagtaatgggatggctgggtcaaatggtgtttctagttctagatcactgactttcacaatggttgaactagtttacagtcccaccaacagtgtaaaagtgttcctatttctccacatcctctccagcacctgttatttcctgactttttaatgactgccattctaactggtgtgagatggtatctcattgtggttttgatttgcatttctctgatggccagtgaggatgagcattttttcatgtgttttttggatgcataaatgtcttcttttgagaagtgtctgttcatgtccttcacccactttttgatggggttgtttgtttttttcttgtaaatttgtttgagttcattgtagattctggatattagccctttgtcagatgagtaggttgtgaaaattttctcccattttttaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctcggttttcttctggggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttttcaggtttgtcaaagatcagatagttgtagatatgcggcgttgtttctgagggctctgttctgtcccattgatctatatctctgttttggtaccagtaccatgctgttttggttactgtagccttgtagtatagtttgaagtcaggtagtgtgatgcctccagctttgttcttttggcttaggattgacttggtaatgcgggctcttttttggttccatatgaattttaaagtagttttttccaattctgtgaagaaaggcattggtagcttgatggggatggcattgaatctgtaaattaccttgggcagtatggccattttcacaatattgattcttcctacccatgagcatggaatgttcttccatttgtttgtatcctcttttatttccttgagcagtggtttgtagttctccttgaagaggtccttctcatcccttgtaggttggattcctaggtattttattctctttgaagcaattgtgaatgggatttcactcatgatttggctctctgtttgtctgttgttggtgtataagaatgcttgtgatttttgtatattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatgtcccatcaatacctaatttattgagcgtttttagcatgaagggttgttgaattttgtcaaaggctttttctgcatctattgagataatcatgtggtttttgtctttggctctgtttatatgctggattacacttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccagctttggtatcagaatgatgctggcctcataaaatgagttagggaggattccctctttttctattgattggaatagtttcagaaggaatggtaccagctcctccttttacctctggtagaattcagctgtgaatccatctggtcctggactctttttggttggtaagctattgattattgccacaatttcagatcctgttattggtctattcagagattcaacttcttcctggtttagtcttgggagagtgcatgtgttgaggaatttatccatttcttctagattttctagtttatttgtgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttaattcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatctctgttcttttacgtttgctgaggagagctttacttccaagtacgtggtcaattttggaataggtgtggtgtggtgctgagaagaatgtatattctgttgatttggggtggagagttctgtagatgtctattaggttcacttggtgcagagctgagttcaattcctgggtatccttgttgactttctgtctcgttgatctgtctaatgttgacagtggggtgttaaagtctcccattattaatgtgtgggagtctaagtctctttgtatgtcactcaggacttgctttatgaatctgggtgctcctgtatcgggtgcatatatatttaggatagttagctcttcttgttgaattgatccctttaccattatgtaatggccttctttgtctcttttgatctttgttggtttaaagtctgttttatcagagactaggattgcaacccctgccttttttgttttccatttgcttggtaggtcttcctccatccttttattttgagcctatgtgtgtctctgcacgtgagatgggtttcctgaatatagcacaccgatgggtcttgactctttatccaatttgccagtctgtgtcttttaactggaacatttagtccatttacatttaaagttaatattgttatgtgtgaatttgatcctgtcattatgatgttagctggtgattttgctcgttagttgatgcagtttattcctagtctcgatggtctttacattttggcatgattttgcagcggctggtaccggttgttcctttccatgtttagcgcttccttcaggagctcttttagggcaggcctggtggtgacaaaatctctcagcatttgcttgtctgtaaagtattttatttctccttcgcttatgaagcttagtttggctggatatgaaattctgggttgaaaattcttttctttaagaatgttgaacattggcctccactctcttctggcttgtagggtttctgccgagagatccgctgttagtctgatggacttccctttgagggtaacccgacctttctctctggctgcccttaacattttttccttcatttcaactttggtgaatctgacaattatgtgtcttggagttgctcttctcgaggagtatgtttgtggcattctctgtatttcctgaatctgaacgttggcgtgccttgctagattggggaagttctcctggataatatcctgcagagtgttttccaacttggttccattctccccatcactttcaggtacaccaatcagatgtagatttggtcttttcacatagtcccatatttcttggaggctttgctcatttctttttcttttttctctaaacttcccttctcacttcatttcattcatttcatcttccattgctgatatcctttcttccagttgatcacatcagctcctgaggcttctgcattcttcacatagttctcgagccttggttttcagctccatcagctcctttaagcacttctctgtattggttattctaggtatacattcttctaaatttttttcaatgttttcaacttctttgcctttggtttgaatgtcctcccgtagctcagagtaatttgatcatctgaagccttcttctctcagctctcaaagtcattctccatcgagctttgttcccttgctggtgaggaactgcgttcctttggaggaggagaggcgctctgcgttttagagtttccagtttttctgttctgttttttccccatctttgtggttttatcaacttttggtctttgatgatggtgatgtacagatgggtttttggtgtggatgtcctttctgtttgttagttttccatctaacagacaggaccctcagctgcaagtctgttggaataccctgctgtgtgaggtgtcagtgtgcccctgctggggggtgcctcccagttaggctgctcaggggtcaggggtcagggacccacttgaggaggcagtctgcccgttcccagatctccagctgcgtgctggaagaaccactactctcttcaaagctgtcagacagggacatttaagtctgcagaggttactgctgtctttttgtttgtctgtgccctgcccccagaggtggagcctacagaggcaggcaggcctccttgagctgtggtgggttccacccagttggagcttcccggctgctttgtttacctaagcaagcctgggcaatggcgggcgcccctcccccagcctccctgccgccttgcagtttgatctcagactgctgtgctagcaatcagcgagactccgtgggcgtaggaccctccgagccaggtgcgggatatcatctcgtggtgcgccgtttaagccagtcggaaaagcgcagtattcgggtgggagtgacccgattttccaggtgcgtccgtcacccctttctttgactcggaaagggaactccctgaccccttgcgctttccaagtgaggcagtgccttgccctgcttcggctcgtgcacggtgcgcgcacccactgacctgcgcccactgtctggcactccctagtgagatgaacccggtacctcagatggaaatgcagaaatcacccgtcttctgcgtcgctcacgctgggagctgtagattcggccatcttggctcctccccgactttgtttttcgattgttttgtcccttgagattttatcttagtttgacgtggattttttttcatagaatcattgcccaggtaattttttaatttctaaaaagaaatcattgagattttgatagacattatgtcaaatctgtagatcccttttggtaatattgacttcttaacaatattatatcttccaatctatgaacatggattggaaaggatattctacttaagggtgtcttccttaatttctttcaccaaaatttgtagtttgcagtgaacaagtcttttgcctctaaggttattcctaagtattttatccctttgatgctattgtaaataaaattttgttcttaatttccttcttggattgtttgttgttagtgcatagaaagacaactgatatttgcatgttgattttatatcttgtaactttgctaaattggtttattagtttcaacactgtttttgttgggatttttagggttttctacctataagaccaagttgtctgtgaacagagataattttacttcttcctttccaacttggatgccttttatttcttttccttgcctaatttctctggctaagacttctagtactatgttgaatagagtgataaaaagagacattcttgcttctaatttagagggaaagctttcagtctttcaccattgagtatgacgttagttgtgggcttttcaaagatatgcacagcggcttttaaacgtcttgattttcctaagactttcacccctgcttcttctcagggtcttagatgttccattgtaattctctgcctgtaatctcccgctccaagtgcccttgggtctacagttctccggcagttttcatgtgccatggcacctgccactgctttcagtggggtccaacctgctatccaactatgccaccgttcccatctaagctgagtcagatgagataaaaatcagttcctcaggcagcctccagacaagacagaacagtgcaaacaagtcccagtcttttccctctgaaaggggaattgtgtgacttcctcctgactgtgttgcactgaggagaaggtaggcaagggctcaaaaaaaaaaaaaaaaaaaaaaaagcaacacaatttcctactgtgttaagtgttgctttgtcttgattgggtgtttaattgattggttgctgcagatccttgactggtttctacagctcctacaactgtaagagccgagattttttttttttagacagggtcttgctgttgtcacccaggctggagtgcggtggtacaatctcagctcactgcaacctccgcctcctgggttcaagcaattctcgtgcctgagcctcccgagtagctgggactacaggcatgtgccaccacacccagctaatttttgtatttttagtagacacagggttttgccatgttggccaggctggtcttgagctcctgaccttgagtgagctgcctgccttggcctcccagagtgctgggattacaggcgtgagtcggcgcacccggcctctgattttcagtaaatacgttgtcrtttacttgatgtttccatgggagaacagggacctggagcttctgccatcttgctgacatcaccataacataactctttagacttccaagtcttgtctttttaaaaacgttcacatttagttctatgatccaatttgaattggatttttgcatgaatacctggttttgaattgtaactccaccatgttatttcaatgtggccttaacctctctgggcctcagttccttcatcagtaagatgaggggcaaaatagcattgggaggattctgcatttacatctgaagaacttagaaacacaactgaaaaatactrtcgtttttttccttatccacactggatacattccaagrtccccagtggatgcctgaaaccacagatagtaccataccctatatatactatgttttttcctatagataggtacctatgataaagtttaatttataaattaggcacagtaagagattaacaatagctagcaataaaatagaacaattataagaatagactgtaataggctgggcgcagtggcttatgcctgtaatcccaacactttgggaggccgaggcgggcagatcacttgaggtcaggagtttgagaccagcctgtccaacatggtgaaaccctgtctctactaaaaatacaaaaattagctgggtgtggtggtgcgcacctgtaatcccagctactaaggacgctgaggcaggagaattgctggaacccgggaggtggaggttgcagtgagctgagatcatgscactgaactccagcctaggagacagagagagacagtctcaaaaaatatacacacacacacacacacacacacacacacacacayatatataccataataaaaattatgtgaatgtagcccctttctgtctcaaaatatcttattgtgctgtacttacctattttcagactgcagttgatcatgggtaattaaaactataaaaagtgaaaccacagatgaggggatactgtagtacatttaataaatgttacttgccattratatttctgtagatttttgatcaacttttgctctggaagatcagaggggactgacctaattaggtctgataaaaggcttaactttatcacttagcattgcttgagtattttactggcctggtgggtgtactgagaaaagcaggcttatgtttcaayagtggactctattgtgcgaaataaatatgagtctcctccctctttgctgttgccttatttgtactagcatgccagtttgaatacacagtgttcatgtcaatatttttgttgatcaatttatcagctcaatttatagaaactttcagagtcttccttattgatgtgtttcctggggcaaggcccattgttttgcttaacatttcctagaacctagatgggcctctgtactcagttgccccaagaattttgatcaaaacatggaccaggctttggtattaaatttccaaagcctggaggctgaaagcagtttggaaaagagttgattcactttaagcagttcttcctcgtgggtgtgtgtgtgtgtgtgtgtgcgtgtttgattttaaagatttctggaatactttctaaatacagaaaaatatgcaaatgaatataacaaaaatataacaatcatccttgtatccatcatccaggtttaacaccttttaactttttgctataattgtatcaatccattcttccccagaagtagacactattctgaaattagtgtatattcttctgttgatgtttatagtcttttatcaaatatggatttattaaaaaataatattatatatagtattattttgttctcatattttaaatataaaataatgtatgttttactttttcygatttgtttttttcactcaacattcttgttaatgacttatctatgctgatacatggatcgttgtagtgggttcattgttaactgttgcatagaatttcatcccctaaatattccacaatttatttattcactcacctactgaaggacacacacactgtatagatagtgtttaatttccatttacctttcttctttagttttatatttatttattactaattcatcttcatactttccccactattgtctaagttttctcccaaattcagatacacaagattttcttaaaacttcatcttgttgaagatctcttttctggagccttctgagttgcttcaacctggtttggttactttgttatcatcctgaagtctcacttttctctcatattggggatgccttcttggcttctctcctgtgctagagtctccgttcctctgcccctcatctctgcacccattcaatggtgcttcgtgtttatgcaaggagctgtggtagagggattagaagcataagcttcagaaggagacagatctaggttgaatctttgtttatcacaattatgagcaaatgtattatcttcacttagcttcaatttctacatttataaggtggacataaaacacccatctcacagrgttgccatgaagattaagtgaaatgctatttcagctgatatttgtgctacacatattttcccccagactacaccgtaacttttcaatttgtttgttgtacctttagatacatagacacattttatttgtagtcaaatgtattatcctacataatttacattttatatgttctgtatccttccctaccccaagctcakaaacagatcattattataatttcttttaaaagtttaaagttttgctttcacatcaaactgattatctacctgaaatggatctgtatatatggtgtgatatataaggctctgtttttttaaatatgggtaaccaattgtcctaagatcaaatattgaatagaccattttttctactttgatttgtagggcttacttttgtcatattactgtcccatrtatgaaggtctgtttctggtctctttattctgtttcagtggtcaaaaaccacacaattttaatcactataatttaaaaataaacactaatatctttaaaacactaatatctttctgttctttcataaaattgataaactcttatgtaaacttacattgtactttgtattttctctggtgtttctatatacacaacccaattatttatgaatgctagcaactttgtttactcatcaattcttaaactctatgtttgtttttcttgtcttactgcactagtcaggacatctagtgcaatgtgaagagaagtggtaattatgggcatctttgtcttgtttctgacttaaattatatgtagtattttaccatgaaggttgatgtttgctatagatttttagaagatatactttttaggtttaagaaagttgctgctggttttttgttgctgttgttgttggttttttcttttttctttttttttttttttttgagatgggtcttgctctgttgcccaggctggaatgcagtggcacagtcatagctcactgcagcctagaactcctgggctcaagtgatcttccctcctcagctgcctgggcttcytaaagcactgggattacagatgtgagccactgcacctggccaagaaagcttcttttaatccttatttgctaaaagatttttttttttgtacatatgagatatggtttgctaatgtatcgaggctctttacatctctcttcgtaaatgaaactggtctatgtattttctttcttcagctttttactggctttggtatcaaattagattgattaccktaaatgaatttgagagcatttcccgcccagtgtccccctttttggattatttggaacaacttgtgtaaaattagaatcatatgccacttgaatatttgacggaacttgcctttaaaatttccaaggtcctttttttagtggggaggggggcagattattacaaactattaattctatctatttaaaggttatagatcaatgtaggttttaagactgtttttggtaaattatatccttacataagattgtccatttcatctaaattatatttttatataaaagtgtccttttcatcagtttaaaagttatctattttcaaatttattagcataaagctattcatagtatttttcttgtgattttaccaagccttatctgtgaccatactttgttatttattttcctgggacatggtatagttcatctccagtcaccttcctctggacttacaggttattcttgtccagaattttastgctattttaaaaattttaacacaaaatttggtcataactattattgttggctgggtgcagtggctcacacctgtaatcccaacactttggtaggctgagacaggaggaytgcttgagcccaggagttccagaccagcctgggcaacatagggagaccccatctctacaaaaaaatttaaaaattagctgggcatggtggtatgtgcctatagtcccagctactcaggaggctgaggtgggaggatcacttgtgcccaggaggctgaggctgcagtgagccatgattgtgccattgcactccaaactgggtgacagagggggactgtctcaaacaataattattattattactttacayacttgatatttatttgtcatttttgttgcctgtaaatgtctttgtttcacccttattagtgaaagatcattttgctggatcttgaactctrggctgactattgttttctctcagcactttgcaggtattattccattgtattctgacctgtattgctgctatggagtagccagctatcaatttaactggcagccttgcataggtaatctctcttttctggctgcttttaagaccttctgtttgtcttttgtattcagtgttaccacaacaccaggggcttggtgtgggtcctgctgcttgccccagagaaagcccatcactgagaccaggattattgccaaggaagaaggctttaggctttaattgggtgctgtagccaaggagatgggagatcagtctcaaatctgtctcccctgatgactggaattagaggtttatatggcagggaagaaatataacaatgtataagaaaacagaaaatgtacccctcccaaggaactagggaggggtaaggaagcaatagtgatgaatgaggkgtctggcatttcattgtctggatgctgtgacctggtgagtttcagctctttgatactttttttgagtggcctgagggtgttgctaagaaggaactcagataaaacaaatgcaagtttcaagctttaagggccaggcttggtggctcacgcctgtaatcccagcactttgggcagctgaggtggttggatcacgaggtcaggagatcgagaccatcctggctcacacggtgaaaccccrtctctactaaaaatacaaaaaaaaaattagctgggcgtggcggtgggtgcctgtagtcccagctactcgggaggctgaggcaggagaatggtgtgaacccaggaggtggagctttcagtgagctgagatcatgctactgcactctagcctgggcgatacagtgagactccgcctcaaaaaaaaaaaraaaaaagaaattgaccagaagggtccatttctatgtttatccaaaaacaaaaagacaacaaaaaaagtgtctatgggactattgggttgatttcatccagcagttgaccatgttgtatccagatgtgaatttctttttacttatccagcttgagaatttgtcagacttctttaatctgttgttttgtctttcatcaatttgggggaatttcttcaagtattgtctttctcctatctactctttcstgctacatcaaatttatacaacatgttctcttctatcttatgtggatgtggcttttaagttctttttcatgttgttcatctctttgtcttgaagtaatttcttcagtttttaattccaatttactaattaccttttctttctttctttctttctttttctttttttttttgagatggaggtcttactttgttgcccaggctagagtgcagtggtgcaatctcgggtcactgcagcctcaaccacccgggttcaagcaatcctcctgcctcagccccccaattagttgggactacaggtgcgtgccaccaggactggctaatttttgtacatttgtagacacagggttttgccatgttgccaaggctggtctcaaactcctgagcttaagcaatccacctgccttgacctcccaaaatgttaggattacaagcatgatttataatcctttgggtgtatacccagtaatgggattgctgggtcaaatggtatttctagttctagatccttgaggaattgccacactgtcttccacaatggttgaactaatttacagtcccaccaacagtgtaaaggctttcctatttctccacatcctctccagcatctgttgtttcctgactatttaatgattgccattctaactggcaggagatggtatctcattgtggttttgatttgcatttctgtaatgaccattcttttttttttctttttttttttttgttgagacggagtctccctctgtcgcccaggctggagtgcagtggcacaatctcggctcactgcaagctccgcctcccaggttcacgccattcttctgcctcagcctcctgagtagctgggactacaggcacccgccaccacgcccggctaagtttttgtatttttggtagagatggagttgcaccgttttagccaggctggtctcaatctcctgacctcgtgatactcctgtctcagcctcccaaagtgctgggattacaggtgtgaaccaccgtgcctggcctctaatgaccattcttgatgggactttaaattgaatagtgcccttttggaagcatccattaaaagttagtgcatatatatacacacacacacacacacacacacacacacatatatatacacacacatatatatacacacatatatatatgtttggcctagcaataaaaatttgtattattgttatgttatgatgtcattatatcctctaccttagaaaaaagacattatatcctctaccttagaaaaaatcatatttctttatattcacacacgtaatgttaaagcatatttttttaaagtgtggaagcagacttaacctctggtatgaggactggtgctgaagagaggatcgaagagaacctttacttatttgtatttgaacgtttataatgagcatattaatggctactcgtgtaattagaaaaaaaataaaagaaatcacaaataatagcaattaaaacttgagaggtttctgatgcagccaggatgtactagcccttgcactgtcacttaagaaccagcaaagccaactttgaaggctcctaatagcactgatcttcagtgactggtttgcatgtcaaggatagctgaaggtggattaaaaacttctcaggcagacacataatcacctgaattcagggacctgccttagaattgtgtatgacacttcgcagtcataatcacaggcccccggctttgagctgctgagaatctcgcacaagctctgcattaggctgacacttcccaggaggatataagaactgccaattatacagagagctacgctctgtaatatcttgacagtctccactctctctctttcctcctcctgctatgaggctccaagtttattccccagttactgggggccactcctgggtccctctgcctcggaagtcttccctcctggctgtggcccaattaagccacagttgagttgctcagaagtgagaattcctgggaggcttgttaagttcagtgcttcaggaaatggaaggaacatcattaagaacttcagcttaataggcagctgggccaacaccagctgcaaagcagaaaaagtgtaagtgactcagtgtccctcagaggcatcaaaaaaaacttgttttaacttttacctaattctatcccaagtgtgtacactagctacgaagcacatacccaagacaccttcactttccccaccactatcactctgttattttcatcatgtatcattacaacctcatcacccatcagtattctcatcatcgctttgattcaccgtcatcccagaactatcatccttttcctattacactatcattctcagtattatcaccaactcatcatttaaccattattatcaccatcagtattataatcacccccattatcattgcaaacaccatcattcagctgcaccatttcaccactcccatggccacaaccataatatacgtctgtagttcatgagaacagaaaaacatcctgaagattctaagaaaaagcccttatttgaaaggcagacaacaaaagtatttttaaataagtttttctcttatttcaatcaggtgcaagaataagaaggtaatagactgagataagaaattaaatgaagaaatacaataaaataaaatttgacacaatggtcaaaatataacctaaactggagagaataaacagaaaaatggaccttgcataaacattaaaatcttctcagaatgcaagagaaaagaaggaaaattctgataattacagaatggaggatgagttacatagatccaacctgtaagtattaaagaatgtctaaagaaaacagtaaatggatcagagggtcagagtaagtggatccaggggtataatatataggaaaacactttctgaatttccagagaaatactctgaagatcgaaatgccccactatattccaagcaaaattagtaaaaagatctacacctgcatgcattctcttctgataatctcttaaccacacttccgctagaatgatccattcaaatcacaagtcttagaacatcattcccaggttcaaatgctttaatctctttccagagctgttaatataaaggactaaattccaacatggcccacaaggcccatggttggccttgcacttctgcacctgctctcccttgctttctgcccgactggaccttctttctgttccttgcacaggcatgctccttctagcacaggaacttggcatatgttgttgcctccccccaggaatgctctcatcctccccyacgaatttcctctggttaactcttattttaggatctcatacaacacttccacaaggaaaccctcccagacctctctaacgaggcgaagcatacctactatacrctcgtgtagcaccatgcacctttctactttagtacttccgacaagtaggtttatgtttatttataggactctttgattactatctgcctccsactcagagtataacctccacaagggtagggaccaaggagccaagttaagtttccaagcagggcacacactgccagatcccrtattaaacacacacatccttgcaacaccaaattgggaagttccactgctggctgtccgctgttgccctttctcctctttcttctttcacgggcctctccagtcagcctttgccttaagaattctccaggtgtgcgggagacatcagactcatttatccccaaaattccaagggacacatcaaaacgtcccaagccctcccagtgaactgtccaacgtcatcatggggcaaaggtggggaggagacctagaggacagcccaggagggaaaaagccacattactctccccctacaataaagactacattttcctgtttaaagaacctccctttcacatttcaagtcttttcttgtagtctataggtatgtgataatggartgatggtcacaagattggtttgtgtctagcaacgtgttgaggctcttttaaaaagtaaagatgtaaagatctcaaagtcttttgagaaaacaggaaaagtcccagtcaacatcctgttgtgatcatattcctgaaagactggaagataggaatatgaaaaggggatcaaccacgattccacttccctaaaaccaatggctttttcttttcagtgtattttcttccactgttttatcaagtactgcttttctccacttcatttcacatcacatgcattgctccaaattactccatgctgawtacatgtatcttaaatggatgcataatatgatgcatggtttcacaaaactttattttgtaatcaatactgaaatgaacttcttcgcagatgtaggattttccatttttgtactaattcctaaggggtgatttctaaaactgatgttatagactatgtttggcaactgattttgctagccaacatccattctcactgcttctagtaacaggactctgaagctttcctctgctgaagcttaaaaaagcccagaaattccagcacactattttgtgtggttaaaataaaaggatgatcaaagtatgaagcacatagtttattgccatacaaaaatttcctttgttcacaacgcttaaagatggggagaataattagaacaaatttcactgggaatacacttgacaggtgaagtacattaaccacatagtgaatgagttcyaattttgttacagtcgaattattaaagtytagttggtcaattaggatgacaacaggcttctgtggaaagaaaagtctaattgaagtttagggagtgcctttatatggcttgagcaacacagtggaaatctgtgacaacatttatattccctagacatgagagggcagtgccagtgttgactggtgaggcttcagagattaactcaaaggctaacatggttcggccctgttgcagcctgagctgtaggtctttgcagaagcagccgacagagtgtagccctgccacggcctaaattctcaaagtgtctgtcaaactcttaggttatatgtactttggaacccagcagttgaagtctgtaactcacctacgaggtgtcataggtgtgatgtgttatgtaacattctcagagggaagagaagtacactccaagttcttaccacataaaacatatatcactcatgtagcaaattatgtaagtgtttgaaatcatttcaaagctaygtaacacacatcgaatacttccatcaaatgtccatatagactatcatgtaatcaaagaatagactccttttttccccaacagatgcctcttttttctttttcttgccttatagaactgrctagattctccagcacaacattgaataaaaatgcagatattcttgtcttgttcttgagcttaggacaaaatcattcatgcctttcaccattaaatgtaattttagctgtagagttttcatagatactcttcatcaggttcaggaagttccttctattccctcttagctgagagtttttatcaggaatggttgttggattttgtcaatgcttctccttcatctattgagatcaatcacatggtttttagtttgttwatatggtgaaatacagtgattgattttgggatgtcaaatgaactttgtgttcctgcaataaatcctacttggtcatgatgtattattttaaaaatatattgttagatttgatttgctgatttttaaagartttgtgcatctatgttcttaaggaacattggtctatagttttctcgtaacgtctgtttggttttgctatcagggtaatgctagccttgtagaatgagtagagaagtattctcttcaatattctggaacagtctgtgtagaactgaaattgttttctcattaaatgtttggtagaattcaccagtgaagctatctgggctggagttttcttttaaagagaaggtctctttaaaaatttaatttatttaataaataaagaactattcaagttatctatttcttcttgagtgaasactggttctttgagaactattcattgatctttttyccttgtttactgtttactgctttattgatttgcactctaattttcattatttcatttcttctgcttatttttcatttcrtctgctcttctttttccagtttcttaaagtggttaagaatgttacttaagtactgcttgagcaacattccacaaatttcgatatgttttcaatttttattcagctcaaaatactttctaattttctactttttagaagtctgttatttagtttccaaatatttggggattcctattagtctttgttattgattcccaatttaattttcagtcagagaacatactcttctgaaaggaaaataaaatcttggcacttcaaattcactatgccaaaagggaaaaattaaccttggaagctgagtcatgaaaaaaagcaaaacgcttgctttttcttttgttcttaaactgatagctatagctagaaggccacatgtgggagcctccctcaccctgacaatgtaaattaacagcttatcttcacaggcaagggacaaaaagaaatcatctcccacccaccccaggaatgcatgtttgactgcttcctctactctatgtttattttatgtaaagtgcagatttactgagcagaagacaaatacataattgactgttccctctacccctccttttgtagtgcaacatgtggattcagtgagcctaatcaaaaccttgaaagaatgtgaccataccctccctcttttttttcctttttcccctttcccctcctgcccacttttccacatttaaatattgaatacttcaaaatcctatttggaaaaaagtacaggtcacagatcctacaatcctactgtggcttgtgtctctttttccgaggcmcatcctcaaccttggaaaaataaacttttaaattgattgagacttgcctcagtgattttctttggtgtatactctgtatcacttgaatactttccaaktgaagacatgctttataatccagagtatggactgttttggccagatgttttctatatactggaaagaaatgtgtattctgctgttgttgaatggcatgttctataaatctcaawtacatcaagttggttgatagtcttgatgtcttctatatctctgtggattttccatttgttctagtgattattgagagaaaggtattgatatatctgcctataattctggatttatctacttctctttggagatttctccatttttgcttcatgtattttgaagcccctactcaccagcatggtcttcctgagcccctccaagagtaatctcaccaccagcccatccacccctaccccaaggtcaacaacagtgtcagtagttggcctacaggggacccattgtgtgcatgtgattagggagactctgggaccacctgcctaactccttgtacacttccaaccacccttactccgtgtctcccagacaaccagactggggcaagtgttgggaagatggagacayaggaatgatcaggatgggaaagaggctcctccccctcctccaacaggcactgcttccagcccagactggtgtgtgtggttgtagggcaggagggggtgtagggccagacctgaatccatctatgaggaaaagtaagcctgtaggctcaagtctccactccaccctgaagtttggcagggtaaggcagatggaactcctctagctcctccagtgctatgagctgcttcctttctgagagagaggtaggacttgtgagtcagtgcttcaggtgtccccatgtcactaccagactgctcatggccaccaaattcttccagcagccttgggctgggagaggaggcagtcagggtgactattgatggcattaagtgttggagggctgtgcaactccccgccccttgacccactctcttccctttggctttgcaaaggaaaacctccttgtttctcaccttttcttaccttctggtgaggtaaggtgagggagagaggccttacgtttcttctcactgcmtctcacaggttatccaagcccagaagtgttaccagaaaggggaccggatccagaccccaagagagggttcttggatctcatgcaaaaaaagaattcagggtgagtccatagagtaaagtgaaagtaagtctataatgaaagtgaaggaatagaaggatggctgctcctccatagacagagcagcccrgtggattgctgattgcccatttttatggttatttcttgattatatgctaaacaaggtgtaaataattctggcctgccttttttagatcatattgsgtaacttcctgtcgttgccatggcatttgtcaactgtcatggtactggygggagtgtagtagtgaggacgaccagaggtcactgtcattgccatcctggtgttggtgggttttagccagtttctttactgcaacctgttttatcagcaaggtctttatgacccatgccttgtgccaacctcctgtctcatcttgtgactaagaatgcyttaacctcctgggaatgcagcccagcaggtctcagccttattttacccatcccctagacaagatggagttgctctgattcaaacgtctctgacaaaagcactctcaatatctgagccccccattaacaagaacaaataaataaacgaaaaccataataaaacatcaataatctggtgtctaggagaaatttagctgttgtacaccatttgttatgatgaaactcctccagcttctccaaatgctgtgagccatctcgtgtctgaagttcagatagaacctgtgactcaggtacctcaggtgtccaagcatcactaccagattgcccttgaccaccagattctttcagcagccttggggtgggggagtggacagtgaaggtgactgytgcaagcattaagtgttggagtgctatactgcttccatcctctccagcccctctgttccccawgatttgtttctcctggagtgaatacacgcrgaggaccttaagagcaaggtcttaaaatatgtgcaacacatacaagcttttcaaagaacaattattcagaatacatacagaactcttacaaatcagcaagacaggcaagctagtagaaaataatttagagatagaaacaggcacttagtacaaaaggatacgcaaatcaccaataaataggcaatggccctgggacttcctgctcaccgtacctgtaccaacagcctgactgggccaggctttccactggtgcagttctcatacctgtcactgccaagaatggctctttttgaagtgaggctgctgagtctgggagcatcaagagtgggagggaaagcatgggcttgctatagccatgtttcagagcaaagagcacagactggggtttgggcactgattagtctgtcagtgtttattgtggttttgccaattacttttccccttgggctttagcgtccctatttatctgatggaagagtgggatgaaatcagagttgttacctgatattcaacacatgaattctatttaatttggccagcacagtcactgtccttctcactctcactctytcaaataggattggctgtcaacatttaaatatcaagayttyggagcggggcgcgatggctcacgcctgtgatcccagcactttggcaggccgaggtgggcagatcacgaggtcaggagatcgaaacacagtgaaaccccgtctctactaaamatacaaaaaaaaaaattaaattaaatatcaagatttctggcttctcttgaagaattaggtgatgggcccacatttccacactaaaacaactgtccagaactgcgtaggaggccgtgtctattaggctggatcagaaatcttgctcaagcaacacccctgctgcctccctcagcatgaacctcggtatgaagacagagacaatgttatgtgttcatcccataggttcttcccaggcatttcccggccccgtagggttagcattggttggcaaaaaccatgtgacagagatttgctgatggcaatgtgatgcagtaaagagatggtgtaaattctccatgtattcttacattgtgtggttggaagctagaaacctctgagaggacagactggcaagaaagaaccagctgacatccccaagtgatcactataggacagctgccaagaaaagctcgctgactcctctgagccccaaatagaagcaaaaaacaaagcttggttgtgttaagccactgatatgcaggggttatctgctaccatggtagagcttgtcctctgctgactgatgaaatggatcataagaatagtagcaaatattcattgagtgcttcctgatttgaatgcctagtcattgggctaaatactttacatataataccttagttagtcttaataattattctgtctgataggtactattattttaccctttttagataagaggtttagagatgttaagtcatatacttgagttcatagtaagtgagagagttaggcagtctgatgccaaaactttcgctacgctcctctcttttttctattctatattgtctcgctgagtctgtctttctctgtaaaaaaggcaatgataacctcaactttaacagtcagatattagttgtgctaagagatagtctgggttaattttaaattatttggatcagtttgaagttacgtggagaaattggcaatggtttaatctacttgaaccagtctataccagataagtacagttagaattaatttgagctggattctgctagtatagacattctggaacacccttggatttttgctaatcctttaacagagatattattggcagttagatagtaattattatgttaagaaaatgtaattatattcttaggttactgaagagtttaatcagaaataattaaatgtttcaaaaatcatgtgggcatctctaacactgctagcgtagcaaaacctcctgtccaaaacctccttccagtcactacctcctccatcttttccaaagaaaagccttaccctgacttaacatgccatagtgtgggcgaaggattacccaggtgctgaggcaagagactgaaggcacaaactgttgcagtataataaggaaaatagttagaataagaatagttataatacaaattagatatagagataaccatagacattatcaatcattagtataaatattattactcattagcttttaatattactctttgttgtattactaatataaccaaggaataaccagcgggtatagggtcaggtgccaacgggacattgtgagaagtgacctagaaagcaagaggtgagccctctgtcacacctgcataagggccacttgagggttccttggtcaagcagtaatgccagtgcctgggaaggcacccgttacttagcagaccgtgaaagggagtctccctttccttggaggagtcagggaacactctgctccaccaccttcttgtgggaggctggatattatccaggcctgcccgcagtcatccggaggcctaaacccctgcctgtggtgctgtgcttcagtagtcatgctccttgtccactttcatgttcctcccgcactcctggttcctctttgaagttcttagtagatagtggtagaagaaatagtgaaagtcttaaaatctttgatctttcttataaatgcatagaagaaaatgctgacatatactgccttccctctctgcttcggctacctaagagcaaagggccccctgtcccatgatcacgtgacttgcttgaccttatcaatcacctggacgactcacctgccttaccctgcctccttgtcttgtatgcaataaatatcagcacacccagctatttggggccactaccggtctccacgtcttggtggtagtggtcccccgggcccagctgttttctctttatctctttgtcttgtgtctttatttcttacaatctctcgtctccgcacacggggagaacaccctcaaagccccgtagggctggaccctacaccatagattagttttgcttagctttaaacgctttataaatggaattacacaggatgcattattgtgcctgcattcattcaacactatgtatgccagatttacccatattattgtatgtagctgtattgttcatacatttgtattgctgtataatattccagtgtatgaatatgccataatttatttatccattacactgtcattgaatattgggttgtttccagtttgggtttattacaaataatgctgccatgaacctctttcatatctttaattatacttgtgtaaccatttatttaatacatatagataggcaggaagttactggattatacaatacatgcatactcttctttagtacataatgtcaaacattttccaaagtggttctaccaatctacatacccagcatcagggtataagagctccagttgctccataatcttgccagtatttggtatagaccatctttttaattttagccattctgatgggtctgtagtattaactcattgtggttttaatgtgtattttcctgaacatctatgaggttgagcacctttttatatatgattggtcattttgctctcctctttcatgaagtaccttttcaagtctcttactatttttctactggagtgtgtatttttttatttatttataggagttcttttatatattactgataagatccctttttatatttgtggattttctttttacattgtatggtgtggctctatcataatttacctatttttatttataattatttagattgctttcaatgtttttattccaacaacttctatgaattgaggattgtgggtattgtttaggatagagtatttagtatcaatctcttaggtttttttcaacagcattcagcaccatatgaaaggcaaatggctgggatcagccaggttgagtttttctttccaggaaagtgagattaaaaaatataataccacaagataattgataatattggttttcaaaaagtcattgaaattataaaattgataaggtcaatcacgtgacttgcttgaccttatcaatcacctgggctactcaccctccttaccctaccccttgtcttgcatgcaataaatatcagcgcgcctagatattccaggctgctaccagaatagcgcacccagctattcagggccactgttgactctgaactatgtaaggagggaagtaaagacagcatgggaattagagttactagatatagagaaagaaaggatggtgggctggaggccaagtgaattgggaggaatagagtgactacactgtaaggacaggaagtcatggtcagagaacagtatatctgaatatgtggtttcagaagtgggacaattcttcagtaatgagaaggaccagatatgcccgtaagtggctgaagtagaaggcaagtggtgaattttggtgaaaatttgcaaaccatgcatctgacaaggggttatatccaaaatatacaaggaaatcaaacaactcaatagcaacaaaacaaaacaaacaccaaataatttaaaagtgggcaaaagaccaaaatagacatttctcaaaagaacacatatatatggccaacaggtatatgaaaaaaatgttcaacatcactaatcatcacggaaatgcgaatcaaaactacagtgtgatatcacctcaccccaaatagaatgagtattatcaaaaaggcgaaaatgacaaatgcttgtgtggatatggagaaaacggaacccttacgcactgttttggtgggagtgtaaactagtacaaccattatggaagacagtatagagtttccacaaatgaattaaaagtagaagtatcatatgattcagaaatcccactactgggtactgatccaaagaaaatcaatatgtcaaagggaaatctgcactcccatgtttcctggagccttattcacaatagccaagctatgaaattatcctaaaagtccatcaatgcatgaatgaataaagaaaaggtagtacatatgcacaatagaataaaatttagtcataaaaaaagcatgacaccttgttatttgtagcaatgtagatgaacctatagggcattacgttaagtgaacttagaggacatcacattaagtgaaaaagccaggaacagaaagacaaataccacatgatctcactcatttgtgggctctaaaaaaagtcaatctcataaaagtacagaacagaatagtggttgctagaggagaaatggggagagattggtgaaagagtacaaaattacagataggagaaataagttgtggtgttctatttcacgttagagggactattgtatatttcaagacacctaaaagagtcttttcgatatttgcaccaagaagaaataagtgaagtgatgtatttgttacatatactgatttgatcattacacaatgtacacaagtattaaaatatcacactgtaccccataaatatgtgcaattcttatgtgtcaaaaatcaaacttttacaaaatacagaatgtgttataagtaaaacacacacacacacacacacacacacacacacaaagagaggccagagaattgaatcaggccatctaaatgaacactgaagtcactcagtgtgatgaactcaagaataggactttgagacaattgtaaccatgttaataggaaaagagagaaagagagtgtccaggagatgttaggggacagtgcagggaaatggtgatgtatagcacaagctttaaggagcaagaggttttctttttttttctttaaacatccctccactgggagttcagacccactgcccatctatctccctagcacctgctgctctgtgttcccccacaggcccctcaggtcactcagcatcctcagcattgggcgggtcactgcttggctcagcagagacatgaggaagggtcctgagctttataacccttgggcactgcagtggggaagtggtcatgggctggggcaccattgctggttttcagtgttcgtgctgaatttatcaaagtttaacaacataccttataccagcaattcaagtctatttatatgtaaatatgcatattatatttattcatcatatatagttgcatcatttatacaaatatcaatacaactgactctaaaatattatatatttaataaataaagtctatattacaaatacatatgtacatatacacataatgtgtgtaatttttttttaacttttaggctctggagtgcatgtgcaggtttgttatataggtaaactgcatgtcacaggggtttagtgtactgattatttgccacccagctaataagtatagtacaccataggtagtttttcaatcctctctctcctctcacgaccgtcaagtacacatgtaggagcaagagatttttagtaagaagagaggaataatggtttgaaaggaatcaaaaggagcaaagagaacctatacaccacattcccacactgaagtacttagagtttcagagaataagtagagtctctacctgaaatacacaggaagcaatgtcctcaagggaaatccaaattacatttaaagccaggagaagcaaggaactgtccgtaaagaagcagtctaaggaaatagggaagtttactaatcatgcagctgaacttccatagagtacaactgaaagtaagggaggaaaagggtgttgggtcaagaaagaacaatcagaatattatggtgataaaaataccagagagaa

SEQ ID NO: 12303 - DNA, 35884 bp, Homo sapiens
gtgcagtggcactatgatggcttacagaaggcttgaactcttgggctcaagggatgtcccacctcagcctcccaggtagccaggacttcaggtacacgccaccatgcctagctaagtttttgacttttgtagagacaaggtctccctgttgcccaggctggtcttgaactcctgggctcaagcaatcctcctgccccagcctcccaaggtgctgggatgacagctgtgagctactgcatctggttccagttttctttttttttttttaaatggagtctcgctctgttgcccaggctggagtgcggtggcacaatctcagctcactgcaacctccacctcccgggttcaagtgattctcctgtctcagcctcccaagtagctggaactacaggtgcatgccaccatgcctggctaatttttttgtatttttagtagagacagtgtttcaccatgttagccatgatagtctcgatctcctgaccttgtgatccgcctgcctcggactcccgaagtgctgggattacaggcgtgagccactgcgccctgctccagttttcttataatgtgcttatattagtttataatttgaaaatattttgtagttccttcactgaaacttttaaagagcaggaattgattctccttccattctctcttcctctcacagggaggataaattacacagaacagaaaatatgaaaagtgaatcactccagactttaaggcatgtagagaaatccacaaagagcagttgcaagggtcatattacccccagtatattaccctagagtgttgcattttcctgtgtttcttttctttctttctttcttttttttttttgagatggagttttgatcttgttgcccaggctggagtgcaatggcgcaatctcggctcaccgcaacctttgcctcccaggtacaagcgattctcctgcctcagcctcccaagtagctgggattacaggcatgtgccaccacgcccagctaattttgtatttctagtagagacagggtttctccgtgttggtcaggctggtctccaactcccaacctcaggtgatccgcccgccttggcctcccaaagtcctgggattacaggaatgagccgccgcacccggcctgtgtttcttttcttttagagcatttcctaatttgtaatcatatatttattagtgtaattatttgattaatattgtcctctgctacactctacaagaacagcactcttgttcaccaatgtattgtatctgtagtgcctggcacatagtagacactcaaataaatatttgttgactaataaatgaatgagaggccattatcctaagcacaggaacagaaaaccaagtactgcatgttcttactagtaagagggagctaaacattgagtacttatggacacagaaacggcaacaatagagactggggactaccagaagggggagggtttaaaaactatcggcctacactttgggaggccaaggtgggtggatcacctgaggtcaggagttcaagaccagagaaaccccgtctctactaaaaatacaaaaattagccgggcgtagtggtgcgggcctgtaatcccagctacttgggaggctgaggcagggagaattgcttgaacctggaggcggaggttgcggtgagccgagattgtgccattgcgctccagcctgggaaacaattgtgaaactccatctcaaaaaaaaaaaaaaaaaaaaattagcggggtgtggtgatgcatgcctgcaatcccagctactcaggaggctgaggcacaagaatcacttgaacccaggaggcggaggttgctgtgagccaagatcatgccactgcactccagcctgggcaacagagcaagactctgtctcccggaaaaaaaaaaaagaccagccttcccaagatagtgagggccacatccctacaaaacaaaatttaaaaattagccaggtggccgggcacagtggctcaagcctgtaatctcagcactttgggaggccgaggcaggtgtgtcacctgaggtcaggagttcaagaccatcctggccaatatggtgagaccctcatctctactaaaaatacaaaaattagccgggcaaggtggtgcgtgcctgtaatcccagctactcaggaggttgaggcacaagaattgcttgaacctgggaggcagagtttatagtgagccgagatcgtgccactgcactccagcctgggcaatagagtgagactctgtctcaagaaaaaaaaaaaaaaaaattagccaggtatggtggtgtgcaccagtctcagttatgtgggaggctgaggtaggaggatcaatttaactcaggaggtcgagactgtagtgagccatgattgcgccactctattccagcctgggcaatagagtgactgttttaaaacaaacaaacgaacaactgggtactatgctaagtatctaggtgacaggatcattaggatcccaaatcccagcatcactcaataaagccagataacaaaaacctgcacatgtgtcccccctgaatctaaaatgaaagttgaaaaaaaaaattatggctgggtgtggtggctcacacctataatcccaacactttgggaggctgaggcgggtggatcacgaagtcaggagtttgagaccagcctgaccaacatgttgaaatcctgtctctactaaaaatataaaaattagccgggcatggtggcgccctcctgtagtcccagctactcaggaggctgatgcaggagaatcgcttgaacctggaaggtggagtttgtagtgagccgagatcacgccactgcactccagcctgggcaacagagcaagactctgtctcaaaaaaaaaaaaaagaaagaaagaaagaaagaaaattattcaagccaaacatcaaacattaacttttgccatttaatgtttcactcagaaattaaactttcataacccagtgcaagctgcataaagaaaaagataatttgactgggcgcagtggctcacgcctataatcccagcactttgggaggccgaggtgggtggatcacaaggtcaggagatcaagaccatcttggctaacacagtgaaactccgtctctactaaaaatacaaaacattagccgggcgtagtggcgggcgcctgtagtcccagctactcaggaggctgaggcaggagaatggggtgaacccgggaggcagagcttgcagtgagccaagattgcgccactgtactccagcctcggcgacaaagccagactccatctcaaaaaaaaaaaaaaaagaaaagaaaaaggtaatttattaagccttggaactgagaaggctcagatctgtctgaagacacggcttcatctgaggtcaaagatgtcatggagtctgatttctctctccccctgttttagctgtacttctgtgcaggctccattctcaggctctctcctctctggggcacagtgactacagaagcctcagccccacatcctcccatgttcaggtctagggagatccttcatagctcctgacaggccttgaggccgggtgcggtggctcacgcctgtaatcccagcactttgggaggctaaggcagaaggataacttgaggccgggagtttcaggccagcctggccaatatggtgagacccccatctctactaaaaatacaaatattagccaaacttggtggcacgcacctgtagtcccagctgcttgaggtcgctggaacccaggaggcggatgttacagtgagccgagattgagccactgcactccagcctgggcaacagagcgagactgtctaaaaaaaaaaaaaaaaaaaaaaaaaagtaaatgaatgaatgagggaacagaattggcctgtctcaggattgctttttgggataaatatttccaattaaaggggcagattgattctcagcactacgaaccatcatctctccctctggtagtgatggtctcagaaattacatttcaagaggaaaacagaaagaccagaagtcctaactacagcaagcagcaaaccaactcacttgtcaaatgagagtatctaggatgggagcctggaatctgcatttttaaacaagtgcctcagatgattctgaatcaagtggtctggggaccacagtttggaaaacacaccctagaacatccttttggagtctgagtgttaacctcactgagagtcctccagctttccagagaatcaggctgacatcactgtgcctatgtaatgtgaatcagtctttattttgcacttgtgtggkgcattaacaaattcaasatacaagatagcattacatattgtagattagcattacagcattatgcaatttcacacaattcatgttagctttttcagttttctttttttttcaaaatttgacacatttattttatttttgagtttcatttttacaagagaagacacaaggtaaaraaagacaaccactttggagagggatcatggtgagggcaatgtcactgtcatggccatagtacaagccttccaagaaaagggacctgcgttattccctctcctgagcaagctgcccctgtcccacaaaccagttctatctgttttcacatctagagcactgtccataaacatgtccatcttggctgtgctccagtgagatgaactgaaagaaggaataactcataaagggacctttgttattaagaaaaattcttgtcttcccaaaggaatcaagatctcttcagagaaggagcaactgttggaaaatcagaagtgaccattccctaacctattcctgaccacgaatgccttgtgcaaaagctaagatgtgactctcttgtctttctttcaactgactcttaggagaaggcattcctcctccactcttatcagttagctctggaaagaacaaatgtgaaagccaaagtcagctaagaaactttgagacggcaaagtcaagggcacgatggatcaggcctgaggtaggagggaggagccctgcactgtccgcctctttgcctttttctggcaaagacactgaggcagttcctaggctacagaacaactggttcctcccctgtcacctcagcacccactgctcagtagacccaaagatgcaaggaataaagctacaaggaaatggggaagagagaggagagtggggtgaggctgttttcccagacgtttgtcaggaggagctacagaggcacacacagcagggcaaagaccagactatctccacctgttgttttgcattgtttctgggaaggaaacaaaagcgggtttgctcagcgatttctgatctttagacattaaggcgatgaagaggaaccatttaaattttttcctaatggggcttcagaatgctcctgtcagatttacattaaactatctcaaaatgcatttttagaaaacaaaaattattttcttctacttatgatacagtatttacatttcatggggtataggacagagactagtggtatgaccccaactgatggtgaagttgtgagtcagattatggggggtgggggttggcagggacaagaacagagagtaggctttgtgactgctcagaattgctctgcattgtcaagaacatgggctgaaatcaaacaaaaggtttagggggagcagaatggttttaaatccacaaaagctgagggaacactgaaagcaagatcacccccccgtccatagagactcagctttccgactcccttcgccaaagcaaggttaaaagtgatgttcttctatggaagtgaacacttcagtctcaactaacctttcacgccctggatcaagctgttaagcaacagcttgactgagttcctcctcaggtgggcaaaaatatctactgcctatccaagtttacctagtttattttaattaattaattaattaatttttgagacaggatctcactctgttacccagcccagagtgcagtggcatgatcatggctcactgcagcctctacctctgggctcaaatgatcctcccacctcagcctcctgaatagctgggaccacaggcgtgcagcaccacacctagttaattttttgtatttttgatagagatggagtttcgtcatgtagcccaggctggtcttgaactcctgggctcaagcgatctttccacctcggcctcccaaaatactgggattacaggcgtgagccactgcgcccggccccaagtttacctattatccatggagtctgtgccatctgcaaagtctcaacgttggagacacagctgctgtaggagtaaagagacttgaattctaatcccagaaagatgctgaatctctctcaacctctattgcccattggtagaagaagaattgcatcctgtagttcctccatccctccaccatgtggtaagacataaattccaagaattatgcagctcgttttgaggaaaagaatgctctgaaagaatccaacttatcttcattcactcagtcacactgttatttttttaagagctaaatttttattgaaaaatttaaggagaacttctgagggcccctgttttatgaagcaaagctaacctcattacaacatctaagctatttgagaagactctaaagcatctccatggtcggcatttccagaaaaacaaaggccagtgtaattcttcaaacctctgatgacttccaacccatcaaccaagaaatggctgtcactacagtagatagctgcaaaggggaatggctgtcgtcacttgtctcctctccttgtccttatacctgaaaacagcttttgggatcagctggatgtgttcattggtactatcctatagctgaatttgaagtttccaaagctccttttagagaagtcatcaagtttgataaaatccaagttctgatgtcttggatgcataagtctgatgtattctctgtgcttcagttaggtctgtcagttaattatagactgccttttactacttcatagcagaagagctgatagcaaaaataccccatttctcaattcctctttctcctgcaaaccttgcctcatccaccccacctttgtttcttggcttactgcagacctctagaccttgaggtcaaagagcagagatataagaggcaataaaaagaaaagatrggaatgatgaaaacatgaggttttataagagcaaaattttcttctgcagaggtggggagtgggagaaattctccagagaagcccaataaaaagaagccaatttcaggtaatcagmaaatacaattcagcacaaaacacaatttccatggattaaaatctgcaacttgatattggcagttaggctaatttcttcagtttgtattagacatgcaagtatatggttacattgttatatatagatttataggggtctttccctctcttttgtcccccattaaaaaaaaaaaacaaaacaaaaccagaggccgggcacggtggctcgcacctgtaatcccagcactttgggaggccgaggcgggtggatcacctgaggtctggaattcgagaccagcctggccaacatggtgaaacccatctctactgaaaatacaaaaaattagccgggcatgctcgtgggtgcctgtaatcccagctacttgggaggctgagggaggagaatcacttgaacctggagggcagaggttgcagtgagttgagatctcaccattgcactccagcccgggcaacaagagcgaaactccacctcaaaaaaaataaagtaaaataaaagattctagcgccttgcaaagcagaaaaaaaaacatcattgctaagaactgatctgcagctgtggtcatatagggtgttctttgtggaatttgttttgtaagaaattttcttctacaactaaaatgaggtttggagtccacttctctgtcatctttttcccctccacatccctccccagcttggcccccggggattagaggagagaagaacaggattagtactcgctcagactgtgccacttggccacaggcttgcgggggctctcgcagacctctctccagtgttcagcaccactggctgtgacactgtgtgcccccaggatcagcctccccaccacctcattcttggtggtgcgatcgaagtcgataacgaggaactcgatgctgatatcaggcaggaggtcagtggggatgtcgtagatgaaagattcattgaagatggggttcaaagtgcacttcttcacatgggttttcttcttggcaatgcgctttctgccgtagtagacgttcaccttgacataaggatctggggcccccaaagagataagaaaaagggagacagacctatgacacagtcctctcctatgtaatggtaatttcatgttgggaaagggggggctctgttgttcgtatctttgatggccatcccatgtgttctttagtgattgcacaataaacacacactgactatatgtsagtctgcytgcctggatgaggggccaaggaaaccaagcaggaatagaacagaacaactttctcaggttaggtctgaagaaatcccatgataccaagaagtatattaaagggcacagagacaaatgcctgcagcctttttgagaagtctctcttagcacctggcatgaatattatttaggataccttgccaaatgtaaagaccccatttgttcaactgaagaatcttcctagccagggaaatctattggacgtagatactcrtcaggaagagaatgtctacagaaagaggagcagattaaaagtgaaagaggcaaggatcttgaagtgtggaggtctatctgggccacaggcaaggagtcggggatggttcagacagtaagaaataggttgaagtaaatagctgctacctgagagaccggtgatatccatcttcggcaagtgtctggctttgaggaccaccactgtcattctctgtgccacaggctgatatgacagagacacctggagctcccctctgctgatgcacttctgtgaggaaaaaatggcaggtgagaatcctggcagagggtgcagggcagagcacaaaaagtgtgcagagcagtgggaagagtctgggggaggacaagtgcagggatgataagttttttggaaagatgctcatcccctggaaaggtgttatgattttatttaacaaggagggagaaaggaaacattataaccataattctgatattaaataatttgcatggagagcccacatagccttggatttatgagcatgacctctggagccagattagcctggattcaaatcctgactatttctctttttttttgagacaggttctcactctgttgcccagattggaattcagtgacgtgatcttggctcactgcagcctccatctcctggactctagcaatcctcccacctcagcctcctgagtagctaggactacaggtgtgtgccaccacatctggctaatttttcttttttctatacacagagtctcactgtgtagcccaggctggtcttgaattcctggtctcaagtgatcctcccgcctcagcctcccaaaatgctgggattacaggcatragccaccatgcccagttgctatttcttatctgtgaccttggacaagttactcaacatctctgtacttcagtttcctcacctataaaatgtgggtgaaaggttgtacctaccacatagcattatcagaaggattaaataagttaaaatttgtaaactgcaatggtgcccagcacatagtgcgcactatagaagtgcatcctctcatttggttcttatcctttaaaaagttctgaagactgtacagtgggaggtaggagaactgggtttgaatcttaaccttgccacttactcaccacatgtccttgggcaagtccctgaacctgtccctgcatttcacagggtgaatatccacacctgctctgcccaccccaatgtgcactccagtgtatcttctccagccaagtcagcttcctccccagcaccctgatctttgtttctccatctttaaatgtgatgctaggctccattttgagcttgaaaaaacctctagtcctccaataactttttttttgagacagaggctcgctcttgtcgcccaggctggagtgcagtggcgtgatctcggctcactgcaacctctgcctcccaggttcaagtgattctcctgtctcagcctccagagtagctgggattacaggtgcccgccaccatgcccggctaatttttgtattcttagtaaagacaggatttcaccatgttggccaggctggtctcgaactcctgacctcaagtgatctgtctacctcggcctcccaaagtgctgggattacaagcgtgagccaccgtgcctggcccctccaagaacattttaaagaacattttcataggcactgcatgccaggttttgaggatccagagctgatgggactcagttgttgctcccaaggagcttaccacttagtagaagagtcagagaagtaaataaacctgtgcgggacttgtcagagaaatgagaagcctgtctaagtgctctgggcacctagagctgggagattcaggggaggcttttttaattaattwattwattwatttatttatttattttttaattttattttttgagacagagtctctcgctctgtcacccaggctggagtgtagtggcgagacctcggctcactgcaacctccgcctcccaggttcatgccattctcctgcctcatcctcctgagtagctgggactacaggcgcccgccaccacgcccggctaattttttttgtatttttagtagagacggggcttcaccatgttagccaggatggtcttgatctcctgacctcatgatccgcccgtctcggcctcccaaagtgctgggattacaggcgtgagccaccgcgcccggccatggagattcagggaaggctttaccagctgatgcctggactgagttgatgggggtacaaaaccatgaagcaatgggcagagggatgatcatatcaggcagattgacagaaatggctggtacaaaggagttgggcctgaaaaggtaagctgtgttcagagaatggttgagaggtgaatatgcctgaagtgggggtggctgataggaggggtaggtcaggaacctggaaaggtgggcaaggctagagtaaagggctgttgggacactaccaaagagcagagtcagcagcacccatacaagaggaggttggtgagtataggagtggcaaagctgtcatttttttgagtcagggtctcactctgttgcccaggctgaaggacagtggtgagatctcggctttctgcaacctccacctcctgggctcaggagatcctcccacctcagcatcccaggtagctgggactacaggtgtgcaccaacatgccaggctacattttgtattttttgtaaagacagggtctcactatgttgcccaggctgatctcaaattcctggggtcaagcaatccgcccaccttggcctcccaaactgctgggattgcaggtgtaagccaccatgcctggccagttgtcatcattttattaaaattattattatttcagagaaaggtggaaaatgagctaaagtcgaggaagaccaacatcagaaagctcagttaagaggccgctatagccgggagcagtggctcatgcctgtaatcctagcaytttgggaggccgaggcaggcggatcacgagttcaggagatcgagaccatcctggctaacacggtgaaacctggtatctactaaaaaaatacaaaaaaattmgccgggcgtggtgactggcgcctgtagtcccagcaactggggaggctgcggcaggagaatggcgtgaacccgggaggcggagcttgcagtgagccgagattgcgccactgcactccggcctgggcaacagagcgagactctgtctcaaaaaaaaaaaaaaaaaattagctgggcgcagtggcgtgtgcctatagagccagctacttgggaggactgattgagccccggagatcgaagctgcagtgagctgtgtttgagccactgcacttcagccttggtgacagagtgagaccctgtcaaaaagaagctgctgtggctgggcgcagtggctcacgactctattcccagcactttgagaggtcaaggcaggtggatcacctgaggtcaggagttcgagaccagcctggccaacatggtgaaacctcatctctactagaaatagaaaaattaggccgggcgcagtggctcacacctgtaatcccagcaatttgggaggctgaggtgggcggatcacgaggtcaggagattgagaccatcctggctaacaaggtgaaaccctgtctctactaaaaatacaaaaaaattagccaagcatggtggcgggtgcctgtagtcccagctacttaggaggctgaggcaggagaatggcgtgaacccgggaggcagagcttgcagtgagccgagattgyagtcactgcactccagcttgggcaacagagcaagactccgtctcaggaaaaaaaaaaaaaaaagaaatagaaaaattagccgggtgtggtggcgggcgcctgtaaccccagctactcaggaggctgaggcaggagaatcgcttgaaccaaggaggtggaggttgaggtgaaccttgatcacgccactgcactccagcctgggcgacagagtgagactccatctcaaaaaagcagacttcgttgttctgtagcaacgtgctacagaagaaatgattgggactggaactaggrctgtggcagaggagatggacatggaggtaaaatatgtctcaggaagaattgtcaggggtttttaggcttgggcagttaattggctgtgaagcgtagggaagagggaggaaagggtggactatttcttgtgtttttagctttagaaagtggggatgaggctgggataaagaaaacaaaaggaggtgagttttggccgggtgcagtggctcacgcctgtaatcacagcactttgggaggccgaggcggacggatcacgaggtcaggagatcgggaccatcctggctaacacggtgaaaccccatctctactaaaaatacaaaaaaattagccgggcgtggtggcgggcgcctgtggtcccagctactggggaggctgaggcaggagaatggcgtgaacctgggaggcggagcttgcattgagccgagatcgcgccactgcactccagcctgggagacggagcgagactccgtctcaaaagaaaaaaaaaaaaaaaaaaaaaaaagggaggtgagttttgaggaatgtagaacataataagttaaatttgggacaaaatcatacccccacaatcacccttattccttgtattcttcaaagccccaaagaaatgtcatctactccaggaattcttaaattgagcaaaaatagactatgctcatcaccaaccttatatacaccacacacccacaaaaatgacttgttaggcacttattaagtgccaggcactctctgctagaagctagggctgaaaagatggatactgaggaatcctacccttaagaagctcccaggctagttcactatctactcaggtatgtctggtgcaggaaagaacagcggcagcaaatatgccaattaactcatcaataaaaaacaagaaataagcctaatagtttgtgctttgattgtaggccttaagtcatctccaggaatgaaactgtgatatttcacatgattttaaaaatttattgagtctatgtttcgtcctaggagcatatggaaatgtctctcacagggcataaaaaataactaactaggctgggtatggtggctcacgcctgtaatgctaacactttggaggccgaggagggcggatcacttgaggtcaggagttcaaaaccagcctggccaacacggtaaaaccccgtctactaaaaatacaaaaaattagtggggcatgatggtgcacacctgtaatcccagctactcaggaggctgaggcaggagaatcgcttgaacccaggaggtggagtttgcagtgagctgaaattgtgccactgcactccagcctgggcgacagagtgagactgtctcagaaaaaaaaaaaatctaaccaaggtttaaacccactccttagcttttgaaattgaaatacaaaaggggatcaactttaaaaatattttcatgttttttctctgctagagagaagccccacattttgtccttacccataacatatgtattgtcagcttttttttttttttttttgagatgaagtctcgctctgtcacacaggctggagtgcagtggtgcgatggcttactgcaacctccacctcctgggttcaagcaattctcctgcctcagcctcccgagtagctgggactacaggcacatgtcaccatgcccgggtaatttttgtatttttagtaaagacggggtttcgctacattggccaggctagtctcaaactcctgacctcatgatctgcctgcctcagcctcccaaagtgcggggattacaggcgtgagtcaccatgcccggcctattgtcagctcttaatcgtatccatggaaagtatcctcagccagttttattttatttttattatttttatttttatttttttgagacggagtcttgctctgtcacccaggctggagtgcagtggcgcgatctcggctcactgcaacctctgcctcccgggttcaggccattctcctggctcagcctcctgagtagctgggactacaggcgcctgccaccatgcccggctaattttttgtatttttagtagagacggggtttcaccgtgttagccaggatggtctctatctcctgacctcgtgatccgcctgcctcggcctcccaaagtgctgggattacaggcgtcagccaccgcgcccggccttatttttatttttgagatagggtctcactctcttgcccaggctggagtgcagtggtgtgcattcactgcagccttgacatccagggctcaagtgatcctcccaactcagcatcctgagtagatgggactacaggcatgtgctaccaggctcagctaatttttgtattcttggtaaagatggggttttgctatgttgcccaggctggtctcaaactcctgggctcaagtgatctatccgtctcagcctcccaaagtgctgggaatacaggtgtgagccaccatgcttggtccctcagccaatgtgtttttgtttgttttgtttgtttttcccctygagacagggtcttgctctgtcacccaggttggagtgcagtggcacgatctcagctcacggtaacccccacctcctgggttcaagcgattctggtgtctcagcctcctgagtagctgggattaccggcgtsaatcaccatgtctggggtttccgccacgttggccaggctggtcttgatctcctgagtggaagccatccgcccacctcagcctccttaagtgctggaattataggcgtgagccaccatgcctggccctcagccagttttgaattacagtctggttgcycttgccaaccagtatacttctgggctttttccttttgccagaaatcagaatgtaatcagtgaatataaactcatttttactattagccacatcaaatgaaaagtaatcccatatggaaaagaaaattgaatggattccaaaacattcagaactgagctatccaatacagtagccactagctacacgtgcctatttacattttaatttaaattaaataaaattaaaattatagttcctcagttacactagccacatttcaagtgctcaatagcgacatgtagctagtagctaccacactgcatggtgcaaatatagaacatttctatcatcattagacggcactgatctagaaaggacttttgcattgttttggctactgctcccgtctgtttccatgaataataataaaatgttagctaggtttgatatatccatttctggggccatccttcaatactgagtatctaaatactaaatatgcagtctttaaatatgattctaactttatatacagaggaaggataggtgggggaaaagcaacgtttcattatttcttttttttgagacggagtcttgctctgtcgccaggctggagtgcagtggcgtgatcttggctcactgcaacctctgtctcccgggttcaagcaattctcctgcctcagcctcctgagtagctgggactacaggcacgtgccaccacgcccagctaatttttgtatttttagtagaaacggggtttcaccatgttggccaggatggtctcaatcttttgaccttgtgatccgcctgcctcggcctcccaaagggctgggattacaggcctgagacaccgcgcctagccgacatctgattttaaaagcacagttttatttgcaagaataacacgaatgacaagattatagcttaggtttcccgattacttatttaaaattctgtatcctaaatcatccattctaggaaaatcttcctaatcaaaatccccatgcctctttcctagttttttgggaaagttgacaacttctggttacccttttcatttttttctcccttaaaatcactcctcaggcaactgtcctccatctgatccctccttcaccttgtgccatctcacacgggcagcatgcccatccccactcagcgccgctttgtgatgcccaagtctgtagccacaacaccacctgaatgccactccattctgcattgaaggcartttaatgtcattccctcaagctccctccctttctctttctacccaattcccattccaagtagctatgtcaatggctctttcttttgaaagagccattgaaggctgtgagcaagctctgtttcccagccccttggcctagtgaggcaaaggccctgttggggggcaggcaagcagaaggacaagggggagaaaggattttctcatgcctgacagagctgcggggctcggctctctgagggcaatctccttgctccttcagtggaacagaggaacaggaacagtggtcctaaagaatacactcagaagaaataatacttaggcaagggatagtctgttttcctataattagcagaacctctttcagagtgattttctagccaaggagcccttgtattaggtggaccatcataagctcaataaacccttcttgaggccagatgtcctgagggccacctctagcctaaatcacaaccatgggaaaacaaaaccttaacattcaatcccatcccccttttcctccctgcaatacacatacatgatctgttgcccagtctggagtgcagtttgtggtaatagctcactgcaacctcaaactcctgggcttcccrccttggccttccaaagtgctagtattacaggggtgagccactgtgcctggccatattttcttttatttttttattttttattttttattttttattttgagacagggtctccttctgtcatccaggctagagtgcagtagctttttcctggtctatgtaatccagaccaggaaaaagccctttacagccagtgtggcatggtccagggcagctctagctgacgttcaccaaggrgagatcctactttgctatggtagggaggatttgggatagacatttgcagcctgcacttctagggaacctagtggatgagtgactagggagatgacagccatggctcagatggaacatagtcctgcctacgggcactggttgggaaaatgggtttaggaagcctgggaggctggaaggctctagggtggggctgcacaggctctgggtawcctatctcgggccttctccagggcatgtgttgctcaggatcctagccctggcttatccctcctcaagggagttaataaagtggaaagaaatgtggctcttgccaagagcccctggcagcttagcaaatgccattgtctgtgctgtgtccagtgcccttgatttgaggctgttttgttcccagcccaaatcagtccctttcattgccagtctcttcccagctgcagcttggcacagagccatgttctactcccagccttgggctgcaagtgtatagctgtctggaggagtccagctggttggtgactttaccaaggttggagtcacagggaagggtgtattggaaaggctcctccttcaaggagaggtagacaagggaaggagtagaggatgggagctgctgtgaagggaatacggaaacagcagaatgggtcggcagagccctgaggaaaaaagatgggacaggggaggggagagaaggggatgaaacaggccactgcttccatttctattcacaccttctgattccagtctcagaggatgcgaaaaccccttcagggctggactctgggatgtctcattgtatcctggcattgagaaccacaagatgttgtggcagtgtcttgtttatgctctgacgttcaccaagttttcctataattagcagaacctctttcagagtgattttctagccaaggagcccttgtattaggtggatgaacataacctcaataaacccttcttggggccagatgtcctgagggccacctctaccctaaatcacaatcacaaatgtgtctaatattcttcaarattcttggacttccctggcccgtgacatggatctgagtgtgccaggtggcagtagcagttccttcaggcaatgaaaggcaggaccgggctggctgcagggggacaggtgcctactacagagcagagaaggcaagaatacacacacacaaagtgtgctccctgctgtcccccacccagacttggcacagtacccttcttcagcaggcaaaccttgttcctgggtactcactgcacactctgcacctgctaacttaggagcctcttctatccagtcctgagcctcctgtctacccactgagtccagtgaggacttgcaggtaaaaaaggtatcaagaaataagtatgatctgcccacaggcagagctctttctgggagatgtgcagttgtttctagtggcctcgaaattctttcctaacctccttcaccaattcctcccttgtcttccttcactgtgtcaaaacaaaatataaatatttacaaaccacatgcatcacccaggtatcaaacttgactaataataggaataacaataatagtaacggtcacaatttattgaaggctcactgtgtcctagtagctatataaaatcatcatcctactctattcccataagaaactgagacttagcgaaagtgaagcagcttgcccaaggtcatttagctggtggaatttggatttaaactcaggtctgacttcaaagtccttgctattttaaccacttatgttataccctgaaaaagacatgaaactctaagtttaaaatttcaacaacttctttcatagcacctaccatactcactatacagtaattacaaaaaatatttgtctttctccttcaataaagtgaaacctcttcaagggcaatcatatgccaggcatattatctcatttgattctctgtaaggaagrcaatattatcagctccattttacaaatgasaaaatagaggcttagaggggtcgagtaactcacccgtgtcacacggctggcaagtggtaagctggagagtaaagtcgtgcagtccaattctggagcccaagtgtttaactgcagcatttcactgcctccccagttgtggaagaaataaatgaactaatggggttgggtggggctacacttactgtgctcctgaaattacaactcaagagccaatgtcggtccagtgggaagagggagagagaaggcaggatggagggccctcgtccctcttctaatacaaagagggaggacaggagaaatggagagaggggaagtgtctatggcaaaggtttgggcctagaagggtgaagcaattcattgaattgcattgtaaaatggtcataagaagacatgtgcatgacggctgggtgcagtggctcatgcctgtaatcccagtacttttggagtccgaggcaggtggatcacctgaggatagaagttcaagactagccaggctaacatggtgaatccccgtttctactaaaaatacaaaaaattagccaggcgtggtgatgggtgcttgcaatcccagctactcgggaggctgaggcaggagaatagcttgaacctgggcggtgggggttgcaatgagctgagattgcgccattgcactccagcctgggcgacaagagtgaaactctgtctcaaaaaaaaaaaaaaaaaaaaaaaaagacatgtacatggtatcatttacacccctaggttagggttgggaaagggaagctgagggaaaaattactgaattattgtcatagcttctcagctgtgaaaaataaattcactggaggaagatcacatcattttggagaggaaattagctcccatatccctgatataatgaaggatctacaaatggtaggccagcctgttccaagtaagctggacagcatcaggatgccaaccactaagtgaaatggtgaaagctattgraccttctctcaccaggaagttgcttcttagaggagacctcatctgccaggccctctgtcttactctgaccactgcttatccttgacatccaagagcttcctctctacagcccttctttgccacccaacccactcccctcccacttccatttatcccctgagatattttctcccccaacctaccattgctccccaacacacacttcctactcacctggatattccttttgatgatgtccctggtcagttgtaccttgcctgtgctggggtccacccctgccagtggcaccatgacctcgccaatgacatcatcccgagagaagcggtcaaagctgaggacaaggaagtgcagcaccaggtcctgcagctggctgtaggggatgccatagaaggtgaaggtctcgtcaaacacagggtccagggtcttccgcagcactctggtcttcacccgatgccgtttgtcaggaaggatggtcattttgatgtaggggtcagatccctgggtctggtcatccatcactggcagcccrtgggcctcctggattgtcaccaccagggcttttttcgggaagttatagtccactgagaaggtgagggatcctagcatgacatcctcctctggagatgatggagaggtggttttgctctccccaggggtcaggcttgtaatagggctccttagttcttccccatagtccattttgatgggtaattggtctatacaagatccagagctaggccccctgggatctttgtctcggcttagcaggccagcctctgctgcgtccaccaacaggttcctacgtccaccttccctcccaggaccatctttgtctctccgcactttgatgattttcttcttgttgctgagggtctctgggtatatgctgatgcctttgagcatgtgaataaacttgtatggtgggttcttstgcttcttctctgcctgctggtggcagcatgaccagacaaagacggtcaccgagacacacaccaccagcacagaggccccgatgaggccggccaccaccggtgacacatctgaaggcggagatcagagatgtgtcagggcgggtggacttcacctcctgtctagatctcccctgctcattgccactgctggagccaagctaatcttcaatctagcctctaaagcaaaatgtgctcatctgggcttcagaatttttcccttctattagaggcaccctctcccaacctctccaaccactccacggcttttcctcccagccttctatagaaagccttctctgaagcaccccacttgactctatgttctttcctagaccttctctcagcacttatagacttggtttgctcatactgatttgtgcttcacataaagctgctctgtacgtgttctaagatcacctttttacatgagcacctgttcacttcaactgttacacaagatgtttggtttcaggatattccatagcatccagaacagggcctgcactgactgactcgctgtcaggctagggtggaagggtgtggagatgagtttagatggtcttggtagggtgttcagggtagtaaaaatggatgggtgccaaaaggaagaattctgggtttatgtacttttaaaatatgttccaaaattttagctcccaggtatataaaatacaaggctgggtgcagtggctcacacctgtaatccyggcactttgggaggctgaggcaggtggatcatttgaggtcaggagttcaagaccagactgaccaacatggtgaaaccccgtctctactaaaaatataaaaaattagctgggcgtggtggcatgtgcctataatcccagctacttgggaggctgatgcaggagaatcgcttgaacctgggaggcagaggttgcagtgagctgagatcgtgccactgcattccagcctgggtgatggagcaagacttcgtctcaaaaaaaaaaaaggtattcctccaggatgaatatatccattgtaggcaaaaaaataggtgtgtgtatgtatgtatatatatatrtgtgtgtgtgtgtgtgtgtgtatgtgtatatatgtatatgtgtgtgtatatatgtatatatgtgtgtgtgtatatatatgtatttatgtatacatatattattctaaataggaagaaatagagactttctcttttcattattattaccttaataaatccttcactggaagaaataggggttttcttccctattagtggaaaatgtcagatctctgctcaaatgtcaccttcttaggcctttcctgactcacctatttaaaagtgcaatcttctccatcctcaccacccactcttcctagccttgcttaatttttttcaacatgccgtcattctcgctctctgatacacacacccctacacatgtaagaaaaaaatatataaaatacatacacaaatatgtaagaataaacacccacacgcatattattttacaatttattatttatcttcactagaatataagtctcatgaggacaaaaatttatgtctgttttgttcacggctgtaccctcagcacttaaaacacatagcaggcactatgtgttggatgaacaaataactaaacagaaataggccgggtgtggcggctcacgcctgttatcccagcactttgggaggctgaggcaggcagattacctgargtcaggagttcaaaaccagcctggccaacatggcgaaaccctgtctctgctaaaataaaatacaaaaattagccaggtgtggtgacacacacctgtaatcccagctactcaggaggctgaggcaggagaatcacttgaagccgggaggtggaggttatagtgagcwgagatcgtgccactgcactccagcctgggcaaaagaccgagaccccatctcaaaaaaaaaaaaaaagaaaaaaaaaagagaaagagaaatagattttttttttgtttcccttaccctagtcttatcttttcccacaaaaattggaccctcaagtttcttcgctccctcaagttcattgaggctaaattgggtttaggctttaaaggtccagattaggcctatagttttttccactttactttttaggggaccacttggaagggagggagaactaaggaaataaatgtagcctgggcaacatggcaaaaccccatctctacacaaaaaaattacaaaaattagcagggcatggtggcacatgcctgtagtcccagctatttgggaggccaaggtaagaggatcacttgagcccaggaggtggaggttgcagtgagttaaaatcgtgccactgcactccagcctgggcaacagagcgaggaaaaaaaagaaaaggaaatagacataattccagcatttccccgattctttctggaatattctttttttttttttttgagacagagttttgctcttgttgcccaggctaaagtacaatggcacgatcacggctcaccgcaacctccgcctccagagttcaagcaattctcctgcctcagcctcccgagtagctgggattacaggcatgcgccaccatgtccggctaatttttgtatttttagtagagacagggtttctccacgttggtcaggctggtctcgaactcctaaccgcaagtgatccaattgcctcggcctcccaaagtgctgggattacaggcatgagccaccgcgcccggcctaaagcattcttgtatcaggcatctgtgcagctcactgcttcacttatcgtgagccccgaacctcactggatgagggaaatatttcctgtctgccccaagtaagataatgtccccatcacccttccttaattttcttcatggagcttattatcctgacatatatttattatctttctttgatcactagacaagcttaataaaacagcaactttgtctgttttgttcactgctatagttccacgtcctagaactatgcggcatgtagtaagcgttcagtgaacaaaagagtcagtgaattcaaaacagcctccacagattagaaagagaggattgaggcctggtgcggtggctcatgcctgtaatcccagcactttgggaggctgaggtaggcagatcacctgaggtcaggagttcgagaccagcctggccaacatggtgaaaccctgtctctactaaaaattcaaaacttagcctggcatggtggcaggtgcctgtaatcccagctacctgggaggctgaggcaggagaatagcttgaacctcggaggcggaggctgcagtgagctgagattgtgctactgcactccattctgggtgacagagtgagactccatctcaaaaaaaaaaaaaaaaaaaaggattgagtcaagatgattacatatatcagggataaatgtaaatttctatttggactcaaaaacctatttatagtcaataacctcacttgatgagtcaaaaatgacttaggaatttaggcaaccacaatcttggactataattagtataatgcctactgttttcccttctattagaggtatcctctcctatcctctccaaccaatccatggctttttcttccctccaaacctagatgaagsgtttatcttctctagaaagcctatgagcatcatgagcacaatactatgagcataatgtccagattacatgagaggcaggtataatttcatctgcactggtcataatatacatgtaatattgtgtatagcagtgacaataataaaattgctattttttgtgtaaatttatatgtccctgccaggcattgtggtagagcttactttttttatttcttttgagacagcgtctcattttattgcctaggctggagtgcagtggcacaagcttggcccactgcaacctccaccacctgggctcaagtgatcctcctgcctcagcctcctgagtagctgggactacaggcacatgccatcacacctggctaattttcgtattttttgcagagatggaatttcaccatgtcactcaggctggagtgcagtggcatgcatgatcgcagcttactgaagctttgacctccccagttcaaatgatcttcttgcctcagcctcctgaggaactaggactacaggcatgtgccatcatgcctggttaattttttttttttttgagatggagtcttgctttgcccagacttgagtgcaatggcgcgatctcggctcactgcaacctctgcctccctggttcaagtgattctcctgcctcagcttcctgagtagctgggattaccagcacgtgccactacacctggccagtttttgtatttttagtagagacggggtttcaccatattggccacgctggtctcgaactcctgacctcaagtgatctgccagccttggccccccaaagtgctaggattacaggcatgagccaccatgcccagctaatttttaaattttttttagagatgagtcttcactatattgcccaggtggtcttgaactcctgggctcaagcaattctgctttagtctccaccaaattgctgggattacaggtgcaagccaccatgcctaaccaaggaagagttacattttatttaaaatatatatttattgttattatttttttagagacgtggtctcactctgtggcccaggctggagtgcagtggtgcaatcacagctcactgcagccttgaactcctgggctcaagcaatcttactaccctagactcctgaatagctgggactacaggaccatgccactatgcctggctaattaaaaaaaattttttttagagacaaggtgctatgttgcccagtctggttttgaattcctggcctcaagatcctcttgcctcagtctcttgagtcgctggaattataagcacgacccactgtacccgggtacattttaaaataatatagataaggagcaaaacattattaacaaaataaatcaaggtgaccatgtctatatccataccgaataataatagtgtttagtctcaaagtattaaatgaaatagcttttagggaaagttttcacaaaatggagacagccttggtagtaagctacttgaaggcaggcaggaacaatatcctatggatctttgaatccctcaagagtctcttgcttctaataggagttcagtaaatatttggttgaacaactaattggattcagttgccattaagaatgggcacagcctaaggaagtggctctccattcatcaatcaggtgctttcctgcaaattgtttgctactcattagtgaaactgaacactgtctctatgagaagaggaacacagcaaactaccaagacaggcatattttttggaatgatcataaagagagatctgaaggcttagattaggagacacctgggcaattcttttggctctatcatagatttattccctgcagcagtgcggtggaggagcggggggcaacccactgctgcttacatatttacaatgcatcaacttttattgttagaaaatggagatagggtagaaaagagagaagatgaagaattctcatattccaggaggatagagaaggaaaagaagagaaacagatgaacgcatctttgaattatctagttgttccccctggccttgtttcctatttttgctgttctttcttcattttagtatttgttaactyttgcctctctccctgaaaccaagacaatgagctagaatcatcaaagatattaaaacctagagctctctgtcttgctttagtccaaagcttggtgggaaatggaagttgaaactaatggctgaagtgagtgttttaaagtagctataaattgcagtgacctgtgcttctcgctccttttgtccttcatggtcatggataattgagtgttggcttggtgtatcacccaagtgctgtggcatttgaaatgaagtactctatgagatgtgaaaaagttggaagtggtagttctctatgtaggagatcctctgtaatggtttaaagacctgcaagacacatctgggctattggccagctccttcagcttctgaccagaactgcttttattgacaccccctttcctaaacatagcttttcgcagtcaagtagacaaatataatacaatggaatgagaataaattttggcttcagccagacattggtttaaatcctagcattggccaggtgcagtggctcacacctgtaatcccaggactttgggaggccaaggtaggcagatcacctgaggtcgggagttcaagaccagcctgaccaacatggagaaaccccatctctactaaaaatacaaaattagctgggtgtggtggcacttgtctgtaatcccagctacttgggaggctgaggcaggataatcgcttgaacccaggaggcagaggttgtggtgggccaagatcacgccattgcactccaacctgggcaacaagatcgaaactccgtctcaaaaacaaaaacaaaaacaaactagtgctacctttagtcatttgtttggctttagccaagttattttatttctgagctttggtttccttgtctggcaagtatatataataatacatacactcgagggtatttgttaggattaaataaaatgtagtatgtaacaggctgatataatttattttccctttcccaataatagtccctctaagagaaatcactatattatgttccacaccatctccttttttcaaggattctggaactgcagttagagaaaggaatctgttggaagggaataagaagaaaaagaacaggaagaaatcatggattgctcatgtgatcatgaaagggacttttgttttggaaacttagaactcaaagaataaagatgcggaaggtgaagtggaagaaaaaataccatcaagatttagccttgtggaataagtgagaacaagtagttaatgagtgtgaagatcagttatctgaacacatctgatttgatttcttcttccttattctgaggggatagagcacactggattctgctcatttcactgtacctcttattcaggaatgagaaaagccatttcctagctggattgtgtctccaccctaaaaactggagtcccgatgctcaaacctactggattgtctgagggatagaatccctgaaggaataagaaggttctttggcagcaactctcactggcttcccccatctaaactgaatcaaggagaagcagggcaattatattttatttatttgatcaggaaagcataacacaggaagtttgctcctttagcatatactgcaggagtccccaaagaggaaaaaacttccttctcaagcttgtctttgccaccttcttccctattttccactccactttctgctccagagagtgtaaaactaatcttggagcccacagggctgggtcggggaccagccgctctgaaatgacgtaatgctttctgcggtacacaaagcggcctcccccgggctgggcctctttcgcccctccccctccggcctggatcgcgcccccgccagcatcaacgctggtcagtccccctttttgaaaaggcggcccagggaaacagggaacaaaggccccggaaggagagcgtcggcgctgccaggaggcccagaaatagacatcacgtcatcccccagcccagcagcgccaagcgccatttggtagcatcggagggaccccaccattacgatgcggaatggagcttgcagggctcacgtttcctcctagccccagcatccagctgaccggcttaaggagtggcttcctttttgctccccaccccgcacccctctttccccagaggccgccgcctcccctggctgccagccacacggcccacagtctccaagctgccatcttgatgccccatcccccttgtcacttccctcccccgcagcccttaggaatgggagggggaggaaggggcaccgccctgtgtgccccaagggggagggcttggcctaccccacctctcctcccccagaaggaggggttcacatcctccgcacgcttgctgtttctcacctccagcagtgctgacagtgcaccatacaaggttttagcatcctggacttccccaccctcggtgtggctcaggccctgccagtccctgcagcccatagctcaagttcatgcactgtcaactgcccactacccactacccaccaccacaggcccgattttagtggggctggcattttgaaggctctggtctgggctgcattctctgccctgccgctgggcccccttggccttgcaaccattctgaccacctcaagcttagttttcccgagtctacttaccaaagctaggtcggatattggtgatctcagccatgtcgtaatcagaggctgttgctataacgtttttgcaatggtragacagctctgggaaccctcggtcagtaccgasgcagcagctgtagagctctaggtcagggaagggggaaggtatccagcggacgcctcctgcgacggtccggcccctagttgtcagctgcgctcagctcttaagatgctccggggatgckctgagctaaggatgcaggtgcagtcagactggtcctgatgagaggtaggctccgccttcttccgaatggtcctcggaagaagactccgcctcttccgaatggtcctcggaagaagactccgcctcttccgaaagattacggaagtcagccctcgcccccttcaggaagctctcccggaggggactcctcccaccgccgagttttcccgagaatgaggccscgcccactgacgcgctgtggttccaaaacgagaaagtactgaagggtaagaagcataggtagattattatatgaaatcctctgatttcagttttctgggctttaatacagcagcaaaatgttctcggtcctgagttccagaattttgggaaaataaaattctgtactgcctggatttcagtatcgactgccatcattatgcatttctgagaccgctaaaggttattacggaacttttttttttggcttatatttcacagtggatggaaactgtcttaaacctcagaaactctgatgaaagaccaaacctggggatggttgcacaactctgaacatttactaattttaaaaaaacagccgggcacggtggctcatgcctgtaatcccaaacctttgggaggccaaggcgggcagatcacttgaggtcaggagttcgagaccagcctggccagcatggtgaaacccccatctctactaaaaatacaaagattagccgggcgtggtggcacacgctacttgggaggctgagacacgaggatcgcttgagcccaggaggtggaggttgcagtgaaccgagatcgcgccactgcactccagcctgggcaacagaacaagactccgtttgaaaaaaaaaaaaaaaaaaatttggttgtacacgtaaaacagatggatattgtggtatgcaaagctgttcaaaaaaaaaaaaaaaaacaactaatgaaaagtgccaaagttaatcagtgttgaatttttttcatgaacctcaagtgcttagggtttcgtatgagagaggccaaaccgaaagatctgtgtattctgtaggtcaaagaacaacacacatgaaactccgagcttctggagtcttccttggtatttgggagagttggtgtgattcaggttagtcagactactgccatgtttgcataaatttcaaccttcattttggctgtggataatttcatccgttggattctgtttacagataggattagttcaaatgtataaatttgtgttggtggtttacctgtaaaatgagggggttgaaagtatttttccaccttttgacattctgttttttattatttttttaatctccgtggattccagacattgtttttctagaaaagtggaaataacatcattttagaagtcattcattcattcgctcattcaaaaagcacgtattgaattattgaacatctgttacaccccaggcagcctcctggacactgggtcaatgcattattagctagagttaggagacttaatacctgattctccttgatagctgtctgtgtaccgttgtgaaatcacctactcagatgagccagaactttgtcctgtgcaaactggaatatgatataataatcttacagtctattgtggagaccaagtcacctaagaaaatgtgagagcattttgtaaaatgcagaatattgtacatatatgaataattactatagcctgagtccaagagtgccttagttttaatcaggagcctgcactatttgtaatttagagacttctttttctggcattttatgacttcttcagtcccttggtcctgtgttccaggtgactcgtagtgagaaaaattagttgttaatcttttttttttttgatacagagtctcactgtcgctcaggttggagtgcagtggcacgatgccggctcactgcaacctccgtctcccgggttcaagcgattctcctgcctcagcctccggagtagctgggattacaggcgtgcgccaccacgcccagctaattttgtatatttagtagagacggggtttcaccatgttagccagggtgatctcgaactcccgacctcaggtaatccgcccgcctccgtctcccaaggtgccgggattacaggcgtgagccaccgcgcctggcccccaaattagctgttaatctaaaccactgaatcttaacctcagttttgagtaggataactccatgggcagagaaagctaagtagtgcctttaaatttttttgccaataactgacgcactaacgttgtggcttcactctgccctaaaatgggatggcgcatagtgttaggcgcatgctccttgatgcactgcggcgcggcgctccgaggctcggggacgcgcacgcaattcgctgttgttggctgacttccggtggtgccaaagccgtttccgtggaatcaggccggctggtgagggtacaggtttgtgtgtggtggggtgggaagaggcaggtgggagctgggacacctggacgaacgatgtccaggttgagaaggtcgggtctgagggtgggcgctgggtgcgtggcggaagttaagggcgtgaagtccagtgtctagttgggaatggggactggagccagccctgggcaccgaggtggaagcgcggttaggaccccttttgaaaatgttttcctaggagagggccgtgccggggctgcctccacattggcattcattcaccctgctggtccgacttgggttcccaaaaaagtggattctgtcgagctactgctgtgtttgaggtgcctggagctgaagtagctgtctttctttccttctttttctttctttctttttctttttttcccctttttttgatctcagtaattatctgtgaaataaaagagctgccctggctactcccattctatttcttataaggtcaccaccatctctcacaggaatcaacgaaatcttcatgttttattgagctttagttactgagttttaattacatcagttgattgaggggatggagaatctcccctaatgtcttggagaaacagaagggaggtttaaaactaactgtaggtcgggcgcggtggctcacgcctctaatcctagcactttgggaggctggggcgggaggatcgcttgaggccaggagtttgagaccagcctgggtaacaaatcgagaccccgtctctacaaaaaaaaaaaaagaaaaaaagtcgttgagggtggtggcaagtgccttgtagtcctagctactcgggaggccgaggccagagggtcactggagcccaggagtctgaggctgcagtgaactaggatcttgccactgcactccggtctgggcaacagagcgagaccttgtctctggaaagaaagagagagagagagaaagaaagaaaagaagaaagagaaatctaaccttagacgcttagagttacaaagaacttttatttttcagttctctagttcaggctttcatctagtactctgataagtggacattcaggcttcgcttgaacattgccagtgatctaacacaaggcggcctattctattattggatctatttatgacagtaaagttttcctgggtaataagatgccttttttttttttttttttttttttttttgacagagtctccctctgttgcccagggtggagtgcagtggcatgatcttggcccactgcaacctccacctcccaggttcaagcgattctcctgcctcagcctcccaagaagctgggactacaggtgcccaccaccatgcccggctaatttttgtattttttagtagagacagcgtttcaccatattgaccaggctggtctcgaactcctgaccttgttatccgcccgccttggcctcccagagtgttgggattacaggcgtgagccactgcaccaagccactatcagtttttatataatgcttaacatttggcccaaatgctgcacagaataagttgtttaacctctgtttcatttattattcagggagcattcattgagtatctacaatattcagtgacacattgagtatcaatactcagtgatacattgagtatctacaatacccaaatactgaactggtgcagtggcttggatgggaccgtaatcccaatgacttgggaggctgaggtgggagcattgcttgagcccaggaggtcgaggctgcagcgaactatgttcgtgccactgcagtgcagcctgggtgacagagcaagaccttgtttcaaaaaaaaaaacccagatactgctggatattagggatatgagttgaaataatcccatttctcgaaaagctgatagttttggaggaaggagatgagaaagagaaagatgagagaccattacaaaactgataagtaccgtaaaagaggtttacaaacagatactaaaagaacatagaggataccctctggtttaggtcagtaatgcccttaaaatgtgataactagaattgaagcaaaaagccaagaagtaacatagcgcagaggatagtaggactcttatcttccttgtttcgacacaaagtttgttgttaatgtagcctaacctttttttttttttttgagatggagtttcgctcttgttgcccaggctggagtgcaatggcgagtgatctcggctcactgcaacctctgtctccgggttcaagtgattgtcctgcctcagcctctggagtagctgggatcacaggcgtgtgccaccacgcccggctaattttgtatttttagtagagacagggtttctccatgttgatcaggctggtctcgaactcctgacctcaggtaatctgcccaccttggcctcccaaagtgttgggattacggacgtgagccatctcgtgcccagccaacatagcctaaccttttaaacaatcacactttgcttttgatttgtttctattaatggaaatacctgtttatgaaaacagcaatagcaaacatgtattgatcatttaccatctaatgaagtagatgctattatattccattttatagctgaagacactgagattcaggttgagtaacttccacaaggtcataaagctggagagaaggtgacttgggaaacatccagacagtctgattccacagtttactctcagcatcatgctagtctaccaccctgatggtaataataacaatgtttgctggacgcggtggctcacgcctgtaatcccagcactttgggaggccgaggcgggtggatctcaaggtcaggagttcgagaccatcctggctaacacggtgaaaccccatctctactaaaaatacaaaaaaaattagccaggcgtaggtggtgcacgcctgtagtcccagctattcaggaggctgaggcaggagaatggcgtaaaacgcgagaggcggaggttgcagtgaaccgagattgcgccactgcactccagcctgggagacagagtgagactctgtctcaaaaacaaaaacaaaaacaaaaaaacacaaaaataaacccacagtgtttattaatcacttactctttaattgtaacaattctatgaagtaagagcaattattttttactgttgagggtactgaagacttgcgaggttaaatcacttggcctaggtaacagtagtccatcagtagtaatcagtagagttgagatttgaactcagtcacttaaccactgtctctcaacttccacctaaagggaaattgtgcatttggtgtgaagtattgtgttcatgatcgaacatgaataaatgaaaagataattgagtaaatgttattacttttaattaatatgaaggcagtaagaactttttattctttcagaatggaacaaaagtgggacttttaaaatgttgccctgtaagaagagaagaactacagtgacagagtccctacagcataaaggcaatcaagaggaaaacaacgtagacctagaatcagccgttaaaccagaatctgaccaggttaaggacttgagttcggtgtcactatcctgggatccaagtcatggcagagtagctggcttcgaagtacagtctttgcaggatgcaggaaatcagcttggtatggaggatacatctctgagctctggaatgctcacccagaacacaaatgtac

SEQ ID NO: 12304 - DNA, 13718 bp, Homo sapiens
aatgtaacatgaaatcattccttccgccttagcagacagatggagagagacattccagtttgtttccagccttttgtctttggagcatttttggcatttccttcaggaaactggaggttgtgacctaaggtttccttagtgaacacatttctgtttcccacagttaaccttacccagaaatgacatctactctattaggtgaggtttatcttcatgtcccaactgtgtcctgtgcatatacaatgacacttgaaagcacaaattctgaaagtagcgaaaagattagagagcccaacatgccaaaacactttaatcccccaaaagatgacaataatcaaaaacaagaattaactattacaataagtctgtgatgcttgcaaagtgccttcattttgtagttggaaaaattaatgactgagaatattaatgctttcagatactatgaattgaaggttttcagataaaagtgttatgctactcagcccacattttacagctagctgcttcactgatactgtatacttctatgtggttcagaagataggctgggagaagccaagacagtgtcctgaaaaaaaaaaaaaaaaaacacatgatttaatacccatatccatatccccacttccccaacatgttggtgaaaggccaagaatgtatgcttttttgatgggttttgaatgatgattgagtctcatcatttaaactagatttacaaccacatttttgtgtataatttctttaaaagcccatatttgatgacagaattattgcatttaatttatttggcttaaatgcagtttaaaactcaaacaattctacttactagccaatgtggtattcagaaggttggtggtttttatctcattctttactactcttcagtgttaacttattgaagtttctcttcctgaaaaagatagagtggtttctaaacaaaccacacttttttcacaccctagttaaggtaaaaatcctttaaagaataatagaaatttgtccttcactttgattccaaagagctacacaatccagtagatgactcaataattatttttaagaatgctcttcacaaagggatctttaaaaaaatcagtttattaatgtttaaaagttgataaagctatgtgcaaaatgatccacaaaagtcagaaacctattaaatactattctttttaaaaaaacaagacatctctcggtttaattgcactgaaaaccatactaaagagacagtaatatatttttattctttgtaatatttatacatatcttcaattactatctaatgaatagctggactgaaaagtttctggcgttccctaccagttaaagtaatgcttttaagggcacaagagggtggtattttcttaagaaatacacattcaatggtgttaacacgggttagaaaaatccaataaaatgacttctgctgaaacaaatacattcaaaaatcaagaaaagtacttttaacacaacaaaatacaaccatgttgttgcttgaaatgaatcacacaacattctgaaataaacatcaacaaaagtgccaaagacagatgtcatatttgttagactcatttgctaagaaatctcccttggtttgcaaaagttaatccattcggttttcactttgttttgcttgtctgtttctcctaggacaccaaggatcctggctaatatcatttagataaagtgggcttccttatgcagatttcggcttcaatggatatgaaatggtaacacatttcattgaaaagatgttttttaaagaaatcaaagtgacttcaaccaaattccaaaaaacggatcccgcttacatggaaactttggcctcagcgaaggacattgttttacacctccaaaccatcttcatcttcccacagcctacgtactcaacatagcctatttgctatagatgatcgatcattccacaaccccagctctgataactctcaggtagttaaagtataaagtaaaagaacgttgaggaggggtatgaagggaagggagggtggggtgtgggatgtacagggcatccctaaagaagcagaagtgcacacactcacttgggtttgaaactaaagtgaaggaaaacatctcctcaaagctccagacaaagagacgctttcacatggggacattagtctttgaggaggggccaaatgaaccctttaggagcttgacaatgctagacctttggctcagtgcaaaatcaaagctccaggggggtagaaaatatattccaggccgggacctgatctccacccttcccagtgcattgttcacaggaactaactctacccaccaacacccgacaccaccaggctgttcgtattctcccccttcctccctctggcttgcagcagctcctccctggcagcagtcgaagcccagagatttttttccaaacactggggtggccagcgaccaagtaaagagcgcttccggtgggtggacagcttccagttctaggaagaagagttgacgtttccagaagacataatggtctctgggttgtccccttcgtctttctgggggtgggaggaattgtccgatttgctgcggctgaattccatgccggcgatgatgggtcgcttgaatttgccagcagagtctccgctcgggcacttgcagcaggacatgatccggatgaaggcccgacgcatctccttgttggtcagagtgtaaatgatggggttggtgccggagttgagcacagctaacaccaggaagtactccgctctgaagaggatgtcacaggtcttcaccttgcagcccacatccagcaggagcaggatgaagagcggtgcccagcaggcgatgaagacgctcaggacgataattacggtcttgagcagcgccagcgacttctcagagctgcggctggccttggaaatgttcttgcggaacgtcaggcggcggctccgagtcctgaccaaggagtagattctgcagtacagaatgacgatggagagcagaagcagagtgaagaccgtggtgcagaagaggatatagtgcttgtggtagagcggcagcacggtggagcagctggacagcgcactgatgcagttccagcccatgataggcaggccacccaggatgagggagatgacccagcaggcgctgattagcaggaagaggcggaagttattgctcccgttgtggagtttcattttcagcattgtgatatagcgctcaatggcgatggcgaggagactgaacacggaggctgacagggccacaaacatactcccttcccgcagaaaccactgggcgggagtgagcttgtaggtggtggccccagacaagagcaggttagctgtgtaggctactcctgccaacaggtctgagagggccagattgccaataaaatagtacatgggtcggtggaatttcttggttttccaaatggtcagcaagacaaagatgttctccaggatgataaagcagcagatgagaatgaacaccaccgaggtcagtttaatgctgttctccttgtccgcgctgatattcagctttcccgtgtagttgtaatgccggacgatgatatcatagttgacgtagtcagagaccgagctgcggtgggccttgaccagcgggacgctggtgggccccatggtgccaaccctgtgtccccaggaagccggggtggcgctactccggacgaacgctagagggcgaggcgagagagccttcactggcttcaggggtggttcgatgagtgatccaggctttttgtgtagcttttccttggctggagagggcctcggaaaccgcagccttaaacaagtcagaggagagagtcagggaaagagccacagcatactggcataattcattctagctaaggcactgctccaattgtgttgttgttgatttgttttaaagaaacttggggagagctcagggagagagattttttttaaaaatcaaattatcttttttcttccttttttttcttttttcaaaaaaggaagagggggaagaaaaagagagggagaaactctatggccacattcactcaaagggaaatgggaattacgatgttggctgtgggttgacaaaaaaaaaaagatgatgaaaaggaaaacaaggagtgggaggaatgggaaacctagagaactacaccccattttaactccactcctgccctctcaccaccccacaccccctcacccccggatttccagccatgagattctctgaagcagtcaccagcttagctgcacgctcaataccagcccacgtctctcctcggaaaagactcaactgccagtctgagggcgaagacacacacctctgtcccccatgcccacccccagccccccagttcaaagatactagcaccacctcctaattgccatgtgccatgcaagaaatcagatttgcaggaaaatcatttgaaagcgtaagccatttgggggctctattaataactctctaggagcaggtgtgcttagggtccgagggcgcagtgaggtgtgggcagccaggcccgccccgccttgctgtaaacaggaaagcttagcgcctccgtgaagcgactgccttttctttcttcttcttattctccccgcctccccccgcgcccccccaccccaccccccaccccaagccagggcaagtaaatttaaaggtattcagttaaaaccattcataacagattgcagcaaatcccagaagtttcgtacattagttgattgcataaatattttttgctttgtttagtttagccaaaacatacacaaaagagagaaatcaaactactcatgacagccataatacatgctaccacatttctaatttcgattgcaaaactactcttcagaaactcacattaaactgctccctggtgcattgctaaatttgcgtgggcagttttatttactgcagtcccccaacacgttgactcctctcctaggactagaaagttacaaagaaactttctaagacggcactggtcagcagaagtctacttctaagttgcttaaatatttcaaggtaatgcagcaatgcaataaaatgaggtaatagagatgagaacaatcccagcaactccgcgaacagcagaggctgctcaagccaagaagctccgcattttcccccaactaatgttataccctgctcctgggcagtactaatttaagccattacccacgctccacaccacccaccatattctttgtctataggatttccaaaatttaacgccttccctcctattcctccgaccaactgcaattttcactgcccctacacccgtaggttccacagttgggaattaaccttttttctgaactccataaatcacaagtgcccaagaacaatctgatcgagatgggctccttagtagcccagagatgcaaattttcagcgcccggagatgcatgttttctaagtttttgtttgcctcgttcgacttaaaaattcgtttctgacacctaagccctaccacaaccgggctccccgcgcccgcgacccccgccattcgccgccccctacctcgctcaagcagggcgaagttgcgttcggagagcccgggatctgtacggctcgcttcgcatcttgctgctgcccccgactgactgcgtagtgctctcgcaaacttactcgagtcggggtcccctccctccgcagcggagcactccaatggccagtcccgctcgccgcggccagttccctgcctgctacgcgaagtcacccagcgccgcgccaaggctgggtggtttcttcaggaagaggctgggaggggttaatgccttaaccccccacgccctctgtcagctgggggcccccggatctgaactgctgagacgcactgtccaggaaagatctggggcagaagcaaaaaaaaaaaaaaaaaaaaaaaaaagaacccctcctccccaaacaacaaatgaaagaaaaaaagagagagagagaaggggcggagcccggtaacccctggattctactgtataaatcactgccctcgcccagatagacgctgatccctggctgtggagaggattctcccgagcccctgaaaaaaaaaaaaggtggagagactttgaaaacttttctctcgaaaagtctgaggaggcagaggacggcccggagtctcgtagcgcaccgccctggtcccacaccccccgcagccctaggaggatcggtgtgctgagcttgtggccaggagctccccgagccactttcgcgcgagcagcagaaaacctgagccgcggcccggcgagtgtcggcggcgctctggggaggagaggctgggaaggggctgcgagaggtacggaggagacaagcagcccgggagggagaatgaaccggraggttcctgtactccccccgccaccccagatcctcgtgctactcgcaactgcggtctgaggggcagtggctttcccagagtgcacagagaaatgaaccmgcgccggttttggtgttgggcgaggggtttccctcagctgagcacaaagtcaggctgtgtgtcccagattctggccaatggagaggtcgttgagggggtgggctgctgctgagtcctgagagattcaaaacgcctgggcagctcaggaatttccaaagggggagattctcggccaggagctgcggagcaactgcagctgcccagcaggagccggcacccttctctcacattctgcttgggagtcgactcagaggcctcraatctcattactagcactttgcccacccttttcttttgcttagatgctrcttaagaacgtgaggctgagaggcggacttggtcagatctgcctgcgtgacaagctcaggacaggacgcttctgcccttgcattactgttgtaaaagtttccacccagtccctggtcgcactgcgttcccatcccggcagatgtgaactcaaaaacttcctccgctgtgcagtttcaattggcagacacaccctgtacctgaatgactcagaaggaggcagaatgaacaaacaacagacccctgacttctgggattttgtgagtttgccaaaaaaaaaaaaaaaagaagtgacagttaattcacagctgttttaaagcattcatcgacagcgacgcacccaatacatacccacagcttcaacaacagtacagtgcatataatgtggaaaccaagataacggtcctctaagactccagagtagatcctaattggatttgaagacttatttcacttaaaggggaagaggtatattgtgtctacccagcamaacaaaacgggggacttggcattcccccccttctcccgcctccacmcacactaatttatgcattctttaaagccaaaggaatcaaagtgaaatttcacacctagtctgtatcaagcatgtgctaggttaatttaaccttactgctctgtgaagtaagtaagcattgctggccattttattgttgagagaagtgtcattcagacaactaaggtgacttgtagatttcccagctagtgagtggcagagctgggttccaaaacctaaatattgcaaatgccttgccttgtggctcaaacgctatcagtcaataaatagttaaggaattgaaatatatgttcctagagggaaacagacttctagatttaaagttttacatttgctgcatttctgactgtacaagtctacaaaatgcatataaaagtatgctaatgaatgtccttttaaaaccactcattttctacgtaagcatacaaagtgtatacatatgcatattaatgaatgttttctgaaacttctcattgtctgcctatgatatctcatgtaacattgtacttttagtatttgcacatagtgttacacatattaatccatttaatctgacaagttaggcactataattattctaattttacaaacaaggaaattgactcccagacatattaagcagcttgcttaatgtgggacaggctgcagactcttaaccactactccagaccaccatgataaacctcaaacaggttcaagaatttccttggggatatcagttgttttcttgtgaataccactggtttttaacattcaatattgataaagtgttttacagagtccaaaaacctttcagattgttatttaataatattcatctttagtacacacctatgagatgtaattgtagatgatcaacttaggtaaaattagatagtaggcaaatgtttccagcaatggcgtcctggccaattccaagtctctagttcccatataagtctcttcccattgctctccaaggaggccctaaaaattgcattctcaagctatctcctgactgccagtacaactccctgtctgctgctgcctagaagtcaagcccaacattcctaccttaagtttgctccatttccaatttttgatttcaaagtggctttgttgttctttacacatgctttagtgtttctctttaaaagtttacagataaaataccacacaatctttggagcatacactaaacaaaaatttgtcataaatgtgccattcaaatgtaactgtgtgagctatcttttttttttttttttttttttgagacagaatctcactctattgcccaggctggagtccagtggcgtgatctcagctcaccgcaacctccgcctcccaggttcaagcaattctcctacctcagcctcctgaatagctgggattacaggcatgcaccaccacacccagctagttttgtatttttagtagagatggggtttcaccatgttgtccaggctggtctcgaactcctgacttcaggcgatccacctgccttggcctcccaaggtgctgggattacaagcatgagccaccgagcccagccatgagctatattttttatctgctaaatattgcaactctactcttttccctttcctttttttttttctttttttcaactgagacagggtctggctctgctctgtcatccaggctggagtgcagtggcgaaatcatagctcactgcagccttgatctcccgccctcaaaggatccgcctacttcagcctcccaagcagctgggactacaggcaccagtcaccatgtcctgataattattatttttattttttgtatagacaggagtctcactttgttgcccagggtgatcttgaactcctgcgctcaagcagtcctcccaccttggactctcaaagtgctgggattacaagcctgagccttactctctttcctaattgctccagtcactttccaactcccttttctcccctcttccctcccctgacccagtcactggtaaaaatccaggctttcccttacttgtctattcacaggagaataactagcctcttatttcaaggaggaaatagtatgaccatctcaatttccctcctctccaagctccagcttaatagcaactttacccacccttacctccttcccacctgtttcagaaataaaagcaactttactcctttccaaggcaaactcttgcccaggtcagcatgctgcttcctccaaactttctgagacttggctcaattattcttattctcccttgtactttcagttcttagcttctgaggactctttactttcaacttacataaatgtttatgtgttttctctaccaaaaactctttcttcccttcatcctaggtcccaatatctctctctcctcgtttgccaacattcaaaattagtggaacatgactgagccttggaacagacacttaggttcagccttgatattgccagttctaagctatgtgactttaggcaagttcttttaacttccttgaacctcagtgtcctcatctgtaaaatgaaataatgatatttgcctctttcattgtgaggattaaggagctacatacctgtgagaattccctacactacagagaaaatgcttcacccatccaccacctccatcttttattattattattattattattattattattttactttaagttctggggcacatgtgcagaatgtgcaggtttgttacataggtatacacgtgccatggtggtttgctgcacccgtcaatccgtcacctacattaggtatttctcctaatgctatctctcccctagccccccacccccaacaggctccagtgtgtgatgttcccctccctgtgtccatgtgttctcattgttcaatacccacttatgagtgagaacatgcagtgtttggttttctgttgttgtgttagtttgctgagaatgatgatttccagcttcatccatgtccctgcaaaggacatgaactcatcctttattatgcctgcatagtattccatggtgtatatgtgccacagtttccttttccagtccatcattggtggacatttgggttggttccaagtctttgctattgtgaatagtgccacaataaacatatgtgtgcatgtgtctttatagtagaatgatttataatcctttgggtatatacccagtaagggaattgctgggtcaaatggtatttctagttctagatccttgaggaatcgccacactgtcttccacaatgttgaactaatttatactcccaccaacagtgtaaaagcgttcctatttctccacatcctcttcagcatctgttgtttcctgactttttaatgatcaccattctaactggcatgagatggtatctcattgcggttttgatttgcatttctctaatgaccagtgattatgaggttttttcatatgtttgttggctgcatgaatgttgtcttttgagaagtgtctgttcatatcctttgcccactttttgatagggttgtttggttttttcttgtaaatttgtttaagttctttatagattctggatattaaccctttgtcagatgcatagattgcaaaatttttctccccttatataggttgcctgttcactctgatgatagtttcttttgctatgcagaagctctttagtttaattagatcccatttgtcaattttggcttttgttgccattgcttttggtgttttagacatgaagcatttgcccatgactatgtcctgaatggtattgcctaggttttcttctaggatttttcttgttttaggtcttacgtttaggtctttaatccatcttgagttaatttttgtataaggtgtaaggaaggggtccagtttcagtgttctgcatatggctagccagttttcccagcaccatttattaaatagggaatcctttctccctttcttgtttttatcaggtttgtcaaagatcagatggctgtagatgtgtggtgttatttctgaggcctctgttctgttgcgttggtctatatatctgttttggtaccagtactatactgttttggttactgtagccttgtagtatagtttgaagtcaggtagcatgatgcctccagctttgttctttttgcttaggattgtcttggctatgtgggctcttttttgattccatatgaaatttaaagtagtttttcgcaattctgtgaagaaagtcaatgatagcttgatggggatagcattgaatctacaaattactttgggcagtatggctattttcatgatattgattcttcctatccatgagcatggaatgcttttccatttgtttgtgtcttcttttatttccttgagcagtggtttgtagttctccttgaagaggtccttcacatcccttgtaagctgtattcctatatattttattctctttgtagcaattgtgaatgggagttcactcatgatttgtctctctgtctgttattggtgtataggaatgcttgtgatttttgcacattgattttgtatcctgagactttgctgaagttgcttatcagcttaaggagattttgggctgagatggtgggattttctaaatatacaatcatgttatctgcaaacagagacaatttgatttcctcttttcctgtttgaataccctttatttctttctcttgcctgactgccctggccagaacttctaatactatgttgaataggagtggtgagagagggcatccttgtcttgtgctggttttcaaagggaatgcttccagcttttgcccatttagtatgatattggctgtgggtttgtcacaaatatctcttattagtttgagatacattccatcaaaacctagtttattgagagttttcagcatgaagaggtgttgaattttgttgaaggccttctctgcatcaattgagataatcatgtggtttttgtcattggttctgtctatgtgatggattacgtttatctatttgcatatgctgaaccagccttgcatcccaggtatgaagctgacttgaccgcaccacatttgtctttaactgtctttaagtgcaatcattgctttcaccatcccactttccatttttttattcactttgctttttaattttccaataaaattttaaagtcaaaataatatgtgcatatcattttaaagagatcaaatggtacaaaacttgaaaagaagagcattagtcctccgaggttccctggttcaccaatttttccagtcactgtgaagtcttgttgattttcttctggtagccatttgcaaatcttgaaatcccatgttttatacctccatttcttcattatcaatcttataacaatatctataggttttctgccatgttgaaggagtattaattaacttgaagaaggatgcttatattataaactttctgaattcttgcatgtctgacattttaaatattctattatttacttgaataatattttgactaggtatcaagttaaaagttgtaagtcatttcccctgagaattttgaaagcattactcttttgtcttttaatttctagggctactgataaagagcataaagctattctgatttcaaaacttcacagctgactattttttgtctctggatgtttttagaaacttctctgtctcttcagtattccagagtgacatgatgatataccttgattttctaagtcctttgcagttctgaaaattatctgaaattatttctttaatgacttcatcttctctccagtttttctattttccctttttgcaaatcccactattcagattgtggaccatctatctagcctgatttttaaatttcctcctattttattttcctttttgtactttcaatccttcagttaatagctctcttttcactctcatactttaatttccaagggctctctttttcttttctgaatgttacatttttacagaactctgttcttatgttagggataccacatctttacttatctctgaggatatcagagtgttgttgttgtttttgttgttgacattttctcctattttctttgttgtcacactttcctatttgttttgctctcagttctttgtgccattggctttcccaattgtcagatgatctctggccgtccatttatatttcaaacagaggctaaaatagaggcaaatcagaaagctaatttaaaactttgtgtgggggcttgtcaatggaggggtggtaaatgatcaggataaacactttcgttgagtatgccaaatgtcaatatctggagttctcaagttttgggcaggtcagttttgccagacagaaattctaaaatctcttgtctgacttctagcattttccggagtgaaccaagaaagaaaagtgggagagtgaaggagggaacacctcaccatttgatatttagatttgaactgaatcaccatgatgggaaccccctctacacactcagctccatcaggtgtctctgactccagtgaccctctgatttaacccattcagagaagaaacctccagtctt

SEQ ID NO: 12305 - DNA, 68305 bp, Homo sapiens
gtagaggcaggatctccctatgttgctcaggcaggtcccaaactcttggcttgaagtgatcctcccattttggcctcccaaagtgctggaatcccaggcgtgagccaccacacccggctgaaaggtggctttggcgctgctaacatcaaggtccctgtgagacatccgagcagagatgccaagttggcagttggagactagagtctagacttcacgggagaggtccaggctggggatgtaaactcagaagttgtcagtttattagtgtttagagccatgagtctggatgagatgggagagagagaagaggcccaagcctgagctttgggcacttgattaattcaaagccacaagatgaggaagaaccacctgaaaagactaagaagttgtggacagtgaggtaggaagagaactaagagaagaaagtgctgaatgacaagcagcatcatggtagctggccatgggaaatggcccgccaaaaactgcacactgcggttcacactcttgctcggccccagccactttcctctgggctgtcaccatagaactaacaaaaagcagcagaagtggcagcctgccttctgaggccaggtcacaggaaatcttgcagcttctaccttagtgtttttgaatgctgctctgggataagccagttgccatcaaagaagtttgactactctgagccaccacgatgtgaggaagcccaagctaagcatgtgggaagcccaggatggagggaaaagatggccaaccagggccatggttgttccagccatctcagctgaggcaccagccacaggagtgaagaatttgttttagacatccagtccaatcaaaccttgccatgactttggctacagctgcaccagcatgagaaaccctgagggagaaacccacaggactaggagagacagtgacacactgtcattttaaggctctatattctgggatggctcattctacagtggataatggagacaggagttcattgcaaagggagactgaccagtcccctgcccgcaacagagcacagccctcttcacccagacccatggagaggtggctgagcagacctcagctgggcagccctccacactctgaaggctccccctttcctgccttagtggcaagaataataattttctctttgtgcccagagagctggcaactgccaagtgccctgctgtccccagggcccttacaaaaggactgcaggggaggtttttctgagaactgggtcaccggttacttagatgcttcaaacctggcagaacagagaaacatcagataaaggagactgggaacttcataggaagctgctggtccttgtcatggggacacaccatgacaagccaccagagagtggctgcctgccctctctggacccttatgtcatagggacctcctctcttctagagagctctctctttctttgtaaatgtttgtaaatctttctttgtaaacattttggaaagtatgcattaatcaggccagacacgatggctcacgcatttaatcccagcactttgggaggccgaggcgggcagatcactcgaggtcaggagttcaagaccagcttggccaacatggtgaaaccctatctctactaaaaatagaaaaattagctgggcatggtggtgggcatctgtaatcccagctactcgggagggtgaggcaggagaatcacttgaacccaggagaaagaggttgcagtgagctgagatcacatctgtaatcccagcactttgggagtctgaggtgggcagatcacttgaggccaggagttcgagaccagcctggcaaacatggtgaaaccctatctctacaaaaaatacaaaaattagctggatgtggtggcacatggctgtagtcccagctactggagaagctgaagtgggaggatcacctgagcctgggaggtccaggctgcagtgagccgtgattgtgccactacactccagcctgagtgacagagtgagaccttgtcttgaacaaaacaaaacaaaacaaaacaaaacaaaacagaaaaaaacctgtccttttctcccactgcctgttcagttccccagaggcaattgcttaacatttctttcacatttattggaataggtaacacaaggcgtgtgctaaaaatttcaaaaggtacaaaaaaggtaaagagattaagtctccctccttccttctccccacccagctcctctccctaaagacaaccacttctaccagtgtattacatctccttccagagatatgctatgcatatgtcagcatataatataaacagccttaaaaaataaaacagggctgggaatggtggttcatgcctgtaatcccagcactttgggaggccacggtgggtgcatcacctgaggtcaggagttcaagaccagcctgaccaacatggtgaaacgcttgtctctactaaaaatacaaaattagctgggcgtggtggctcatgcctgtaatcccacctacttgggaggctgaggcaggagaattgcttgaacttgggaggcggaggttgcagtgagctgaggttgtgccattgcactctagcctgggcaacaagaggaaaacaccgtctcaaaaacaaccaccaccaccaacccagaaagggtaacttgctacaaatgctgttctgcaccttgcttttccacttaaccatatattttgaaggtcttccatatcagtaggtaaataactgctttattattttaggggactgcacaatattccactgtagggatggaccgtaattcatgtaaccagcccctactgagggacactgaggttgatgccaaccttttgatattacagtgaaacagcaaataatcttgtactcatgttttcttgcacatgtatgcctctctcagtaaagattcctgaatcaaaagacgtgtgcttttgtcattttttaaaatttttatttattcatttatttttgagacagggtctcgctctgtcacccaggctggattgcagtggcacgatcatggctcactgtagcttgacttcccgggctgaagtgatcctcctgtctcagcctcctgagtagctgggaccacaggtgtgtgcccccatgcctggctaatatttaaattttatttttagtagagacagggtcttcctatgttgcccaggctggtctcaaacgtctgggctcaagcaatcctcccgcctcagcctcccaaaatactggaatcccagtattataggctgtgcttttgtacttttaataggtattgacaaaatgagactgtattgatgttcttgtttgcagacttcatacttaagtgcccctttccctacaccttccccaattctattcaaataaaaatcaacatctttaatctgtgctgtagaattggtaagaaatgtatctctgcacttttacatttgaaatatattgttagaaggttgagcatcttcatatgcttaattgtcatggcaaccacttctagcctgtgtagcgatttcttctagttgtttatttccatagagctaaataatgtttgaatgtagccattcattgatttatcagctttaggtgttatctattgatttttgctccaatacatgaggatttagctcacttacagtgtcatccttgcacctcctctatctttctacccttccttccttctctcttttttatttttattttttttttgagacggagtcttgcttgttgcccagggtagagtgcagtggcacaatcttggttcactgcaacctctgcctcccaggttcaagtgattctcctaccacagcctcccaagtagttgggattacaggcgcccactgccaagcccagctaatttttgtatttttagtaaagatggggtttcaccacattggtcaggctggtcttgaactcctgacctcaggtgatgcacccacctcgtcctcccaaagtgctgggattacaggcgtgagccaccgtgcctggtctcttctctttatgaaaaatattgctggttttccatttatagtagtgatatatttttttcctttccttttcttattaaaatagactattttttagagaagtttttggttcacggcaaaattgaacagaaagtacagagttctcatatattccctgctcctcccacccctcagtttttcccactaccaaggtcctacaccagtggtacatttgttacaatcgatgaacctgcactgatacatccttatcatccaaagcccatagtttgccttagggttcactcttggtgctgcacattctatgggtttggacaaatgtacaatgacatgtatccaccattatagtatcatgcagaatagtttaactgccctaaaaatcctctgtgctccacctattcatccctccctccagcctaaccccaggaaaccactgataattttactgtcttcatggttttgctttttccacaatgtcatgtagttggaatcatacagtatgtagtctttttcagattgtcttctttcagttaataaaatgcacttaagtttcttccacgtctttttgtggcttgatagcttatttctttttagtgctgaataatattccattgcctggatttaccacagtatatttatccattcacctcctgaaggaaatcatggttgctcccaagtttggggaatcattaataaaacttctaggaacatctgtgtgcaggtctttgtgtggacataaattttcagctcatttgggtaaataccaaggagcatgaatattggatcatatggtaagtgtacatttcattttgtaagaaactgccaaactgtctcccacaatggctataccattttgttttcctaccagaaatgaaaaagagttcccgttgctccacgtcctcaccagcgtttaggattttaatcctttgaataggcatgtagtgttatctcattagtattttcatttgcaatctcctaacgacaggtgatgttgagcatcatttcatatgtttatttgccatctgtatatcttctttggttgaggtatctgcttagttcttttgcctatttttttttttttttttttgagacggcgttttgctcttgttgcccaggctggagcgcaatggtgcaatcttggctcactgctacctccccctcctgggttcaagggattctcctgcctcagcctcctgagtagctgggattacaggtacccgccaccacacttggctaattttttgtatttttagtagagatggggtttcaccatgttggtcaggctggtctcgaactcctgacctcaggtgatccacccgcctcggcctcccaaagtgctgggattttacagacctgagccatggtgcctggcctcttttgccaattttttaatgaggtcttttgtcttcttgttattgagttctaaaagttctttatatattttggacagcagttctttatcaggtgtgtcttttgcaaataatttttcccattctgtgggtttggtgggtttgtcttctcattctcttgagtgatgtggcatttaaaaaaataaaattactttaagtttaaaaagcaagtccatttaaagagaaacacccaggaaataatagccaaggtggtagaatatggtgaaaaaatgaaagggcacccaagagcctcaggtttgggcaatactgatgacacatagagcctggttccctggcaattattatggcggttactactattttaataatattagcagttacggttggtatttttgctattacaattaatggcataggggctgtatcgcccctgtcttcctggaacctggaggcaatgaggagctctgcaaagttgttgagattattatgaccatatctgggtatttcaccactacaaagagctgcgcaaagtttggacggtaggaatcggggtggacatcagctcggtgacaggtaggaggtgggtccgaggaggggtcgggtctgggagcctccgcccccaactcaaggcaggctacacaagatctgtctccgttggcgtcccggtacctagcttgagcccgaccatgggcatgcgtggcgtggcgcgaatcctgtccctgtcgctcgtcctggccgcggtggccacgggggcctgggagcgggggccgctgggcgtgctcttgccctggcagggctccgccgcgctgggccgctgctgtcctggccgtgacccgatgtttgtcgcccgcgggcccccgcgctgcttctgcgaccaagcgtgcggcgcggcgcggcgcgggactgctgcgcagactatacgcgggtctgcccaggtgcacccggggaaaggcaaggcactagcggaacgctcggagcggaggggagctggggcgggggatgagcggaggaagggagcccagcacctagggggctctgggcttggaggggtcacacgagccgagggcggggcgcggcgcttggggactggaagggtgcgccgcggggcagacgggacgtgcagggggtcgcgcgggcaaggagggacgcagacactcaggacctaaaggggaagcactggctgtggagctgcgagccgagaaagacgcgcaggttatgaacctgggtgcgttcatctcgggggacctgaaggagagggactcgtggagagttgaggggtgtttcggaggaggggcgcaaggactgctcacaggacttgaagggcggcaggaaggtggaggattcggcccaggtgcgggacgcaggcggtggaagggaaatgagcacaagaggcgcaggcaggaaggagagcgcctggtgcgagagaggaaggagcgcacccrgtaagcggtgtcgggggggtcgtgaagcttggagggcytcgaggggagggaggcgcttgggttgaggtagggcgccagatttcgcaaatcaaaatacagcacacccagttaaactcgaatttcagataaacaaatctttctagagaaaaatatgtcctaaatatcgcatgggatatacttatactaaaaaattatttgttgtttttctgaaattgaaatctaactcggagtcctgtattttatctgagagccccagctggggacgggcgcggggccaagagagctgcgagggaggaggggttgcaagcttctttcgggcggaggggtcacaaggcgaatggagaaggtgacaaggagcatggagaaaccaagaaaagggctaacgcttggagagcaaggatggaaagacgctcaaagcggaggcggaacggtctgagtgattccaaaactagtgtgtccaagctggttagaactcaggcaggcgggtccagaagccgaggggcctgacagatacgcaggtgaagtccatctgtggtccgcgtgctgggcgtggccaccgggctagtccaagcattcctggtaaaggctcctccagagtggtacccacagcgctctattaagggctattttagttgagtcattagtgggaaggacgctgcctatcccctccccccccgccaccccactcccttcttctagagatggagccttgctctgtcgcccaggctggagtgccgtggtgcgatcatcattcactgcagcctcgaactcctgggctcaagcgattcttctgcctcagcctcccaagtagctggatgacaggcacgcaccaccatgtctggctctctatcctttttaaatcccagaagtaaagttttcacacccactggagacaaaaaaaaatctaaattctgtcaccctgtaaaacggttatgacccaactttcctatgtcagggaggaaagtgattgattgggcccctctaccgtgtgatatcactagagcttccttcagaaatttgttttaaaagacagagagggcgcttttaaaaaaatgcataatgggtcgggcacagtggctcatgcttgtaatcccaacacttggggaggctgtgggaggatcatttgaggccaggagttcgagaccagcctgggcaatattggaagacccagtctctacaaaaaattaaaaaaaaattagcctcaaatggtgatgactgcctgtagcaccagctactcaggagactgaggtgggagaatcacttgagcccaggaggttgagcctgcagtgagctatgattatgccactgcactccagcctgggtgacagagcgagatcatgtctcaaaaataaataaataaataaataaataaataaaaatgtaagggacctaacatccattaatcacctatccctctgtgcccagaagctgggctggatgtcccctggaacctgaatacattctccctgccctctggggttcaggtatggaataacatccctgtttagcagtcaagaaaagcaaggctcagagaggagagggctttgggcagtcaagaattcccagccagtggaggagctgggtctgattctgagtcttctagctccttgctgccaggagtggccaacgttggaaattcaggcagcagtgagatgagaaagtaattttggatgtggtgtcttctcaagccataggcaaaagagaactccttccagattaaatttggggaaggactgcctgggggtgcttttgtactggttggttttctgtgtagagagttcatgcagccgcgggtctgtacwgattggagctgaagtcccaggttagcaccaccaacaggggctcccctgccacagcgcaggagtgggggcccaggatgggtccaggcaaaggcatcagtgatactttctcatggtctgaccgacacccacagaatcacacaatgttagcccctcccaagagatgtcctttctatacggagtgggggctggaggaaccaggagcctcaaagctttgctttcacctttgttttgctcttttgggatctgcctccttatctggagcagggtcttgtgaagagacgcagggaaaagttcactttccacctcccaggggagcaggcaggaggggactagttaggaggcaaaagatgtagagaagtatttgcttttttcatgggctatttttaggagataaagtcaactgccttaagtgatcaattgtaatagagggagatgttgaagatgacttaaaaaacaaacaaaatccgcaaacaacaaatctaatatttatgaaataccaaatgtcaggaaggtactattttaagtgcttgaagtaaattgtctcatttaagcctcataataacgctrtggaacagtgttatcatgtctgttttacagatgaggaactaaggcacagagaggttaagtgacgtgttctgggttgcacagctcttaaacagcagatctgggatttgcactccagcagtctgactccagatctcaatattgtatagcagctcaagggtggcagagactcaagaatgttaggagagggaagcttgagtctacaggtgtaaggagaccccttgacatcttccccatttagttcaattaaaattttctttttttttctttttctttctttccttccttctctcttttcttttctttttctctctctctttcttccttcctttctttttatttttcagggtttcactgtgtcacccaggctggagtgcagtggtgcaatcatggctcactgcaacctctgcctcccaggctcaagtgatcctcctacctcagtctcctgagtagctgggactacaggtgtgggccaccacacccagcttttttttttttttttgtattttttgtagagatggagttttaccatcttttccaggctggtctcaaactcctgggctcaagctatcctccagccttggcctcccaaagtgctggaattaccagtgtgagcytccacacccagcctcaattacaattggtggccaccttctgtgtgcccaattcagctagaagcactgggggatggaagcaaggctggagttctggtacccctcaagcttattgtctatttttgggagacaaggtagttgggaaaggaataaataatttcagtctgagcaaggtgaagcttggaaatgattggtgaggatggtgtggargcagggagagagtggggctggagtgattagtaaggccttgaaagatagacaccactgtattttccaagttatttacagaatgtttccatgtattctatacttcttaaakatcatctcaaccctgtatggttgatgtccctacatatacacttatgtgtttcctgtagacttagtactcttagggttgtgacacaatttaacttaagttaacaaggatatttattggcttaggtaactaaagaacaacccagggattccagagcttcaggcatgactggatccaggggctccaaggatgtcatcaggactctatctctttccattcttcggcttttcttgtgttaacttcatttacaggcatgctgtcaccaagtggtagcaaagctagtggtcaaagacagtagctgtaaactgccatccttaatggattgagagcatttttccccagttccagccaaaatcccagggctggttctcatgggctcagtttggattaaatggtcattgctgacccaatcaatcactgaacccagggagaaggaatatatcaactggccatgtgggggtcacctgcctcataccaggaacgagagggtgcgatcagccctgtccaaaccatgtggattgagagtggggagttttggtttctcagaagaaaactgaggtggtattcccagaagatgggggaaaggaggctgggagggtactactcagctgtgggagaccacgtgctttgggaaactttgggtaaagtgtgctgagatgttgaataggaggagggcacggtaaatgactgtggatgagttgcaggaaaatgtagatttttagccactgagcttgggggtctccatctatgatccactgtcaaaaaagatccttcgtgaaccccctcaataggagatgggaaccactgagggatttcagggaacaggccagaactgtattctagaaaatccttttggtagacaataaggagggcagatggtaaggaggctgggcagtgtggttcagaggagaaagcggggtttggataatgcagaaagacattccttggctgggcccygtggctcatgccagcattttgagaggctgaggtgggtggatcacaaggtcaggagtttgagaccagcctggccaacatagtgaaaccctgtctctactaaaaatacaaaaattagctgggtgtggtggcacgtgcctatagtcccagctactccggaggctgaggcaggaggatcgtttgaacctgggaggcggaggttgcagggagccgagatggtgccactgcactccagcctgggygacagagagagactccatcttaaaaaaaaaaaaaaaaaaaaaaaggtgttccttcatgagcctgggcctgtaagggtggggtgaagcgattctaaggggtctgtgggaaatgtggtctggccatggcaggctcagctggcacgatgtcatctgggtatccaggactcagtgagcagccttaccaccgccctacccctttctgtaaggctgggaagctagaatttcttctttggtcaggaaaagtgggctgggctttgctttgagaaacactgctatctggtgttgcctttttgcaatgtcagcctgtggttatatttcctttgttgttgctaaggcaagatttgctcactcaktgttcagtggcacatcacttcctgagttgctgtgtgccaggccctgtgcttggtgatgggatacagcagggaacatgacaaatgaggaccctattgttgtggagctgacactctaatggaggaggcagacactacgagaataaccacagatgtactgagtttgtgatcctgggcctatgcgaggggtgatgatggttccctcttgtgtgcgtgctgccagtgagacgggtagaacacgtgcagggtggtgcctgcctaattttcygcaaaatctctcacctgcctggcaggcagggcaggagatcgtggtggactttggggataccccttggtccagctgtccagccagtgcctgaatctggtctgcagtcttcctgccaggttttttagccacattgtgaacactttcagtgacacaaaactcattcttctagcagcttcttctactgtagataatcctttctctcctgggaaaccgcaggagccatcatgcttctgccctcacccccacccagagagatgggcagtcatccttttgaaacctttggtatcaccacgtcacatctctgctcagaactcggcaatggcttttcgtcatgcctagaataaaatctgaactccttacaacagtcctcaaggccctatatgctatctttgtcccctccctctctgatgtcacctcctaccacttttcctctggcttattttcctgcagcgacactggcctcctcactgtccctctgatatcctacctttaccctgcctcagcgactttgcactgcctgttttgtgcctggaatacagttcccttcctacacagttcccttcatcactttcttgggggctctgttcagatgtccttgtcttggaggacttccttgactcctgcctaaaatagtttcttgttacaccacccttggcactctttctttttttccctgcctctcyctcaaccctggccactcttgacctgctgttttttctcaaagcacagatcactagttgaaattacatggttgcatgttattgtttattgtctgtttcccccactgaatgtcagctccttgagggcagggctgtacctgttttggtcatctgtgttcccagcacccagcccagtgctctgcacacagtaggtcctaaattgttgttgaacgaatgcataaagaccattgaactgggcatttacagtatggccagtgctttgcattcgccattgcaacaaacccgagactgtggttcaaatccaggtttgtctgactctacatccttggctcaacttagggattctgcctcttaagccccagtggcctcatctctgagctgggtttgacaatagtgcaaacacattaggagttggggacctggcaagtgacagatggtacccccagaagggtataatagaaaacaagggctctattcacagaggtgggggcagcagtacaggacaggaggaaatggtgttattggagcctgtgagagtaggatcygcagccaagggcccccttccccaaaatgggggacaataaacaccttgggtgcactctcctcctgccctctgctcctctcatccccgctggtgttccccactggttcaactctactggcagccagggagaggctgggagatgcacaggcttgctgggggttgagtatggagagggagtacagagtttcaggagactgttgtgaggattaaatgaagtcatgtatgggacttgcttggtttagcatccaaagcacaatgaacggggttattagatggatgatgaaagcacttgatcagtcttaggttgccacactgggtgtctcccctccctcctccttcttgccctccctctttctgtttcctttcttctcttgtttaccttcctttctttctttttccttccttccctctgagcttttcaactctgctaagatgggcagattgaaggattgtttgctccaagaaaaaaattttaaacctctgagatttatgcaaagaatatgtgacttcctgaccttccagaggcactgctgcttgtctttggcacaataacgccattccttcatcaaggatgcacatgattttttccctcttcacattttcacgttgctgaattaggacatgtctcatagctgggagggcttttcctgaagacagacctcatctttcttgttaaacgctgtgtctccagcacccaagacagttctgggctcgctgcagatgcttggtaaatatttggggtatgagtgaattaattctgacagtggtggccgccttgcatgtgcagcaaatgtgtgtgtgtgccgctgacaaaacttgctggcacatccgtagaaagtctctcgctggggaagtgcccagattccgtttctgctagactgcctttccctgtctgatttgctctggtcctgatctgggagtgtggacttggaatgaagaagtgtcggtcccagcggggacatcattagaaataccacctgtggtagacatgtgaagcacctcaaggatgggggaacccagcacgttccttwtgtgatgatgaaatatttccgacatacaccaccaatgtagagagataatacaacaaaccctcgggaaaagctaagaaacaaaccttgacaattgccactgcagtgtctgtttccctcctgtagtcacctgctgtcccactctccccagagattgtcacaatgctgaatttgacatttaaaattcccatgcatatatgggggtatgtgtgtgtttatgtacataaacatacactgtacattcttttttttttttttgaaacagaatctcgatccgtcgcccaggctggaatgcagtggcacagtcttggctcactgcaacctctacctcccaggctcaagtgatccttctgcctcactttccctagtagctgggactacaggcgtgcaccaccatacctggctagtctttgtatttttcttttttggtagagatgggatttcaccatgttgcccaggctggtctgaaactcctgggctcaagcgatcctcctgccttggcctcccaaagtgctgggattacaggtgtgagtaatagcgcctggctacaggactttcttgtgattcacagtagttatgttctgtaaagttgccacaaagactgaattaaccaatactgaattaaccaatggcccctaggggaaatatgtacacacatatctcacttagtttatactttagatcctaaaaacaactcatcctggtcaattccattttcttcattttaccaaagagtgttaggaagtgttaagagactcgcccgaggctgcctccctaacagttgctggagttgggattcaaaccccatccaactggcccagggctggagcttcttgcactacatagacctgtccctactgtctctgtcctctggtaacatctgtatgaagctggaacaagaagacagagtggggccctgtttaacttcagcttggaacctgcacattgagttactcaaatttttcactaatcttcgcttgtctgtgagtaactataaatgtgctgcaagtattgattttagggttaaaaataatttcagcaaataagcaaagtagcaaatacagaatctgtaaatcatgaggactggctgcatatatatgtatttactatgcctgtatgaatgcctaaatactttatagtaccgttttgcagttttaaaaaactatataggccaggcgcagtggctcacgcctgtaatcccagcactttgggaggccgaggtgggcagatcacttgaggtgaggagtttgagatcagtctggctagcatggagaaacgctttctctgctaaaaatacaaaaaattagccaggcatggtggtgggtgcctgtaatcccagctyctcaggaggctgaggcaggagaatcgcttgaacctgggaggcagaggtagcagtgagccgagatcacaccactgcacttcagcctgggcaacagagctagacaccgtctcaaacaaacaaacaaacaaacaaacaaacaagactgtatataaaaagcatcacattagacatgtgaatccttttgcaagtaatttatttccccttcaggttactgacagtgtagctgtggctcattttcactgatgtagaggaatagttagtgcttattaaacacctgctatgtgctgggagcaaatgctttatatttcatatttggttgaacccttaaggccaccctatcagttagatactattcttattcccatttgacaaaagaagaaattgaagcatcagttgccctaagtgcttaggaaatgtttattgaaggaatgagtgatggagacgacctaagtgatcatcaataagatgattggataaaggtggaattctaagtttaggtgaacatatgaagagttgtcatagggaaactttcaaggaaggcatagactgaggtttgcaagagttctagcacttggtgtggtgttttgggggttcagattgtggggaaggtggagaagacctggatgctggctagctaaaccccacagaggtctcccttgcagacaccaccttctcttccagcagtctcctgcactgtggcacagtggagtggctgcagtcgctgtgtgaaacctgccaggtctcctaccatgtacaccggaggcgtgtcctgcaggagccgaggaatgggggtgtccccttcccgctgctggaagagcgggctggctgtgtggagtactggagccaccagggagtggagtgccagcagtcattgcatgagtggggatgggccccaggggtggctctcagtgggaacagtcaggctggactgcagggccctccatgagttcttgggtagggtctgagtttggaatggggctttgccttcctttgccctgatcccccttctcatcttgtgaatgagttcagaagctctgaactccactgggcttctcagtcttctttctgctcctctccctgtgtgaatcagtcaggactttgtatgcaggtgataggagacccaacttaacctgaactgagcaaaactgtgtggctcctgtaactaaaattccaggggctgcattcaggcatggctggatccaggagctcaagcaatgttgccaggaatctctctccatgtctcagctctgttttcctctcagttggcctcattctcaggcaggcttttccctgtaatggtctttgacagcttcaggcttccctctaaccagcctaacagctgaagagaaggcctctttccccatagttccagcaaatatcctaggatatttgtggtggtgmgcacacccgaagtcccagctgctcgggaagctgacgcaggaggatcacttgagcccagaagtttgaggttgtagtgaactgattgcactacaagaccctgtctctagagatcaatcaatcagtcaatcaatcaaaaggtcgttctgactgttatgtggacagcagactgagaggggtcagagggaatcagggagcctagggaagaggtggctgcaatggttcaggcaagagactatggtggttgaaccagggaggtggcagtggggtgatgaaaagtgggagtgttgcttcctctgcttgaaatccttctccctacccccagccactcccatccagccattcctgggtcatcacttcctgtaaagatgtcagtttccctgaggaagatcgggaagatcatcctgacttgctaatatgtgccaagtgcctcaccacatgacctgactctgtgaggtcagtgttactattctcttcttacagacagggaaaccgaggctcaaggaggtgacaaagcttgtccaagtcacatggctattgactagaggaccaggaccctcccattctgacctttgatatcacccacctacaatcttttcgttgtactgttttttgttgttgttgttgtttgttttttgtttttttttttttaagacaaggttttgctcttgttgcccaggctggagtgcaatggtgcaatctcagctcactgcaacctcctcctcccgggtccaagccattctcctgcctcagcctcccgagtagctgggattacaggcacccgccaccatgcctggctaattttttgtattttttgttgagacgrggtttcaccatgttggccaggctgatcccgagctcctgacctcaggtggtccacctgcctcggcctccccaagtgctgtcagaatgtagtaaggtgatatatgatgagcacctactacataagtgctcaataaacagcagctgaattattttctttgctcaccgttacagccatgaggctctgatctttatgactgatcccttgaatcttctttcaaaacatctcacctctgtatttgagggcttgtcccttcaccatagcatgagagcaacagctgcatcacagtagctaacaatgtcaagcaaattacaaagggaagaaacactcactgagtacctgccttgtgccagaccctcgaccaatgttacattacattctgacaataacaccaggatgtagatactgatattatccccattttgcagttaagaagaatgaggctcagacaggtgcagtaacttgatcaaggtcactcagctataacaaggggagttgggactaacctgggcttagctggggctctccttactgctctaggtgacaccaaaagtacaactacagctgttggaagagggaagggaggctgtgtgttagggattcctaaggaatcacgaacctcttgtgaaatgattatcaattctcttctatgttctcctctgtttgatctagaaaggaagaaacttggaagctggccaagtaaaataattttattcattcatttgtctttctatcaatccatccccctatacctcctttcttccatccttccattgttacattcactcattcatctattctcccatccatccatccatccatccatccatccatctactcgttcatctagccatttccactcatctctctgcattcttctatcttcttccattctaccttcttccattcttctatcttcccatccatccatccatccatccatccatccatccatccagctatccatccatctatctacccatccattttttattcattcacctatccatccacttgtcaactctccatccatcctttccattcatcctctcttccacccatccatctttctactcatctctctgtctctccttttcttccagcctctcatcttcccatttatctacctattatacatccattcttcctttcttccatcatttcagctatctatccatttattcatttagtcattgactttaaacattttattttcttcttttaaaattatttaattaattttttgcctttcctatggtgctgatagttattgactcttttttctttgttttttttttttgtttgtttktttttctgttttttttttktttktttgtttttttgagtctaggtcttgctgtattgcccaaggctggaggacagtgatgcaatcatggctccctgcagccttgatcttctgagctcaggtgatcctccccttttagcttcccaggtagctgagactacaggtgcacgccatcacatctggctaatttttgcaggatgaggtttcaccatgttgcctaggctggtctcaaatttttgggctctagcaatyctcctccctcggcctcccaaaatggtgggattacaggcatgagacattgctcctggctgactaactcttttatctactctattaaaaaaatcattcacttattcattcagcaaatcattcattcaaaaagaatttttgagaccacaccaggccctgaagtctcagagataactatgatcctgcttccagcactataaagggcactggtagggattatctacccagttcaaagatcctacagtctctttagggctgtcttgtaagtgacttggataccagaggtaccaagctcggtgtccctatggtgccatarcctgggatgtggtccgccctaactctgttttctccttgacccacagtccctgctttgataaccacasgcagctacgggaaagagtgggaaaagtgagatagtcccaagaaacaggcaacagcagggtaagtgaaaatcaatcaacctaaagtcaaactaaaatttgtgaacatgtttccttgaactaagtttcttttttttctttttctttttttttttctggagatggagtcttgctctrttgcccaggctggagctcagtggtgtgatctcagctcactgcaacatccgccacccrggttcaagccattcttgtgcctcagcctcctgagtagctgggattacaggcacacaccaccacgccaggctaatttttgtatttttagtagagacrgggtttcatcatgttggccagactgatctcgaactcctgacctcaggtgatctgcctgcctcagcctcccaaattgctgggattacaggcgtgagccaccgtgcccggcccaaaatttcatttatcacgtctttctcttactttggcaacatccatatctccccgtttgtcaccttgttacacctgcaagctcattaacatggattttaaagtccccaatgattggtctccattcaacttcattcattcacccattcattcaactttgattgagtgcctactatgtgacaggtactgtgctagtccttgggttatggcaaggaacaaaaaagacagaaatacttggtcctcattgagtggacagtctagtgggaggagagagacaaaaaacaaataacatgttggagcctaagtgccatggagaagataaagcagggaagggggtaggggtgccctgagaaggtgacatttgaactaagatctggaggaggagatctgggggaagagtgtgcctggaagagggaaacagcaagtgcaaaagttctggggcagggcatgcctagtgtgttcaaggatcagcaagaaggcgggtatagtttgagtgcagggagagagtaggaaatgaggttgaaaagataacaaggtaggaggtagatcctgtggggcctgtaggctgtgttgaggagttgcgcactttctctcatgaggtgggagtcatggtagggtttttagcagaggagtgacatgatctgacttaagtcttcacaggattccttgggatcctacttggacaatggatagaggagaagcaagggggtaactcgggagaccaatgaggaggcaattgcagtggtccaggcgagggaagaaggtggtttggaccagggtggtttcgtcgtaccttgtgaaggatggattgtggggactggcgacagatcagcgtgttgtgggatcgcggagctgaggtcaaatttccaggacagtgcctggctcatgataggtacycagtaaatatcagttgaaagaataaggtctgaactaagtcagtggcaatggagatggacaggagaactaaaagggttaggattcttttgattgcaagtgacagaaacttagctcagactgcgtcaagtgaaaaggtgaagtattggtttagataaccgggagggaagttctgaaataacattacttcaagcagggctggcgccaacggtgtgtgtaaggccgtcagggctggctctcgtcccctctctttctgtcactcgctccatgggttgactttattctcaagcaggctctttccctgtggtggtcaagatgggcatcttgcagagattgtggggataagcagccccacatcctcccagatcagtaaccccaaaagtgtcctcttggaagtctcagcggatcatatctggaggagaccccgattgggtctgcttggatcctgggcccatccctgaaccagtcgtcctggccaggaagatggggaactctggtcggtcaactccaatcacatacccgccttagtggcagctgtgggagccacggccaggccggctgagtgatggcccctccaagaccatagggcgagggcaagaagtttccaaacaaactgccaaaaggggaagagaaattgtatggggaagacgcaatttctagttatcacagacttctggtaggggacagattcccgaggggatatgggggcagatcagagagggaaggactggggatgggctttcggctgcacctggaagaaaaccgtgggctcctctggccaccagggggcagcagattcacacagagtcattcacgagtccttgacacgccgcgtctcctccagcagggggtgctatttactgctccttgtagaaaaagttgggtggaagtaaaatttggcaaattctgggtcttatttcagatacccttgaatgggggggctttccttttaaagaattctcattgcaaatctttttttcttctgttttttgagaccgagtctcactctgttgaccaggctggagtgcagtggcgccatctcagctcactgcaacctctgcctccggggttcaagccgttctcctgtctcagcctaccaagtagctgggactacaggcgcgagccaccacgcctggctaatttttgtatttttagtagagacagggtttcatcaagttggccactgcagtgagccaccgcgcctggccttttttttttttttccctctttttttttgaggcaaatctttttcttttctcttctttttctttctttctttttttttttttttgtggcaaatctttttaataaaataggatcttttgaaagaacgtgccgggcgcggtggctcacgcctgtaattccagcactttgggaggctgaggtgggtggatcacctgaggtcaggagttcaagaccagcctgactaacatggagaaaccccgtctctactaaaaatacaaaattagccaggcgtggtggcacatgcctgtaaatccagctactcgggaagctgaggcaggagaatcacttgagtcagggaggtggagtttgttgcggtgaaccgagattgygccattgcactccagcccgggcaacaccagcaaaactccgtctcaaacaaacaaacaaacaaacaaagaaaagaaaaaacacagtggagagcttaagagtatctatttaggcttattttcagcagagatggttccattttacatcccactgcttattaggtatgtggccttgggcgagttttctctctgatcctccgtttcctaatctgtaaactaggggaaacacctaccttgcaggggttccatattccatcggccccaatgacttatttaacattttaaaaactgagctggatataattctaggagttggacccaacagtaaacaaaacaaatgaacattcctggcattatggagccagccttctaatggggaaaacagatgagaaataaaacactcagtcttttggataaagtgcttagaatagggtctgcctggtacatggtaaaccctgaataatgttaacttgaaaagcagaagttgaatcttgttgtatgcaacctgttgaggccaattgggttgcacaaaagattcctgtatcagggagaaattgtaccaacctgggcctaagatagggctggatgtacagtaggtgcttcataaatgctcatgggtacttgaggtggtatctccctgtgtggctgcaggtactgtgtccagttccagttggggtccattccagggagctgcgggcaggcgagggcaccccatgcccagtggacaaggtatytgagtcagggccacacggtctgtgtgaggagtgaatggcctgcccaggacaccaggagccggcgctgctacggggacggtggtggggccaaagggtgagcgacaggactcgggcatgggcaggtgtggctgtagagcccagggcatctctgctgcctgagatagcaccctgggagagagatgctgctccctggccagggcgggggccagcagggtcccaatcccagggtccaaagagaccagccagttaggagccggactcctgccacttccggtggtgtaaacttgggcaaatctcatcacctctcggatcactaagtgcctcatctgaagatacagataatgagaggacttccccatcggtcaggggtgagggctaagtgagattgtgcaaggtgaggacctaggacagtttctgacatccagaaagtatccaagaaaagggagcttgcatggtcattgaaccctcacgagtcccttaaaggccagatttggttactctcattttatagatrggcaaaccaactcagagaggcagtgtgacttagtcaaggtcacacagcagggtttgacccagatttggcttacattatccctctagactgcctcccgtggggtgagggtatcttggaaagcacttcacacatactaattataatactggcttacatcgattgagcgcttcctatgagttgaggattattccaagctctttatattccttcattcattcagtgttgagcatgtgctaggyactgttctgggcactagggattctgcagtgaagaaaacagctgaggtcccttcccttatgcagacagtaaggtcccttcccttmtgctgggaggaggcagacatcgggcaaataaatctataatttgtcagatgggagatgaatgttaggagagaaagcagagtaaggatgatgtcctgggggttgttaattttttttttcttttctgggtcttgccctgttgcccaggctgaagtgcagtggtgtaatcccagctcactgcagcctcaacctcctgggctcaggtgatcctctcacctcagcctcccgagtagctgggactacaggatgcrccaccatgcttggctaacttttgtattttttgtagagacggggtttcaccatgttacctaggctggtcttgaacaccttggctcaagcgatctgcccgcctcagcctcccaaagtgctgggattatgggtgtgagccaccgtgcccagccattatttttaaaagcctgatcaaggagggtaacagaaaggaggtgatatttggacggayacccaaaggaaatgagggaggagccatgtggatctctggaggaatagctttccaggcagagggacggcgagtgcaaargccctgaggtagagcgtgcctgctgcactgaggagcaagagaggccattgggcaggagcagagtgagtgagggagagcgtagaaggaggtgaagtcacactaacacaccgtatgccaatgaaacattgcaagaatctaacatggatacttttaggatctctgctttccagatgagttgactgagatacaaagaggtgcccaaggtcacatacctagcaaatggcagaaatgagatttgaccctgaactgctcagaccyccaagccaagctctaaactctagtctagactgtttcttactgaacatgcttttccggtgcagggattatcacactgttggaatatgagctctctctggggtctgtacagggagttctaccatttccaagggtgttaatttccttcttttaaaaattaagcagccctgatcactgtaaacttagaacagggaatgccaaggccagttagggtgttagggagaaacgcatttaggcaggaggcattggattacacagatctgggttcagattccacctctggccctgattggctatgtgactctgggcaaggcctgcacgtgacccggacagtcaccaccacgtacgattgtggggagcacccacaattttgcacagcacctgaccccttgtagatacccactagtgggggctgctgtcattatctctaatctgcagaatagatataataagacgtagtttgtgaaaatgagatgtaatggatgtgatgaacctggcacatagtaggttcccagtaaatacacgtccaacaatattatcacactatagggtggcccttcctgccagcctcccttccaacctccctcccgcttacttgtcctagacctgagattccactgttagagtttcattctttgggataggcgctcactttttagagcttcagtttattcatcaatttttggaaacactttctagtcttaagactctgattaatcccaaatttctctttttggacacaaatactctgggatgtgaaacatggcactttggcaaggctgagatgtgggtcccaggggccacagtacccaccaggaatgggaagggacagaaaggagagccagggctgtgtccgagacaggcatctctccacactccccacctggggccaggctggcagagcaggtgacggaaggtctcatgggggcatgagctcaccaggaaggactggcggagcagggggatccaagagaggagaggcatgagccgtcagccgaattctttccacgggcagctgtgagagcgggcgtgccaagggcatgggcctggagagggattagcctatcagttgggaatttttggagggtttatttagcttaagaagtatccctgagtttgggtcaagcataaggaacatctgccatgagccactcacctactgcgtgctgggcacgcaccaagcaggtgcttcacacgtgtgttcacagttaggccttaggggcacttttagacaagggacatgaactccattttatataatgatgatggcaataataatagtaactttaaaatgttatcatttgtaaaacacttattatctgccacgtactgggcttacaggcttacaacggtgcctggtaccaygtgggaggcgcttaatcagtgttttttttttttttttctatttttttgatgggggtcttgctctgtcgcccaggctggagtgcagtggcacgatctcgactcactgcaacctccacctcctgggttcaagccatcctcctgcctcagcctcccaagtagctgggactacagtgcatgccaccatgccgggctaatttttgtatttttgtagcaacatggttctgccatgttgcccaggctggtctggaattcctgggctcaagcgatctgcctgccttggcttaaagtgtggggattacaggtgtgagccactgcaccaggcccagtgtttgtcattattgatattattttgcatttttacaaaagatttggattacacctacagaaaattggctttaaaatatatgaacaggttcacaaacatttgggaaggtcacacacctaggtagacactgcccaggcaaggaacagagcctggccagcccccgagacctgcacacgccccctccctcagtccctccctccccataaaggaggcctctgccctgacttctctggtgatccattgtgcgacatccttgccagctttaggaactcgatgtggagccctcaacactatagttccatttcatttcgttttgttttgtttctttccaactttgcatcagtgaaaccacgcaggatgtgctctttggaattcgactgcctttgttccacatgaggtttccaacgttcatccacgtggttgcacttgyagcattagctggttcattcttgttgctgaaatagttagctattactattattattttgagacagagtctggctctgtcgcccaggttggagtgcagtggcacggattcagttcactgcaacctccacctcccagattcaagagattcttatgcctcagcctcctgagtaactgggattacaggcaagtgccactatgcccagctaatttttgtatttttagtagaggtgaggtttcactatgttggccaggatggtcttgaactcctgacctcaagcaatctatctgcctcagcctcccaaagtgctgggattacaggcatgagccaccacgcccagtcagttagctattattatgatcatttttattttctttgcacacagcatctcagatgacctccccaccaacacctcagaggggcaaagattattgatatctccatcttccactgaggagagagaggctcctaggagccaggtcccaaacgccacctgattccagagcctgtgctcttagccactccgtggtgtggcccctcaacagaggaggaaaagggggcacagagcagttaagcaacttgcccagccttgcccagcagggacgtgatcgagccacctccccagaccctcagaactgactctggaatgcccttgtggcctctgagggtcgctggctctgtggccatccccagggtgacttacaagggcccagtscccatacacttttagggcccacaaagacattttaattttaatttcttttaaaaccagaagaaaaaaactgatgctataataataataataataataataataataataatawwawtagtggatcacaaatccagcctggattttacttgtctttatacagtgcagtcacaagctagagggagggtccctgaaagcaaacatccctggagcccaggaaagccatcattcgactgagccagccccatctcttgcaggaacaagatgtggctgtggcaagcggccagccatccccggtgccgagggacctgggagaagctagggcagctccggcattgttcctgccctgtggtccacagcctcgtcttcatctagcgtctgcaccccctaaccgtctttccaaagcctcggggatggcagggaaactgcagggcttgggatcccgcagaaccaaagagttgggagaaatctgcaattttgagactgaaggaacaagccttgtcgttatgttgacactgaaaatagctttatgcttccactcagtgccagctgagtcacggtcctactgacatctcctgcccattcagggcttcccacatttcatctcccagacacactctcctggcccttgccctattctccttattgtatacttaattttttaatgaactctctcccttcccttccctttccttccctctctctctctctttctttcttttctcttttttggatggagtttcactcttgtcacccaggttggagtacagtggggtgatcttagctcactgcaacttccacctcccagggttcaagcgattctcctgcctcagcctcctgagtagctgggattacaggcgtgcaccaccatgcctggctaatttttgtatttttagtagagatggggtttcaccatttgaccaggctggtcttgaactcctgacctcaggtgatgtgcctaactcgacctcccaaagtgctgggattaccggcatgagccaccgtgcgcagcccctccttccctcccttgtctccctcccccacttccctctcccccccttctgtctccccgttcccccctttccctatccccctcccccctccctccctccctccctcccttcctcccttccttccttccttccttccttccttccttccttccttccttccctctttcttgacagaatctccctctgtcacccaggctggagtgcagtggcacaatctctgcttgctacaacctcggcctcccaggttcaagcgattctgtcacttcagcctccctagtagctgggactacaggtgcacaccaccatgcccagctaatttttgtatttttagtagaaatggagtttcaccatgttggctaggctggtctcgaactcctgacctcaagtgatccacccatctcggcctcccaaagtactgggatgacaggtgtgagtcaccatgcccagccttcttttctttactcaaataaatttatttgaaaagaaaactacttaaatatatgtttaaagaggaaacattttatcacaattataaaataaaataaacaataatagcaaacatttattaagcacccgtaagagtgccaagcactgtctcagccttttatacatactcactcattggattctgagttagatgcaatgattatccccattttacatgtgagaaaactgaggttcagagaggtttggccactttgctggaagttgcagttagtgagtggcagagtggggattcgaactcaggagctgcacctactgcttaggttccctgcacagtatatcagcctcatgagggcaggggttttggtttctgtgtccctgggcctaaaatagtgcctgacacacaataatgctcaataaatacttgttgataaaaacaaatgaataaatgaatgatcagttgctatactaagaagacaatcaggctgggcatggtggctcacgcctatgatcccagcactttgggaggccgaggcgggtggatcacctgaggtcaggagtttgagaccagcctggctaacatggtgaaactccatctctactaaaaatacaaaaatgagccaggcatggtcgtgggcacctgtaatctcagctacttgggaggctgaggcagagaattgcttgaaacccgggagatggagttgcagtgagccgagatggcaccaccactgcgctccagcctgggtgacagcatgagactctgtctcaaaaaaaaaaaaaaaaaaaaaaaagacaatcagaaaaataaatacaatggaaaccagagaagtccactgttgcctgctcaagatgctgagcatgaagcctgttctcctgattcagacaagaaaccagccagtgtggagtgataggaagaacacactcatagccaatggagacttgctccttgacaaattagaaaaattatactggaatcttggcactttgggaggcctaggtgggaggattgcttaagcccaggagtttgagaccagcctgggcaaaatggcaaaaccccatctctaaaaaaaaaaaaaaagatacaaaaattagctgggtgtggtagtgggtgcctgtagtctcagctactcagggggttgaggtgggaggatcacctgagcctgcgaggcagaggttgcagtgagccgagatcgggccactgcactccagcctgagcaacagagggaaaccctgtctcaaaataaattaaaaaaaaaaaaaaggcttaaaaggaggctaatttttttcctttaggagtcagttgttataaacatttttaacagtgaattcacataccatgccattcacccatttaaagtgtacagttcaattcttttcagtatatagaaaaaattgtacaaccatcaccacagtccaatttagagcatttttatcctcctctgaaagaaaccctgtactcgttagcagcctctccttcctccgacccctctagccctcagcaatcactaatctttttctgtctttatggatttgcctattccggacatttcatataaatggaatcacacaatatgtggtctttcgtgactagctgctttcacttggcagaatgttttcaaggttctcccatcttgtagcctggatcagtactggagtcagttatttaatgctacatcctgggttcgggtaaaacgacctaaaatgtgagtcccccgcttcaggaagygccgctgtaatgaataaagaaccttttgggggaatcatagctcaatctcttcctggttctaagcgggcaggttcaggcttccctgcggtggggttggagcaggaggtttatctttcagctgtccttgggactgggcaggaacttgttcaaatgttactgctactctatcctccttcctaaatcaggactctggacgctcctgggaatcactgtctgttgctgctctctgggagtgtgaatgaatcactgggtgagaatgtcagtagcacctgtgtgtgctggtctggggcgagaatcctgggccaaggggcagcggaggggagaaagaagcagatggccacgaggccagcaaggggctgtccgactcrtaccccacagccagcattccctgcctctacccgtacacttgttttggctgcaggaagctgttttaggtggaaatcatttgatgtgtgtaggtgctgtcttcccaaacacaccgtgctcgacaattgccccagctctgcaggatagactttttgtagctcttggtagctacccattttttcagcctctaaatagtggtggtgcctgttttaatcctctcatggatcgtgtaaagtaggtgatcttttccccattcacagatgggaaactgagcttcaggatagtcacatgacttgtycaagttctcatgattaggaaacgttggagctgggctttgaactggactgcaaagcttgtgctcttgacgaaataggaaggcagaggctgtggtggggagcagcttggttatgggtacccagaaggcagagccgtttcttgcgtaccataaaatgggacatttaccttgggtactccctttggagtgtgttgctggaacttgtgcagggacttagggartcttctggggaagaggccagcaatgtgttggggatggagacgaggagcactcagtgttatgttttggagccttgtcctacacctgaggacctccaagtctatcagtcaaggccctttgggaaatgagtgaaagaactcaaccagctcgagcaaggataatttattgactcatgtaaagaaaatatccaggataagactgccttcaggtatggctggatccaggggtttaaaggttgaagccactgcctcactttcttttggccttgctctcctctctgttgactttgtgcttaggtaggcatcctgtggtggcactaatggctgccagcagctctaggctttcttcctccccattctgcatcacaaagctgaagacagcatctcacttccaatggtctcagtctcagctacaggtctggggttgctgcttattgaccaggctcatctcacacccctggttcatattcctgaatcaatgggtsgggggagggtgggggaatgcactgttttgattggccggtgctgggtcaggtgcatatccttggaagtggaggcatggtcagtcctacttgaaccacgtgaaccaagaaggaaaactcgggacccttgtatcagaagcaatgggaatggatgctgggaatgtttcaggccacagacatcctcctcgtgggtggcagagaagccaccattcatctctgtggctttgctgccaacttgccatgggaccttgagcaagccacttcccttctctgagcctcagtttcctcatctgaacagcgatgatctttaagggcccatacagccctgaacttttgaggccaacagggtttgtctagccaacagcctggcatcctagcttgacaggtccaagctaaggcttaggaatgcatggccttcagaaaccctggggtcgaacctggggctgggcgcctggcctcttgttcttgcccatcctggcagggtacagcctgtgatgtgggagggaagggttctgaggaggtttctttgcacatccccagcattctccgtctataattggctccaaatgaaatgatctcatccctgaacactgaggaagaaagggtgggggtgaagctgctcgctggcagcatctgacatagtttatgactaacccgcttccctcccgaggcagggagagacggtccgctctctcgaagacaatgtacaattttgaaaaaaaaaataaaaaagtcttggtaaatagattgasgaggctccagcctcctgggcttttgggaggcccaaggcatttttcccctctgcccaaaccaggtatcttttgcccattgctcacaagtcaacgtgacccrtgctattaccattccccaaacttttcacgtcaaaccctggccgggaaggtggtcaatgtagccagtccatcaagcgatttgtcccatatggattctcaattgagttttgtggccggctggagcttgtttaaatgcccatacattaattttgaaagatgagctcctaatcaacttttaaaaagcttgtcacagcaccatctgtttggcgtttgtcactattgcattacataagaggaaagacatttttaaagaatgcggctacatttagtaattggatcgccggagagaagccaaaccggggcggatggcaccgtgattcagaaatgccacgggcccttctccggggtgtggcggcctccccaaattccacgcggtcttggcagagacctgagtgcagcccagcttgggagacaggcttggggtggcttcttttcctcttgccttggtcttcctcttattttttccatttgttctccctcaccccttgctaccccagtattagcagtgaccaagtggctttacttccctgagtcccaatttcctcatctggaaaatgggattcacaagagcaccatcttgtgaggtttaaatgcattaatgcctacggtgcctggcacgtggtgagtgctttataaagtgttgctattttataaagctatgtctgatgcatagtaggtgccaacacatgttcattttccttccttttycccttccctttatttatttatttatttagagacagggtcttgctctgttgcctaggctggagcacagtggtgcaatctcagctcactgcggccttcacctcccaggttcaagcaattctcccacttcagctccctgagtagctggaactacaggcatgcaccaccacacctgactaattttttgtattttttttggtagagacggggtttcaccatgttggccaggctggtctggaactcctgacctcaagtgatccatcagccttggcttcccaaagtgctgggattacaggcgtgggccaccgtgcccggccccttccttccatttaattcaacaagttcttaggaagtgcccacgtttgaggcagagctggcatcatgcacatgcacagccatttgcacagggccccacactcacaagaatgctgagcttggtttagcgttctgctgtcgctggcttgacattcttaatttttgaacaaggggccctgcattttcattttgtactggaccccacaaattatgcagcyggtctcatctggaggtctagaatgatgctatgtcttatttgaccgtctgatatttaaaataacaatagagtcaacgttttaaaatcaggagagttcacacaacagtctggcttattttagaaaattagaacatcttgccactgtgagtctgcattcccacacactgccacatgggctggagctggagtcctctatacaggccacatccgccactgtccccaccactcctggaggctttggactgagtctctttgctcatttatagagcttccagcatggtagctgggatcatgggctttgcagccaggtatgtgttcagcttttctgttaatcatcacagtaacctctctcttagggtagtaaggattaaactagttaatataggcaaagcatctggaatatgttgcactgttattgctactgttctgctttatcctggtgcagaagctcagacccccagtctgagggctgcccctccgggagctggaagctgcgcctgtggcagctggctatgaaagcgtctctttctgctgtcccacacagcagccgttgtcaatgtccactttctctccctccacctgcagcaccagagttcacaccttgggcccgccctcctagcattattttgagaaaagggccttctgtcctgtaaataggctgagtcatccctgcctcagggcctttgcacacgctgcacttgcttcctagaatacttcttttcccatcgctttgcttggccatcttctccttttggtctagctcaaatggtacttcctcagggaggcttttcctgatcgcctaagaaaagtagccctgttttctttcccctgtcatacacattcgcctatattattttcttcccagaactggtttgttgtgtatctyccagaggaccaggtctgccttggtcactgtgatatccctagcacttaggccattgcctggcacatggtagatgtttgataattatttattgaatgaatgaaggaaggaagaaaagaattcatcaactcctcatgaccaccctgtaaagcagggacaagagacctgagtcatggagaagagaagggactcctcaaggtygcacagcccagaaggggcagaaagggtgatgaggacctaggttttctgcttctacaccccctgtcccctcaaccccccaggtgggaagcagcagagacatttggatctttggctcgaccagccaccaagaacgggtcaagtgtgcagcaaggcccagagcacagcgtctgagrgtggtgagagcgattcacccaggcagccaggaggcgagactgtttacaggggctagcggctgtcgccatgacaaccggacagcctacagcttcctgcgtcaccagggacgcaggtttgctcttggctgggaagcagtggggacaatggagtgggggctgggaaatggggggaccctaaacactcagtcttggggggaggcagttctcatttctggttttttttttttttttgagatggagtctcgctctgtcgcccaagctggagtgcagtggtgcgatctcgactcactgcaacctctgcctcccgggttcaagtgattctcctgcctcagcctcctgagtagctgggattacaggcgtgtgctaccatgcccggctaatttttgtagttgtagtagagatggggtttcaccatgttgcccaggctggtctggaactcttgacctcaagtgatctgactaactcagcctcccaaagtgctgggattacaggtattagccaccatgcccggctgggagttctcatttctgagagttgcttgaaggctgggagggcctggtgatgctacctaagtgtgtgtgtgtgtgtgtgtgtgtgtgtgtgtgtgtgtgtgtgtgtagtgtctgggctgtgtggagccaagctgcctgggtctgaatctcagctttgcctcttctgtgccgtggcattttgggcaagtgagttaatctctcggtgccttagttccctctaatgtaaaataaggtggacagtagtacctcataggactgttatgaggattaaatgagataatagtctcacggcacttacaatgcaccttgcattgtgccttaattcttgacatcaatctacatctgactctaggttgtcttcttgctggggtagtgggaaatttggtctcaatcatcctcagggatccctacttccctggcttttgtcattcattcaacaaatacttattgagcacctactgcatgccacgtattgttctagaggctgagaccacagcagtgaacaaagcaaacaaaaatccctggcagagtagagctaacattctagtagggatagatagacattaaatatgacaaaaaggaaaatagatattatatcagatgacaataagaagaaaaagaaagcagggctggaggattccaactgcaggggagctgttgcaattttagaaaaattgatgcatggggatgtgagtgtgtcagggaaggcctcactgagagagtaacctttgagtacaacttgaagaaggtaaaagagggagtcacaggttatttgcaagagcattccaggcagagggaacagtaagcgcaaaggccctgaggcaggagcatgagcatgtatgtgactgtatcatgtagtcatatctcttggcaagtctgtgtgtgtgatgttatgtggcacacattggtggcatataggtggttatgcctgtccacatgggtggcaatgcacatacatgtttgttcatgtacagagctgctgtgttcagtcacagaggctgtgcctgaacaattcagggagtgacattcacactgattgccatgaaatgggaccccctggtgtagtgcagcgcagtggccccgagcatatatataaggaaatcaatgtaaaatgtctgtgaaaatgttcacacgtgtatgtgtccggatatttaaatataacgatatgcaaatatgtatatatgaatgtctttaagatgttgatatttcattcctcatggacttttgcttcagtattgatttttaaaaaatattgcattaagatattatttctcttgattactcagtttttgggtgcatcttacatttgcatcagaggcaagtgcctcactctcttaatgctggtcctcgccctgccttggagttgggcaatgaatgtgcgggaggcagggatgaggcaagggaagcctctccttctggctccttccagcatctgggctcatcagcacatgactagaatccaaacctaatctgaacacattttgttcctttaaaacaagatttattgagtgctgactgtgcgccagggactctgcatacattattttattttatccttaccaccatctctgggggtagatatttgctcattccattgaacagacatttgcttagggcctactatgtgccaagagtataagctggcatttgtgctggtctggcagccactcctgatttttctggtaaaagcaccccagttttcctttagggaacctagcctcttccctttactgtccaagtggtttcacctgggctttctgtacccctccctcagactccaggggtgggggtgtgatccaggcgacccaatcagcatactccatcccttttgctccagagattagttataggacgagtatctaacccaagttggttcaatcagagtgaatcctgggatttttgctgccctgttgggaaaaagagctctcttttcatcaggatttctagctgtgagaattctgtaaccctggaattcccagtgagagtctactacatggagagagagagagagaggaaaaactcatcccttatgacatctttaaagcccctggatccagccacacctgaagtcagttaccctaagatttttcaattctgtgagtttatacttgtttttctttttaaaagccagtttgagagggaagctgaaatcctgtgcttggcatctttgtacattatctcctttaattcagagatgaatcccatggggaaggggctctgattgtacaagaactgatcctcagggagggaggtgacttatccaaggtcacagcaggttggtagttggagcttgaattcaagcccaggtctctactcctgagccgttctgccattccacatggtctgacctctggacaagagggtttgtgtgagtattagtgacatagacccgagtcctgttatggccactgttttgctctgtgaccttgatcaagtcatttctctaatatgagcctcagtttcccatctggaaaaatggtagtgcttaccccatcatgctgtcgtgagatgatccatgaaagtaaagtactcagaacagggctagacatgcagcaatgaacataaactattattaccatggctctctttttttttttttagaaaatttttttttaaatttcataggtttttggggagtaggtggtatttggttacatctttagtggtgatttgtgaaatgttggtgcacccatcacccgagtggtatacacttcaccagagcagtatacactgaacccaatttatagctttccatccctcacccacttcccaccttgccccgcaagttcccaaagttcattgtatcattcttatgcctttgcatcctcatagcttagctcccacttatgagtgagaacataatgttggttttccattcctaccatggctccctctttgagggaagaaaggggacccagggggctccccggccaccctgctcccatcctccctgatggccacaggctcccagcagcccttgatggcaccttcatccatcttctgccagacacacagaactggctcgcttacccgggaagcaggcacttaaggaggcgcttccccgctttctcttttaattttcgttacataaatttcacatttcctggaatagagagcttgaatgtctggactcatttggaaatcgagtcagcaaagggcctcatttatattaatggggactcgagcctgacttgagacgtggcagagacaaggatggatggcagcagctcctaggcccagccatccaggctgagctcagacactgccttgagaagcagatgcctccagatttaggctgggactgttctcgttgtgtggggagctcctggatgcaagggcggtgttgtcacccctcccccactgaaacttcccaatggctgctcactctctcagagggaactccagtctgcttatcctgcttgacaaggggctgcgtgatggacccctgctaacctccctgctcctgcccaccactctcctccctcatccttcttcagtctggctggcctcctgagagcattcctgcctcagggcctttgcacttgccgtgctctctgcctgaaaggttgttctcctagctcatcccgtggctagctccttccatggcttgtctcacagacagcacctcagggaggccttccttgattgcccatctggagaaacactctccagttactctgtatcacacccatttcattttctccatcacactgagcaatagtttgtattttcttgtttacttatttgcctatttatttattggctgtctttcccatgagagtataaaccccattagagcacagactacgtgtctccttcagctttgtccccctaggatctggctcagagagacagatttcttaagcaccttaataaatatttgtggaatgaatgcctgcactcattcagcaaaccctttctgagtgccttcctggtgccaggctctattctgggtgctgggaacacagctaagaaaaagacaagaggcagggcacggtggctcacgcctgtaatcscagcaatttgggaggccaaggcgggtggatcacttgaggtcaggagtttgagaccagcctggccaacatggtgaaaccctgtctctactaaggatgsaaaaattagccaggtgtggtggcatgtgcctgtaatcccagctactgaggaggctgaggcacaagaattgcttgaacctgggaggtgaaggttacagtgagccgagatcgtgccactgcactccagcctaggcaacacagtgagactctgtctcaattaaaaaaaaaacaaaaacaagacaagattgttggctgcatggaactcgtggtctggcgcagagaggaaaacaccatagtaacgaacatttattgagtgtgacaaggattttacaaagagacatcacatttaatcctaactacagcccttggaactattatttgtaccagttcatgaggcacagagaggtgaaatagcttgctcaaggccatacagttagaaaacagaggagccaagattgtggccaggccatccggctccccactctgctggtttaacaagctcactgaagccactgggagttaaagccttgtgctgtgaaacctgtgatgggggaggctctgaaggctgtgggagcccagaaaaagcacctgacctattaggctggtgcaaaagtaattgtggttcttgccattgaaagtgatggcaagaactgcaattgcttttcacaacctaatagcttttgataggagaaaagatgagcaaagcctcctgaaagatgcagtaccttagttgtgtctagaatgtatttatttttaactttacattatagcttaagaacttttaatatctccatgctgtccacagttaaaattttaagtaatgcatattattccagtgagaggcagcaccatccatcactgttggggagtttcatgcttgcaattttgaggttctctttaatgctttgaggaccaacaccctggacttactggagtaatgtagcgctcaggtttcggctcctccctttacttggctctgaggattctacatgcctggaacaaggcacatctccaaagtcactaacgtggctagataatggataactagaagtgcctgccccctccaccatccttgtcttgatgccaggtgagatccaggctcctctgccccaagaagggctgagcttacattatctccagctcagcaggtccttggaaattaggttgttttaaggaaataaagaaatgtgatatttcaacaagacactaggracagcggttgcctctgcagagggaaactgggtggccaaagratggggtaagagggaaattttcgggccaggcgctgtggctcacacctgtaatcccagcactttgggaggctgaggygagtggatcccttgaactgagtccaggaattcgagaccagcctggacaacatggccaaaccctgtctctacaaaaaagcccttcaaaattagctgggtctggtggtgcatgcctgtagtcccagctacctaggaggctgagcttggaggatcacctaagcctgagaatttgaggctccaatgagctgtagttgcaccactgcactccagcctgggtgacagagaccctgtctcaaagaaaaaaaaaaaaaggagattttctttgcagatccttttatatctttcccattgggcaccacgtgaaattattaccgagtttaaaaaaaactttttttwaaaaaatgtagaagttaatgtattatttctgcatatcggtctgtggactaagctttatacgatgcattcattctctttatttacctcaaatgtgggaagtagctattattgcctcttcctgacaacaacaaaaaaagcctgaggactggagatgggctgtgccttgcccaaggtcacatggtgaattagtgccagaactgagactccactgggtgcagtggcccacgcctataatctcagtactttgagaggctgaggcaggtagatcgcttgagcccaggagtttgagaccagcctgggcaacatggtgagaccctgtttctactaaaataaaaaatacaacagttagctaggcatggtggtgtgcaatgtagtcccagctacttgggaagctgaggcaggagaatcacatgaacctgggtgatggaggttgcagtgagccgagatcgagccactgcactccagcctgggtgacacagcgagactctatcacaaacaaacaaacaaacaaacaaagaattgagactctactccaggccttctaacctgtccagggggtctccacttctccaggtacctcttcctttactggcggaagccatgccgaggtgtggacagaggggtggtgatacctctgtagttatcacctacagtagggtggtcacacgtcacactggtgttacacaatctgggctcaaatcctggggctgtccctggcctgctgcatgaccttaggtaaatcacaaaacctcttgggccttggctctgtgatagctgggctccaagatggctccaatgactctcaccttccagcgctcactcttttgtgtggccctctttggcagtgaatagggctgacctgtgggaccaacagggtattttggaagtgacagtgtgtgtgacttccacagctagataataaaggatattctaacaatggaatattattcagctcctgggctcaagctatcctcccacctcagccttccaagtagctgggactccgggcgtgtaccaccatgcctgtctagttttatttttatttttgtagagacagggtctcactatgttgcccaggttggtctcaaactcctggcctcaagtgatcctcctgcctcagcctcccaaagtgctgggattacaggcatgagccactgtgcctggcgccggctgatgtctgtcttgactgcaacttcacaagagagtctgtacaggaaccgtccagctaagccactctcaaatacctgagccacagaaactgtgtgaaatgtaagtgacgattgttgttttaagctgctaagtgttgggataatttgttacacagcaataggtaatgaatacagtttttcatctgtaaactaaatattgtggtaatttcacagtgtcattgatgataataatttcatgatgactcctttgatgatgacttcataggttgtatttcatacggttgttgctaagaaattagcaaatgctaattagtgcttggagcagtgtctggcacccagtagattctgagtaaatgttaactggtttgattatatgttctttgttatttctggcactgtgagatgctgagcctgaacaatagattccccgccccccttttttttctgagacagagtcttgctyttgtcacccaggctggagtgcaatggcacaaactcggctcactgcaacctccgcctcccgggttcaagtgattctcctgcctcagcctcccaagtagctgggattacatgcatgtgccaccatgcctggctaatttttgtattattagtagagacgggtttcaccatgttggccagtctggtctcgaactcctgacctcaggtgatccacccacctcggcctcccaaagtgctgggattacaggtgtgagccacagcacctggcatagatacccattaaggaacatagctaggccccaggctgcagtgggataatagagatggttaggatgagagctaccgctattgaacactcactcaatgcctgttcataagcacttcatatccttccatcgaagcctcagcagcagccctttgaggtagatgctattatttccccatttgacagactagaaaatcaaggtgcagagagagacaatgactggccctaaatcacacaccgaagaagtggggtagccaggatctgaactcagatgtttcagaccccaaagtttctattctgaaccactaggctgagctgcagcttggctccccatcccccacgcccacccctgacacaaagcttatcttttccctttaccaatttcctgcttattagtacagagttaattgcccacacatctgagtgcaatcattagttcattcacctcctatctgcagaatgtcaaactcctttgcactcgggagactggagagtagattcctttagaagtttgttcttgtgattcacgttccctctcccaggctatccccttcaatagctaggattgggaataagaatgcacacatgtacagaaaagcacagaaacatctgccctgccttagttccctacagggtctcatcagaggtggtttcattagccccaaccctttgcagcctggcaccttcagacatgccaccagctggctctcctaatatttgctgtggggccatgtgatcatcaggagggataggtcctcaaacaggcgatgagctcaggacatgggcattgccacacctgttcctctccccaaggaggggggaaagctgtgcagtcacagacaacgtggccttttataagcttgaatgtgatgtgcatacttgtgcatgggcaggagagcagacagggaccaagccaaggctgacagggatcagagggaaggacaggggtgtttgcgggtgcctgcaatgtggcagtggctgagctgggcctgtgtgcctgtacaccattgtgtttcagatatttttgactgtcaagttgcaggaagaagtatattttgcagcatgacctgtaacacacacacatgcacacacaattgacatgaaagtttcatgaatctgtacttaccttttatgagcaatscatgctgactttgattcgattctagtttattctactccagtctattttattctttcattacaaaattgctagtcatgacccatgaaatatgtcaaaacccccaaatgcaggagttcataatctgggtctacaaacttgtatagaacaaaacgatataattttattttcactgacctctagttgaaatacagcacttcctttaggtatgaatataggcaacaaatcatagtaatatgtttcatagtaattatgtttcacacacakaaaaatcacaggctgggagtggtggcatgcacctgcagtcccagctactcaggaggctgaggtgggaggatcgtttgagcccaggagttcaaggctgcagtgaactatgatcacgccattgcacttcagctggagcgacagagtaagatcttgtctctagaagaaaaatcacagattgttttgtatctcgttatgtttgttgcagatgtctcaaaataacatttatgatcttcactacctcaaaattgtggtcgttactaattgctggaactttttatttatttgagacagggtctcgctgtgtcatccaggctggagttcagtggctcagtcatagctcattggagccttgaattcctggcctcaagtgatcctcctgcctcagcctcccaaagtgctaggattacaggtgtgagcaccaggcctggcccgatcttgttatttaatttgttaataaagaagcacttgtattactacatcacacatctaaaatattttgaaaattgcatttcagtaggtttcctttgtaaacctatgtatttggctaagtgcagtggctcacacccataatcccagcacttgggaggccgaggcaggaaaattgcttgaggccaggagttcggagagcagcttgggcaacatagtgagaccctgtttctacaaaattgataagagaccccgtcttttaaaaaataactgggtgtggtggcaagcccctgtagtccctgctacctgggaggctgaggtgggaggatcacttgaccagaaagactgagactgcagtgagccgtgatcatgccactgcattcctgcctaggtgacagagtgagaccctgtctctttaaaaaaaaaaaaagaaaaaaaaaggagcgtgaggaaaaaaaacccttatgtattggcatttaaatattattctgagtctgagaagggggtctgtgggtttcactggatttgtgagagggtccatggcacacagagtttgagagctgctgccccagtgrgtcctgatacacagttcatgaaacgctaccccatgctgaaagctcttggggggcagagctccggagtcttgaacctcgagcccagcatggaaatcacatcggtggccaatgtttccatagcacatatggtgccagcctctgtacgaggcccttcacatggattatttcttttaatctttacaccaactcttgtgtgaggggtactattcttagccccatgtctctgtctctttaccctacttcatttttcttcttagcaccagaagtgtcatatatttttatctgtttattggcagcctcccccactgggatgtgtgtctcttgaaggcaggaatttgctttgctgagtgcttcatctccaaaatatcaaaatatgcaagacttaagggggtaccaaaaactcaggaatcatgccatgtcacatatcatgttcacacacacacccacaacctcagaaatcgaaataaggaacattttactgcctttttttttctgggacagggtctcgatctgtcacccatgctgaagtgcagtggtgtgatcatggctcactgcagccttgaactcctaggctcaaaagatcctcttgcctcagcctcccaagtagctgagactacaggcacacgccaccacacctggctaatttttttttttgagacaacagtctcactctttcaccaggctggagtacagtggcgcgatctcagctcactgcaacctctgcctcctgggttcaagcgattctcctgcctcagcctcccgagtagctgggactacaggcgtgcaccactacgtccagctaatttttgtgtttttagtagagatggggtttcaccatgttggtcaggatggccgcaatctcttgacctcgtgatctgcccacctcggcctcccaaagtgctggaattacaggcgtgagacactgcgcccagcctaatttttgtatttcttatagagatgggatttcaccacgttgcccaggctggtcttggcaactcctgggctcaagtgatccccttgctttggcctccaaagtgttgggattataggcatgagccactgtaccctgtctgtaatatttaaaaaaataaaaaataatgccccaaacccataaacaaaatatcaacatttcaagtaaagataggatccaacctcctgcatgtgtacattactgcctggatctccttatcctgttactggtcctgaggggcttaaaacctaacggttgctaaagtgaattagtctcattttgcagatggggacattgaagcaaggatgctaaagaccccctcggtgccaatagccagtaagtggagcagttaggattttgaactcaggcaattgagttccagccccatctttcttaaaccctgcacagccagcctcatgaattatcatgcttgatctttttggtagaggcagtaaactggtaaaatcagataggtttgagttaaaaccccagttttggctgggtgcagtggctcacgcctgtaatcccagcactttgggaggccaaggtgggcagatcacttgaggtcaggagtttgagattagcctggccaacatggcgaaatcccatctctactaaaagtacaaaaattagctgggcatgatggcgcatgcctgtaatcccagctactgaggcaggagaattgcttgaatccgggaggcggagattgcagtgagccgagatcacaccactgcactccagcttgggcaacagagcgggactctgtctcaaaaaaaaaaaaaaaaaaaaattcaattttgccccttcctagctgggtgatcttgggccagtcatctcaatgctctgtacacagattaaagagggcagaggggactggaaggggatcagaatgtggctacttcattaggtgggtccactgtgggtgtgtctgagaaagagtggggagaccgggatgttagagcaggcacccttgggtgagagctgtgggagatgaaatagagaagcatgcaggagccagtggatgtaagtatttgcagaccaagccagggactttggactttatttaacacgtaacagaaagcctttggaaggttttgatggcaaagtgacatgatcagactgacagcttgacaggacccctctggccattatgttgagaagaacctgaaagatcaagggcagaaatagggaagctggtctggacgtggtacaatatgaaggcaataaacaatggtggcctggccccaagctgcagcagtggaggagcaagaaatgcagatcccagatctattttgaaggcagagcccagaggaacggctgacaagccattcatttcagcactgtttgttatagcaaaagttgaaagcaacttgaacgttcaggagtaggagactggcaattaccatgtataatagaacacaacataggcttatgaaagaatgaggaggctcttcgtgtattaatacagaatgatttccaagatacattaaatgaaaaaagcaagatgcagagcagtgtatatggcactcttactatttgtatggggtaaaataaaacaaagcaaaacaaaacaacacacgcacgctacacatcggttatatgtatgtgtgtgtgtgtgtgtgtgtgtgtgtgcaaaaatgatctctggaaggatacgtgagaaactggcggcctctagggacagggggacaggggtccaggggtataagggaaatttcacttttcattgcatcttttggatttgagattttgtgcctcttctcaactggaggtgatgtcccccaggggacatctagcaatttctggagacatttttggttgttgcaactggggggaggtattactggcatctggtgagtagaggtcagagatgttgctaaacaccctgcagtgcccagggcagaccccacaacagagcaagagctggccctaaatgtcagtagtgctgaatttgagaaggtttgatctattaaaaaacataataaggctgggtgtgttggctcatgcctgtaatcccagcactttgggagagcaaggcgggtggatcacctgaggccgggagtttgagaccagcctggccaacatggtgaaaccccctctctaccaaaaatacaaaaattagccaggtgtggtggcgggtgcttgtaatcccagctacaggaggcaggagaattgcttgaacctgggagacagagattgcagtgagccgagaccgtgccactgcactccagcctgggcgacagagcaaaactcagtctcaagaaagaaagaagaaagaaagaaagagagagagagagcaagagagagagagagagaaagagagagagagagaaagagagaaagaaagaaagaatagaagttttttttttttcaggatggtctttattctgaggttgtatattttatgggtttgatatatcctttgttttactaagataatatatagtacatgatagtcattttttccacatctttacttggcaaaataaaatgtcagcaagccttatacacttctctaagctgaataaaaaattatccgggcatggtggtaggtacttgtagtcccagctacttggaaggctgaggcaaaagggtggcttgtgtccaggatttcgaggctgcagtgagctaagactgcaccactgttccccagcctgggtgtcagagtgagaccacatctctagacaaataagaataawttttttttttttactgggctatgaaatcctaaagtctggaaactacccttttcactcaatgggcttttgaaaggtaatgattttaaaatatgtccacaaaatatttgatcctttttccccaagaggtagaattacctctctctaagtgtgaaccagatttggtgactcactgctaacaaatagaatttggtgcgagtgatggtttctgatttctgagactaggccacaagaygcattgtgcctttctccttacccctctctcttggaccactgcccctgggggatgccagcttccatgctgtgaggatattcaagagccctatggagaagtccacatggtgagcaactgaggcctcctgccaacagccagtaaggaactgaggcctcctcagccaacttagaggcaggtcttccatcccagtcaagcagaggactgcagctggtgtcttgattgcaaccttgtgagagacccctagccagaaccactcagctaaagatgctcctgaattcctgacccacaaaaaccatgagataataaatggttcaacttgctagagtttggggggtaatttgttacacagcagtagataaatacagaaggctgggcacagtggctcatgcctgtaatctctgtactttgagaggctgaggtgggtgtatcacttgaggccaggagttcaagaccagcctggccaacatggcaaaaccctgtctctattaaaaaatacaaaaaattagccaggtgtggtggcacatgcctgtaatcctagctactctggaggctgagtcacgagaattgcttgaactcggcaggtggaggctgcagcgagcagagattgtgccactgcactccatcctgggcaacagagtgagactatgtttcaaaaacaacaacaaaaaacctcccaaaaacaaatatagaaatctttgagccctatcagtaaggcagagatcacagaaaggtagcctatgggctctggtctgcctacagatatatttcctttggccagtacaggactacaaaaaatggaattaatcactaatgtttatttatttttattttttatttattttatcttttagcagagacaggatttcatcatgctggccaggttggtctcgaactccgccttggcctcccaaagtcctgggatttcagttgtgagccacatgcccagccatagttgctaacatttaaaagttgggtatttcctttaaaaatccagatttctgacttctcttagaaagatctaatattgctgggcccacatccctatggggtaacaaccagctggagatgaatggtgttcacccctttagacagggtgtgtgttctgttttttatcacactcaccaccacccccttaagtctcttagttaagttgctttactcatttatgttacctgctctgccccagtagtcatttgagcttatgccttctattgtgagacagtttttaatgagatgcccaggcatagttgacatgagaactaaatgaccagagttggaactttgattcatgaatatcatgtaggatgggttaccactgggttgcatagtgggggtgaaaagccagttatattttcatgtcctccctcttctggggggaagagagaaagctgatgccgcctggagacaggattcctgattcaagtccccttacagcgcttcccatctcgcctccctgtgccctccaaaaaataaactcctccaggcttgttttttccataccttttattgaactctgcagacttcattaagggaccatttgcttagaaattcttaaacatttggacatattttacaagacaagacagcagctggaggtcacacaaagatcacaatttcatctcaccacatgcataaaaagacactgggatttgtgtgtgtgtgtgtgtgtgtgtgtgygcgtgtgtgttgcgcacatgcgcaatgcttattttcacctttacaggaaggactagagacattaactgacgagagatgaataggacccacgaatgcacccccgagaaaagagtggctgaggacattggtcatttatggctaatgtgattggcttggcccctgtcaagggtgaggtgatcagaatggctttactggcagaaaagccccaacctcacacgacgggttcctgggagagacagggtcttagctgatgggatctgggggcatactatcatgacggctttggggctcagaaaaaaagatcttcggctctaaaagctggagggcaggctggccttaatatccagctggactcccatggctcagggaaygcaatccagtttccagatgttggctcctatgtttctgccccaggaagtcccagaccaaaggaagtcccaacttcgaacccttggcttagtccattggaaaaccacttggtggtcccccccatgggtcgtgtgtgagctaaaatagaacatgaggctgagaaatgcagggtaggggaagaggaaggagggcagagctgctctgtgggcccccaggaagtgtggctctgagagrgctgtggcccttatcagcttggggcctacaagcatcaaattgagatgtcatcttgagtcaaagaaagatgaccttgatggggcagttatgggtttcagtgggagaggggctcctcatttttcttctcttcacagttaggtagggattcattaactcccccattcactcacacattcacgcatccagtcatccactcagaggccaaccagtcacacattcactcactcacaaaaacacaggttggatgaccatcatgtgccagcggcataggttggggataaccctgagttcctggtgcagaaaataagattctcagtttttgaccttggattgagaaggacctatgaaatcaagatagacctggagaatcctccctgtccccacccactcaggcacactcagctcaaccaagagggaggcccaaaccccagtgaagcccaaggggcagagccaagctgtggatatgtcagagtttcttgggcatcttctctgctgcctgcctctttccaatcttggttcagatcagggaagcaggaagtatgggaagatccctgcatggccccttgagggcatcctaatgggacggaattgggagtttcttatattttcatgaaatatcctatttttgtctccttgtgttgttgcaacttgagtgattctgcagggcagagcctccagtgaggagttgggaggaatcttgaaaactggtttttattttattttggtttcagaggaaggcggctgctcattctacccatccaaacatatcatcctgcccaacctcatactaaaacaaccaaagacaaaccagtcttcggttcaccctgaggttgaagtctcactttctcccaatccaccatacataaaccctctcttgtcaaatgctttccttagagaatgcagtatgcaggatgatttgrgatggaggccacagctgcaggagagtggcattctgcttggaggcagccaagagcctggttttgctgtgaaactggattaaaagctgcctttctcttttgacccttctggatttttttcattgacggggactttcaaaggtcttgagtggggtctcttatttgatttaccaaaaaaacaagcccttttggaatggagccatttgctattgcctgggaagttgttcattgtggggatggctagtggggaacagatatcattgcatcttttatacagaaagccccaggctcatgagggcacaggagctgggcggaggggctgaagcaccataagacagccagccagggatgggggacagcgtggattgctccttggctggcctggggaagggtagcatgagtctcatcccaatgtggtgcctggtaggccactggggatgggttggattggtgactgacagtcattaaaatgttccaagacggagccggaaggaagcagacttgtctcttggacaccccctctgagagctccaaagcccagaagttgcattcctgctaattgtgctgcatgcctttgcctcagtggcttgagcttatatccagagtgttgaaaccacctacacacacacacacacacacacacacacacacacacacacacactccaagaaacaaagaggaatttctgtggttgttcagcccagtttccatgcaatgctagggcccctctgcaatgcccattttttacaccatctagccagcctctctttaaacacctgtgatataagggagctcactgtccaccatggcattgagctccatggtcagacaacccagcctgttaggagggcttccttaatttgagctgcaattgaccccatccctttcatacaatagaaattttcggagaacttgcatacagccagctggcagctaagtttttttcttcaggtgcactgccccactccaccccatcctggccagcctttaggagatcttttcaggatctttggagggaggaacagagaattaggtttataagtgaagatgagggttccctcgattaacagagccctacccaaattcaagttggcatttggggtagttcaggagaaattctaggttaagataaaatcagggagagtggatggaaatgcaaactatataacctctttcttgatgaaaacagcaacagccataggcaacagtgtttgcttatctgggcatcaaacccaggaaactactggcagacttttttttgttttgtttttttgcttttgtgcagaggaaaaaaaaatcttgtctgttttatttgactctggttcaaaccagactatcagaggttttcggggtgggagaactctgatcagggtcatagtccagaataataaaattcatatttgagttggcttcctcttgggagttatctgatgggatggctcactgccatctgagggtcccagtttggctcaaatttctgattctaggcagagccccaagccctgcagctgacagtgaggtgggtggtataccaaaacctaaacgaatgcaagttggagattatctgggctttcttcatcttcctgcatgagttgacggatggagaatcactttctgctgaagatcctgcctagtgagatgtcctccgcccacccaggactgaaaactgcctctggaattaattatcaggacagtccaaaaactcccccaggcgtggataggtggaagctggaaaactgcccctgtccttgccacacacctcctgctctatggagccaggcagctggcaagggaaggggagatgagctagcagattcggggacatctcttctcagggtttggctgcaagggtgtctggccactgttttttggtgaagctgttagaaatggattgaaatggactgggtgcagtggtggctcacacctgtaatcctagcactgggaggccgaggcaggcagatcacctgaggtcaggagttcaagaccagcctggccaacatggagaaactctgcctctactaaaaatacaaaaattagctgggcgtgatggtgcgctcttgtaatcccagttactcaggaggctgagacatgagaatcacttgaacctgggtggaggaggttgcagtgagccgagattgcgccattgcactgcagcctgggcaacagagcaagactttgtctcaaaataataataacaaaaaaataaataaataaacagatcgaaacaaggaactgataaacaagttggtgagatcggaggcccagcatgttcttgtgaggttcacgagaacctgaaaaacctctgaccttcagctctgattgatgttacaggccgacagggtgctggacatgtgggagcagcccagccaggagggactcacatgtgttctggatctcagaaatgccagtgatgagtttgcttgcatgagatttttggttccaagatctctggggatgagaaaactcagtcccttcagatccctaaaggggtgtgggatataagtgaaaccagcccacatcccatcctgattttgagggccatctgtagctctgcttccctgggtctcattcctgcattcatgccctggattcttaagaacaacgaatgggagaaacacacagaaatgaatgaggaaagtcacagcattgacagagtccaggcctagtgtcaagaaatgcctacacaaggaagtcaaaccccaaagtctttccccaccctcaagaaatcagaatcaaaaggaagaaaacccaaacagcccaagggacaatggtaggaactgcaaaagaccagaaaacatcagctacgataatgaccaacaatgaaactcctaagatattgttctgtattacaaaagaagaaattagactcaattgccctattataaatttgctaaaaatacatatatatatatattttatctgaacagaaaaatagactactctgagatgcgtggacattctatgacatagtcgcgcatcagatacttctagagccagaaaaatggcaacagaaaatgcagaggtaactcttatttctgggtgtagccaggactggtttgggttgcctgggctgagtgacatgaaagcatttggatgctgtcctataagcagtgataggtgaggaaacatcagctcggggctggaagctttccattgtcctgccggggtctcaggggagccccttctccctcctgcccactctgcagctacagaaaaagtcctttcccaaagaagcatgtccggaggctttttgccttgctctcttttgattcaaagttacttgaattgaggctgaaaaaaagcctggggtattgttacttgagattagttggtagagaaataagaataggagagagattagcgatagagacctggctttagtggctcttgtccgtggtgaattttaaatatccccttgtccatggaactagacactccagctgggactggagcaagacagaaatatacaatagttacaaatatcaacaatacattacagttttacagaagagaatactgttttgtttttctccttagaaacatggatcttattaggagaaagggcagagacgaggctacagttaccaagacacatggagaagctggaagtcagtttgaaaaagtttgtatcaccagcagttttcaggggcaagctgggtgggttaaaagaaatggcctcctcaggattttgttgtttttccttcttactcttcttccttcttgatccccagtcctttggagaaagggacttcacgggaacaaatgttctctcctccttttttctttccccttgaagtgtgcttaagatagaattcctaaagaaggcactgagaaatctactgcaccaaagtcctgttggtttcttttacccaaagataaaaaggtgaatatactgtctcctccaaagcttccccacctctctcaccgccggtggcagactctcccccrtgtgattgggacacatggctacctggtccctagccctttcagataattgtggaagttggaatgcaagttcagctgggttcttgatgagtttcagtgaatttgccaaactgaccagcatccattcgccgcgtccagcccctagtttgcttgtttgggttgacttgtttctttctgctctcattggttcaggaatgaatgggaaatggaccaccaagttaaagcaggatttgccttcagaccattgctttcctcttctcttctctatcaagacctttctatcgagtgaacttctcagtgaagactcttaagtagatttcccagtgcatgtatattcacgtacataggtacaggttgggtgtatacatattaaaatttggatatgttcttttttagcgggtggatgggctgggaaaacttataatactctctttcgaattgagcacagaataaaagctatactcccccagtacatacacacacaagtaaaagaaaaaaaaacccaatcaaacccaaacaaaatactttctaagcatagtatatgctgaatttcaattattctgtttctataagaactctataggactctggctatgaagcctgaaaaggtaggttcttaatgatacttctgaattcgtccttcaaaagtgactcaataaaatgctactttacggttggacaaaatacacaaggaaggaagggccaggtcctacatgaccacagaaggcagaaagggcctttggttacaaggagagttgcaccaattggttttcgttttttttaaaaaaaaaaaaaaacaaatcattttcaatctgtacagttctcatctgcttcaaccaacaaatgaaatgcctcgattggaagaaggggtggtaagttccttctcaatatatatggctatattgaaacatgttcactttcctgatatgtaaaatagactatattattattattattattttttacagatagcatcagctctaaaaatatctgaattggaaatcacaactatttacttttatcaaaaagcatttgtttttttccctgaattttcacatttgtgctgatggtggacattaatggtgatgaaaacaaagaagagacatgtgagatggtcggcggagaactgtcccacagtcattcctcaagaggcccccagctcagactgcgtgttcagcaaagtgttttgggagtgctgcttcctctgcctggcacgggatgacctcacactctccctgcccctaagtccctttgcagttgctgcgcgaatactctgaagatacctaggaagagtgacgttctcgttttctctgttaatgcggcaaagaacaggactgcaccctcttggggggatctacagtctctggagatgctgagaagtgttatgaattgggtttgtatacagcagagaagacatatttttaagggtggtggaatgatcccatctcatcatatgtgtggcaggtggctcaaccttatgccttatgtatgaagagcaggcagaacagctccatgatatttgtgtactgagaggtggatcatgccattgtactaacaggcagaccagcaacagatgatattgagacttaagactaggtgaaccaataccatatctttcttccactgggaagacatatgcctgttactgtattgaggatagacagaactacactattgtacttgggacatcatccatcaacattacattaagagaacaacattgttccattgtactacagacaggcagaccaataacatgtcatctttactgacaggtgagccaacactatagcattgtattcatcagtggttcaacctaatgccactgtactgaggaatggccaacaacaccatgctgttggactaaaagcaggcaggacaatgccaggtcatcaaacgaggacaggaaaaccaacaccaagaaatacaccagaaccactcaggatgcacacaaatacttattgcttttgtctgtactggctgcatcgatggctgcaggaaggagagttgagcttttagtacagacagtgacactgaaaaaccaatagctggttgacaagaaagagaacagagtaaaacacccaatgtccaactgtcactgtgtccttttgagatgtgcatgtctcctgtatacttgacttcatgagaggccccacccaaggggcaagaacccctcctgacccatgagggttaagggaaggtttcagaggggcagggaaggagcccacagactttgatatggcagacagtaataccagcacaatattacccatgctggccagaaatgggcaggtagcaacaatccaactacagtcccaacaattgggctatgggaaatagtgcttattttaaagtgcaagatgttgacactgtccctggcagaacctatttttgaaaaacataaagtgctttttattttaacttttttttttttaacttgaaaaccacagaaaacaaaacagaatttctattatagtaggtactttccttgctgcagcaggaattattcagtctgaactgggcatttcaaygcgtggtatttttttcctttcatttttgcaagtaaaaaaatcatatttttatgctgttcttcagtaacacacagtctctttgaataaactatttcttttgcatatttgacacttgcatatcttktgagtctacactagtgatgtaaagaaagcgtgttcctcctccaaccctaaaacaatgctctgagttcatgctgttggctgggtgcccaccttctgaacccttcccagattgccagggggcaattagaattgagtacaagtggtgcaactcaccctgatggtatctcaaaawaaaatctcrggtactatgaaataccgaagtcaatgaagacatttgagtaagggttttgcgctgkgatcgtggcttatggcgcagagacttccccatgaccaatcattccctgtagctgtctaacagtggaatccatccaggaggtgatggacaggtgttcctaggggtggctgggcaacattcaataccaaattggtcaacccactctttcaacaccagccgcttgttccagcatccttctctagctgaagccaggaggactgtcaatgttgccctccgaggctgagatggaaagccacgagagaatggggagtatgtggcctcggtcctgtctaaagtggtggtagtggtggctgtgagttccactcatgtcatctcccaaagagggctatagagttgttacaaggaggtgctgtgccctatggcttggccaacttcatgctgatggacctgtcatggctctcaaggtcttagggagccttctctggagtctctcttctctctgagggctttacagggcctttctgttccagagttcatgcagaaaagctctgtggcaggtaagctgaacagctctcctctttggacctcacccaaaagtctctcctccaaggcagggcagttcagatgytctgatctcgtgtgcttccatgggctcctccccctggcaacacacggacgtcaggggagatgtggttctcaagtttgcacttttcctgaccactggrgccttttccagtcaatgcttctgtggagtaaatacagttctgccttaagaacttaggggaggtgggtaaaggggagctttcaaagtggtttttctccgatcttgtccccgtgctgaacttcggactggtgctcccagggaggcttttgggggggctggagtccacactgtagagcagctgtccctcatcatctgtgtctgcgtcaatgtactggtggacacccgcctcaaagttgaacgctattgctgtgtgtttctcaggagaccgggggggtgtcttagcacttgctgtggtgtagatggaggactctgggctcagcacagccttgtccaaaagcgtggcacactccagtccagcgacagcagccgcagcactcccccggttcctgagagggtcatggtacatccctagaacggggaggagtggactggggtcaccctccatgaagttgactttaagtgctcggagcttcaaagggttgttagttttcatggaactcttggggctctcgatgaagaaactagagtgctggctggcatcagggctggggttggcctccacaaacctaccaccactggcacccagagctccccgccagcccacttctggggctgtgctgcccccavtcttgctggggagtgatgtcaaagggctgtgggagaatctggtggcctcagggaagtctgtggcacagctaatgaaactatcaatgcttgacatacttcgcatgtcaatgaccccttctgtgcgagtgggcagaggggctacggggctggggatactctccatttcaagttcttcctttggtttgctctgtgctgctgactccttggtattgaggatgggttgggattgggtcttggccatcttattgtacatgtcttccaactgctgaacgttcaggtgctgaggactagaagacgatctggctttttcaggggatccctgttccttggtttcaaaggacttacttgagctggtttcagacagtgtcctctttgtccatttccatttgttaggagacaagtggttatcttgtactttgtctttcttacccatattctccccatttttctcaaccacaatgtccatcatctcaatgctccgggcaaaagcatccttcatgttcatggatacgatgctgccattcctcttggctctctccagagcctctcgccgtttgattgctttctcctgtctcttctgctccttatagaactcagagaagttattgacgatgatggggatgggaagagcaatcaccaggactcctgcaatgcagcagagtcccccaacaattttccccaggagagtcttggggtagatgtctccatacccaacagtagtcatggtgatggtggcccaccagaaagaggctgggatgcttttgaacttggtgtcgtcctcatccttctcagcaaagaagacaaggctggagaagatcataatgcccatggcaaggaagaggatgagcaagcccaactcattgtagctcctccgcaaagtgaagcccagagactggaggccagtggagtggcgtgcaagcttaaggatgcggagaattcgcatgatgcggaagatctggaccacgcggcggacattctggaattgcagcacgctcttgttggattcggtgaggaaaatggtgacatagtatggcagaatggccaacaagtcaatggcattgagtgggcccttgaagaacttccacttcttgggcgaggagaggaacctcagcaggtactccatggtgaaccatgcgatgcacacggcctccacgtgggccagctgggggttgtctgtggactggccgaactcatcgaggctctgtagctcaggcagcgtgttgagggacagggcaatggtggagaggacgatgaacatgatggaaattatggcaaggatctgtgaggagaagagagtgggatttagttatcaaccaccccacaggatgatcatcataatatcctggatctacagggcactcctcaatgttcaagagcattttcacatttcactagtcatttaatgagccaaaaagagaatttgttgtaatccatttattgtctagatgtggaaaccaaggcccagagaaatgaaatgttttaaagctatcagcaagcccagggttcaagcatactttttcagatagtaaccattttataggccctgaaaccctgcattgtctgtcacaacgactcgactctgcagctgtagcataaaaccaaccttggataatacatacatgaatgggcatagctgtgtttcaataaaactttatttacaaaaataggcagtggactgaatttggcctgtgaaccatgatttgctgacttctgatctagaccagtggctcacactggatggggaactaccttcacagagatgatactaatgataataactatccttgattgagtgttcattgtgtgctaggcactttccatgaaatagctcatttcattcttataataaccccgttcagtgctattagctccattgaacagatgcggacacttgggtttccacagctagtaagtggaagagccagcattttaacccaggtctgtgtgacccaagaacatgagctcttaaggctgtgttaaaaatcagatttggctgggtatggtgcctcatgtctgtaatcccagcactttgggagacctaggcaggaggatcgtttgaggccaggagttcgagtctagcctgggcaacatagtgagactctgtctctatagaagaacaaaggggaaaaaaatcagatgaaagctaaccttttgctagaaaaatgcctagacactcaagattttgcaggtaattcctagggaggcacagacattctgggcccatgttaactcctgattggaactatgtgcttttgggggctaaagaccttggcttaactacctttgagtcccctggatcaagaagagagcttggcccagagaaagggctcaatggatatatgttgaaattaatggaatctaggccagtaggccagtctacagactatgcagaaaagcaaacagatgtaatcaattgctctgagggtcttttttttttttttcaaaaatacaaatccaatcacattactcctttgtttaataaatctccagggctcctcatgaaaaaatccaaacccctaaacctgtctattgggtcccctatacctgtcttgcttttgtagattttccctttctcttcctctgcccctgctaagtgggaaggggggggcctggtcaccatggttgtatcatttgatcctgcctgccaatgatcagagcatgaagtttggataaaaaaatccaagttaagccaatccgtacactggggcttagccagcctacctttgagaaatttgagttcaggaacccaggcggtgagtgggttacgggagggtaagtccctgaattaaatgttaagtagaatctaggcttgaatcagcttcatgataagcccaaccctcaagcaactgtctcccaaatgtaggggacagagatgccataaaaacatcagagaaagctgagccttagcctagacatggtggcttacatttgtaatcccaacactttgggaggctaaggtggggggattgcttgagcccaggagttcgagaccagcctgggcaacacagtgagaccccgtctctacaaaaaataaaaaaatctgctgggtgtattggcacatgtctatagtcccagctacttggaaggctgaggcgggagaatctcttgagcccaaggaggttgaggctgtggtgagccatgaccacaccactgcactccagcctgggtgacagagagagaaaccctgtcttgaaagaaaacaaaagaaaagaaaaaggaaaaaaaaaaaagaaacgaaattagccgggcatagtggcggcacctgtattcccagctacttggcaggtgaggcaggagaatggcttgaacccggcaggcagaggttgcagtgagccgagattgcacgactgcgctccagcctgggcgacagagtgagattccatctcaaaaaacaaacaaacaaacaaacaaacaaacgaaagaaaaagacaaagaaagctgaaccttcaagagaagccagagaatgaagggaaggtgcagatgaaggaggagtggggaccgcaggagggtcatagcagggtgccgagggcagcagttaagagctgaggctctggtgtcagcctgtttgaggttcaagcctcagctctgccatttccttacattgagcatgttatttaacctctctaagccccagtttcctcatctagaaaatgggctgataataacagtatctacctcagagaactgctgtgaagatgaaatgtgttagcacaggcaaagtgctaggacagcttccagcagcacacggtgagtgtctaatagatgccagctgtcatcacaggggaaatctcagcccacatcaccccacccactcagatcaccagcctcggggtggcccggtctcggtctttgcctcctgtccttgttctgagactgtctgctgtatcctgtaagtcaacccaattgctacatgggtgagtgtgggaggtttctggccctgcaatgaatccccagtaaggacacttggttgtcaagtccttctcattttgactctgacctctctctctggccactcctgccatcggttctcaaaattcacactcctctagccgcacactatcattggtcaattctgcatgtccgagcttcttgcttgctgtctggtgaactccaatccatcttttcaaatccagcccatgtgaccccttccctttggagttctccctgctttccccaggcagggttgactgctccatccttgggtttcctcaccattttaccataccttggggatacttaccactcatatcccatcacaggtgcgtgcgtgtgtgtgtgtgcatgcgtgtgtgtgtgtgcacgtgagtgagtgtgcttattgctgcccagaattggtgagtactgggaggatggggatgggttctgaggtttatctatgtgcccccagcacctaacccagggtgggacacctgacaggtgctcaccaagtatttgttggccgttgctcaagttcatggagttagaagtagaagggtcagtaccagaattcaggtttttttttttttttttttagagacagtatctttctctgttgcccaagctagagtgcaagggtgtgatcatagcttactgcagcctcaaactcccatgctcaagcaattctcccacctcagcctcccaagtagctaggaatacaggagagcacaaccaagcccaactaatttttaaccttttttgtaacgatgggatctcactttgttgcccaggctggtctcgaactcctgggctcaagctgtcctcctgccttggcctcccaaagcactgggattacaggtgtgagccactgcactggcctgggaaatatttcttggtcatctactctgcgtgaggcactaggccagacattggggatgccacagggggcaagagagtgccagtgccctgatgggccagctctgaagatgaaagggaatgttccaaggtgtggtgcctccccagcctcaggggttccataacttctgatttttttgctatagttaagtctgacacatcctatgtttaaaaaaaaataggtttgagtttcttgatttgcacccattgaaaaaggaagattctgtaatactttataaatgaaatgtttgaggcagggtgcagtagctcaaacctgtaatcccagcactttgggaggctgagacaggtggatcacctgaggtcaggagtgcaagaccagcctggccaatgtggtgaaaccccgtctctactaaaaatacaaaaaaattagccaggtgtggtggcaggcgcctgtaatcccaactactcgggaggctgaggctggaaaattgcttgaacccgggaggtgggggtggcagtgagctgagatcatgccattgcactccagcctaggcaacaagagtgaaactctgtctgaaaaataaaataaagaaaataaaatgtttgatatatacaaaaatagacctaatttatatataatttatgaaccataatcaaatgaacacctagaacccgccacccaaatggagagacagagcaggcagcagtaacactgacacttcctttgtgtctttcccactccagagataacctctgtgtgcagtttttcgtccctttgtttctctgtatgattttcaataagaatatatgggtccctaaattgtcattttgttgcgttttttttttttttttttttttttttttttaagaggtagagtctcactctgtggcccaggctggagtgcagtggtgcaatcacagctcgaatacctaggttcaaacgatcctcctgctttagcctccgaggtaacttggactacaggtgcatgctaccatgcctggctatattttgtagagatggggtctcactatgttgcccaggctggtcttgaactcctggcctcaagcaatcctcccaccagggcccccaaagtgctaggattacaagcgtgagccaccgcacctggactttgctcagttttgacgttatactgtatgtattttgctacttgtatcactctttccttaatggtaaaaacaaaaaatcaaaaaagcccactcaccttctttattttattttagctttattctaagaaatcatatgcaaaattgctgatttttcatgccagggctatatgtattaaatattcaccaaaataaatatgtaattgttggaataacatcttggcagcacactttttggtgctcctgtgttgagctgaggagtgtgggtcctggagttgaaattctagctcttgccattcattggtggaatggccttgggcatccaaatgttcactgcctcagtttccttatttgtaaaatgaggacatactagtggtttttaaggggatgatttttactcctgggggacacttggcaattttggcagaaatttttggtcgttacaactggtgggaggggtgctcctgacatcttgggggtggaggtctgggatgtcactaaatgccctacaatgcacaggacagctcccacggcaaagaatgatctagcctgaaatgccatcagtactgagattgagaaactctgggacatgccaatagtcagcccctcacaattgtggagttggggacacagagtgggtcagagtgggcagccagtgggctttgggctgagccctacaggaagctgctctcgtctggtgacttctggcaggagggcgcctgcacagggaggaatgggttccctgggagtctgttcctttaagagctgggcagtcttattttcccccaaaggctagcaggggaagcctgctttggtttctaacccccagacaactccagggaaggcccacataattgatgttctggcgacagatgcatgaattatgcacccagctattgtacagacctaaagcaggcaccccttttgtacttgagactgtgccctccctctccccttccctcagcccaaggaagcctaggaaacgagcaaagcagggggaggggctccactggactccaaggtggagggtgtgggggagt

SEQ ID NO: 12306 - DNA, 15531 bp, Homo sapiens
agaaataacaaaatatactgatggctgacatttcaataatagaatccagaaacgtatggaatacaatcttcaaagtcctaattcttgcaacaaaaaaggccaattttggaaggccatttgggattaaaacacatggctagcagatgacttgctgtcttacaaccatgatatcaaggacctgtttgtcaactaaactgtcattctcctgcttcacaataacttttcagagaactgcagagtgtgaagtagaggtaactaagatccaaggaaatactgataagagaatctatgctatattactgtgtgggatgctgcatagtcaagaaagtagactcatgagagtgcgcaagtgctcaagcctggtcagtttatctcattccaaaatctttatgtgagatgtctatcgactgggtaagtgtaaagttaaatttctacctcactccacagtccaaaagaatttattactggatggaaatcttgcaggccaactctaaggtgtcctctgataatctcattctctagctgcagtgacttctgacatcaactacctgggttaggccaaacttcccaggttaaaagcacaatcctccacaagactgccctcacttcagacacaagctgcaagcttaaggctacacagaccaccctcaactccagcgagctggctacaaatgtgtggagctaccatgactccctcaggtttaataacttgatagaacaactcagagaacccaagaaagtgctgtgtttacaattagcactttactattgcaaaatgacacaaatcagaatcagctaaaggaaaatatgcacagggtgaggtctgggaaggttccaaacacaaagctgctgactgtcctctcctcatggaatccttggtggcattacatcttcctgactacattgtgtaacaatattcaagagtacttgccagccagcgaggcgcacctaaactttgatgtccagagattttattgagacttcatgatgtaggcacagtttattgaagcattgcccatgtagctgagttcagtctccagttccctccccttcctgactggtattacatggctcaaagccacaactctctaatcacttagtgcgctttttggcatgggcagcccctatccagagtcatgtcattgccataaattatctagggatctactatgagtcaccactatacatatagatataaactatcaaatatgagtggcccaccatgaatgacagagacactcataacttgggtaattacaagggtttagaggttacctcccaggaacgaaaacaaaggctagccaaattctttattacactctaggtgttcctgcccctgtgcagtaccatcctcctgagtatgaagtggcctaaaagcttgtttctaaagaaaagaatacagcaaaagtgacaagatgccactttaagattacactctatatgacttccatcttgctagcagaatctgtcattttctagctttgattaaacaatttggcacataggggaggtgcatgtgacaaaaaactaaaagtgggctttgacaaacagacaggtagaaactgaggacctcaactaaactacctcatttctcattctggaaatgaatcctcccaacaaccacataagtgagcttagaactgcatctttccccatttcagccttcagatcagattccaacccagctaacaccttgacgacaacccccatgagagactgtgaatcaaagtagccaggtaagccatgcccttattcctgagccacagaaagtgtgagatttttttttttaagtgttgtttcaagtcactaccttttggagtaatttcttaggtattaatagacaatgaatataagatgtaaacttaagaagaacttatgaggccaggagtggggcacacatctgtaattacagtacttccagaggagagtttgagcccaggagtttgagaccaacctgagcaacatagtgagactctgtctctattctctacaaagaacaaaaaattagctgggtgtggtagtggatgcctgtggtctcagctattcaggaggctaaggcaggcagatggtggttgaggctgcagtgagccataattgtgctactgcactccatcctggggaagagggcgagtccctgtctcaaataaagaaaaaaaaaaaaggaataaatgaaaacatgttcatgatataagtaaaaagctttaaaaaaaatgacttctgcatgggaaaaaatattttgaacaagctaaaagagaagtaagactctagaaaaatatttgcaacatataaaagaatcaatatccagtcaagataaacaattataaatcagtaagaccacaaaaaaattaaatgaacaaagactaaagacactttatgacagaataaataatccaaagaaacaacaaagagatgagaaggatctgaacctcactggtgaatgggaaaatgcaaaataaggcaaaataatactggatcatctagatcatggaaaatacacaatttgataacatagtaagtgttggcaagatttgcagcactgaatgtttttgtgcagtgttttccaacactaacaaccaattctccaattatctaaacataaactagatgtccaacaattcaattcaattctgacactatctttgtcagaatccacagatttaagggttcaatcctacaagactgcctcctcttgagttcctctgcccggccgccccactgtctgggaagtgagaagcgcctctgcctagccgcccaccatctgggaagtgaggagcacctctgcccggccgccccacaccaccgccgccatctgggaagtgaggagtgcctctgcctggcccccgcaacgtctgggaagtgaggagcgcctttgcgcggctgctgtgcgaccctccaagtgtgaagtgacagccttgtgtgtgatctttctgccctccccaagtttgcattttcgacattaaagtttacttttcaattaaaatttttaaattggagaatatataatttaaaaaaaaaaaaaaaagactgcctcctcttaagatgccagtcacaagtcctgggctaccagtatttctgactaactggctataaattagaggctcccacaaacccctcctcaggtttgataatttactagaacagctcatagaactcaggaaacactttacctatggtacctagttaataatagaggatataactgaggaacagccagactgaagaaatgcatagggcaagatatggaagagggtgtgccaagcttccattcctctctgcgtgtggcatcctcccagcaccctggtatgttcacaaacctgaagcttgttcaagagtacaaaaaattagccgggtgtggtggtgggtgcctgtagtcccagctactcaggaggctgaggcaggagaatggcatgaatccggaggcggagcttgcagtgagccaagatcatgccagtgcccgccagcctgggcatcagagtgagacgccatctcaaaaaaaaaaaaagaaaaaaaaaaaaagaaaaaaactcacagcctgggcgacagagcgagactctgtctcaaaacaataataataataaataaaatttttttttttttgagatggagtatcgctctgtcacccaggctggagtgcagtggcacgatctcagttcactgcaacctccacctcccgggttcaagggattctcctgcctcagcctcctgagtagctgggactataggcacgtgccaccacgcccagctaatttttgtatttttagtagagacgggctttcaccatgtaggccaggatggtctcgatctcttgacctcatgatccgctcgggattacaggcgcgagcccccatgcccagcctgttcaagagtttttatagaacttactctccagtccattcctcctttcagttccaatcctctaattgcttggtctttctggggaccagtctcatcctgacactatctagaggtctcatgagtagtcacctcatgagcagaaattcaggtgtatcacagggtttccttatgaataacaaaagacacacctatttctcaggaagaaattccaagggttttaagcatactgtgccatgaactgggaacaatgaccaaatatacttatccgtgtcactttctatataccagactgtgaaaaataaatatacatttggtctctgccctccaaatctttggaattgctgaagtgtcttttatatgctattgagatgactggtgcctggggctcttccatggcctcaggaagggagctggttgccaggggaaccaaccttgtgacagacagttggaactttcagtctcacctctccaaccaacccctgacctctgtggaagggagaggtgatggaaattgagcttaccaccaatagttaatgaattaataaattatgcctatgtaatgaacccaccaaaacaataaaaggatgaggttgagagcttccaggctgctgaacatagggtagtcctgggagggtagaatacccagaaagggcatggaagccctgaggcccttccccattacctgacctatgcatcttttccaactggccattcctgagttgtaccctttcataataagccagtaatctagtaagtaaactgtcttcctgcattttttgagccttctagcagatgaatagatctgagaagggggttgtggggacatccaattggtagccaagtccaaaagaacttgtgagtaacctggggacccagcacttttcaggggggcagtattgtgggactgagccctcaacctgtggagtctgtcctaagtctagacaattagtgtcagaattgagtaaattttagaatacctaataggtatggagaattgaattgatgtgtgggaaaaaccccacatatctggtgtcagatgtggggaaaagaaagagagatcagactgttactgtgtctatgtagaaagaagtagacgtaagagacttcattttgttctgtactaagagaaattcttctgccttgagatgctgttaatctgtaaccgtagccctaaccctgtgctcgcagaaatatgtgctgtgttgactcaaggtttaatggatttagggctatgcagaatgtcctttgttaaaaaagcacttgaaggcagtatgcttgttaaaagtcatcaccattctctaatctcaagtacccagggacacaacacactgcagaaggccacaggggcctctgcctaggaaagccaggtattgtccaaggtttcttcccaagtgatagcctgagatatggcctcgtgggaagggaaagacctgaccgtcccccagcrtgacaccgggggatacccgtaaagggtctgtgctgaggaggattagaaaaagaggaaggcctttttgcagttgagataagaggaaggcatctgtctcctgccaactacttgggaggctgaggcaagagaatggcgtgaacctgggaggcagagcttgcagtgagccaagactgcgccactgcactccagcctgggcaacagagcaagactctgtctcaaaataaataaataaataaattagtaattttaaaaaagttggttggcaggcaccagcatgcaaagaatgccaatattccaaaaatggtctggagtatgtacattaaaatgacaaccatagttccttcttgagtggtgggtgattcatgtatcattgtaatggtcaaaagttgaactaccaacaaagcatggattctttcatattgagtctacttttttttccttctttttgagacagggtcttactttgtcacccaggttggagtgcggtggtgcaaacatggctcactgtagcctcgtcctcctgagctctagcaattcttctcccaccttagcctcccgagtagctgggattacaggtgtgcaccaccacacccagctaatttttgtattttttgtagagacggggtttcaccatgttgcccaggctggtcttgaactcctgagctcaagcgatccagaatctacttcttaaggcagaatgaacccccacctctactcccaaaagcaatgtaagttaatttctccctagaacacaattatcccagtatatacttccttaagttcaactgacttcttcaggycaccataaatctatcaaaaaatcaaagggaaaatatcacctgggtcttgatcattttcttctgtgmtcagaaaatagtggataacatggactatacgtctttgtctcttctgcayttgccatgaagtttytgaagttttcctagtcagaaatattagtgtccacttaaagttgtccccagaaattatgatatccaaggccagcaacctccttcttcttccttcattgcttcacttgagttattttgcttctgggagccaggacctgaggactgataaacaaaatggctttcagtgtacattaaccctgggtccagacattgtcactgctgctctgcacttaccttaaataaaagaccctaatatttctaacagttcctttatttgctgcctcagaggttttcatggttctaaatgtgtgaaatctatgcctttcttttgtgaagtagaagtggcatgactattatagagaaggtgggaaagcagaaccagcacagcacaatgcctcagaggcaggtgtctggggaaaagaaagagagatcagactgttactgtgtctatgcagaaagaagtagacataagaggctccattttgttctgtactaagagaaattcttctgccttgagatgctgttaatctgtaaccctagctccaaccctatgctagcagagacatgtgctgtgttgactcaaggtttaatggatttagggctgtgcaggatgtgctttgttaaaaacgtgcttgaaggcagtatgcttggtaaaagtcatcaccattctctaatctcaactacccagagacacaatacactgcggaaggccgcggggacctctgcctaggaaaaccaggtattgtccaaggtttctccccatatgatagcctgagatatggcctcgtgggaagggaaagacctgaccgtcccctaccccgacacctgtaaagggtctctgctgaggaggatcagtaaaagaggaaggcctctttgcggttgagataagagaaaggcatctgtctcctcctcgtccctgggaatggaatgtctccgtgtaaaaccccattgtctgttctatttactgagataggagaaaaccgccttagggctggaggtgagacatgctggtggcaatactgctctttattgtaccgaaatgtttgtgtgcgtgcacatcaaggcacagcacgtttccttaaacttatttatgacacagagacctttgttcacatgttttcctgctgaccctctccccactattaccttattgtcctgccacatccccctctccgaggtggtagagatagtgatcaataaatactgagggaactcagagaccagtgccagcgtgggtcctccgtatgctgagtgctggtctcctgggcccacttttctttctctatactttgtctcttatttcttttctcagtctctcatcccacctgacaagaaacacccacaggttgtggaggggtggcccccttcaaggtgaattctcagacagatcaattttaggaaagagaacacatggaaggctccaagaatgtctttaaaaaccacgtgtgcccatgtactggttcgaaagtctctgtaagctctttgggtatacatacctcgtgtcaagaccaatgtactaagcaaatcacaagaactgtctcatttcacattatgcgctaaaggagtaactttacccaagagagctttgtcctttgcccacagttcctatgaggcaaactctaagcctttggaatacgctgcttgataaaactgtctttggttatcagggcaatttaagccatgccaaattgtctatcctaataatgtgatttactgtgggagaccttggaccacgtggtattagtttgatatctggaggagctggagattgaagtcagcctcataggcagtcaattgtgtgtgtgtgtgttaactgatatccaataaaactctggacaccaaggcctaggtgagtggcaacaatggttacaatggctggcaataataatataagggtgtatatataagaatatgataatttaaaaacgtatgaagcaaaacagaatgagagaggattagacaattcaacaataataattgaagactacattaccctacttgcaataataaagaaaacaaatagaaactcagcaaggataccgaaaacttgaacaacattatcaaccaactagacttaacgaacatttaacactgcactcaacagcagtaaaataaacatttttttcaagagcacatgttatattcttcaggaaagataatatcccatgtgatagcctgagatagggcctcatgggaagggaaagacctgaccgtcccccagcccaacacccgtaaagggtgactcacaagggccccagacccagacagagtcggactcgtcgctgatttcctcagactcttcatccctacagccaaaggacccgtcattaacgccccgcttcctcagcgactgcgttcaaatacagccccaatcaggacgctccacgcaccatcggtacacagacccacaggccgcgagtccatgcccagaactcgactcacccgagcccgaacctctccagacaccactggcagcgacaaaacgccgcatccacgtccgaaaacgcttcctattcagacgcgctcctgcgcggactccgggaagctgagcggtaaagaccgtgaagcgaggcgaggaccacggagcctgcccggratcgcgagttcagactgcgggcgccgctctatgaggtcacagggytgcgcccatcgcagcgtttctgacaggagcggccataatggctgtgggaatcactcttagtcacctcagtgcctttctctcttcgttgcaagggacactcaagagtcgggtgcccagccaaggccaacacggcgcagtggcattctattcagcctgctgtggaaaaaagatggcggcgccctttgtgcccattatagctgagagtggagccttagctggagcaccatgggcacggccatcttagaggaaggcagcagccgtacggcagagaagatgctcatatccaggacaatttggaaaaataaacaaggtttgaagaagtcacggtgctggccaggaagcggtcacagagttgccaaaaccagtggtcactgaaagtgttagatttggggatagggcgggggttctgggctgggtaaggcttttgtgggttagattagactctgactgaatggacgaagccgagaacaggagtgatgctccattaaatgctaatacccacatggggcttgctattaaaaccactgccagtggggaaggggatgaggaggtgaaggtgcaactgtgttaatatctayatgtttccttccagaagtaaaggaagatgacagtggggcacttaagaatatgaaattattagaatgcgatcatcctactttgcaatgtttccagattttttaaaaagtcacacttaaaaaatattagttctatttttgcagatgttggcgttgtaactgtagaagatttaagtaaatattgtatttttggaaggcaacctagagccaatttaattttttcgttttctttgacacagcaattctaaaagctatctaggcaaatctgtcttaatattaaccacaacttttgtaatttacaaaaaaarggaattacaatgagagatgaatactttggtaaattatggaacatctgctgaactgtaagagtatatatcaatttaaaagaatatgctacaattgttttataaaaaagaaaactttgtcagaggacaaaaaaatgatctgcaggatagtatatattttatggtcttgttattggaagaaatcataaacatcttttggaaaattgtgattggttaaacaagacatttagtttgaattaatattgtttgtgttcataggtagagaatgccatgtttttacttgaaaaatattcccaatttatacttaattttactatctttgtaccataatcatgaatatattataaaacatgttgatcttagaaaataggtatgatgatgtataataagttcatggcatgataaatgcaaaataggctgttttctttcagaaaataaatatgctcatgcatttgaaaaattctggagaatatactaacaatatttgactgttccgtacaattatggtgacttaaaatttcttcattttacttacgttttgtaatttctagagaataagaatttcatgttcgtatttcttgagtgttataacatattccatccaggattaaatttcagccccgttcatctggaatgttaatctctggtaggtaagtttagcacctggtccacaggactatgagcagcccatgatgggaccttcactgatcatttccaggagtgggctgataaaactttgccgtggcaggctgtgctgattcacgggacaaggaaggtgattcaagggcctggttggtggagcacttttgtctgattcattgctggagacaatctgccctgaatccatcctgttacagtgtgggaatggtgatgggagcaccaatccacaatttagggcagagatgttcaaatttaagaaggctctttttataaatgcagagtccgaaccccatccccagaaattctagcttggaatgtctggggagtgactcaagaatttgccttcttttacaagcttctcagagaatgctgaggcaggaaccccaaagaaaacacttagaaagttctatagtgttctggacttaaaaatatgatggctgtgtccccacagtatatttaggctttggttcaaattatatctgcacagaaaagcctatcctgaaaactcttcctaaaataactcaggttacaatctatgaacttaccaggctttatatttcttcctagcacttaactgaattcgattttgtatttatcttactcagtctccttcaccagactgtatgtcatatcaaagccagcactttgcctgttttgttcattgatgtgtctccattgcctacaacatgcctgccatggtgtagaagctcaaaaaatattttcaaagaagtaaattactcaatatggagtcagggattgaattctgccacaatactatatggcaaatgtctattacttttataaagagaactcaccatttataaactggattaaatctcattagatcaagggaaataactctggatagagaaaacaggaaccctgtttctagggaaactaataattttttgccaccaggcctgctcaaagagaaatgattaaggaagttcgcacaaaaaggaaataactaaaggaaatattacatcaggaatgaagaaaaaggaacagaaagggtaaatatattataaaatataatattcttttgagttttaaacattgggtttgctggttggaagcaaaagttacaattttacttgatatggttctcagtggatgtagagatgcttaatatcattttgtgttaggggtgtgtaagttgaggccatgatcatataccaccacacacctaataggaaagctaaagcacactggcaatgccaagagctagaaagggcatggaatgcttacacattggtggtgggaatgtaaactagtacagccactctgggaaagagtttggccatttcttataaagttaaacacatttaccatattcgccagcagtcatgcccccagtgtctatcccaaatatataaaaacttaacgttcgcacaatatcgggtacacaaatagtcacagcatctttatttataacagcaaaacactggaaacaacccaaatgtccatcaacagtgaatggatacacaaaccctggtgcatccatttaaaagaatactaactcagtaacaaaaattaaaactatttagacacctaacaacttggatagatcttaagggtaatttgctgagtgaacaaagccctatctcaaagcttgcgtaccttacgattccattttaatagcattcttgaaataacaaaattagggtaatgggatcagtggctaccatgggtcatattgggaggacagtgtgagtataaagaggtagcaagaggaggccaggcgtggtggctcatgcctgtaatcccagcactttgggaggctgaggcgggtggaccgcccggggtcgagagttcaaggccagcctggccaacacagtgaaaccccgtctctactaaaaatacaaaaattagtcgagcgtggtcgtgggtgcctgtaatcccagctacttaggaggctgaggcaggaaaatctcttgaacctgggaggcggggttgcagtgagccaagatcgtgctattacactccaacctgggcaacaagagcagaactccgtggtttttattattatggttatgtaagataacattgatgatgctaagcaaagaatactcaggaaacttttgtatattttgtaatctcttgtgaatctagaattatttcaaaacaaattttagaaaaataacatttaaggcatttttgtaaactacataatggtacctagtaacttggataaacacatccaaatatactgaattacatttatcagtaaattgaaaaaaataaatttggggcctataatatgtaagaactaataaataacaccagattggcacagaaaacacctgtgttatatataggattaaaatttaatcagtgataagaacagcccgctttacaattatggaatcattgataatatgatgcaaggtatgctgtcacagaatagatatcaagtgtatcatgagtttagatttgtgacagtcctcaaatatggttttttttttttttttttgaggcagagtttcgctcttgttgcccaggctggaatgcaatggcgcaatcttggctcactgaaacctctgcctcccaggttcaagtgattctccagcttagcctccagagtagctgggattacaagcgtgagccaccatgctcggctaattttgtatttttagtagagaggggggcttcaccatgttggtcaggctggtctcgaactcccgacctcaagtgatccacccaccttggcctcccaaagtgctgggattacaggtgcaagccaccatgcccggcattatgtatcattttcatgagacttttttacttcatgaatttcctgatcctttttaaagttactcttcatataagttttatttctgtatgaagtaatgatgatgaggcagcatgtatcactgaaatcctcgtgtattcactgccatctgaaacttgttctccagtatgaaatatatctgccaactgttaaggttttatttctgggcaaaggctttcccatgataatgctgctagtatgtgtaagttcattgatgatctattatgatcactgaagagatagggtctttcttcccatagaaggctttcctagcctactcctttgtaagatttatctcagtaaatacttttcaagacatagttacttagaaaattttcaagacttttctgcattggatgtatcaagtttatttcctacatgtttattgtgacataaaatatgaggtaattaatcaccgaaggcactagtgcattctctgcattcattaaaattcgctcctggaaattgcattgtcttccaagggtgaaaatctagcaacaggctgctctacactgcctatatgcatgtatgctaggagcacactgctgtttaatcagttcacattactaacgtggttttctctctgcatgaatttgtttgtatgtaatcagttcagattctctgcaaaaggactatgtaccttacacatttgtcatgtggacgttgtcatagttttaatgaaggttgacaaatgaaaggttacccccaatccacagactctctctcagatgagtaattttctatacattggtacatcaaagaattcagagcctgaattcatgttgaagcctttctgacattgatagcattcatcctagtgaataacactggattttgaaatatgatttttcatactcagtacacatgtagaaaatctatactgtgaaatctctgatgttgtacaaggcagattttcttcccaaaggcatgaacatgtccactgcattgtcagggtttgtttccattatgagttcgctgatgtacaatgagatttctctttgaggagaaggcttttctacattcactgcatacaaagggtttctctcctgtatgagttcgttgatgaacaattagacggctcttcatagtgaagcctttaccacattcattacatccataaggtttttctccagtatgaacttgcttatgtaaagcaagctctgtttccttggcaaagcctcttccacattcactacatatacaagatttctcttctgtatgaatttgctgatgtacaatgagatagcgtttcatggtgaagccttttccacattcactgcacataaagggtttctctccagtatgagttcgctggtgtacaacaagattgctcttaaaggcaaaaccttttccacattcattgcatatgtacggtttctctccagtatgagttcgctgatgtaacatcagtccgctattcacaatgaaacctttcccacattcactgcacctgtaaggtttctctccagtatgagttcgctgatgtacaatcagccgactcttcaaggggaagcctttcccacattcactgcatgtgtagggcttctctcctgtatgagttcgctgatgtatgatgagcatgcttttcacagtaaaaccttttccacattcactacatagatatgacttctctactgtatgatttctctgatgtacaataagattactcttcctgggaaagccttttccacattcactgcatatgtagggtttctctcctgtatgagttcgttgatgttcgatcatacggctcttcatggtgaagcctttcccacattcattgcatatatatggtttctctcctgtatgatttcgttgatgtatgatgacatagtgttttgtggtgaagcctttcccacattcactacagatgtagggcttctctcctgtatgagttcgctgatgtataataagcatgctcttcccagtgaagccttttccacattcactacatatataggatttctctccagtatgatttcgctgatgtacaatgagattacgcttgcctgggaagccttttccacattcattgcatatgtagggtttctctccagtatgagttcgctgatgttcaatcagacggctcttcatagtgaagacttttccacattcactgcatataaaagatttctctcttttatgaattctttgatgttcatttagcctggactttctggagaacacttttgcacacaaagtacatccataaggtttttctcctgtatgaactctctcatgatcagtgagctgagacttcttgacaaacgctttcccacattcactgcatacgtggtttttttctatttcatgagttctctgatgcttactgacttgggatttagtgct

SEQ ID NO: 12307 - DNA, 13287 bp, Homo sapiens
ggaattgaacaatgagaacacatggacacaggaaggggaacgtcacacactggggcctgttgtggggtggggggagtggggagggatagcattaggagatatacctaatgttaaatgacgagataatgggtgcagcacaccarcatggcacatgtatacatatgtaacaaacctgcacgttgtgcacatgtaccctaaaacttaaagtataattaaaaaaaaagaaaatgtgcttaagaaggcagtagctgaaaatggaaagaaagaaaaacactatttgccgtcttcaaagagtttgatcaatgctaaattaaataatggaaaatcaagtgcaaaatttttatcaaatacaaccagtagcatttttatagagttttttttttgtaatgggaaattcaaaaacatagattctaaaaactaaaaaaaaaaaaaaaaaaaaaaaagacgggataaaaaataagatagatttcatttcaggggccaactccaactgattggtggtggctgcccagaaagctctgttgagacacattgtgaagccacatctggactcagcagggagggcaatgatcagctagggaggtgtatcaagggcagagtgatagagtggtatcctatgtgtgtcccattgatatttcacctaatagttgtataaccctgggctaggaagacatccctctcccaccagcttgtattgaggattaccaaatgaatgtaaagtacttagaacagattattgcacttagccagtatctgataaatgttaggctctggaaaaatgtctgttcttttttggaagatagggtgctatagttctaaaatcaaccaggaacacattccttgttctccttctacctctctcactgctccttctcagtctcccttcccttagcccttctatcttagtgctttccagaattcttcctctttgattctctttgatctttacttgtgccacactaatcactgactggtttcattctcaaccatagcaacctcatatgccaatgattccttcccagccccatccaagccaggtaaaatgcctccccttcatctgcatagcatgcacgtagcattggactctaagtattccaactatttgtttatccatctatctctgctactagaccatgggctttcaaaggacaaggctagatcttattgatctctgcactcccagcttctggcacatagtagcaatcaataaatgtttgtgaaatgaaagactgatttaatgaatggtgtccttattttgcagaaaaggaaacagactcagaagttggatttttctgaaggttgccttttctccaaaaccttcccatctttcctatagaacagggattgacaaaaattctctgtaaagggccgatagtaaaacttctgtctttgcagatcataaggtctctgtcacaaccactcaactctgatgtaactgtaaggcagccatagacaatgtgtaaacaggtgggtgtggctgaattgcaatcaaactttaccgcaaaaacaggcagtgggctggatttggctggtggatccttatttgtggaagcttgctgtagaagatgataaatagacactcttgcatgtctagtttctttttctttgttgaacattctcttgttacctagcaaaagcagctcaatgctcagtgtgttagaagccaatactatgatactgggtgtttgagaagagaatggcttttattacaagttgacaaatgagaagagaggagtccagctcaaatctgtcttcctgtgctggcttcaaggcagtaattgcattagaaactgtttgggagtggattctgggattagccgctggtgattggtggaaggaaaggggaggtctggaaggtccttgggcatgcacagttaatgctttatacttcctgatgggaaagtatgcagcggaaattcaggctatgatgtcagcaagctcagtccattgccatattggttccaactgatttcagatagttttattattttataagtggaggaagtttcagagttctttctcccctcctcccctcctcccctcctttttcctcccctgccttcctctccccacccttccctgccttcctctccccactctcccctctctccatctctctttttctcctggaaaccttccatcaacgtttagtcatgcatagctctaccatcttgaaagtaagtctctcctcctccaattgttgccctttctctcgctctacctccttcacagtcaaagttcctgatagggttctgtgttcactgtctccagttcatcattccaataatttctcaactaatgacaaatctccttctcttccattatattcctgaaacgttctccttgaagatcccaaataacttcctatggtgctacatccaactcagaattctttgctctttactaaatctctggcactcatcaaccctattgaaatgaaacattcttttccgtggttcttgtgacaacatgatctcctgattttactcctgtggtcattctcctttaggcttctttgttggctttgtagacctacaaagaagcctacagaagaatgaccataggaggaaaccatgcccccaacactctgaagatacagatttttaacaactaactctgcctatttgttaaaaaactgtatcttcagggttctctgctaggcccttgactcttagtctacatactcccctaggacatatcatctcatctctaggcctttttttttttttttttttgagacagggtctagctctgtcgcccaggctggagtgcagtggctcgatctcaccttattgcaacctccgcctcccaggctcaagcgacccctcttcaacctcagtcttccaagtagctgagactacacgtgcacgccaccatgcccagctaatttttgtattttttgtagagacagggtttcgccatattgcccaggctgctcttgaactcctaagctcgatacccctgccttggccccccaaagtgctaggattacagcataaatcacctcactgggccatctctaggcaattttaaatctaatgatgatcctcaagtttatttttccaacccagagctcattactgaggctagaatcagctggccaattgcctaacagaattagaaatcacccctcttaaccttactcaccacatccagttccatcttgaaaaaataattatcttggccgggcgcggtggctcacacctgtaatctcagcactttgggaggccgaggagggtgaatcatgaggtcaggagattgagaccatcctggctaacagtgaaacccgtctctactgaaaatacaaaaaattagctgggcgtggtggcaggcacctgtagccccagctactcgggaggctgaggcaggagaatggcgtgaacccaggaggtggagcttacagtgagccaagatagtgccactgcactccagcctgggcaacagggcaagactccatctcaaaaaaaaaaaaaaaaattatctcaacctcaccaccccagccagctttcacctatttatctgccccatttgcagcaaaacttcttgaaaaacttgtctatatttactgctccaattcctctccaactctttctcttaaactccctccaagccggctttcaactcgacagctccagctccactgaaacactcttgtcaaagtcgcccatgacttctgcattgctaaaaacagtggataatcctcagatctcatcttactttgatctttcagccacagttgacacagctgatggcatttctgcttgatacccgtccttcacttggccttccagataccaccctcttctggttttcttccttcctcactgactttccacctcagtcttctttgctcattcctcctcctcttcctgatttcttaatactggagtgaacaaaggcttattccttggccttcttgtctacaccctttgagtgatctcatccactctcaagccttaaataccacctgtatgtctatgactcccaaatgtgtatcttcatcccagacctgtcttccaacttctagtctcttagatccaactgcctattcaacatctccactgggatgccttgtaagcttctcagatggagttaaaattgaatttcagttccaaacacctcttccacccatagcctcccacagtcaactgtttgggactggaatgagatggtaactcattctccaagttgtgcaaatgcaaatctttttatcatcatatataaaagttgattccctttgaatcctttagtaagaggactctatggtttttctatttatgcttttttcaagagggttcatagatgccaagtttaaatagggcaagtttaaaatgtctcctattggccaggcatggtggctcacacctacaatcccagcactttgggaggccgtggtgggaggatagcttaagctcaggagtttgagaccagcctgggcaacatagtgagacctcatctctagaaaaaataaacaaaattaaacaggcatggtggtgcgtgcctgtagtcccagctactcaggaggctgaggtgagaatattgcttgagccctggaggtcaaggctgcgatgagctatgaacatgccactgcattctagcccggatgacagagcgagactctgccttaaaaaataaaaataaatgtcttctattgcctttatccccaaaggacatttatactttctttcccccacaggtttgcagaagttgctccaagattgcctgggaatgagtgttgcattcattcttctttctttggcttctccgtttgtcttttggtttgttgaatttcatgactgaagtatttgggttttgtttggttttggttttggctcttgtcttattgaattcatgtttttaacaatttcctctgcagcttgaagcaattgcaagaaacttttcctaggttccttgggttattgtttcttgcagtctttcctctgttttatgcctgccatgcttatttaagtctttgctttcattgtattcttctgcaaaatgcttgcttagtaaccatattgcttcttttcatcttgctcatgcttcaagcagacagctctgtccagttcttcttttggctctgacaaaaagaagagtaattatcagtgaaaccctcccaaccttacctggggtcttttttcccttccagatactattttaatgcaaggggacaggaacttggaaaaagcttggcaaactttctgcagcctttggtatagtactgggcttaccctctcttctaaggttttggtaatgtccagtttggggtactccctttctccctcttctcatggagtgggagtattctcagacttcagatcagtccccggattcagcacggggtcctgggagatggtaacactttggggcttttcctggctcaacttgtattgagccaggaaatattgaaaccacacataggagcctctgcacttaagaagatttctttgacttttttctaagccccctattcccaactttgtctgcttctatccaaatcgggggtatttggtgagaattttcaaggttttgagactcacttacttttgtatcattctgtaggaagaggggctacattaagtcacactaaaatctcctgcttttcttcttgttggatacttttcagtttatagcaagaggatcgcctctttccttgtgtacttgttactggtaatttttttaattggtttatttcattgaggattggaggagggtgattctggaagcaaaaacaaatatagatagatagatagatagatagatagatagatagatagatagatagacagacagatagatataccgtcaatttttttctagcatccttagggacagggttggcgtgagggagatgaaatgcagtgacccccaccagaccccagaagcacccagcttcatggcagagacagtctgtcctcagggggcttggcattttttttgtaaagggtacctgcccactatacttctcattcaatctttctgctgccctttgttttctcagcaaggagtaatgctgcttttcacacagaaagggcttctactgtgcctgaccttaagacaggaaaagtaggggagctaaggaagctacctacaccrccctcacccccagtagccaggctcaggaaggaagaggcacagcggtgtgaatggatggagaagaggaggcyggtaggctgagcccctggctcctggaaygaacacacagccatggcaggtaggaaatctgggctccaacagtggccctgggctggagcagtgaaaggatgaaggtgaggtgtggttggggatctgcaaatctagcctctctcactactaaacaaggtttacagttcccagtggtagaaagaccacatctcaaggaggaatgaaaacacaggamctgagcatttgtgcttggaattaataagcaaatcccatcaaacccttgacatcatggattttggcctcagaaggcagaaaccttgaaagttccagtgacaacccctgtgcccctcatcttcaggctcgtctctstggtggattgccacctgcacagcgccctggcatttccatgcacaaaataattggctgcagaaagttgtcagatgccttgctgtgggaggaaactacaaaaacaaactttattccatcaactcaaattgtttttttatatttcaaatctgagagcactggttcaatttctrtttgtcttctccatgatatgcaattgtcctttgctgtatgaccaaaatgagttaaatgaaaatagttctgtatatttagtagttaaatagccatttgcttcaagatttttggatattttatgtttctttccatatcatttctgtaaagagcataaaattctccagatttctttgaagatggcactgaggcaccaatgacccaaatatgtagggttagaagagctgtgacagctcactaacaatagctaaactttactgatattgctaatattcattttaattagtcaatattaatatacctaaactaagtggaagcactgggtttatattatctcatttagtcctcacagcaaccatattgttattattatctctattttacagaggagaatgtggcttgaataggttccatgacttgtacaagaccacagctggtacatgatgaagcaaggacaagacacgggcatctgacctcaagagtctctccaatcatgaaatacctgtatgagttatctattgctgcataacaaattgccccaatatttagcagcttaggagcaggattgctggaatggtgggataaaacttagtggcttaaaacaacatctgttatctcacagtttctgtgggtcaggaatctgtgcatggcttagcagggtgactctacctcaccgtctctcatgaggctactatcaaggtgacaggcaaggctgcagccatctcaaggctggactggggaagggtccactcccattctctctctttggttgttagcaggatttagtccctcactggcactaggccagaggccaccctctgtcccttgccacatggaccactccccagggcacacacagcagcttgctttctcagagcaagtgaacaagaagaaccagagagaaagagtgtgcaaaatggaagtcatggtcttttgtaacctaattttggaagtgacagctccttactattggcagagttgattcattagaagtgagccaccaggtccagcccttactcaaggggtagtgattacacagaggtgtcgataccagtaggtcgggatcattgggaggcatttcagaagccgcctaccaccgcgcctttctcagacaactgcccaccccatcactcccaggggcaggctaaatggtgtgcttgtgttctgtgactgtgaccccccaccgcccccagccacagctgactggaccagagacggacacctgatccaaactaggccaattagattctctcccccaggaattctgaattgcaattcagagaccctggttggtttctgctagaggtttgaaatgaaataattgggagctttgggacagccattttctgctgtgttcaaaaataagtagagatggctggataggagtgtgagagagagagagaggcatagagacagagaggatggttgtggttcctcccctgggtttggaaaggtacaataaaaactaggtttctgtcacatgcaaccagcggtgatatttccattttttttttgaatcagtaattttgccccaggagagattttgaattgaagtatatagtatatgttacttttttaactaaaggaaaaacagatatatatatatatatatatatatatatatatatatatatatatatatgcaatgataattcttttttcaaagctttagatgaattaatgttaacatttaacaaccaataaggtccaaataccaaccaatccagaaggagctcaccataaatagctggtgtggtcccactgctgaatgctgggtacccaccagctgtctgccatctcaaggccactgcaatctggcctcgaccacactgcagcccgaaggcaggcaggctggggaaaggtggggcctgagaacctcagatcaccagcagtgagtcatggtggcgtagcacagaaacctctgtatgattgcagatttgctctgtaacccactggggtgtcagtatctgtggcagacaactcacagtggaggcttttgagacaatgtccagtgcttttctggctcactcactgtgattcccggaagaacacacacgagtatcctagacagggatgaaaagcctacatctgatatgagtgagaagaggctggaaagagccacctctgggtggtgggatttaagaaacttgccacttcctctaaaacaggacctgcaacctgggtctgtggatagtaaagcccttgatctttttttttttttaattatactttaagttctagggtacatgtgcacaacgtgcagatttgttacatatgtgtacatgtgccatgttggtgtgctgcacccattaactcgtcatttacattaggtacgtctcctaatgctatgcctccccactccccccaccccacaacaggcccgggtgtgtgatgttccccttcctgtgtgaacaatgagtccaagtgttctcaatgttcaattcccacctatgagtgagaacatgtggtgtttggttttttgtccttgcgatagtttgctgagaatgatggtttctagcctcatccatgtccctacaaaggacatgaactcatccttttttatggctgcatagtattccatggtgtatatatgccatatttacttaatccagtctattgctgatggacatttgggttggttccaagtctttgctattgtgaatagtgccgcaatagacatacgtgtgcatgtgtctttatagcagcatgatttataatcctttgggcatatacccagtaatgggatggctgggtcaaatggtatttctagttctagacccttgaggaatcgccacactgtctcccacaatggttgaactagtttacagtcccaccaacagtgtaaaagtgttcctatttctccacatcctctccagcacctgttgtttcctgactttttaatgattgccattctaactggtgtgaggtggtatcttattgtggttttgacttgcatttctctgatggtcagtgatgatgagcattttttcatgtgtctgttggctgcataaatatctcttttgagaagtgtctgttcatatccttcgcccacttcttgatggggttgtttttttcttgtaaatttgattgagttctttgtagattctggatattaccctttctcagatgagtagattgcaaaaattttcttccattctgtagattgcctgttaactctggtagtttcttttgctgtgcagaagctctttagtttaattagataccatttgtcaattttgaccttttgttgccattgcttttggtgttttagacatgaagtccttgcccatgcctatgtcctgaatggtattgcctaggttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaatcctttccccaacgcttgtttttgtcaggtttgtcaaagatgagatggttgtagatgtgtggtattatttctgagggctccgttctgttccattggtctatatctctgttttggtaccagtgccatgctgttttggttactgtagccttgtagtatagtttgaagtcaggtagcatgatgcctccggctttgttcttttggcttaggattgtcttggcaatgcaggctcttttttggttccatatgaactttaaagtagttttttccaattctgtgaagaaagtcattcgtagcttgatggggatagcactgaatctataaattaccttggacagtatggccattttcacgatactgattattcctatccatgagcatggaatgttcttctctttgtttgtgtcctcttttatttcgttgagcagtggtttgaagttgtccttgaagaggtccttcacatcccttggaagttggattcctagggattttattctctttgaagcaattgtgaatgggagttcactcatgatttggctctctgtttgtctgttattggtgtataagactgcttgtgatatttgcacattgattttgtatcctgagagtttgctgaagttgcttatcagcttaaggagattttggcctgagacgatggggttttctaaatatataatcatgtcatctgcaaacagggacaatttgacttcctcttttcctaattgaatgtcctttatttctttctcctgcctgattgccctggccagaacttccaacactatgttgaataggagtggtgagagatggcatccctgtcttgtgccagttttcaaagggaatgcttccagtttttgccccttcagtatgatattggctgtgggtttgtcataaatagctcttattattttgagatatgtcccatcaatacctaatttattgagagtttttagcatgaagggctgttgaattttatcaaaggccttttctgcacctattgagataatcatgtggtttttgtcattggttctgtttatatgctggattacgtttattgatttgcatatgctgaaccagccttgcatcccagggatgaagcccacttgatcatggtggataagctttttgatgtgctgctggatttggcttgccagtattttattgaggatttttgcatcaatgttcatcagggatattggtctaaaattctctttttttgtcgtgtctctgccaggctttggtatcaggatgatgctggcctcataaaatgagttagggaggattccctctttttctattgattggaatagtttcagaaggaatggtaccagctcctccttgtacctctgatagaaatcggctgtgaatccatctggtcttggactttttttggttggtaggctcttaattattgcctcaatttcagaacctgttattggtctattcagagattcaacttcttcctggtttagtcttgggagggtgtaagtgtccaggaatttatccgtttcttctagattttctagtttatttgcgtagaagtatttatagtattctctgatgttagtttgtaattctgtgggatcggtggtgatatcccctttatcattttttattgcgtctatttgattcttctctcttttcttctttattagtcttgctagcagtctatcaatttcattgatcttttcaaaaaaccacctcctgtattcattggtttgttgaagggttttttgtgtctctatctccttcagttctgctctgatcttagttatttcttgccttctgatagcttttgaatgtgtttgctcttgcttctctagttcttttaattgtgatgttagggtgtcaattttagatctttcctgctttctcttgtgggcatttagtgctataaatttccctctacacactgctttaaatgtgtcccagagattctggtatgttgtgtctttgttctcattggtttcaaagaacatctttatttctaccttcatttcattatgtacccagtagtcattcaggagcaggttgttcagtttccatgtagttgagcagttttgagtgagtttcttaatcctgagttctagtttgattgcactgtggtctgagagacagtttgttataacttctgttctttacatttgctgaggagtgctttacttccaactatgtggtcaattttggaataagtgcaatgtggtgctgagaagaatgtatattctgttgatttggggttggagagttctgtagatgtctattaggtctgcttggtgcagaggtgagttcaatccataattatcagattcaccaaagttgaaatgaaggaaaaaatgttaagggcagccagagagaaaggtcgggttacccacaaagggaagcccatcagactaacagcagatctcttggcagaaactctgcaagtcagaagagagtgggggccaatattcaacattcttaaagaaaggaattttcaacccagaatttcatatccagccaaactaagcttcaaaagtgaaggagaaataaaatcctttacagacaagcaaatgctgagagattttgtcaccaccaggcccaccctacaagagttcctgaagraagcactaaacatggagaggaataactggtaccagccactgcaaaaacatgccaattgtaaagagcattgaggctaggaagaaactgcatcaactaatgagcaaaataaccagctaacatcataatgacatgatcaaattcacacataacaatattaaccttaagtgtaaaagggctaaattctccaattaaaagatgcagactggcaaattggataaagagtcaagacccatcagtgtgctgtattcaggaaacccatctcatgtgcagagacacacataggctcaaaataaagggatggaggaagatctaccaagcaaatggaaaacaaaaaaaggcaggggttgcaatcctagtctctgataaaacagactttaaaccaacaaacatcaagagagacaaagaaggccattacataatggtaaagggatcaattcaacaagaagagctaaccatcctaaatatatatgcacccaatacaggagcacccagattcataaagcaagtccttagatacttacaaagagacttagactccca

SEQ ID NO: 12308 - DNA, 13449 bp, Homo sapiens
attcaagtttaaagtcccccaacaactttaaaaataggggagtgtttggcaaagcattccaaataaatgaccctcagctctggaatttgctccttctagcaggctgctctccttagtagtcagccaaaccccaaatctggcagcttttaaaatagggtgcaaaaaagattctttttaaacctgagagtcactaaagatttattttactggaaagacatgatcgcaaaaataacaagcaattattgttactgcaccaagtagaatcagatatctgcaagagagattatgaagtcaagagccacccttctttgctcattctgcagatgaagaaaccaactctcaaaaagatgaaattatttcctcaagtcacacaacctagtggcagggcctggtgtcatgagtcatgggccagttcttacaccatatcctctgagaatgacatggatgatttcttccttgtatcatacttggttattcacaaatgcaatgttcttgcaaatgttaatattataatctttggtaactgtagcaaataatcgttgaattattttgtaatttttggtgtgcaacatcctttgcaaagtcctaaatttcatacaratgtgaaagctggttgcgctactttattgatcctcacaattaaaatttctaattcatccagaagaacatatgtgaatctgtatgaaatacatatctaagaattttaaatttacaatgaaccattataaaaaggccttgaccttctccacatttcctacctacttgcccgtttcccattatattttactctgacctagggaaagtacaggatcagagataaaggtgaaaatgattcccagaaagacaggaaaaatttgaacacttattaagctctattaagttttagataaggagttaggcccagagtgagaaatttactgtggtgataacagactcattctcttgaaaacctactagtgtatttaatgaggcagatagtgaattttgcatcagtcttcgcactttcccacattccacatgctatcccattttcttccagttcaggctgagaacacactgacacacaaagggtcagagaactattcccagagttcattcctcctcataaaatagattgtggtttttttctcccttctgcagaaaatgttctttccttctaccatatccaatccatgttggccatttagtaaaatgaacaacttaagagagaagttatttttgtttgttaaaggtgttttcctgagttttacaacgaaagataaaatgttgaatataaaaatagaaaagaccccggtgggtctttctagtgtccagccccagggccttccccaggccccagctagctccttgtcacttctttattcctgacttcagtccccaggggtcagtttccctttccctgaggtggctgtgccaccaaccagttaatcctggacattctttcttccaggaatggctatggaaagggacagaatgtctcaaactcccctgtcaccatccccatctttgctgtcctaaaaacgaaagaagctaagcttccttttctggtttaaccagtcagtgcttagtcatgtaagaaatgcagaggagacaacaaaaacatggatactattatacaaaggttccacaatctttcagagtcctttcagtcatggtccctggtctgtatttgattttcattttcttatgagggtaggaggtaatggaatctccttctccatgatgtctcctctcaggtttgttgactccacagtaaatatttaacatttagagagatcagggattacagagaccactctgtagaagaaaaatattaccaaagtgaagttgaggccaggtgcagtgactcacgcctgtaatcccacttggggaggacaagatgggcagatcacttgaggtcaggagtttgagaccaacctggccaacatggtgaaaccccgtctctactaaaaatatgacaattagctgggtgtggtggcacgcacctgtaatccccagctactggggagggtgaggcacgagaattgcttgaacccaggaggcagaggggcagtgagccaagatcaggccactgcactccagcctggggtatagagcaagactcttgtctccaaaaaaaaaaaaaaaaaaagtaaagttgagaggccttaaaagaggaatgctctcaggtcccttcacctgatctctctagaaactaatggaagatcagtgtgggcttctggaacttgccagtttaaactctgggaatacctcctcactaaagccaggctgagttagccctctgagctcccatgttcctgtgccagattgcactgctattactactgctttaccattcgttccccattgtagactgtgtttttttgcaaggaagagactgtgatctttctttacttctgatcactgggggctattagagtccctgtcacatagtaggtacttagtacatgattttcagaaaaatgaaatggttctcagaagaagaaaggcaggaagagttccctatagggaaatataaatactcctccaaggaatgaacaagacttcaaaactgagtttgagtctcagcaatgctgctcagagaaaaactgccttgccacaagatgataatttgataaataaggagggtttaaggcatttttgaatcctgcattgttccttgttcctctaccccaaatgactcaatatgaataggtgacaaaaagtaggtgacattggaatcagatatatcaaacaggaatgtggaccctgtgaaaaactcctattgtgtttgagcaagttaccaaccctctctgggctggcttaaatctgtaacatgaaggaactaggtccgatgatatataaagttccttacagctttaacctcttatgattttaagtgattcagagccatgtactgaaatgtattttaagcttcctcttcaaactcatcaaacaaaaaaaaaaaaaaaaaaaaaaagaaagaaagaaagaaaaagaaaaaaagaattataccatagtcaacaacacacttggggaggaaaaataaactataaattatggtcatcagatcaaatgagctgaaacacaagattaaaatgttttctatccacagagcaatttttcacaatggtgtcaaacaaaaagttctagtcaatgtttacactaggacttgatgaaaaattccagacataaaacttctggaacgtagacttgaactcagaaggacctcctatctctgaataaattgtacaactaaaatctattgggatttttttccttaacaaaaattcatccttcaacaattatttgagttttattactgagactattaaggcatagtaaaactctggttatctggaacagtcattctaggtatgacagctaaagattttttaaagtaccactatttttggatgaaaatcattgaaagacattacatttatttgacttctttaacagaatacactgaatgtaatttaatcttttcctcagtgtgaataccaggtactggtattgtcctcagtaacatcctcaagtcccagtgaaatactctataatactctaggctttttttcttttgacagtgtttcagaatccactcccactatcagctgtcacttttaactgctgtcaattctgtcaacttggccacttgtggtcatctcctgctgatatctaatttctagattaaaggcagggaaaactgtcttaattcatccttgcatacccaggggtagcatagttctagctacttaaggtgagtcattaaaaaaaagtttattgtaatagtgcatgacttaattgtaggtttaaaattaagcaacaaaaaaagcttgctgaaactaggtgtgaaataacaataaatgaatgctggatagtgcttgaggggattgctttaatacatagatttgccacattttctctgctttctaattctccactatgatccaggtagattagaggaccacagaattgagttcctgatttttcataagatgacaaaataatagaataaaaacattaaaaatgattgcataaactttggctgattatataaaatttagtgtcatcaaataatttatttttwtttttagatacatgtttgcctactccaaactgaaagctgagaagaactggcattcttagattttttagggtgatagctgagggagcacctcatcacacccactaactgttattttggataaattatttaatcttctttaatttcattttttttgcatcagaaaatagtaatgacaaaacccttctgactgggttcttgaaagactaatgcattttaaagcacttaccataagacctgacacttaataagcacacagttacttttgttataacaggttgtccattcctggagtggggacagtggtaccaaccctgggcaaagccaggcaatatgactgccaaaacattttgctcttgtatttgctacttggcaaatactgctcttgcctcagtattgggtgttttgaaaacaaatgtggcacccaaatagaaataagctttaaattccttaaatctctgacattatagaaaacaggcacttccattgaactaacattctaaagaatggggttttaatgtaggcaattttaggaaataaagaaaggaaatttaaaagaagactgatatccaagtctccacaatttatcataaatgttatcatccttagcactgaaatctgaaaatttaagaccttcccatatcaatgtcaattattatagagttaaaatattcattgtaaaaagcaaacactgtagcctcaaatttgtatgcaactataatactacacacaaaggtgtttgtccttacagaaactcattcatttctcaatttaaattaaaacattcataatattccaatttattaatcagtgttatttatctcaacacaatataataacatgttactgaaaatagagatattaaatactgcaaaatagttattttacagattattcttggaaatttagaaataatagtgtaacatgtggatgagaatacagatggtgatatatatcacacacttcctaaaaaggactaattcttactatataaagaaaaacaatgaatgagactttatcatcgccactgaagaaggtatctccattaataaataccttctcccaatgtttttgaatggtatttttaacctaaataaatatctctttactgaacttggtcaatttttttatttctacgtgaagtttactacttgatgaccatatttagcaactcctgattgttctccttgttaaatccaagactactaatacaggttttattttctaacagcttcattagctgcatttttaacttctaaatcttttcctaaaaaggcataattgattcacaaaaatattataattgcatcctagatcctttataaatcatgttggctgtgtgtaacacttttacactaaatttctaaatcaattcaattcatgagagatacatataatacattaggaaaatcttgaagagcacttttctaaaatactgaatctcttagagtatataaactgaatcacaccacaaagtttaaatatgctgacatccattggaagaaaattattttactgagcattttaccaactttattggaattaattgttctttcttaagttgctcttcagctcttcactttagttgtgcttcactgctggagaattcatttacttaaacatgatataccagcaaaattgtgtgctggtcaaaatcaatttttgaaacaaattattttcaaatcattaagaaagatgtaaatccaactgcaaaattgatgccacagttcagactcttgtggttcctcacggaataaaaggggaagtgtatctctgatttgtctggtgagacaaatcagagatactatgttaagatggggagcacaaggccatggggtccgctagcagtaactgattggcctgaatgagatatagcttgctaattcctgcactatgggaatcctgaaaaaatcttttagtaaatttaaccaccactgcataaaacatttttttttaattaccatttttaaagttacattttgtgtcatcatctctcccaccactcaagaaatctgagatttacctttggattctacttttttccataactctaaacagcaatctgcagtcatgtccttttgatcccatctcttaatatttcctgttgacttctgttcattcctattgcaaggaacattattgytgcctttgataaggccattatcatttttctctcrtatcttcctaatatgcatttttttaaccagtcttcctgcctccagtcttgcctcctcmaatcgatccttgatgctgccaaagtggtatttgtgaaatgcagtttagcatgctgcttcagctttgtaattgtttctcctaatggtcaaacccaaactccttcttgtagcacggaggttcttaggtgattagcacacttcccctccccatcttcccacttaatttctccatatttcttcttccccttttaggtaaacttactggtccttgctctatraagtttctcctaaaagtcacccctttcaccactgtgtccttttacacactttgtacaagttacttctaacagtgatttgcttacatgtttgtcctccccacatctagcccagtgaytggttcaaaaaaggcactaaaaaaatggataaaattaaatatattactcttaatgattagtgtaatataaatatttacaccccatatctaagttctggctctaagcaaaagggttcatctctcctcaagcccttaaaatcactttagaaactcttcaacttctaattcaacatattctgacactaaacacaaatagscagtcttaacttgcttggaaaaccacatggtttaaatgtactataaccctttcccaaataagagctgctattatgaggcattaatgtacagaccgtttcatatgtatacttggttgcttaggaacamagataattccagttccagaatayatgaattgcagaattagtaacttctgttaaagataattggaggttaagasaattagtcagggaagctgaaaaaggaaactaaagttagagacagaaactaagtaaagataagaaaaatgagctttacaaagctactctagtggcatctgggagcagaaaaatccaatttgtttctaagacggtaatgaaagtgaaatccaagatcaacaatcttgtcataaaattaacaaggaatttaacatacaaatgagggaccaggagtagctgtcatttgatatgtatcgtagctatagcaaaatgaaataatgtgcaagcttctcacttattgagtttagtggcataggaaatctttgtttgcaagcacatgataggaaatggaaatttacagtacattagagaaggtacattggagttatcgatagagtttttatcacatatccaatacttaatgagtagcagttggaattagactactgtatatgctttccagagataattatgtcttctagaaaagtcaaaaataattatctgaatttttaatttgctcctatcattattgacattttcacctatgatctagtaagaattgtattcttgataacagaaaatgtaatttcttaaaaatgagttaaattttatttaataattcatagacataaaaacagaaatttatagaggttttatagacagttgagtatggccagttaacttttttgaaagaccttaatactcaaatctttttcctgactggggacccctgccagagatttaccagcacaggaagaataacctattgcctttgtttatcagattttattatgcacaggaatcatctagagatgttggtacaggtagcgcctgtctcagtaggtctacaaaagatccctgaattctagtttccaacaagctctcagggatgctgctggtttacggaccatacttttgaatagcaaggcctgaatcagtggctattagccttgacgcctattggaatcatctgggtagctttaaaaaaaacatttctagggataaaacgttatttaactagtctgggctgcaacctggacactgagggttttaagagctctcaagttgaggtgaacaggtagctaaatttaagaacctatggcctaacatgtattggttatatttattagacctcatttcagtactgcatagattatgagagtaaaaatgtccaaaaatctccaaatccttactgaaaatataataacaatcaggtttcaactttaaggatctcagtggcttcatttctatattcttattaaattatttagtaacatatttgatagtaatttaaagatactcacggaattataatgaaatgacaatctcaattacttttgaattaggagatagatgtacaaaaatataaatatgtgagttttaaagtatagggaagtgtcagttcccaataagaaataaaaaggttcagactagttaggaagtttacaagaaatccccaagtctgtcacaccaggaggaaggcccacagacacaggaaagaccggcgaaagtttagttagtatcactacttgaaataggcgtcgctgatccagcagttaaaaactgtatcatcactattagatcgttcctaattattttgctaaattgaagtttgcaaaaggtcaagaagcaattccattactgaggctccttccttaacttttaggaatgtgcaccaaaaataataaaaataatattttaaactcggaggtatttgcacaattccataattatagtaaagagtatcagagtttaagtcaatgatagtaaagagtattggagtttaagtcaactgccacatactagtcatgtgacttaaactttagaacaggcttcttcacaactaaaatagtccaataaaaatgtgcaaacccaaattaatgccacatacaaatataaaacagaattaagtataactttgacaagcaaaaaaataaataaataatatagcatgttttggcgcaaagaactaaagtccagactgggaatgacttccagctttgccactaattagccacataacaagcaaatcacatactttaatctcattttaaaaataaagatgcctcaaggagattattttgacaatccctagcagatcaaagttctaaaaagctaaaaataactgatttaagttaccctctaaatcaaatatgactaatgctaacaacaacaaaccaaaaccaagaatttccttttaacatgattggtttaacaagcctttgaagaaaaatatttaaaacttgtcttcaagtctactaattgtacggcaatcatttaaaatagtaaaactatttaaatctaaaaaaaatgtagtgtgtggaggtggggagaaaagggatcattaaatgcaatgcaagaacaccaagcagaattaaaataaagaaataatgtaaacaggataagatagcaaaagctttttctaaggaaaactgtttcaaagcatgcagtgtgaaattttgcaatctatcccaaacaatatactgcataggcatcgtctttaaatacacacattttctgtttccaagtactacagataactcataattcctataaaaaattacacaatttaatcaagatggtagtacgtggagattatttccttttagtttattgtttaaatacatgtcttgccaatcacaaaatatctagtgtagccaaagacataagaaatccctgtatgaatcaaaaagtgccattcttgcagctttctgtcacaaggatgctgagaaatgtactgtaacagtttaggaaacacaagattgtctcaattttaagtttcaatcattaatcctcttcagaactggaatcaccctcttggtcagaaagttcgggaacagggaagcggagaatggcagctaccccagtcaactggctgagctgttccccagaaacgtgaagactagagaatatcctaacggtgcctgcattctctttcacactgtccaccagcctcacataccggctccgtgtggctacatcctgatgcctgaagagctcatcgctgatgagcaatgtgtcaattgccatggcttcattggccttctccacctgcttgagtccatagaaagctcgatccggttcatgctgtaacattttatagaagtcatccaaggctttgacttccccagcagctttagtgtctgaaaggcggctagccacagtagggtcacaaagggcctctttcagggagtacttgtgtccggaggaggcatgtacctagaatcacaattacaaaagttaggcaaaataatctcctagaacacccattaatcagcccacaaaggcttaaagccaaaagcgctagtaaggcttcatatgtttcagcgaagtttactccataaatttgctagacatttaacattctctttttatttcattatctcatgaaaatcccagctaagtaaagactttctcttcttatttttcccagttctaaaactttaggagtagtttataccaatccctctgcccattcttaattatccctgggtaagattgttttacctgaagaaatttggaccggttttccaggagcagtttgttgtcggtcttcactgcttgttgaaacakgtagtcgcagaactgctccctcacaaatcctgggctggccaccaggatgcactttacaacatcaaagtgtatgtggcgctggatagcctggaccacctgttcatagaaccgctccaaggcccggtcatgctgagagcaattgcctttccttttcctagggatgttcacctccaccttggcccgagtgagggtcatgctgggagtgactaagcagatatgggcgaggccttcctgcatgaccacagccgccacatcagcgctccaggctgggtcacaggcctgctcgatgcgctccagtaccacactatcccactgcttcttggccagggtgaactggcggttgggctccagctcgatggtgtggtaagcccccatcttgacatactcattctcttggatgttggtccccttaacccgcagctggcaggcttgagagtcgaagtcgatggcctccacgcagagagtgagggtagtgcggacccggttgctgcccacgctgcccgtggaggactctgtctgtaccttgcggatggtggaggcgcgcaggctgtcgcccacctgcacgaggttgtaagtgtgccacatgtcctcaggctcctcggggaccagggtcacctggcccgcattgtccttctcgatgttcttcctcacgagcttcatggccaaggaaggggctcactgacagaaccaaaggaaccaaggaggtcctcacctccgccccgggagaggggatgggaatgcaggccaggaagggggcggggcccggtttctaagggcacttgcctggcgggaaggaaacacgcttgcttcgactcatgcagcctagggcagcacttcctctatcctttcctctctcagtctcccggcgcgctgcgtctaacaggctcggggaacactgcagcgaaaatctacccctacacagttcccgctggcagcacgcaacagygggctgackaaatgaaggcgcatgcgcagcccccgtcccgcgacccgacgcacgtctcccgtccccaaaggagaggcggggccgcagttcgcgcgtgcgcaggcgyactaagctgtgaggcgctccggacgaatgaactccctcaagaaggtgcacagagtggtggcgagtcctttattttaatgccaaacttcaacttcctaagttttctcttccatccctgtctgtgaagaatccggggagtgtgtgagtgcaaatactagttttacctgcctgcggctgccactgcaacgcttccctctgggtaaatccaatttcaaagcttagcagtaaaagtagctctcagaagtgcagatttggccccaacggcccaaactatgctcgtttttgctcttgccttatccgcactcggacgctacaagcctgttggagctggtatttagaagcggtttctgagaactactggtcacgttctgtctgggctcccagcaacgtgtccagctgttttctgcgcctagttaccgtgtctgcacgatctgattcacccagatgttaaagcgctggtcccaagagagaagaaactatgtgtggaatttacccctgggtggacctctcagttgcttgacctgatgtcctgggaatcctaggctccaaagttggcagcctcagctttccgcagcccagtagcctgtgaaatgtttaggttgggggttgggtcgcaagagcttagggccagatcttcactgccaaagctaagctaaaagccgaggctatgggaagtggggaaaaactattaactaggactgaccctgattgaatagctacataatttaaagaaaatccttaagttacttagcattctttattaggaagtggaaatggagaagtgggattgcctctttaagagaccgatgaatagaaaaaacaaaagaatctaaaagtttcttgagagcttagatggagtggagggcagagaagtcctgcacacatagcttctcactgtcttttctgtctttctctgtgtggattggaaaggggaactaaccagcctgaacagatgaaacagggatgaaaggaaggaatctgagtttggcataggcgtgtggaaggaaaataaatctcggatccccaaactcattaagccaaagggaaaagttaagctgggaactgggtcacgcaaaactgccttgcctcttggtttttaaatgagatggctaccagatgaaaagctacacacctcgctcatattttgcccacaaggaaattctcagtgagcgccaagatctttaccataaagtgtttctattaaaatttaccatggcaatgtaaatagatagcttctgttttcaggtacagtcacccctctgccctcctgacacaaatgcatatctgattgttcccctgccccatttgtctatgttatcttacgtaaaaatgcagattcagattgactaagccagacagaggcatgaatgactattttccccctgctaccctctcacatgaaaactgtatttctcagtatcccaccctttcccctttaaatttggagccctcaaaatcatcttcccagaaaggcatagacctgtcttccccgcgcacgtccttaattttggcaaataaacgtcctaaaatgattgagacttgtctcaacatttttctcaactgacaggcttcacaatttaaacttaagtgtcaattatcttcctaagagattatcaggggacggaaaggtcccctccaaggggaaagtccaaataagaaccactacttattaatatttgtggcctcttttctctttgtttctcgctctctatgtctccccttacttcctccttcttcccaccttcctatcatactgagtaccctcaagaagttcctaattcacattgccttcttccaattccaggagaacccagcaa

SEQ ID NO: 12309 - DNA, 12812 bp, Homo sapiens
tctttggagcatttttggcatttccttcaggaaactggaggttgtgacctaaggtttccttagtgaacacatttctgtttcccacagttaaccttacccagaaatgacatctactctattaggtgaggtttatcttcatgtcccaactgtgtcctgtgcatatacaatgacacttgaaagcacaaattctgaaagtagcgaaaagattagagagcccaacatgccaaaacactttaatcccccaaaagatgacaataatcaaaaacaagaattaactattacaataagtctgtgatgcttgcaaagtgccttcattttgtagttggaaaaattaatgactgagaatattaatgctttcagatactatgaattgaaggttttcagataaaagtgttatgctactcagcccacattttacagctagctgcttcactgatactgtatacttctatgtggttcagaagataggctgggagaagccaagacagtgtcctgaaaaaaaaaaaaaaaaaacacatgatttaatacccatatccatatccccacttccccaacatgttggtgaaaggccaagaatgtatgcttttttgatgggttttgaatgatgattgagtctcatcatttaaactagatttacaaccacatttttgtgtataatttctttaaaagcccatatttgatgacagaattattgcatttaatttatttggcttaaatgcagtttaaaactcaaacaattctacttactagccaatgtggtattcagaaggttggtggtttttatctcattctttactactcttcagtgttaacttattgaagtttctcttcctgaaaaagatagagtggtttctaaacaaaccacacttttttcacaccctagttaaggtaaaaatcctttaaagaataatagaaatttgtccttcactttgattccaaagagctacacaatccagtagatgactcaataattatttttaagaatgctcttcacaaagggatctttaaaaaaatcagtttattaatgtttaaaagttgataaagctatgtgcaaaatgatccacaaaagtcagaaacctattaaatactattctttttaaaaaaacaagacatctctcggtttaattgcactgaaaaccatactaaagagacagtaatatatttttattctttgtaatatttatacatatcttcaattactatctaatgaatagctggactgaaaagtttctggcgttccctaccagttaaagtaatgcttttaagggcacaagagggtggtattttcttaagaaatacacattcaatggtgttaacacgggttagaaaaatccaataaaatgacttctgctgaaacaaatacattcaaaaatcaagaaaagtacttttaacacaacaaaatacaaccatgttgttgcttgaaatgaatcacacaasattctgaaataaacatcaacaaaagtgcsaaagacagatgtcatatttgttagactcatttgctaagaaatctcccttggtttgcaaaagttaatccattcggttttcactttgttttgcttgtctgtttctcctaggacaccaaggatcctggctaatatcatttagataaagtgggcttccttatgcagatttcggcttcaatggatatgaaatggtaacacatttcattgaaaagatgttttttaaagaaatcaaagtgacttcaaccaaattccaaaaaacggatcccgcttacatggaaactttggcctcagcgaaggacattgttttacacctccaaaccatcttcatcttcccacagcctacgtactcaacatagcctatttgctatagatgatcgatcattccacaaccccagctctgataactctcaggtagttaaagtataaagtaaaagaacgttgaggaggggtatgaagggaagggagggtggggtgtgggatgtacagggcatccctaaagaagcagaagtgcacacactcacttgggtttgaaactaaagtgaaggaaaacatctcctcaaagctccagacaaagagacgctttcacatggggacattagtctttgaggaggggccaaatgaaccctttaggagcttgacaatgctagacctttggctcagtgcaaaatcaaagctccaggggggtagaaaatatattccaggccgggacctgatctccacccttcccagtgcattgttcacaggaactaactctacccaccaacacccgacaccaccaggctgttcgtattctcccccttcctccctctggcttgcagcagctcctccctggcagcagtcgaagcccagagatttttttccaaacactggggtggccagcgaccaagtaaagagcgcttccggtgggtggacagcttccagttctaggaagaagagttgacgtttccagaagacataatggtctctgggttgtccccttcgtctttctgggggtgggaggaattgtccgatttgctgcggctgaattccatgccggcgatgatgggtcgcttgaatttgccagcagagtctccgctcgggcacttgcagcaggacatgatccggatgaaggcccgacgcatctccttgttggtcagagtgtaaatgatggggttggtgccggagttgagcacagctaacaccaggaagtactccgctctgaagaggatgtcacaggtcttcaccttgcagcccacatccagcaggagcaggatgaagagcggtgcccagcaggcgatgaagacgctcaggacgataattacggtcttgagcagcgccagcgacttctcagagctgcggctggccttggaaatgttcttgcggaacgtcaggcggcggctccgagtcctgaccaaggagtagattctgcagtacagaatgacgatggagagcagaagcagagtgaagaccgtggtgcagaagaggatatagtgcttgtggtagagcggcagcacggtggagcagctggacagcgcactgatgcagttccagcccatgataggcaggccacccaggatgagggagatgacccagcaggcgctgattagcaggaagaggcggaagttattgctcccgttgtggagtttcattttcagcattgtgatatagcgctcaatggcgatggcgaggagactgaacacggaggctgacagggccacaaacatactcccttcccgcagaaaccactgggcgggagtgagcttgtaggtggtggccccagacaagagcaggttagctgtgtaggctactcctgccaacaggtctgagagggccagattgccaataaaatagtacatgggtcggtggaatttcttggttttccaaatggtcagcaagacaaagatgttctccaggatgataaagcagcagatgagaatgaacaccaccgaggtcagtttaatgctgttctccttgtccgcgctgatattcagctttcccgtgtagttgtaatgccggacgatgatatcatagttgacgtagtcagagaccgagctgcsgtggkccttgaccagcgggacgctggtgggccccatggtgccaamcctgtgtccccaggaagccggggtggcgctactccrgacgaacgctagagggcgaggcgagagagccttcactggcttcaggggtggttcgatgagtgatccaggctttttgtgtagcttttccttggctggagagggcctcggaaaccgcagccttaaacaagtcagaggagagagtcagggaaagagccacagcatactggcataattcattctagctaaggcactgctccaattgtgttgttgttgatttgttttaaagaaacttggggagagctcagggagagagattttttttaaaaatcaaattatcttttttcttccttttttttcttttttcaaaaaaggaagagggggaagaaaaagagagggagaaactctatggccacattcactcaaagggaaatgggaattacgatgttggctgtgggttgacaaaaaaaaaaagatgatgaaaaggaaaacaaggagtgggaggaatgggaaacctagagaactacaccccattttaactccactcctgccctctcaccaccccacaccccctcacccccggatttccagccatgagattctctgaagcagtcaccagcttagctgcacgctcaataccagcccacgtctctcctcggaaaagactcaactgccagtctgagggcgaagacacacacctctgtcccccatgcccacccccagccccccagttcaaagatactagcaccacctcctaattgccatgtgccatgcaagaaatcagatttgcaggaaaatcatttgaaagcgtaagccatttgggggctctattaataactctctaggagcaggtgtgcttagggtccgagggcgcagtgaggtgtgggcagccaggcccgccccgccttgctgtaaacaggaaagcttagcgcctccgtgaagcgactgccttttctttcttcttcttattctccccgcctccccccgcgcccccccaccccaccccccaccccaagccagggcaagtaaatttaaaggtattcagttaaaaccattcataacagattgcagcaaatcccagaagtttcgtacattagttgattgcataaatattttttgctttgtttagtttagccaaaacatacacaaaagagagaaatcaaactactcatgacagccataatacatgctaccacatttctaatttcgattgcaaaactactcttcagaaactcacattaaactgctccctggtgcattgctaaatttgcgtgggcagttttatttactgcagtcccccaacacgttgactcctctcctaggactagaaagttacaaagaaactttctaagacggcactggtcagcagaagtctacttctaagttgcttaaatatttcaaggtaatgcagcaatgcaataaaatgaggtaatagagatgagaacaatcccagcaactccgcgaacagcagaggctgctcaagccaagaagctccgcattttcccccaactaatgttataccctgctcctgggcagtactaatttaagccattacccacgctccacaccacccaccatattctttgtctataggatttccaaaatttaacgccttccctcctattcctccgaccaactgcaattttcactgcccctacacccgtaggttccacagttgggaattaaccttttttctgaactccataaatcacaagtgcccaagaacaatctgatcgagatgggctccttagtagcccagagatgcaaattttcagcgcccggagatgcatgttttctaagtttttgtttgcctcgttcgacttaaaaattcgtttctgacacctaagccctaccacaaccgggctccccgcgcccgcgacccccgccattcgccgccccctacctcgctcaagcagggcgaagttgcgttcggagagcccgggatctgtacggctcgcttcgcatcttgcygctgcccccgactgactgcgtagtgctctcgcaaacttactsgagtcggggtcccctccctccgcagcggagcactccaatggccagtcccgctcgccgcggccagttccctgcctgctacgcgaagtcacccagcgccgcgccaaggctgggtggtttcttcaggaagaggctgggaggggttaatgccttaaccccccacgccctctgtcagctgggggcccccggatctgaactgctgagacgcactgtccaggaaagatctggggcagaagcaaaaaaaaaaaaaaaaaaaaaaaaaagaacccctcctccccaaacaacaaatgaaagaaaaaaagagagagagagaaggggcggagcccggtaacccctggattctactgtataaatcactgccctcgcccagatagacgctgatccctggctgtggagaggattctcccgagcccctgaaaaaaaaaaaaggtggagagactttgaaaacttttctctcgaaaagtctgaggaggcagaggacggcccggagtctcgtagcgcaccgccctggtcccacaccccccgcagccctaggaggatcggtgtgctgagcttgtggccaggagctccccgagccactttcgcgcgagcagcagaaaacctgagccgcggcccggcgagtgtcggcggcgctctggggaggagaggctgggaaggggctgcgagaggtacggaggagacaagcagcccgggagggagaatgaaccggraggttcctgtactccccccgccaccccagatcctcgtgctactcgcaactgcggtctgaggggcagtggctttcccagagtgcacagagaaatgaaccmgcgccggttttggtgttgggcgaggggtttccctcagctgagcacaaagtcaggctgtgtgtcccagattctggccaatggagaggtcgttgagggggtgggctgctgctgagtcctgagagattcaaaacgcctgggcagctcaggaatttccaaagggggagattctcggccaggagctgcggagcaactgcagctgcccagcaggagccggcacccttctctcacattctgcttgggagtcgactcagaggcctcraatctcattactagcactttgcccacccttttcttttgcttagatgctrcttaagaacgtgaggctgagaggcggacttggtcagatctgcctgcgtgacaagctcaggacaggacgcttctgcccttgcattactgttgtaaaagtttccacccagtccctggtcgcactgcgttcccatcccggcagatgtgaactcaaaaacttcctccgctgtgcagtttcaattggcagacacaccctgtacctgaatgactcagaaggaggcagaatgaacaaacaacagacccctgacttctgggattttgtgagtttgccaaaaaaaaaaaaaaaagaagtgacagttaattcacagctgttttaaagcattcatcgacagcgacgcacccaatacatacccacagcttcaacaacagtacagtgcatataatgtggaaaccaagataacggtcctctaagactccagagtagatcctaattggatttgaagacttatttcacttaaaggggaagaggtatattgtgtctacccagcacaacaaaacgggggacttggcattcccccccttctcccgcctccacccacactaatttatgcattctttaaagccaaaggaatcaaagtgaaatttcacacctagtctgtatcaagcatgtgctaggttaatttaaccttactgctctgtgaagtaagtaagcattgctggccattttattgttgagagaagtgtcattcagacaactaaggtgacttgtagatttcccagctagtgagtggcagagctgggttccaaaacctaaatattgcaaatgccttgccttgtggctcaaacgctatcagtcaataaatagttaaggaattgaaatatatgttcctagagggaaacagacttctagatttaaagttttacatttgctgcatttctgactgtacaagtctacaaaatgcatataaaagtatgctaatgaatgtccttttaaaaccactcattttctacgtaagcatacaaagtgtatacatatgcatattaatgaatgttttctgaaacttctcattgtctgcctatgatatctcatgtaacattgtacttttagtatttgcacatagtgttacacatattaatccatttaatctgacaagttaggcactataattattctaattttacaaacaaggaaattgactcccagacatattaagcagcttgcttaatgtgggacaggctgcagactcttaaccactactccagaccaccatgataaacctcaaacaggttcaagaatttccttggggatatcagttgttttcttgtgaataccactggtttttaacattcaatattgataaagtgttttacagagtccaaaaacctttcagattgttatttaataatattcatctttagtacacacctatgagatgtaattgtagatgatcaacttaggtaaaattagatagtaggcaaatgtttccagcaatggcgtcctggccaattccaagtctctagttcccatataagtctcttcccattgctctccaaggaggccctaaaaattgcattctcaagctatctcctgactgccagtacaactccctgtctgctgctgcctagaagtcaagcccaacattcctaccttaagtttgctccatttccaatttttgatttcaaagtggctttgttgttctttacacatgctttagtgtttctctttaaaagtttacagataaaataccacacaatctttggagcatacactaaacaaaaatttgtcataaatgtgccattcaaatgtaactgtgtgagctatcttttttttttttttttttttttgagacagaatctcactctattgcccaggctggagtccagtggcgtgatctcagctcaccgcaacctccgcctcccaggttcaagcaattctcctacctcagcctcctgaatagctgggattacaggcatgcaccaccacacccagctagttttgtatttttagtagagatggggtttcaccatgttgtccaggctggtctcgaactcctgacttcaggcgatccacctgccttggcctcccaaggtgctgggattacaagcatgagccaccgagcccagccatgagctatattttttatctgctaaatattgcaactctactcttttccctttcctttttttttttctttttttcaactgagacagggtctggctctgctctgtcatccaggctggagtgcagtggcgaaatcatagctcactgcagccttgatctcccgccctcaaaggatccgcctacttcagcctcccaagcagctgggactacaggcaccagtcaccatgtcctgataattattatttttattttttgtatagacaggagtctcactttgttgcccagggtgatcttgaactcctgcgctcaagcagtcctcccaccttggactctcaaagtgctgggattacaagcctgagccttactctctttcctaattgctccagtcactttccaactcccttttctcccctcttccctcccctgacccagtcactggtaaaaatccaggctttcccttacttgtctattcacaggagaataactagcctcttatttcaaggaggaaatagtatgaccatctcaatttccctcctctccaagctccagcttaatagcaactttacccacccttacctccttcccacctgtttcagaaataaaagcaactttactcctttccaaggcaaactcttgcccaggtcagcatgctgcttcctccaaactttctgagacttggctcaattattcttattctcccttgtactttcagttcttagcttctgaggactctttactttcaacttacataaatgtttatgtgttttctctaccaaaaactctttcttcccttcatcctaggtcccaatatctctctctcctcgtttgccaacattcaaaattagtggaacatgactgagccttggaacagacacttaggttcagccttgatattgccagttctaagctatgtgactttaggcaagttcttttaacttccttgaacctcagtgtcctcatctgtaaaatgaaataatgatatttgcctctttcattgtgaggattaaggagctacatacctgtgagaattccctacactacagagaaaatgcttcacccatccaccacctccatcttttattattattattattattattattattattttactttaagttctggggcacatgtgcagaatgtgcaggtttgttacataggtatacacgtgccatggtggtttgctgcacccgtcaatccgtcacctacattaggtatttctcctaatgctatctctcccctagccccccacccccaacaggctccagtgtgtgatgttcccctccctgtgtccatgtgttctcattgttcaatacccacttatgagtgagaacatgcagtgtttggttttctgttgttgtgttagtttgctgagaatgatgatttccagcttcatccatgtccctgcaaaggacatgaactcatcctttattatgcctgcatagtattccatggtgtatatgtgccacagtttccttttccagtccatcattggtggacatttgggttggttccaagtctttgctattgtgaatagtgccacaataaacatatgtgtgcatgtgtctttatagtagaatgatttataatcctttgggtatatacccagtaagggaattgctgggtcaaatggtatttctagttctagatccttgaggaatcgccacactgtcttccacaatgttgaactaatttatactcccaccaacagtgtaaaagcgttcctatttctccacatcctcttcagcatctgttgtttcctgactttttaatgatcaccattctaactggcatgagatggtatctcattgcggttttgatttgcatttctctaatgaccagtgattatgaggttttttcatatgtttgttggctgcatgaatgttgtcttttgagaagtgtctgttcatatcctttgcccactttttgatagggttgtttggttttttcttgtaaatttgtttaagttctttatagattctggatattaaccctttgtcagatgcatagattgcaaaatttttctccccttatataggttgcctgttcactctgatgatagtttcttttgctatgcagaagctctttagtttaattagatcccatttgtcaattttggcttttgttgccattgcttttggtgttttagacatgaagcatttgcccatgactatgtcctgaatggtattgcctaggttttcttctaggatttttcttgttttaggtcttacgtttaggtctttaatccatcttgagttaatttttgtataaggtgtaaggaaggggtccagtttcagtgttctgcatatggctagccagttttcccagcaccatttattaaatagggaatcctttctccctttcttgtttttatcaggtttgtcaaagatcagatggctgtagatgtgtggtgttatttctgaggcctctgttctgttgcgttggtctatatatctgttttggtaccagtactatactgttttggttactgtagccttgtagtatagtttgaagtcaggtagcatgatgcctccagctttgttctttttgcttaggattgtcttggctatgtgggctcttttttgattccatatgaaatttaaagtagtttttcgcaattctgtgaagaaagtcaatgatagcttgatggggatagcattgaatctacaaattactttgggcagtatggctattttcatgatattgattcttcctatccatgagcatggaatgcttttccatttgtttgtgtcttcttttatttccttgagcagtggtttgtagttctccttgaagaggtccttcacatcccttgtaagctgtattcctatatattttattctctttgtagcaattgtgaatgggagttcactcatgatttgtctctctgtctgttattggtgtataggaatgcttgtgatttttgcacattgattttgtatcctgagactttgctgaagttgcttatcagcttaaggagattttgggctgagatggtgggattttctaaatatacaatcatgttatctgcaaacagagacaatttgatttcctcttttcctgtttgaataccctttatttctttctcttgcctgactgccctggccagaacttctaatactatgttgaataggagtggtgagagagggcatccttgtcttgtgctggttttcaaagggaatgcttccagcttttgcccatttagtatgatattggctgtgggtttgtcacaaatatctcttattagtttgagatacattccatcaaaacctagtttattgagagttttcagcatgaagaggtgttgaattttgttgaaggccttctctgcatcaattgagataatcatgtggtttttgtcattggttctgtctatgtgatggattacgtttatctatttgcatatgctgaaccagccttgcatcccaggtatgaagctgacttgaccgcaccacatttgtctttaactgtctttaagtgcaatcattgctttcaccatcccactttccatttttttattcactttgctttttaattttccaataaaattttaaagtcaaaataatatgtgcatatcattttaaagagatcaaatggtacaaaacttgaaaagaagagcattagtcctccgaggttccctggttcaccaatttttccagtcactgtgaagtcttgttgattttcttctggtagccatttgcaaatcttgaaatcccatgttttatacctccatttcttcattatcaatcttataacaatatctataggttttctgccatgttgaaggagtattaattaacttgaagaaggatgcttatattataaactttctgaattcttgcatgtctgacattttaaatattctattmtttacttgaataatattttgactaggtatcaagttaaaagttgtaagtcatttcccctgagaattttgaaagcattactcttttgtcttttaatttctagggctactgataaagagcataaagctattctgatttcaaaacttcacagctgactattttttgtctctggatgtttttagaaacttctctgtctcttcagtattccagagtgacatgatgatataccttgattttctaag

SEQ ID NO: 12310 - DNA, 15589 bp, Homo sapiens
agtgagccgagatcacgctactgcactccggcctgggtgacagagcgagagtctgtctcaaaaaataaaagacacaaaggggcctcaaatgcatctaactaagtgaaagaagccagcctggaaaggctgcacactgcatgattccaactatagaacactctggaaaaggcaaaagtatagaggcagtgaaaagatctgtggttgccagggggcagatgggaggaagtaatccataggtggaggtgggaggatttttagggcagtgacrcaactgtgcgacactatggtcaatggtggacatatcatgacacatatgtccaaacccatggaaggtacagtgccaaaagtgaacccccatggaaacgcggggttccagaagacagagccgtgtccatgcagctttgtccrttgcaacaaaggcaccgcttttggtaaaggacatagatagcgggggaggcttgcatgtgtggggtggggttacatggggactctgtaccttctgctgaatttcactgtgaacctaaaactgctctaaaaaataaagttttttttaaaaaagcaatttgacccaaagtcagtctcaggaggccagggggtgggggacagaacaggccagggcaggaacttgcagggacgggtgcaggcaggctgaggtctcaggaatgtgtctgcacctctgtggtttcccttctcttcttcccttctggggacctttgcaatctgggctggctgctgggtcccgcctaggtttcagattctgccccaccctgaggttggccagtcccttctctctgtggctctgggagtggagcctcagcccttggtacagtggagcaaacaaactctgatttggggccccagagaggaagcgctgggaatccaggggttggacaggctggaccccaagccctgcttccaccatggctgtccgtgcgaccctgggagtgactgtcagtcctggtgagacagggtcacagcacctgcctctcatggccattcaactgggttaatgtccctgcccagccagggaatgagaggaggtggcaccatgtttgctgctggagtgtaatggcgcgatcttggctcactgcaacctccacctcccgggttcaagcgattctcctgtctcagcctcctgagtaactgggattactggcacgcaccaccacgcccagctaatttttgtatttttagtagagacagggtttcatcaaattggtcaagctggtcttgaactcccaacctcaggcgatccgcctgcctcggcctcccaaactgctgggattacaggcatgagccaccgcacccagcctgcccatgtggcttctaacttgttccctgaccctgaccttttgctggaggcagtgaaggcaggagagagtggaggccacatccaggagcttccagggacctgaggggttggaggacaatgaaatccaggacacgccactgacttgcgcctgtctgccaatttttccccatttaaaaaagttatttaaagggccaggtgcagtggcttacacctgtaatcccagcactttgggaggctgaggcaggcggctcgcctgaggccagaagttcgaggtggtgaaactccacctctactaaaaatacaaaaattagccgggtgtggtggcatgcacctgtaatcctagctactcgggaggctgaggcaggagaatcacttgcaccctggaggtggaggttgcagtgagcagagactgtgtcactgcactccagcctgagcaacagagtgagactctgtctccaaaaaaaaaaaaaaaaaaaaaaaaagttatttgaattgtggtcaagtttatcttaatgatttttaagtgttcagctcagtggcagtaagtacattcatattgtcaccatccatctccagaactttttttttttggagacagagtctcgctctgtcaccaaggctagagggcagtggcacagtctctgctcactgcaacctctgcctcccaggcgcaagtgatcctcccacctcagcctctcgagtagcagggaccacaggtgtatactaccacactcggctaatttttgtatttttttgtagagatggttgggggggtgtctcactttgtggcccaggctggcctcgaacccctgacctcaagtgatccacctgccttggcctcccaaagtgcagggattacaggcgtgaaccacctcacccagcccagaactcttccatcttgcaaaactgaaacactgtggccttaagcactcactccccaatccccctcccccagcctctggcaccccccaacccattctacttcctgtctctatggaggtgaccactccagggacctcccatgagtggaatgactcaggatttgtctttccgtgaccggcttatttccctcagcataatgtcctcaagattcatccacaatgtagcatatgtcagaattcccttactttttaaggctgcctttttttttttttttttttttttttggcagagtttcactctgtcacccgggtgggagtgcagtggtgcaatcacagctcactgcagcctcgacctcctgggctcaagcaatcttcccacctcattttttgattttttgtagagacaagatttcactatgttgcccaggctggtcttgaactcctgagcccaagcgatccctctacctcggcctcccaaagcactgggattacaggcatgagccaccactctgaaacagcccggcctggctgtctgccctttttaagaaaataagattttggccgggcgtggtggctcacgcctgtaatcccagcacttcgggaggctgaggcgggtggatcacctgaggtcaggagtttgagacctgcctggccaacatgatgaaacctcgtttctaccaaaaatacaaaaattagccaggcatggtggcgggtgcctataatcccagctgctcgggaggctgaagcaggagaatcgcttgaatccaggaagcagaggttgcagtgagccgaaatggcaccattgcaccttcagcctgggcaacaagagcgaacctccatctctaaataaaaaatattttggccaggtgcagtggctcatgcctataatcctagtgctttgggaggctgaggcaggtgggtcacctgaggtcaggagtttgagaccagcctggccaacacgacgaaactccgcctctactaaaaatacacaaaattagccgggcatagtggcaggcgcctgtaatccctgctgctggggaggctgaggcaggagaattgcttgaatccaggaagcagaggttgcagtgagctgagattgcgccattgcactccagcctgggcgactgatcgagactccatcttaaaaaaaaaaaaagtttttatggaaagtaacacagtgcacagaaaactccaacagtacaaaacagacacatggtttcctctcctccaaagctgtcgcgcccagcgtcctccgggaagtacctgggcagtgtcgcctgggtacagcttgtgcctgacaggggcaatgtcatcgtcacctctgcttgctggggttcccccgacagcctgtgctgccgtgttgttcccggggaggggctgttggcgggcacctccctgctttgtgctgctgtgtggatatcctcccaaggacatcttcctgtgcgtgtgtctggcagaaattcctagacatggaacccttgagtataagggcatgtgcgtcactatgttttttttttttttttgagacgcgtttcactcttgttgcccaggctggagtgaggctggagtgcaatgatgcaatctcggctcactgcaacctttgcctcccatgttcaagtgattctcctgcctcgcctcccgagcagctgggattacaggcatatgtcaccatgcctagctaattttgtatttttactagagatggggtttctccatgttagtcaggctggtctcgaactcccaacctcaggtgatccacccgcctctgcctcccaaagtgctgggattacaggtgtgagccactgtgcctggcttttttttttttttttttttttttttgagtcggagtctcgctccgttgcccaggctggagtgcagtggtgtgatctcagctcactgtaacccctgcgtcctgggttcaagagattttcctgcctcagcctcctgaggagctaggactacagacgtgcgccaccatgtctggctaatttttgtatttttagtagagacgggttttcaccatgttggccaggacggtctcgatctcttgacctcgtgatccacccacctggcctcccaaagtgctgggattacaggcgtgagccattgcgcccggtcgtgcatcactattttgatgcatcatcttcaaaccaccctgccccagcatcaccggactgccggtgtgcccagcctcccctgcacagcttcccactctgctcacagagaagacggtggaggggggagcccaggcgtgggttttccgtgtgctgagggtgtcctcagccacctttttccccaagtcattgacgtgaagctgattttctcattggtggccatggaaactgcccagaaatgggagcagggcctctgagaccctgccccagctagactctctctccaggcttcagtgtctcctcctggagctgggtgttgactctgtccaagactctgctcagtcacttcctggctgatccccgagtgctcaagtgtgtgatgagattagggctcccccaggcaggaaacggccacattggacccctccctcccccatccctagttcattttattttccccaatcctcatggctcccaactaggccctcctgctcccagacccccccaagccctgtcccccatcccctgtagcccagcgctgagcacactggggccagaaccacccataccagactcccccagggcacgacgggttgaggcctctctgaggcagggagggacaacactgaggggccttgtgcagaagagggaaggggtacccccccgagcttcagtttcttcatctgcccgatgagcccccatccaatggtacccaggagtggggatgtgctggggctagaggagggaggccccctggaggctggcttggggacccttcaacctggccacctcactcagggtcagaggtcagagcaggcgagccacacaccccgaagtccccccggtcctcggcaggtgctgtccccagcatcactgtctcccctacagatgcccgtgtgtcccctgggcaagagtgaagtgaggcactcatacaggggtgccttgtgagtatggggtcagccgaggatgctgaggggctctcgaggttcagccagagtccctgacgctgggctcgtgctgctctgggggtctgaagggaccctcgctattaccctctgggaggcgcccatccttggtttttttttttttttttgccgagtctcgctctgttgcccaggctggagtgcagtggcaagatctcggctcactgcaacctccacctcctgggttcaagcaattctcccacctcagcctcctgagtagctgggaccacaggcatctgccaccaagcccagctaatttttgtatttttatgagagatggggtttctccatgttggtcaggccggtctcaaactcccaacctcaggtgatttgcctgccttggcctcccaaaatgttgggattacagccgtgagccaccgtgcctggcctagcagggctcttcttatcctgctcaccagagataggaagtcggggggtgacttcaggaaaggcccagagcccgtgatgggcgtggggattggggtgaggacagggctgtcgtgagaacagtggctgcagatgtgagcggctggcaggaagtggccacttgaaccgcagatgcttcctgggctggtcagggaccgggggtgctggctgcagctgggacccccccctgcatcttgctggcctggcacctgggtccctgggaggcgccacactggatatagccacgtggggcagcccggtctccataacccacactccagtcctcccacgggctggctggcaagyggccctggtgggtctgygggggcaggggcagccttcctggtttatctcyaccggcgcgatctgctcgtccgcctcggctccagaagctggggctcagggtccrgcgaggcaggaagcctgaggccacagcccagagcagcctgagtgcagtcatgtgggggcgactgctcctgtggcccctggtgctggggttcagcctgtctggcggcacccagacccccagcgtctacgacgagagcgggagcaccggaggtggtgatggtgagtggtcctggctttgggrtgcagagatggggttacatcagagatggagctgggggyccggagctggggagggggaggccgggaagttgcgggcttcagcccagcccactctgtatccygtctctgaccccatarggctgggctattcccttgagtgtcatgtccagctgtttcccaccagggcagaccccaggctctgagcacctccctccctgctgcttctcgtcacctgccgaggcrggggctgactgaggtcccctctctctcccagacagcacgccctcaatcctgcctgccccccgcggctacccaggccaagtctgtgccaatgacagtgacaccctggagctcccggacagctcacgggcactgcttctgggctgggtgcccaccaggctggtgcccgccctctatgggctggtcctggtggtggggctgccggccaatgggctggcgctgtgggtgctggccacgcaggcacctcggctgccctccaccatgctgctgatgaacctcgcgrctgctgacctcctgctggccctggcgctgcccccgcggatcgcctaccacctgcgtggccagcgctggcccttcggggaggccgcctgccgcctggccacggccgcactctatggtcacatgtatggctcagtgctgctgctggccgccgtcagcctggatcgctacctggccctggtgcacccgctgcgggcccgcgccctgcgtggccggcgcctggcccttggactctgcatggctgcttggctcatggcggccgccctggcactgcccctgacactgcagcrgcagaccttccggctggcgcgctccgatcgcgtgctctgccatgacgcgctgcccctggacgcacaggcctcccactggcaaccggccttcacctgcctggcgctgttgggctgtttcctgcccctkctggccatgctgctgtgctacggggccaccctgcacacgctggcggccagcggccggcgctacggccacgcgctgaggctgaccgcagtggtgctggcctccgccgtggccttcktcgtgcccagcaacctgctgctgctgctgcattactcggaccygagccccagcgcctggggcaacctctatggtgcctaygtgcccagcctggcgctgagcaccctcaacagctgcgtggatcccttcatctactactacgtgtcggccgagttcagggacaaggtgcgggcagggctcttccaacggtcgccrggggacaccgtggcctccaaggcctctgcggaagggggcagccggggcatgggcacccactcctctttgctccagtgacacaaagtggggaaggctgtactgggtcgaacagggtcccttcccccacttcacgtccttcctgggacctcagaatgtgaccttatttggaaatagggttgttacaactgtcactagcrgaggtcactttggagaagggtgggccttacatccagtgtgggtggtgtcctcataagataaggagaggccaggcctggtggctcacgcctgtaatcccagcactttaagaggccaaggcggatggatcacttgagcccaggagttcaacaccagcctgagcaacatggtaaaaccccatctctaccaaaaatacaaaaattagctgggcttggtggctggcgcctgtaatcccagctactcaggagactgaggcagaaggatcgcttgaacctgggaggcagaggttgcagtgagccgagattgcgccactggactccagcctgcgtgacagagagcctgtctctaaattaattaattaattaatttaattcaattttaaaaagacgaaaagtgacggccaggtgcagtggctcacgcctataatctcagcactctgggaggccaagatggaggattgcttgaagccaggagtttgggaccagcctgggcaacatagggggatcccatctctacacacaaaaaaattttttaatgaaccaggcattgtggcatgcgcctatagtcccagccactcaagaggcacaggcgggaggatcacttgagcctgggaggttgtggttgcagtgagctatgattgtaccactgcactccagcctgggcaacagagcaagaccttgtctcaaaaataaacaaactaaaattaaaaaaagaagacgagagatagtgggtgtggtggctcacacctgcaatcccagcactttggaaggccgaggtgggcagatcatctgaggccaggagttcaagaccagcctggctaacatggtgaaatcctatctctaccaaaaatacaaaaattagccaggcgtggtggtgggcacctgtactggggaggtgcccacccagctactggggaggctgagtcaggagaatcgcttgaacctgggaggcggaggttgcggtcagctgagatggtgccactgcactccagcctgggcgaaagagcgactctgtctccaaaaaaaagagaagaggagaggacacagagacacacagagaagaaagccatgtggcggcagaggcagagatgggagtgatgcggacggacacaaactaagggatgccacgatgccaagcacagccaacagccaccagcagccaggagacaggcctgggacgggctctccctcacagcctccagagggaaccagccctgccaccaccttgaccctggacttctggcctgcagaactgtgagacaataaactctcattgttttaagctgcctggcatgtggcactttgtcagggcagcccaggaatctgaaacaggatcaaactctgcttcctgggccctgccagcatctctggctcggctttctgggctggatgcagcccacgacgcactggtgtctgagatggggctggagctggggctggggctgcaktccctggagactcactgcaagttcctgcccaggaggctgagggcaccccatcctcagtgcccaatgctgtggccccaccaggcccagagcctggttggccattctcatgcccaccagcttctggctttgggatgtctcttgagcaaccagaatagcacccccaactctgctccccaaaacccatcactagcacggctcagcctcctgctatcccctgactgctggggaccctcgccttccctcctctcacctgcaggctgatccttcttttcactttctgtcaatgtcaccagggataaggtgggacaatggggggtgggggtggacagtgtgtgctggggggttcgggtgctgcagacctggaactcccttctgccaggatgtyggcagccggttgtaagccttgcaygggacagaccacaaggggccatgccagtggctgtggaggacacagctggtgtgtggggaaggggagaagcctcagcacctggtgcacaaacacacacacagacacagacacacacacacacagagacaccgctgctcactccagggartggcayagggcagtttcaaagaccactggggcatgaactatgggggcaaggcagagggttggagggccactgttgggctcctcattgggtctatgtctctgatcagcccaactttgggcagccctgggctgggggtgtcaggtgcccgggacacacacatgcacacacacacacatgcacacacaaagttcatgtgcaccccagaacatgtgagtaagatcagtaacgtgtattcktgtcaatatcctggagtgatcatttaccagagttttctgagatgttaaccacaggcacaagctgggtgtgtgggtatgaatggtccccaggaccaaactgcggtcccacaactgcatgtggttgtaggattatctcaaggtgcaggtgtttgacatccataaaccctcctccccaccactctgaaaggctgggctgtagacgaagacagggctcagaagccctggcctgtgggcccccaccacccggccactatgtctcygaggggccggagtctggccccatctgtggaacgggctggcgctctgggtgctgctttccaggttcccgctgctcacaggaggccgaggcccggctgtgaccctggagatgaggttttatcttacaacatcctctacagcaagtgggcacggggcctcgggctgaggaaggagccacagggcctgtcgcttgtagggtgccaggggtggggaacccaccggccagggcagcctcagaccttgatctcacaggcagcgaggggcctccrtgctggcagagatcagggctgagcggtgttggctgaaataaataccaccccggagaagatgggcaaatgcagacataagcaggtgccaggggtcacaaaggggaatcaaagtctgctggtactggtggcaggcagctggtagggccccccaaggcaggcaggttctgggcctgggggccctgggagtgggctggtcctctgggcacgaggacatcaggaactcacggtgaggaagcaccggggtcacccagccccggcagccggaagctgaaagtgcatttgctgagagccatctgcttccccgcagggccttgtgatgtgagcccgaggtccccggggggcgaaggcagagggtgcgagagctgggacagtcttagggcaatttggggtcctgggtgccccaaagggaggccggggctttgtgtttcagagaaacgcagcctgttccgttttgaarttgcccaccggctggatgttttgctaatttagtccacatcgtgtttgctcagaaagaggcttttggccacacgagtgctttctgggaatgtttcttctcccgggaacagaatgtcaggctgtgggagctgccgtggccccaggaaaatgatgcccagctccaaggctggggggttggggtgcttggagctccagctgtagctaggaaggtgggggatctcccaagggacctccagctgtcccccctgcaccacacyggtgactgctgagcccacacctgggtcccaagagtctcatcctagggacgggcagatctctgtcattctgttccttgggttcatttagaggcaggtgtcacctgggctgaggtctgcccacccaccatacagagtcacaggctgatagggacrggatgcagccagatggtgtcgtcctgctctcagcagggcagccgttaggaagagaagccgctctgactggccaggagaggagaaagattcctatggggccgccaggacttcgggatgggaccccacacccctttcctgaacccaactccacggggctcaggccagctgccacctcctcatttagatggcagaaccccaactggawgggggacacatggcccaggcctggcactgtacaactctgcctcctttccccttccagtggaccacagtgatgggctctgggtgtccatgtgcggtaagrggggagtagcttgtgtcagaccaccaaccaaatcgaaaagctacccatagcacactacccagcaatacaaaagaacaaactccaggccgggcacagtggctcacgcctgtaatcccaaagctttgggagactgagatgggaggatcacttgagcccaggaatttgaggctgcagtgcacaatgatcatgtctatgaacagccatggcactccagcttggrcaacatacagagaccccatctctacaacacacacacacacacacacacacacacacacacacacacactagctgggcgtggtggtagtgtgtgcctgtggtcccagctactcaggaggctgaggcaagaggatcacttgagctcaggaggtcaaggctgcagtgagccatgaccacgccactacactccagcctgggcaacacagtgagacctcgtttgaaaaataaaagaataggcctggcatggtggctcatgcctgcaataccagcgctttgggaggccaacgcgggtggatcacctgaggtcaagagttcaagaccagcctggccaacatggtgaaaccccacctctactaaaaatacaaaaaaaattagccgggcatggtggcgggcccctgtaatcccarcttctggggaggctgagacaggagaatcgcttgaacccaggaggcggagattgcagtgagcccagattaaaaaaagaataaactatggatacacgaaacaacacaggtgaatgcaagggaatcatgctccaaagattatccgctctgattccatttacctggcattctcaaaataacaaaattacagacgggtagggggaaaatggcttagtggttgcaggtgttgaggggagagatgaagttatggaagagcagctggaaggatcctgtgcagatgggctgtttgttgactatggttgagattacacaaatctgcccatgaggaaaccgcacactgttaactacaggcaaaacttccctagtccaaaaatcctaaatctgaaatgttccaaaatccaagtctttttgagcagcgacttgacgtgctcaaaggcaatgctcattggggcatttcagatttttagattagggatgctgaaccttagctaactatataatgcaagcattctgaaatgtgaaaaaatctgaaatccgaaacactgctggtccccccagcatttcggataagggatccttgacccgtatgmgckcgcgcgcgcgcacgcrcacacacacacacacacacacrcgcgcgcgtgcgcccgcgcacagctgttcgctggtgggtgttgcgtggrccagggtggagggaggatgaatgtcccactttgtccccaggaactctgagcctctgaccctgagtcactcccactgccagtggggggtcggggcggggcggaggagtcggggcaggtcgtcgggggaggttggtaggggagggaggtggggagatattgmgcctatgtctcttatctctggggtgggcccagctgttacctgtcctccgcctccccttcaggctcagggtctgagtcctccacctcaaggccggctccattcagcttcacgtcctgctgtaaaggccccggggccacagaagccaggtcatccccgtaggtggaggacgacgaggccggcagccgctgctctggaaggaagggggcctcggtcgggagggcgtggcggggaggggacccaagggccgaggggaggagatccgtggcccagagcagcagcgatggtgtccccgaggctaggcggggggtagggtcctcaccgagggcgcagcagctgggaggcgcgggctccaggggcgcggcykggcggcaggcggcctcccgcaggcggcaggcgctggcgtagaccaccccgtcggagccgcacaccgggttcccctgggcgccgcagtcgtggtcgcagccgcatcgcgcgatcgccgccccctcctcaggggccacggcagggcccgactcgccggggaaccagcctgggggacgaggcaggctcgacagaccccccaccctgaaccttgcccgcgcccccacagaacctgggggtggggaagatgtccctgggtcccgggcccactaccccctcggtgggtcttggggcgcgacagttaatgggaggtcctgagccctggccttatggaatttcacgcaggtatttgcctaatacttacaaaaacagaaacagacttttaaaaagcggttgtaggagagaaaggagacagggcgtcctgtctgggccrccctgcaacaacagccccgtcccctgccgcgcctcctccgcactgaccacacccaccccaaccccacccccaccgcactgaccgctcctatcctcaaccccgccccctccgcsgtgaccacacctaccctcaaccccgccccctccgtcctgaccactcttaaccccgccccctccgcactgaccacacccaccacaaatcccgcccctcagcgctgaccgcacccaccctcgaccccgccccccgcactgaccacacccaccgcaacctcatcccctcagcactaaccacatccactctcaaccccgtccccttcgcactgaccacacccaccccgttcggccccgccccccgcactgaacacwcccgccctcaaccccgcaccctccgcactcacctccccctcgccgctcgaccccgccctcaccacactgaccaccctcaacccattgcgcccagtccccaccacagtgaccacaccctcactggctcggccctgcccccagtatactgaccattccccagccacttcccttccgcacttaccactcccccagccacgcccctccccgctgaccgctcctccagccccgcctcccccgtacaggcagagcgcccgcccacctctatgctgcgttctcctgactttacgttggcccctcctctgccaagcccccaggggagccctccctggcgtccgagggtgggagtcggggtgtggcaggccgcggtggggggcggcagtggctccgcgcactcacccgggccccgggcaggggcgcgctccacttcgttgcacgcgggtccggcgcacagttcccgggcgagtgggctgtgsgtgctgacgttgtagaagcgagtggcctcgaaggctacgggacgagggtggcgggtgaccaagtgcaggcgcgacgggtcagggaccgggccgggccgggggtgcgggcgcgcgggcctaccgggttcgtagtagtcgtacacggagactggcagcgccgacgtcctgcccaccacgcactcccggagagcacggaaccgcacgcacgtcaggcaccggctggggatctgtggggcagcggcgggcgcaggctcgacccgggccaggaggcccggggcgctgagctcaggcccagaactggctgatttcagggatacccaggacgcgtgaaacacagaagaaacgtgatcccattttctttttttcttttacttttctttttttttttttttcctgagacagagtctcgcgctgttgcccaggctggagtgcagtggcgtgatctcggctcactgcaagctcggcctcctgggttcaaatgattctcctgcctcagcctcccaagtagctgggataacaggcgcccaccaccgcaccctgctaattttttgtatttttgatcaagacggagtttcaccatgttggccaggctggtctccaactcctgccctcaagtgatccgcctcggtcccattttttattctttgggtccttccatcccactgggaaaacgtctcaggtggcctctgaaacaccactcctttttgtgtgtgtgcacgcatggctgagcatgtgtgggtgggagtcagcacattcacgatactgtgcaatcatcacctctgtctagttacagaacggtttctttctcccccaaagaaaccccatcgccatcagc

SEQ ID NO: 12311 - DNA, 32376 bp, Homo sapiens
gcaaattaaaactacaatgagatacccacaccactcagaatagttattattaaaaagtcaaaaaataacagatgctggtaaggctgcaaagaaaatggaacaagtgttggtgagaacgtaaattagttcatccactgtggacagcagttgggagatttctcaaagaactaagagttgaactacaattcggcctagcaaacccattggtaggtatatgcccaaaggaaaataaattattctaccaaaaaggcagatgcacctatatgttcattgcagcaccattcccaataacaaagatgtggaataaacccaggtgttcatccaacaatggattggatatatggaccatagaatactacacagcaatcaaaatggaaatcatgtcctttgcagcagcatggatggagctagaggtcattagcctaagtgatgccatgtggaaacagaaagccaaacatagcacattctcgtaagcaggagctaaacactgggcacatgtggacatagataagtgtctgttcatgtcctttgcacactttctaatggggctgtttgtttgttgcttgctgatttgtgtaagttgcttctagattctgaatattaggccttcactggatctgtaggttaatgaggtcccactcatcagttgttatttttgtttaattgcgttcaaggacttagctgtaaacactttgtcaatgcctataacaacaggatgtttcctgtgattttttttttctttgagacagagtctggccctggcaccggagacacttagagtggggagagagggaggagggcaagggctgaaaaagtgcctgttgggcgctatgctcactacctgggtcaacggattcattcgttctccaaacctcagcatcacgcaatatacctttctagcaaacttgcgttatgtgcccccgcattctaaaataaaagttgaaaacaataataataatatggaactaaaaattaataggcatgcatcttagcaatataaactcaagtacaaaatggaagaggcccacgttttagagattttgaaatttaaaacacctataaatgtgattgtatatataggcatgtagggacaactgggcttcatctgtaagaactacaggtggaaagtggagactccttactggcctgagagcaaggagacagccctgagtcttggtgtctgaggagaagaagtatgtgtttctgttcgattcttggtcagaaaaaggtgttataaagaagaatcttggttccctgtctcttttctcatgccagatacttataatagtaactatacatgtgtatatatatgtgtatatatatatttgtctttataaaagctcacatctcccaagtatcacacaaaaccctttttgtctttttttctacaccccatggagaagtacaaacaggatgtgatactctaatatcactcagttttctaaaataagtaggttgcaatttcctatgaagtgaaactattcctagttcacattgagaaagtaccagattcagtttctcataggaccaacaattgtctggaccaagggaaattacaaatggtctggtcttacatttttctccagctacctgtgatgatctctaagagtctgttgttgcagataaaaaagtatatcactcaaggcagggtgcagtggctcacgcctgtaatcccagcactttgggaggcagaggccggcagattatctgaagtctggagtttgagtccagcctggccaacatgatgaaaccccgtttctactaaaaatacaaaaattagctgggcatggtggcaagcacctgtaatcccagctactcgggaggctgaggcaggagaatcgcttgaacctgggaggtaggaggtcacagtgagctgagactgccctactgcactcccagcctgggcgacagtgttagactctgtctcaaaaaaaaaaaaatgtgtatcactcaaactgacaccttcatggatcttagaaccctgatcatgttcccatgagaattccattcattccattcaagaagatctaactttcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagagcacatggacacaggaaggggaatatcacactctggggactgttgtggggtggggggaggggggagggatagcattgggagatatacctaatgctagatgacgagttagtgggtgcagcgcaccagcatggcacatgtatacatatgtaactaacctgcccaatgtgcgcatgtaccctaaaacttaaagtataattaaaaataaataaataaataaataaataaataaataaaaaagaagatctaactttcctaaatatctatgcatccaacacagcagcacccagattcataaaagaaatttgtaaagaccttcaaagagacttagactcccacacaataatagtgggagactttaataccccacttacaatagtagacagatcatcaagacagaaaattgactaagataatcaggacctgaactcagcacgatagatatctacagaactctccacacccccaaaccagaatttacattcatctcatcaccacatggcacatgctctaaattcaatcacataattggaagcaaaagactcctcagcaaattcagtttgttacaactgaaattggcacaaaccactctctgaccacagcataatcaaattagaaatcgagactaagaaactcacttaaactcatacaattacatggaaattaaacaacctgctcctgaatgacatcagggtaaataatgaaattaaggcagaaattaagaagttattacaagctaatgggagcaaagatacaacatgccggaatctccgggacacagctaagggggtattaagaggaaaatatatagcactaaatgtccacatcacattagttgtgatgacctaacatcacaactaaaagaactagagaacgaagagcaaacaaaccccgaagctagcagaatacaagaaagaaccaaaatctgagctgaactgaaggagattgggttccttcacacacaaaaaaatcattcaaaagatcagcaaatccaggagctggttttttgaaaaaaataataaaatagactgctagctagactaattgaaaaaagagaagactcgaataaacacaatcacgaatgacacggggaatattaccattgaccccagagaaatacaaacaaccatcagagaatataatgaacccgtgtatgcacataaactagaaaatctaaaagaaatgggtaaattctcagacacgtgcagcctcccaagactgaaccaggatgaaattgaattcctcaacagaccaataatgagcctgaaattggttcaacgtacacaaatcaataaacagattcatcacataaacagaactaaaacaaaaaaccacatgattatattaatgatgcagaaaagccttctgataaaatttaacatcacttcttgttaaaaactctaattaaactaggtattgaaggaacatacttcaaaataataagagccatttatgacaagcccacagccaacatcatgctgaatgggcaaaagctgaaagcaatccacttgaaaactggcacaagaatgccctctctcaccactcctattcaacagtattggaaatactaggcagggcaattgggcaagagaaaaaaataaggcgtattcaaataggaagagaggaagtcaaactatctttgctgcagatgaaatgatcctgtatctagaaaacatcaacccaaacatcaacctgagatcttcttaagctgataaacaacatcagcaaagactcaagatacaaaataaatgtgcaaaaatcactagcatttatataccaataacagtcaagttgagagccaaatcaggaatgcaatctcatttacagtttacacacacacacacaaacacacacacacaatacctaggaatacagctaactaggagggtggacaatttcttcaaggagaactataaaacactgctcaaaaaattagagatgacacaaatagatggaaaaatattccatgatcatgaataggaagaatcaatatcttaaaaatggccatagtgctcaaagccatttatagattcagtaatatttgtattaagttatcattgagattcttcacagaactagaagaatcatatggaaccaaaagttttaaatttaaaaattcatatggaacccaaaaagagctcaaatagtcaaggcaagcctaagcaaaaacaaaaaccgaaaaccaaagctggaggcattatgttacctgacttcaaactatactacagggctacagtaaccaaaacagcatggtactggtacaaaaacaaacacatagaccaatggaacagaatagaaaacccagaaataaaaccacacacctacaactatctgatctttaggaaacctgacaaaaaaaaagtgatggggaaaggattccctattcaacaaactgtgctgggataactggctatccatatgcagacaattgaaactggaccccttccttacaccatatacaaaaaaactaactcaggatggattgattgatggatgtaaaacctaaaactataaaaacctggaagacaacctagacaatacattcaggacacaggcacgggcaaagattttatgactaaaatgccaaaagaaattgcaacaaaagcaaaaattgacaaatgagatctaattaaaccaaagggtttctgcactgcaaaagaaactgtaaacagagtaaactgacaatctacagactgggagaaagtttttgcaaactgtgcatctaacaaaggtctactctccagtatctttaaggaacttaaaccaatttacaagaagaaaacaaacaaccacattaaaatgtgggcaaacgacatgaacacacgcttttcaaaagaagacatacatgtggccaacaatcatataaaaaaagctcaacatcactgatcatgagagaaatgcaaatcaaaaccacaatgagataccatctgatacctgtcagaatggctattattaaaaagtcaagggacacatgttctcaggacctcctgagtgctgatcactcatatttggctcagaaaaatctcttctaatatattacagagtttgactctttttgtccacaataatttggtgyctgaacacgtgaggcctcagataagactcaggaccccaaaggagttgtctcaacctggagctaaggtaccagcaggggcccactgaaagcctccaggattttgagcttcttctctgccagaagtggtaagtcctcctgagccccgacctccctttggttgacggccctttatttattctgatctactatttctttttctttctaggaagttgttgtttaaggatcctacttctagttgggagatacattctaaagggtcttctccattgcttttctccccaaattaatctcgatttggcttgtctgttcacatttgcatgaggaactgaactgttgttttcatagggaaacgagagactgtgtttcctcagcttaaaaaagaaagggcattttgctcctcccagccaaaatgtgggaagtgatgaggggtgcttgtgggaatgtctgggggtgggtggaccccatcgtgatgtgagtggcctacagggaacacccaacaaaatgagttttaaaaaggcttgtccaggaagcacatatgggagctggtcactctgcattttgggccctcctggaggtgtttagaccttccgagagagaaactgagacacatgagagggaagaaatgactcagtggtgagaccctgtggagtcccacccacaaccagcacactgtgacccactgcacaaacctctagcccacagctcacttcctcctttaagaagagaagagaaaagaggagaggagaggaggaacagaaaagaaaagaaaagaaaaagtgggaaacaaataatctaagaatgaggagaaagcaagaagagtgacccccttgtgggcactccattggttttatggcgcctctactttctggagtttgtgtaaaacaaaaatattatggtctttgtgcacatttacatcaaggtaagagagccctaatggcrgcttgcacgctatagagttcctaagttctctctttctctattttcttttctgcctgctttacatctgctgttacctttctactgagataaaaaccactgtttagatccaaattttttttgcaagctggtaaatttatattaatatctcatggctagagttttgaagtaaaagctacaggatgtctgtgtgtgtgtgtgtgtgtgtgtgtgtgtgtgtgtgtgtgtggtgtgtgtgtgtttaaaagcctttatgatagatttctataattttatgtttaattggcagtgaacccattttaatttccctctaacacaccagacttcttcctctgtactttgagatgtaagttttgctgattttttctcctaaaaagtgtttcctgtaacatggaaatttagggttatttagctgacaactgcctggggtaaggaaacaggttatgaagagtttgaaagggttgggcgtggtggctcacacttgtattcccagcactttgggaagctgaggtaggtgactcatgtgagatcaggagttcaagaccagcctggccaacatggtgaatccctgtctctactaaaaatgcaaaacttagccaggcagtagtggcacactcgtaatcccagctacttgggagactgagacaggagaatcrcttcagcatgggagatgtaggttgcagtgagctgggatcatgccactgcattccagtctgggtgacagagtgagcccctgcctcaaaaaaaaaaaaaaagaaaaaaagaaaaaaagaaaaaaaaagagtttgaaagtttgagatagaaaaaaagaggttttttgaatctataagatgtactwctatcagcatgcctaatgcgtccatgaatctgtgtgtggtgtacataatgtttcactactaaaaatatacaaaagagctctaattaattggcttaaagagaataaaagtgcttaaatcaaatactttatcaggacaagatgcttcttcaagttcacttaagtaaaatctttaataaataagctggctttaaaattattggtaaaataagattagaaatgtcttaagaattgttagcrtttttgtttgcacttattgcacaagtggttttgtgcttatccctgcagaatagtataagattttccataagggttataaaactataaacctggccgggcacggtggctcacgcctgyaaccccagcactttgggaggccgaggctggtggatcacctgaggttgggagttcaagagcagcctgacacacacaaaacaaaattataaacccagcccaaaacagaatgatctttgcttgtataatttttaataaataagccatgtaatattgttggttaaataaaaacagctaactactgagatattggttaaaaaaaataactttatatttaaccataagttyccttacttaggtaaacacctgaaattcatagtttataacattggttaacagggaattaactttaagtgatgactgtcacagtgttcataaataatctaggtaaactattaaataagtttatcaagtaaatgcaatggaataaatgcctataaacaaacttgtcacataatttacaatctaaagttatattaaataatagatattaattgaytagctgggtaatttataatttaaaaattacaggaaaacatttttaaaaaacaattcttattaaaagataaatatctgtgtttaattcaaagcttttttaaaagttatgtataaaacaagataaatggaaacaggaaataagagatgtaaagacagttataaatataaagaggaattttggtaaaaaagatgaaaaggaaagtaattttacacaagaaagtcttatgtagtgaatttttgtcctgaaataaaataactgatagttcaagaaagagggatatttaggacaaaacaggcagtttaagcatgttgtaagtggtctctgtaagtcacaataagactttttttaaaaaaagaaaggtagtgtaatgtagttggttatgattaagaaatataatagtcattctacagatgggtctttgatatttaaaaaacacaccctaatccaaaactaaataattggttaaaacaaggttttagtaaaatattaacttattcttaatgcaaaaagtttttaatttttaaattctataatctgtctttttgaaattcttccaatgaatatatcaaagttcagctttttctcttttgaaaggccttggatgatagctctctccttcaccttgtgttggcttctgtaacttttattaattatctaaagtaagagaggaatttttatttaaaaacagaaaaatgaaatatcctttagacctgctttttttattctgtatgcctgttatatctgtatcttcatatgtgttatctggaagtgatatttcactaccaaactacatgaaacagctcatcagttgtcttttttwaaaaaaagtaagtgcttatcagattggcagacactagctaagatgcctttgaattcacctgattttaatatttagtaaaattaatttagtaaatttaatcttaaaactctctccagtaattagagctatgttatgttaaacctcgtttttttttttttcacttgaaatttgggttactaaattaaaatagtaggagtataaaatgtttttggtgatgcatataaaacacaaggatataggttttgcaaaaaaaaaagtaggtttttttctagttaagaaactatttaagagttgctttaaaatgaagaaaaaattacggagataaaactaaataaaaagaacaatttagccaggacaacaaaagttaactctgagacctgtgattaccaagaagatagttgatatagaggaagggcaaaaacaagtaactattaaaaccagagggtataatgcaaaggaattgttctgctttttagattgttataatcagtttcttaaaaataatctatgtggtagattgtaaaaaataaccactttaagggccaaattcttaattttttttttgagatggagtcttgctctgttgcccaggctggatggagtgcagtggcgtgatttcggctcactgcaagctctgcctcccaggttcacgcccacattcttaattttaaatgcttcagaatttaagagcttgtttggattgatgcaggacccgtagctcactattaaacaatcactaatgagtatatgagatccaaatgcacaggaggttattccagagagaacaaccagcttagtggaccagacaaacgccactgaaaggtctgttggccctgagaaggggactagccaactctccctataaaacaccaagtgcagcatcccagatgaagcagtgaatatgctttgtatgcgagccaggtggggctggtgtatgaagcatatgaaccaagtaaccattaaaatcaatcaaccgttggtggacacttagtttggtttcatgtctgtgctgttgtgaatagtgctgcaacaaacataatgagtgcagttgtcttatttatttatttattttttattttttgagatggagtttcattcttgttgcccaggctggagtgcaatggtgccatctctgctcactgcaacctccggctcctgggttcaagcgattctcctgccttagcctcccaagtagctgggattacaggtgctcgccaccatgcctagctaattttttgtatttttagtagagacagggtttcaccatgttgcccaggctggtctcacactcccaacctcaggtgatctgcctgtcttggcctcccaaagtgctgggattacaggcgtgagccaccacacctgacccaattgtctttttaatataatgacttttcctttggctggataccatgtaatgggattgctaagtgaaatggtagttctatttttagttctttgagatagctccatattattttccatagaagataaactcatttacattcctaccaaccatgtatcttgctaacatctgttggttctgacktcttaaaagtagccattttgaytggtgtaagttgatactcagtgtggttttaagttgaatttctctgatgattaatgatgttgagcattttttaatgtgtttgttggccacttatatttcttgttttgagaaatgtctgttgatggtctttactcagttttccataaagttgtctgtgttttttgttttttttttcatgttgaattctttgacttccttgcagattctggacattagtcttttgttggaggcataatttgcaaatattttcttccattgtgtaggttgtctgttcattctgttgattgtttcttttgctgtgcagtagcttttaattttaatcatgtctcatttgtctattcgggggtttgttgcatttttaagggtctttaccataagttctttgcctggactaatgtccagaagggtttttcctaaattttgctttaggaattacatagtttcaggtctcacattgaggtctttaattcatcttgagttgatttttgtacatggtgggagataaaggtccagttttattcttttgcatatggctacccagtttttccagcatcctttattgaatagggtgtcctttccccattgtttactttgttgactttagcaaagctcagtatgttgtaggcatgtatctttatttctagtttctctattctgttcccttgatgtctgtgtatatttttgtactagtaaatgctgtcttagttactatggccttatagtataacttgaaatcaggcaatgtgatgyctcctgttttgttctttttgcatagaagtgttttagctgttcaggctggtttttggttccaaatgaatttaaaaattgctttttctctaattctgttaaagaaatgacatttgtaatttaataggaattgtgttgaatctgtagtatgctttgggcaatatggtcattttaacaatattgattcttcccatttgtgagcaaggaatatttttctatttggttgtgttgcctacagttcctttcatcagccttttgtcactctctgtgtagaggtctttcacctccttggttaaatatactcctcagtgtgtgtttgtgtttgtgtgttcttaatttgattctcagcttgaacggtactgatgtatagaaaagctactgatttttgtagcttgatttttttatccagagactttactgaagtcacttaccaagtctacgagtcttcyggaagaatcttcagggttttctgggtatatgatcgtgtcatcagcacacacagataatttcactttctcttttccaatgtggatgcactttctttctttctgttgcctgattgctctggctaggacttccagtactgtgttgaataggagtggtgagagtggacatccttrtcctgttccatttcttggggaaatgctttcacttctccccattcaattttaaggttggctgtgcgtttgtcwtataaggctcttattttggggtatgtttctttcatgcctagtctgttgagggattttatcatgaagggatattggactttctcgaacgctttatctgcatctattgagatgaccatatgctttttgttcttagtttatgtcatgagtcacttttattgrcttgcatatattgaaccatcctttcatccctggaatcaagccaacttgatcatgatgaattatgtttttgatacactgttagattccgtttaatagcattttcttgaggatttttgcacctgtgttcctcaggtttcttggcctgtagttttatttttctgttggatccctgtctgattttgctatcagggtgatattggtttcatagaatgagctaggaaagaatcccatcgccttgattttttggaatactttcattatgattggcaccagctcttcgttgtgtatatggcaaatttcgactgtgaatccatctgttcttgggcttttttgccggaagatttttagtactgattctttttggttacttgttattggtctgtttagggtttctattttttgcctgtgcgatcttaggaagttgtatgtgtctaggaattcatccatttctctaggttttctagtttaygtgcataaaggtgttcatagtagtctctgatggtcatttgtatttctgtggcgttggttgtaatgtcaactttatcatttctgattgtgcttatttaaatcttctcctttttttggttagtgtagtcagccatctctcaattttatttatactttcaaaaaaccaacgttttctttcattgattctttgtaatgtttttgtctcaatctcattctttatctgtcctttcagagtttccattgttttcagcatccatcactagcaagccagtgcgatcctttggtggtgccacaatattcagatttttcacagcgtcagaatccttacactgattccttctcttctggagaggcctccacttactctcttcgaatttattttcatttggatgggatttgttttgcacattttccccyggccccgcagggagggtgactgtagagcatgttgggaagggtcttttggcttttcccatggctttgggagcttctgcagcagggtttgtgttgggctgtgcagctcaaattgcaggccaggagctggtgcttaagggtaagagccaccctcggcacaagcaggtggatatggacctggtgtgtttcctgtgaggtgctgactgttgtttcaggggaagggctggaccgtggagtgtcaggtgccctgagctttgtgttccacaggggcgagggaacacccctgggcagagctggaacccccggcttgcccacagatatcccagtgatgagtgcaggcactagtcctgatggacatggctggagcagctcctagtgaaatgccctgaggtctctgcggggggtgaaggagctacaccgtttccagtcccatagggaggaacgttgtctgtctccctatcacacccgtgctccagggctcatgagtctcagttcagacacacactcttgtctctccccaggccacagtgtggctgagggcmgtgggaaacacctgccttgccactctctgcaggcgtggttccaaggcagagcctcctccctcagcccagtgcagaccctgagcggctgtctgttgtctgacgtggtagctgcttcatgtaggtgggatgtggggcttctgcctctctggatgggagagtggacgtcagttgtggtggtgttgctggctgggtgggcccgacctcaggccctggggtgagtggtcaggtgccagcagggtaggaaagggcaggtagttcccggatcacaggcccctaggtggccggctggacagcgtgtgtgagtcctgaaggggctggactgggttttggctgctccggggttcagatgctggctgtgatggggagggatgggctggtccccagggcacaggcagaaccctcaggcggggcaggcagaaggctcaggtggtagagcctgcggcagatcacagrcctgtggggactgggctctcagaagggctgggggctgcagctgaaatgtccaggtgggggcagggtggctgtgctgtgggcctgtcactagggagggcagsgcccctckgctggggcactggagactggcagctgtgaggcacagggcccgctcacacttccctcctgaagtgtcactcggttttgctctggggacacgtgaaagtgccaggcctccccacaccctccctgggcctggggcagcagggrcagaggcagaggtggcagtgactgcaaagggcttgtcaggggcctctgagcattggrctttcagagggcacygagccagggccacsgtgttcgggtgggggcaggacgggtgactggggccctgcagctggcaagccccattagcaggaaggaagccccatttcgcaggaagcaacagaggtgggcagctgtgtggtgctcagcttggctgctcctgtgccccagctgtcatacttattctggggcccacagaggtgcctggcctcctccctccctgctaaggcagtgkcagctggacccaggctgctcagggatcagaagcctgtgggattccacgtgggctccagaggcgcctctgcaccatctctgggaactccctgtgcctctgtaggccaaggggggtcaggggctctcctgtgaccaggattgtaaagggccaagacaggggtgtggatcccaggggcctcacacccactcaatctttccctttgttaaggagcctctcactcactcaccccttccccgtgttagggagcctcgcactcactcaccccttccccgtgttagggaccctctcactcaccccttccccgtgttagggagcctckcactcactcaccccttccccgggttagggagcctcgcactcactcaccccttccccatgttaggraatctctcactcactcaccccttccccgtgttagggaccctctcactcactcaccccttccccgtgttagggactctytcattcactcaccccttccccatgttaggagcytctcactcactcaccccttccccgtgttagagaatctctcactcactcaccccttccccgtgttagagaatctctcacwcactcaccccttcccygtgttaggagcctctcctggctcccaccttttctcttctcttctttccatgtcctcatgtttctcaggtgaaccccagcatcctcttggaagatccacttgacctgttggtatttactcactattttgggtcctcttagtgagtaggcagactccagccctttccattcagccaacttgaacctcagcccacaatcattttcttgrcactttttyctcttggraaatccggtcccaatgtgcttgtctttcatttgagaataattttcattttctccagtagttttaaaattactttgtatctattctagrtatcttttactctatcatagttaagacattgatgttatttattaatttgttcacattaaactcatgttctttcttcatttctgtaaaaatgtcaaccattttctttgcaatatttactgaataacgtactccttatttccttcattctgaaagtgtgatccatagagagatacctgtttcctcttctcattccatttcttgtgtgcattaattatgttttctacttyattcatttctagtttttctctgatgactaatgaaaaatttaatagatattccacaccaatactatgytcatcatttcagctgtgtcttgttcttatgcaattatttctaaatgtgttgatatgatttactatttttcacctcacagtagcttcctaattcatttctataattgcctgttttttctgtaatggactttttgatttttatttctcttgggtgggtttttctcccacacatgtgatcttccatacagtttctcccygggctgactcaggaaggaaagctgatgaggagcattgctgtggtcactcctgccctgcggtgtccatgctgccaagcttagaatcagctctgtgttctgtccggcatggtggggcccatgtgagcctcacactcacrtgctagagatgcctggtccagcagtgataaagygcatctgtgtcatgcacacccgggaaggtggctcaatgctgagtgtggcccgggtcactgaggggagctatcccagggtctgtccacaaacacagaagagggagaacaacagtctctctagggtcccacggtttcctccattttttgctttgttctgagagagagacaaagtgccatgrctgctctgtgggttggacagatgcatgctttcacctgcaggctggaacccaagctgaggtcttcagcatccccaagtactgataaagcactttaggttgtttttagaaaacactgaaaaattaacccttttgctaaagaggtagaaacaagccctcccctcaacgaaattcctgaaactctcaggttaaacttcgtaacccaatcccttcactgcagacacccaataggaaagtcacatgtgcaaggatgagatgactttggtcaagctcagaccccacagggccaggaaggcctgaaggagaggaggcccatgcttccagctctcagataagagctgcttctaaggactttttaaaaaccccacaagaaacccttccatgtccttcaccccctcctgctttgacraggtttatcactagatattctttaggatgtcaggaattcagataagatgctctcgagaaaaaacttgcccagcaacggcatctcctccaatggactgacagcaactctggctttgaacctctggaatcagggaactctgtttctaagcagctctgtcagcctctctcttgttgctgataagaacttcctttacttctgtatgtcagagagctctctctatggtgcttttcctctactctcacaccacaggaatcatcctcacagaagaagacttctaggaccagatgtgtgggattttttttcctagacccagtagcggacgccagctgagtgtttaaatgcttcttccccagtgccgtaaacaaatagcacttgaacataaatttaatttactcagcaagaccatttttattttctgcagcaagggtacactcaccagcagttttgcttcgagagtacacaaaacaaaagagacagggtcatttataacctgacacgtccaccctactgctctgtccggtttccactggctggaacaggacctcacactctgtatttgtcccgattggctagtaacttagaacttctgaaaagaggcaaaggtagagcagaacaaaggaaggaggaagtaacttgtggaatgctgagaaaggtgaaaacaccttcaaataaggaagaggaacaggctatgacctaatgcttgcttggaccagtataagcatgccagggcaaatatttaggctaaattgtgggagctaataacataaagtacattgatttatttatcacggctagcagatatttgagaatgttagcatagctctgacactgtctacccagagacagtcccagatcccacagattgaatggttcagtccccaacactgcccccacaccattcccaagtccagacctccagaacttctgactgactggcttcaagttggggaccctatgaccacctctttgggtttgattaatttgctgtagcagctcacagaactcagagagacactgacgtttcctggttgaatacaaagcacactgcagaggacacagatgaagagactcataggaggaggcatgggggaaggggcgcagggcttccataccctccctgggcatcaccctccaggagtctccacatgctcaaccacccagaaacccacgaaacccagtcttcttgggtttttatgaagcttcatgatgtcagtatttcctcccacaaggaacaggctgagaccatcttctgggagggtcttaagagccaccatcagaaaggcagggacattagagtcttgccttgggcaggtgaaggaagggcaggaggaggtcagaggcctcccctaaggcctaacacagccaatgttataacaaaagactgtaacaagggctatggagctatgagccaggaaccgcaggtgaaaaccagtgtgtatcacaacatcacacttccctctccggacacactgtggcttgccatgccatgcactccagattgtaatccttgcttctcactcccaaataaactcaaaatccagacaaccctsgagcaacgcagccttgaattcctggggtctcttatatgcacacttttttcaaccaaargggggtcaaaactrtagcatttgtgggatgcaagacttgtgtatatgaacggcagacttttcctatatgcaggcccagcagagacaatgtcggggctggagtacgagcaggtgttggtgcatgtagggggtactgaaacgaattgcctgtgtatcccaagaaacaactctactgagagatcatattctctaggggtttatttttgtttttatttttattttaagttaaagcttcgggtagaacacccagtgtctccttgtccatctgaagaagatgctgctatgtggaagcacatccttgagatccacaaggagacactgggcaaggagacgagggtgmcccactgtgcagaagtctccctaayaaatgmtctatgaacaccctggtgtttagtgcttctttctttggaatcccagcagctctrtcactggacggtttggtgcactcccttgagggaattcccctgggctgcttggggtccactccagcctcaggtgtagstggaggacgcagcctcccaccttggtctggagccctgagcccctcactgtcattgcagatcccgaggttcctctcctggctccactcagtggtggaaacctccaccctaatgagcccttgatggtcccaggtccctgtggcatctcacctgtggcctctgttctttcctgtggatccatctacacttgggaacttccacatctctttttctgctcatgacattgatgctctgggtatttcagaaatgcccagatagatggacaaatacacgtccatctatccattagggtcagatgtgagatccagagtggacacatcaatcacctacgtagactgtggagtccaacgccaagatcctcttatgtcccaaacacctcaggtcttaccctggtctggaaatcargcacaaatgagcccctcctaatgttccagcaccactgaccgtacaaccactgtcacgagtgggatttgtgacaacagtcggcaaaggaagaatctgaggctcagagatggttcattaccgcccgaggtcacgtaggcagtggatgataaccagtcgttgaataaatataactcccccccaactccccaaatcaaagctcaaatataagtcattgttcccaaagcgttgaacagggattgaggtgcagagggacggccaagtaagcaaagggcaccgaggaggcaggaaagactcagagatttgttcccggggggtggggttggacactgtagcaaaatattttaaaaaggggaagttaagaggggactatttggttgaaagaaaacccacaatccagtgtcaagaaagaagtcaacttttcttcccwatttccctgcatttctcttctgtgctcrctgccacacgcagctcagcctgggcggcacagccagatgcgagatgcgtctctgctgatctgagtctgcctgcagcatggacctgggtcttccctgaagcatctccagggctggagggacgactgccatggtaaggaccccacaacrctgagctgatggacggctgaaggagggagggtgaccatgtgggaggctgtgagaaggaaggagatgcctccgctaccctcgtcaggaagggcagacacaggaaggaaccagttttatttgctgctacatcctggctctcagtgggatgaaaacaaaccagacagacggtggctgggggtcaggaaagggcccattaccrtctgaaatgatgcagagggcctagtgactgcccccacctcagccctaatggaatgagagcaagggtcctggggagggcagttccacttcctgtgtggctgcagatgacagcaccccatgagaagaaggacccagcctccgattggccacactctgtgtgtctctctatcctgccagcaccgagggctcatccatccacagagcagggcagtgggaggagacgccatgacccccatcctcacggtcctgatctgtctcggtgagatttgaagaaggaggggagcttctaacctaagagggacctcaccccacagccaaactctkgtccctaaggagaccccaggggctcacaaagatcccagggaggggaggacctgcccaggcttcagggggcaaatccctcaccgggaactctcttccagggctgagtctgggccccmggacccacgtgcaggcaggtgagtctgtccccagctcttccaggtccctcctcctcactggggacaaggggccacccccgtgccgctggggatggggaatagcagttctgggctgactgatsggggcrtctggagggtcctgggctgagagctggaatctgctgggttgggtgggaaatgagttagaatcygactcctgatttccttccagggcacctccccaagcccaccctctgggctgaaccaggctctgtgatcacccaggggagtcctgtgaccctcaggtgtcaggggggccaggagacccaggagtaccgtctatatagagaaaagaaaacwgcacyctggattacacggatcccacaggagcttgtgaagaagggccagttccccatcccatccatcacctgggaacayrcagggcggtatcgctgttactatggtagcsacactgcaggccgctcagagagcagtgaccccctggagctggtggtgacaggtgagctgacactcaggggtcccagccccagactctgccctcaggaagggggacggctctcaggggcttctccctctcacagcccagccctggggatgacgcgggtggtctgagccacatttaacacggtgcctccttctctcctaggagcctacatcaaacccaccctctcagcccagcccagccccgtggtgaactcaggagggaatgtaaycctccagtgtgactcacaggtggcatttgatggcttcaktctgtgtaaggaaggagaagawgmacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgagaaattcacagcattgcctggagttccctgagtctccaggcaggtggggagcagccrcgtctcagggcagytccaggtgggatgatgttggggcgagagggctcagggctcctggggccagagacacaggaagatcagcagtgatgwggccccgggkgaaagggaagatttgtggggaagcctgagggtcggctcctggaaaccatgaccaccttttcccaggtgtttctaagaagccatcactctcagtgcagccaggtcctatsgtggcccctgaggagaccctgacyctgcagtgtggctctgatgctggctacaacagatttgttctgtataaggacggggaacgtgacttccttcagctcgctggcgcacagccccaggstgggctctcccaggccaacttcrccctgggccctgtgagccgctcctaygggggccagtacagrtgctacggtgcacacaacctctcctccgagtggtcggyccccagygaccccctggacatcctgatsgcaggtgaggagcccagcgggttcagtcagggacccaggctccgcacaggccctgccgggggagctcaggtagtgatggccgggatgagggatgggggtcccaagggagggagagacagacagagacaggggatgggcggggagggggagactcagagaaaacagagacagagacactgagggtcccagagggagacctggggaggtgtcagctcagagcaaggtggggcagcccctcgcccatccttcttctctccaggacagttctatgacagagtctccctctcggtgcagccgggccccacggtggcctcaggagagaacgtgaccctgctgtgtcagtcacagrgatggatgcaaactttccttctgaccaaggagggggcagctgatgacccatggcgtctaagatcaaygtaccaatctcaaaaataccaggctgaattccccatgggtcctgtgacctcagcccatgcrgggacctacaggtgctacggctcacwsagctccaamccctacctgctgactcaccccagtgaccccctggagctcgtggtctcaggtgggggccttgaccctgtcctctctgagctcaaagtctcagctcagaccctgccccaggagagctctgggctgrgatggagtgagcgggggtctgagaggggctcagccagtgggagactcaccctcagagggaaggaggagaacagggccctcccaggcctgcccaccctcagtggcatcgccagcatcatggacaggagaggcgggtggagggaggggcctggggaggccacaggtcccatgtagagaaatttggtttgaggtggagacttcaggaaagccccagstcctcagcctcctctcattcttttacccaggaccstctgggggccccagctccccgacaacaggccccacctccacatctggtgagtccctgaggcttctgaactcaagggagtgcggcctcccccagggcagccctgggtctcccagagaatcccattcccctcaaagactcgagcttccctccagggagccgggcagagccagaggaggggccacagggtccccagggctctgaggctgggctggtgaggggtggggggtcaaggcagagagaaatgttggggcccagcctgggggaggagcagccgggctgatgtggggagcagggcagccccagccctcacctccccgtcctgacccagcaggccctgaggaccagcccctcacccccaccgggtcggatccccagagtggtgagtgasrggctctgagtgggaggtgggcagggtccargggaggcaggggtgggttctgtcctaggttcagkctcctctggaggtggtgatatagacaggctcctcccctgcytgggcctcagtttctccaaatgtaaaggtgagaggcctgcgggtgggaaagttcctttcagctctgactcccagctgtgacctcctgggagaggaggccycccagggaacctcccagacccgattccgcgggggcctgtcccgtcccacctgcagcagwgacggtgacctggggcaggggaggggagmagagtcrtggttcaggacggtmaggctctttccctgcagctccggggctcggctctggtgcaggaacaagggctgcaggtcagactcctgggcttccttcccagctctgccgcttcctggctgggggcccsgggcaggcgattcccctctctgagcgtcagtttttcatctgtacagtgggtggggtggatgtttstgtgctgcacgactgttgtgggggttggaggtggtgaacagaaggtccagcagtcacctgcacacagtaggcgctcatttcaatgacatcacccccatccctgacatcatcgtgctcaaggtctgggaaggcacctgggggttgtgatcggcatcttggtggccgtcrtcctactgctcctcctcctcctcctcctcttcctcatcctccgacatcgacgtcagggcaaacactggacatcgagtgagtagggaatggggggaccctgagggctgaccgagggtgggctcagggcacagccaaagagaatccaaaccactgggcaaatgcagctttgagaaactgttccagcatttctcaccaggccaatcgacagtcagtcccatctacaaatgtaaagtgtccttcgggctcagtgccatctacaaatgtaaagtgtccttcgggctctgtccatcctatgaggcatttggaacatggaggcaggagtgtttttargtttccttccttaccttcgagctgtgtgtgcagggcagggggctccaatgttcccagggctgaggctctgtccttcttcccccagcccagagaaargctgatttccaacatcctgcaggggctgtggggccagagcccacagacagaggcctgcagtggaggtaattctgcccgaagaccccagactcccacctgctcgtggcccatacactgcccctaaagctcccattcttcccccaggtccagcccagctgccgatgcccaggaagaaaacctctgtgagtgagaggaagaggtgaccagccaggagggagatgggggccccgaagtttcygtagcaatggggaaaggggcrctggctggaaagggtctggggctcagggygagatcatctcaccccacactgtggggcctcagggacatcgcagcccctccctgcatctcagtggccccatctgggagctgagcaggggctggcaggactcagaggtcccagggaaccttcccaagagacaaaccccttgctctgccccagcagatgctgccgtgaagcacacacagcctgargayggggtggaratggacactcgggtgagaccccrccyctgtcccaggcaccaaaggcctcctggtgccagatctaatccwgcagracttctctgtcctccttcccccggctctcagcatcgtcacggtggacccctccttgtccagcaygctgcctccygcctgctgcgacctcactctctcctgctgtcctgggacctcgtgggcctcctcccrggtccccttcctgctcctcatcctctgtttggccgtctggttgttagagctctccccaggcctcaggaggatgaggaataaatgaaccaccccggtcccccaggctccccttcattcattcaaccagcaagtgttcccagggagctcactgtggatggggctccccatgggagctgcagacacagcagggagsaaagccgcccccgcctcctgagctcacctcgtggtgggagacaaaatgcaaataaatgtgccgcgtccaggagtgcaacgtgctgtaaggaacataaaccagrgaaagggcagagagtgtggggcagtggggccagtctgaatggaaggggagggctgtctgctcagctgtcatctgagaagcctggacagagtggggcacacgatcctctgatggacgagcccctgcaggcagaggaaacaaccctgcaaaggcccccaggcagcagcgagctcttgcaggaaggcccgtgaggctgcagccaaatgggcaacgtcagagtgaggagcagaggccagaaccacagcgagggagcggccagaccctccacggccttagggcgtccctgagattccatcgggaaagggatgtaatcggatcacccggggaacagtgaggaaaattgactccagggggtcaggaggattcaaggacaccccccaccactgtctctctccagcagagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggtgagtcctttcctctccaggcccccaggcctcccccacccccaccacgttccttmcctctcactctcccccgctgcaggctgctgcatctgaagccccccaggatgtgacctacgcccagctgcacagcttkaccctyagacggraggcaactgagcctcctccatcccaggaagggccctctccagctgtgcccagcatctacgccactctggccatccactagcycagggggggacgcagaccccacactccatggagtctggaatgcatgggagctgcccccccagtggacaccattggaccccacccagcctggatctaccccaggagactctgggaacttttaggggtcactcaattctgcagtataaataactaatgtctctacaattttgaaataaagcaacagacttctcaataatcaatgaagtagctgagaaaactaagtcagaaagtgcattaaactgaatcacaatgtaaatattacacatcaagcgatgaaactggaaaactacaagccacgaatgaatgaattaggaaagaaaaaaagtaggaaatgaatgatcttggctttcctataagaaatttagggcagggcacggtggctcacgcctgtaattccagcactttgggaggccgaggcgggcagatcacgagttcaggagatcgagaccatcttggccaacatggtgaaaccctgtctctcctaaaaatacaaaaattagctggatgtggtggcagtgcctgtaatcccagctatttgggaggctgaggcaggagaatcgcttgaaccagggagtcagaggtttcagtgagccaagatcgcaccactgctctcyagcctggcgacagagggagactccatctcaaattaaaaaaaaaaaaaaaaaagaaagaaaaagagaaaaaagaaatttagaagaataacaagttattccaaatgaaggcgtaagaaagggaataataacaataataagaggagttgttcatgaggaaaaaccaaagcttgaaaattcaacaaagccagtgaagctcattcttgaaaacatgaatcacactcatgaattctaactacaatgaaaaagagaaagaaagagcaggcatgcatttccatatgggagtgagccagcagacagccctacagatcgtacacacgttttccaaaactaacaatggaacaggcggcaaacctatgccaatatactagaaattgcagattaaatagatgaaatattctaaactggagtttacataatgaacataagagtaatcagagaatctgactcattttagatgtgtgtgtgtgtgtatatatatgtgtgtgtgtgtgaaaaacattgactataataaaaataatctcgagttcacgaagcttcattggtgatttcttacaaatattgacacactaatgaaacacacaaacacacccagagcatcacaaatgtttcttgagaatagaaaaagtggcaatgtgcccaggtgcggtggctcacgcctgtaatctcaacacatagggtggcagaggcggcagattacttgaggctgggagttcaagaccagcctggccaacacggcaaaaccccatctctactaaaaatacaaaaattagtcggacatggtggcgcacactgcagtcccagctacttgggaggcagaggcaggagaatcacttgatcccaggagatggaggctgcagtgagctgagatcccgcccctgcgctccagcctggtcaacagagccagactctgtctcaaaaaattaaaaaaaaaaaaaagtcatgacatataaaatagaattttccattctataacaggcatattttaaactctacagtttttctgtttcaaaataatatttttttaaattttattttaatgttttactttattttatttggcagtttaaaattctacatatttaggatgtgcaacatggtattttaatatgcctgtgaaatcgctaggtcaagctaattaacatctgtaacatcacgtagttatctttctgttaagagaacatttaaaatccactttcttaccaattttcgcgtatgcaatccattgttagcaactgtagtcaccatactgtacaacagatctcctaaacttactcctcctgtccaactgaagtgcggtatccttcgatgcagctctctgattccaccccagcccagctcccggggaccaccttctactctctacttccatgagttcaactggggcaatccgcacataagtgagatcaggcagcaggtgtcttcccgtgccttctttattccgcgtagcgtgacgtcctctaggctcgtccatgttgtcacaaatgaaacaatttccttcttctagaaggcggaatagtttttcgctgtgtttatactgagcgcttcattttctgtatccattcgcctgctgatggacgcttggccgggttccatgtcttggttatggtggctaaagctgtcatgaacatgggagggcgggcatctcttcaacgtactgattccatttcctttagatacacacccagcagtgaaattgttgaaacacagggtagctctgatcattaacttctgaaaaacatctatagtatttttgtggtcattgtactcatttacattaccactagcggagggcagcggttctattttttctacattctcgctaacacttgttattctactctttttcatagtaaccatcctaacagatgtgaggttatagcttcttaaagtttatatgtatgtaagtatatgcctatatgtatatatgcaaatgtatgtattcatacataaacatccatacgtacatatgtgcagatacgtatgtacatatatatgcatgtgtattgtatgtatatatgtatacacaggtatacacatatatgtgtagaaagtgaaattttgcagtgagatatcacctcacagctgttagattgcctattatcagaatggtgaaagatcagtgttggtgagcatgaggagaaaaaatccttacacaccattggtggacatgtaaattaacacagccattttagaaaacagtatggaagctcctcaaaaaactaaacatgccaccaccatataatccagcaagcccactgctgggtgtataccagaagaaatgaaatcggccacagaagagacgtccacactcctaagctcattgcagcactattcacaattgccaagttacaaaaacaattctatatttttgaaaaaggattcatttctcctgtccctgtagagaaaacgggctcaaattacacattagctgagctctgagtactcactcatgtgtgtatctatgagggtgcatgttcgtgtgtgtttcagtatgtggtttttccattctgtgtactcacccatgtctgtaactatgagggtgcatgttcacgtgtgtgtgtgtgtgtttcagtgtgtggtttttcccatttttcctcccttgaggatatcgcattgtatgttttggattctttgatcttccaattaaattacatcatttagaattgctttcactaagtgtgaaacaataaaaattttttttaattgtggctctggaaataccttcctttccctttcactctgtatcaagatttgtaaattttttaaaatttttgttgttattttaagttctggggcacatgtgcaggatctgcaggtttgttacacaggtaaacatgtgccatggtggtttgctgcacctgtcaacccatcacctaggtattaagcccagcatgcattggctgttgttcctaatcctctccctgtcccaactcaccctcctccaacaggtcccagtgtgtgctgtccccctccctgtgttcatgtgatctcactgttcagctcccacttataagtgagaacatgcagtgtttggttttctgttcctgcattggtttgctgaggataatggcttccagctccatccatgtccctgccaaggacatgatattgttcctttttatggatgcatagtattccatggtgtatatgtatcacattttctttatccagtctatcattgatgggcatttgggttgattccaggtctttgctactatgaatagtgttgcaaaaaacatatgcatgcatgtatctttgtaatagaatgatttatattcctttgggtatatacccagggattgctgagtcaaatggtatttctggttctagatctttgaggaatcaccacaccatcttccacaatggttgaactaattacattcccactaacagtgtaaaagcatttctatttctctgcaacctcaccggcatctgtttctccttgactttttgataatcgcaattccaactggtgtgagatggtatcccattgaggttttgacttgcatttctctaatgaccagtgatgttgagctttgttccatgtttcctggccacatgaatgtcttcttttgacaagtgtctgctcatgccttttgcccacttattaatgttttattcctgtaaatttgtttaagttccttgtggattctggatgttagacctttgtcagatggacagattgcaaaaattgtctcccattctgtagcttgtctgttcgctctgataatggtttctcttgctgtgcagacgctctttagtttaatttgatcccatttgtcaattttagcttttgttgcaattgcttttggtgatttcgtcatgaagtctttgcccatctttgtcctgaattatattaaataaagtctttgtcctgaattatattaaataaagcataagggaaaagatgtagaagggaaagtacatgtaatggttaaggcgtctactgccaatccctccccgttcctcaagatgaagcctgacatgctgggtttaatgtgtgagacaagctgccgacaggtcgtttgcctttgtctttaataatttagattaacacagaaatcttcaccatgaatttctgaaggcctttctttagtatctcctggtgttgaatttgctgttggaaggtccaatcccagtgagcatgaaaatccattggaaataatttgcatttttacaaataaataattttaggattttttttttgtttccaggacagacttccttgtatttttttaatgagttaaaaattatataatataaaaataacatttaaaaacccacaattcaggccgggcacggtggctcatgcctgtaatcccagcactttgggaagccgagacgggyggatcacttgaggtcaggagtttgagaccagcctggtcaacatggcaaaaccccgtctttactaaaaatacaaaaattagccaggcatggtgtcaagcacctgtaatcccagctactcgggaggctgagacaggagaattgcttgaacctgggaggcagaggttgcagtgagcagagattgtgccactacactccagcctgagtgacagagcaagactctgtctcacacaaaaacaaaaacaaaagcaaaaacaacccctcacaattcagcctaggatatgtttattaaatttacatttgtctttttgcttaagattgctttggtattcgtcctctttttggttccatatgaattttaggattgttttttctaattctgtgaaaaaaatgatgttgatattttgatgggaattgcattgaatctaaatattgctttgggaagtgtgatcattttcacaatattgattcttccaatccatgagcatgggatatatttctattttgctgtgtcatctacaatttctttcagcagcattttgttgttcttcttgtagagatctttcacctcctcggctaggtatatacttagatatttttaatttttgcaactgatgtacaagggattgagttttgcagcaacctggatgagctggaggccattattcatgacaccacatccagctaatttttgtattttttgtagagatgcggttttgccatgttgcccaggctggtcttgaactcctgggcccaagtgacccgcccgccttgacctcccaaagtgctgggactgcaggcatgagccacggtgcccggcctatcatagcacttttgatcattgggataattcctcctccttgtcatttttggacacatgcttcccacatgcctcatcttccagagagggtttccaccagggctgtgctgggagttaaggctggaaaaggggagatggttccagctgccagtgccacatgagtctactcagggctgtaaccagcagggaaggtccagtgtgagcctcagactcgcatgtgggacagacgcccatgtgtgacaacgctgcagtgaatctgtttcacacacatggaggaggcggctcagggctgaccatggacctgagtcaatgagcagagatatcccagtgccatccacaaacacaggggagaaggagccacaacttctcactttcatccaaaaccccgacccctccctgtctgtgagggcctggggttctcctctgtctcatacagaggcagaaacctcccccttagtgacccccagactttgcaagtcaccagcagccgctcggctctggcctcttctgcttcttaaggtttcctgcctatgacaggaagtctcatttctcattttcttcatcggaccatggctacatatttcagacacattataagtaggttttcccaatgttaggagcagatgtgggctgttgagcatttaagttgctcaccgtgactgtgcagtccaacaccaggatccactcatgtttcagcccctcaagacttaacccggtctggaaatgtaccatgactgaggccctcccatgacccaggcaccactggcccccaaaaccactcaggaggggggttcatgacaacaggctccaaatgaggaaaccgaggctcagagatgggacttactgcccaaggtcatgcacgcagggatga

SEQ ID NO: 12312 - DNA, 17781 bp, Homo sapiens
tcctgccccaagacccagcctgcctctgcctattgtgatatctcgtccctcaagacgaagcctttcctacccactggtgtttctttcccagcttatttgagtaaagggattttctatttttttctttttcatctctgggccactgctctcaaaggtacatattaggatgagatactgtttacccagagtactctgtgtcaccattattcagtaggacttttgtttcttcaagggaccttagaaatcatttgcatagtctaactcatttgactgaagagagaaacagcccagaggagtgatgtggcttgcccaaggtcacacagcaaattagagacagaactaggattagaaccttctgtacatctgcacgggcagccacagcagtaataagcatttattgagcatggctctgggcagggcattctgcccagcatggacaaaggggaagagatagagcaacttcccttggagatttgggacctagagtctagatggcaggacgagacataagataaataacaggcaaggcagcataggccccatgcaaaatcagtgctataaacaagttctacagagaagttcagaggatgaaaggtttccttcccaggcgaggccagtatggaggaacgtcgtgggaaaagctaaggaccaggattctgccactaatgctctttgtgaccttggaaagggcatttcctccctctgtaaagtgtagttagacaagggactgctctcaggtcccccctggctctgtcagtcttgttctttgaagagagagctggaattgaagcctcttccttctcccttcatctgaaaactcggaacagggaacgtttgagaggttgatcaattcctgaactttcaaaggtagccggagaatcaactctagggaggaaagcctgaggggcactattgccctataacccagggacagcaggaatatggggaaactgtggcataacaccatagaaaagaccctgtcacccagcatcccattcccaaaaaaagtttggcaggaatygaagttaaactggggaagcagggacccctggaaggttggggtcccaatgggcctcagattggatttttattccttcctgaattcaaactccaaagctagaggagctctcccactcctattgtggaaaagggcagctgttgcccctgtccccagtcaggggaaacttggagcaggagtggaggggtcatctcaggaggcctaaggagaagtcattagtcggagatgatgcaattgtgagtaaatgttacagcctctggctcaggctagttggatgctcagaagctgggggctaggacccctagagtccccactatctcccccaactcacaactgagaaggagttagataaactgagggaagaaagaaaaaaagtgaaatgagagggtatccagaaaaggataagctagtgaaaggaaactaaggaagtagggggttcctggaagggctgaaggcggaaagggaggctgaaagctgtgctgagagggatccgagcctgaggggagaaaggccaggcgggcgtggccaggaggggagtaagcccagagctggtggtgacagatgggtggacacaaagaagagagcttcagggaagacagatggatgggggagggaagagaagaggttgggggggttaggggggagcccagtggttggaggccataatgagattggagatggactatgagctgaggagaggtgagtgaagaggagagaagaaaggggaggccgccttaggagacaaaggcaatacagcctagagggccgggaggagagggctcagttgggtgctgagaaggggggcttccagccgggctggcagcagagagagtgacagattgtgtagtgagccagagtggagacccgctgtcaccttccagaggcacagagaggtggagacagagaaagacagactgacagagaccatgtggaaaaacaaggaaagaagctaagacagaagacatccaagacaggctgtcccttcccagaaacaacagctcctgcccaggaggagcaagctctgcctgtcttgctcctgtgacccaaaacactgccactgttacaaaataacaccctagccataggccactcctgggaagggtcaggcggtgtggcacagcgagggttaatgtcgtctgctgtccctgccagccgcttgcctggttgggtccccagggctccccacatatgtcaccccctctcctgccaaacccactgcttcccagctcctccaggccctccccccaccctcaaggacaaggcccaggcccctgtgtcttccctacacaccaacctccctcccctccctcaacgatctacctctcaggctatggggaaagatttgtgaatcatgatctgaaaaagtgaatgcctataaaatgtaaaatagcaggaacactcattctattgtatcaggttttgcttgattatcggattatagcaaataaaagccagtggagatttttaaacaacaaaaagaaagtaaaataacaacaaactataaagccataatcatcctccttatccccaggccctggtcttcctgtcctccttgcagcaaagacccacacacaactccaagggttctccctttcactggggccagaggccagacaacctgggttggcctcagagctctcccctgcctccacaatcataatgcttcagatatatgtgtgtatgaaacttcttgccacttttaaatcaccataggaggttgggatgagcactttatacagttcacctagcactttcccatgcattatttcacctgggtgtcactactataacaaaataaaactcagccaaggttaagtgacttatccaaggtcaccaggacttagacccatgtgtagctgcccccaaatttagtagatgtagttcttcccaccatttcatgcgtttatgtcctctttgtcacaactatgttcttttttagctactcccctaaggagcaaaagctgaaatcctaagtgaaaactggggcaggaggccccagagtccaggatcctgggatgccagatgcagaggaggaggagcagcccccagagcactctttcaccctcctctcccgtggaaccttagcttgaactgcgacgggttcaggcggtgtgcttcagggatggaggttgcagagcttaagtatctgagcaaaatggcctgaaaggagggagccctgcaaggggtttggcttcttcctgcatgctctatgccatcctcaaggttcctttctgcttcgggggtctctctagattctgcttcttttttcctcaatgtcttactttttgggatctggcctccctgtttcagtaatagttcctcatctccatcgttcagtttatcacctttccccaccttgttctctttgtctctggtattttttgtttcctcccaactgtctgctctctgcttaccccgtgcctatgtggccccaccttgccttggggcctccctcaggactctgtctcatggtgtcagtatttccctgccgctgaatagctgtttcctccacatatgtattcatccaagtctgtgtctccctagcagcctccttttttttttttttgacggagtcttgctcttgtcacccaggctggagtgcaatggcacaattttggctcactgcaacctctgcctcccgggttcaagcgattctcctgtctcagcctctcgagtagctgggattacaggcgcccaccaccacgcccaactaatttttgtatttttagtagagacagggtttcaccatgttggtcaggctggtctcaaactcctgaccttaggtgatccacccgcctcggcctcccaaagtgctgagattacaggcgtgagccaccgtgcccggccacagcatcctcttttaaagcctctccccaagtctctatctctcccatagcttgggtctccaagtcttccacaaagccttggcaacctggcaattctgtttccattcttttttttttttttttttttaaatctttttacctcctttgtgtctcaatctccccatgagactgtgtcttcccatttccctatgtctttcccatgtctgttacccaatgactctggtttctcatttttttctctccctgagtctcggtatcttcccgtgtctttctcgtcgtttccctccgcttcccctgtctctgttcatctccccttctttctgtatctctcatctcccccatggcactctctcctgagtctcttggtctcccaatttcttggatggggtggagggcaggagagtggaggaggtagaattgttgttgctgggggctcattaggtggagattggtttttaatcagcaccatggcaatgatgatgcaagaactgagatgccacctgatcccctgccccccagcccccctcctcaagcctcctttcccctccagctcagcccatctgctggcgcctgggcacctgtctgggcctgcccaggtgggagttggcacctcccagactcagggatgggggcaggtgggggagcttggggaggaattatgggacccccttagggaatgcttcaccctggagaaagcccagaaaaggttgaccagcaacagggaaatggcaagtccctccagcctgaaggtgggatgtgctcctactaagctctaggcccactacacatattatctcccttaatttccatggcaacctaagaagcagctataatcaaccccattttacaggaaaagaggtccaggctcaaaaggttgttatttgtccaaggtcacacagctgacagagcctttttcactgtaccacactacctctggagtcctctccagtcatggttcttttgaatactctcaaaggttcagagaagacatccaacagctgagtggggagagaacttcagacactgaaaccctctatgcactgtctctctatgcactctggtccctgtgctgcccctcctcaatcctgccactcggcaacacacacatacacacacacactcacacttacattcacattcacacacacttgcatatacatgctggaggctgctgagctattgatgggagcttaatcagtgcccatttgcatataattttgtgtctggttttcttattgctgatttgatgccctcaaaacacactcagagcctgcctaggctgccctgccctcctctcccagtgtccttccaatcctggttcttcctgtcttggcactcctccactcctctccttttagcccttacctctttcttcctaagagccctctaattcccagtgggtcaggttgggctggccagcctagaaaaactccttgtggggtctgtgtcccaaatttgatcctgctcctccccttggtgatgggttaggtaggaagatagcgggtggggtaagagggtatgggggtgattgagtcccagggtgatgagggtaggggcctgaacagttgctacaggcaggctggcaagcagtgggtaccagctttatgaaggataagagcttgagggccaggaccctagggtcctcttctgcattttagtgctacccacttgctcttttctcggtttccctgttagtaccttgaagagtctccctctcaggaaaaaagagacaccaggaaggggctgtccaagtcacgctgggactccgaatggggccatggcacttaaccatagcttgctgggagcctctgccctgctgcctctggtgtgggagactgagggggttcatctgtggtcctgccctggctctcgccccagccccaccccttccccagctctccatttcttgcttatgaaatatgcatggagaacagatgtccctgctcccccgctccccgcccccacccagggccagcccccgcccccagctcccgaggggttcccagatccctctgccaatggctgcctggcctggctgtttaatattgatgaggggggggtgggcctgggccagccaatggagagctgggggtgtgtgtgtgtatctccatatatatacatagggctgggccagctcaggtgtgtgtgtctgagggtgtgtgtgtgagtgtggctggccccagtacctggccaagcccaccacttccacctgggccctacacccccacaatgtgtacccctcttatctgccctggagcctgtacagccatgccacgctacccctgagagtctagaaagctggtcactaactttgcagacggatgagccttgagcacccagaggagactggggctgtcaacgctgccccttgtcctgccggcttggatcccctgacagggtccttctaggtaaaggggaaaccatgggcggggagggatgggcgtgtccctcccattctctggctcaagccccttcctagagcctccctctagttctctcccttgtgcgctgtgtctctccctgtctccgcgtgtccctcttctccactcctccccttcgactctttgtgcctatctatcctcagttgggttagggctggcagaagtggggtgggaagtcctgtcctgcaggcttggaattgctgctcccctgatccttggaccctggaactttgagaccagaagtggatttgggggtgaggacttgatgggtaaatagaagctgctgccgggactggaactggggaggacaatggggccaggtggagatgagactggggccagatggggagcacggagaggggaaggaagggcatggcaaagtgatgagggatgaaggaacatagggaccgggcagagagaattagcctgtgatagatgtgataaatgtgttgggaactccgcagctgaactcctgctcccagccccagcatggggggtggggagttgggggcactaaacatgtactgggaggtgctgactttggggcctcccacactattgccatccccccatagttcatttgaaccccagaatatggaatgtgttctcaatttcagcactaaccaccttctgtttcctgttaagattgtgtgtgtacttgtcatcagatgtggatgactttgcatccctccagagcttcatagctgtttgttggcttgacttgaacctatcttctgtgtggtggggtggggcaaggcttgggaggatcctaacccctttgagagtatctatcagacaggaaagccagggctggggaggaaggggagatagtgatggtgcaggcaccttggtgcttctgtttctaatcattcttagttgagctgatggtgagtggcccactgttcccctttaacactgcacacaagcaaagccctttccccagcttttcccaggccatgtttgtgctgccttgccctgatctcctctggtcctaggacaagcaaaccttagctgagtcccataagggtagctccaaaaatctgtctgtgtcctctgcaggccgtgtctgaaccttccttgggctatgggagagtatgggggtagaaggttgattatgttccctttccccaatcttccttgcccagcctccaaaagggccagggaatggcaagggctgaaaatttcgaagacagaggtggaggaagaggctggttgtgcacagtggggtggtggtgagaagagatatcttcccctggttttagtggacaggatctcatatctacaatggttctgctgggaaggtttggggaactgggaggggagctgtgcagagctggggcagctgcgcagagctccatatgtcctagtctattctacaatgggcaatctgtgtgtttatccgctcctccacctcaggcagcaagggtggagaggggccctgagagggaggggaccacagggccaaggcttgtattctcccctcacaactgggaagcatctagagtcatagctaacttctcttggggctgtggctgcagtcttgctcagattttttcctccttttatttattcatttagataaaaaacagcatacaatttataatcttaaccatttttaagtgtacaattcagtagtgttcagtatattcacattgttgtgaaacagatctctagcaatttttcatcctgcaaatgtataattctatacccactaaacaacaactcccctttaccccctccctccagcccctggcaacggccattctactttctgtttctatgaattagactactttaaatacctcatataagtggagctatacagtatttgtgttgttactggtttatttcacttatcatcatatcctcaaggttcattcatgctgtagcatgtgacagaacttcctttttagggctgaataatattccactgtatgtatataatacattttgtttatctgttgtctattgatggacatttgggttgcttctacctcttggctattgtgaatagtgctgctatgaacatgagtgtgcaaatatctctttgacaccctactttatttgtatatatacccagaggtaggattcctggagcatatggtagttcyattttttattttttgaggaacatttatactgttttccatagtggttgcatcattttgcaatcccaacaaggcataagggttccaatttctccacatccttgccaagacttattttttgtttgtttggtttttgtttttatagtagccatcctaatgggtatgaagtgatatttcatagtgggtttgatttgcattttaatgattagtgatgttgaacattttttcatatgcttgttggccatttgtataaaatctttggagaaatgtgtattctagtcctttacccatttttttcttaaaaaatgtttatttatataaatttatggggtacaagtgcaattttgttacatgcatagattgcataatggtcaagtcagggctcttaggatgtccatcacctgaataacatacacggtacccattctgtaatttctcatttcacscccctcccaatccctcctttgcccatttttaaattgggttatttgattttttgctgttgttgagttgtaggatttatttatatgttctggatattaaccccttatcagatatataatttgcaaatattttctcccattccatagattgccttttcactctgttgattatgttcgtcaataaattaaagtctgatgtggtcccgttttttctatttttgctttttgttgcctgygcttttggtgtcatttccaagaaatcactgctgagtccaacatcatgaaggtctctccctatgttttcttctaggagttttatggttttaagtctttaatcctcttgctcagttttaacctgcctggtgtatccttctcatcacttctgttcctttcctgttactcgttttctcttcccttcttactacctttcgtcctcctcttcctttcaccctgtccacctgcctctctgtctctcggcctctccccaccccccgacccccaccagtttctgctgttcttccctcacattcacagttccttacccctcccagcccatctcaaacctgctttcccacctctgagctgagcattccctcctccctccgctgctatcacttctctcttctctttttcaggcttcagactggcaccctgaccatggaaccctgaagtggcagtgacttctagagctcagtggcagaccccacgacccttcctcccccttcctccccctcccaccaccagctttcaagctcccagagggaggggtggggaggggatcctgatctcacagggcagggggcttccatcatgatgctcaactcagacaccatggagctggacctgccgcccacccactcagagactgagtcgggcttcagtgactgtgggggcggggcgggccctgatggtgccgggcctgggggtccgggagggggccaggcccgaggcccagagccgggagagcctggccggaaagacctgcagcatctgagccgcgaggagcgccggcgccggcgccgcgccacagccaagtaccgcacggcccacgccacgcgagaacgcatccgcgtggaagccttcaacctggccttcgccgagctgcgcaagctgctgcctacgctgccccccgacaagaagctctccaagattgagattctgcgcctggccatctgctatatctcctacctgaaccacgtgctggacgtctgaactcagcctgtctcccacctcccgggcctctctggggcccctttccaccgctcactgcttagaaaggccgcatcctccccgagcccttataccttggcatggagtcccaaaggccctgggcacaggcagagagcccaccggctggtcatgagggcctcttcctttctctgacccaggcacctcgagggctattctcctgggttccttccggggtttatygctgaggcccagctgtgcagaattgtttgctagtgtggttggtatggaatccttgctggctttactaagccagccacacttggagtctgcccccaagctctctcactgaatgctgcctcttctacccctatgtccaaattttcagccaccacagacctcagctgtgtatcctatctgttctagcttctcctgcccctggtggggatgggctgtcagaattgcaagggaggaaggctggggttagagtggggagtgggcttcttcctccaagatctcagtctctcagtgcttggcagaggggtgaggccctggggaggcaggggttggtgccctgactcctgtgaggggaatctcagtagctgggaattatggaaaaactcttcctgtttctgtccatcttgttcctgtggcttagcacatacagacctcagatcttacttggtagtgagtgccttgccctctttgagctatttggctacttccctgtccctctgactcctactgtcccaattttctccctccctgtgtgtcactagagaaaaaaaaaaacaaaaacctagattccggattaggggatgacatcccaaacagcccggagtatttgcagaaggctcaggcaacgagtgggccacatctcacttctgcttcctcatctcagcccactctgaaaatgtgcagcaccctcactggttcctccccccaacgcaaggaggatgcccaattgttgccctctraaaatgcacagttctcctggccctaggacttacttattacatttttttctctttccttgagctgcctttggcaagggaagagacccccaactctgcgcccctactccatgctgctgatccccacctgcgcactatagckcagggtcagcagtggaatgaagggccttagaacctgcatagaagaaatgaactcactgcatttctgtgctccctcctccctcgcaccaaactcctagctctacaagtatatttatttatttatttatttattcatctatttatttacttatttatttatttawaaatattgctatttattgccgagttgtgcactttggggtagagtgaggggctcccagcagctctagctgggtctctcttgcttcctccctgcttacgcctttccttttcttgctccttcttcaactcctggtgtgtgtgagcatgccctttgcttgccacaccatatcctttccccagatccacctgtcctgacactctagtcctccaggatagtgctcctcccccagctccagggctcctggatgtccttcctcaactccctccacccctagacaatcctacctggtcccatctgcctcttttctctccccagcctgccctgtgacccttgcctcttcctgatactcccaagagcaggccccaggggtctgtgtcacatatctctgtgtgattccttctggttgcatccccaatttcatacaaaaagaaaaataaaagtgacctcgttctagcaccaggtatggttgtggctcattcaattgggttaggaagctggcctgcaggttatggtagggtgggcattgagggtcctaggcttcgtaggctcttctgatggggtcaggagagctcagtttggggaacaaatgaagacagagaaaaggggccacagggaaaagaggtgcaggggagagtataacatacaggtccaagatctcctcaccaaaatctgggtgccagatactcccttcttggcactaatttagtgacactatctgacttctctgatgttgtgcttccgctcctgctctctatggcctgagaaggaggtgaatatttcggtggaacccaagttaaacatgtgtctgtgggtccatgctgctgggaaaagctatggtatgaaactgagacattgccttcccctttattgtctctaggctgggtcaaaattccctgcaatctcagttcttggcctattttgtgttccccagccttaggatactggggaaaacagatggcaggcctgggactcagagaagaatatggacagggataaaaaaaaaaaaagagtgctgaagggaccctcaaatgaatttatagatggggacactaaagctcagagaagggtagggtcttacccaaggccacacagctaactgggggcacaactaaggcccaaatccaggttctttctaccatatgctgccaactcccctctgcctccctaaaatgacccaggctgacagttagccctcttttggaccccatattttcataggtgcattgataaactagagaggatttagggttgtgtggcgaagaaaccaaaaggtctggagaccactttatagaagaaatagttgaaaaactgaggatatgtgtcttgataagagtagacttgggggtaatatgacacccatctttaaatattgaaagaagaatcaaaaatggatattctgtggggccccagtaggccgaacaaaacccgtgagtagaagttagaagaaagcagattttaatttgaagaaaaattttgcaacacctggagctgtccagcaatggcactgactgcctcaagaggagaactccaaatagagaagctggagagtcaaccacacgcagagaaatcatagagcacattgctgcctcagatggaacactggctaggttcattagaagatcctctccaaacttaaggtcatacgagaaggctgaaggcaaacagcaggagggaaatgcagagacaactttcagtccctgaaatattttcttttttctttttatctttttgagacagagtcttgctctattgcccaggctggagtgcagtggcgggatcttggcccactgcaacatccacctccccattcaagccattctcgtggttcagcctcctgagtagctgggactacaggcgcccgctgtcatgcccggctaatttttgtgtttttagtagagatgggttttcgccatgttggtcagactggtctctaactcctggcctgaagtgatcctgctgccttggcctcctaaaatactgggattacaggcatgaatcaccatgcccggctatgggttttcatctttgatgaacaaagaatgacataagcagcatgaagggcttgagttagacctagggaggagcttccatacaggaggacttgacatcttccccttcccatgtgagttaaatgacatgtgctctgcccagagcctggcaaaagggaaggctgaactgagatcagggagaacttcaggactccaaagggccagagttggacgggaacacagaaatcactgaatccaacaactttatttcaaaggcaggtaaactactgtccagacaggtgacgtgactcacccatgatgatggcctgggattagaagccaagtcttccattcctggccctgagagctttgtgcttctctgtgctcagcagccacagtcctctgggctccctgcctccctctcttgtctctttgcctgggctggagagcagaagggcttagggggcccctcccctcagggatccctgagggcctggaggtggtgagagggggaagctgcagctgttctactgctagctccgaatttcttcagataatcaattggcctcgctgccgctgtcgctcttgttgctcttctcactctgggaaggacaggagaaggaggtggagagtgggaagaggagggagcaggggaccaggcactgggggaggagggagagggcagggagatggaagtccctgggctgaggggaaagtgaaagctttggggctagcagatagggaggatggggaaaagggattgttagaagaggatctgctctgcatccctcattccacatccctctaaacccaactcgtgggtggtggggtgggggaggggcagttaggaggaccccagaatgggactcttgcacttcacccctgcttccttactccccttgccaagtatcccatgcatggccatagctcccccagctgtccatgccctcttccagtcctagtgaccacaggtgcctgaccctccagtcctgtcttcatcaacgccctgtcctgtaactcagcaaacccatcaccagtgacagagcagaagtcaaggccccaggggctgggtgggggttgcctaaaatctctctctctctctctctctctctctctctcacacacacacacacacacacgcgcacacacacacactgtcataggctgccaggcatatggcctctttgtgcccacacaatggaggccctgtctgtgccctttcccaagtctgggcacagtgtggagggtgctccgcttcctcattccacccacctcccttccctctccacccccagtgcaggccctgtcttctttgcctttgcttcttcctctttctggaaagccctttctaccacccagttcctttatctttctgctttcttcttgtgttctttcctgagcttttgacctctcattggatgaggattatgggcagaagaaagaggctcacagtgctgggatgtcagcgcagggaggagaagggagcaagcagagatgagcctgaaaggctgagagggagtggaagaagggaggcagtggtggcagtgcagcaacactgtgctagaggggagaaagcccacacccggcagccagaggtcccgtgtccctgctctgtctccacctttcccctttgtgccacagtgagcaaaccgcatgccctccctgagcgacagctttttcatatggaaagcaggaaagacaacaagacccaccggggtgtgatgaggattaaatgagatcatcgtgaaagtgttcaacaccggaaacgctcatcagatgctatctcaggggcagtaagtagcagggtcaactgtactgtcatacagtttgtgcactttacaaagcaccaggctaagggcagtgcaggggcctgacacccaaccccacttgtactagaccagctgtgcaccaggatgcaagcatcccctgagaggtggccctggaactgagcccctcatgtgggttcctgagcattggtcaggagtccagatgaaaactccgaagtcctgaccaccttgggaaccaagacagaatggaaagggacaagaggctaaggggaatgtctctccctgagggggaaattcctgagcttagtcttctctgagcaaatagacaatccatgagatctactaaactaaggatggagaaactgcagctgaggagaagaagggggctgaagaagcagaaaaaaaagagggagacatggatcgagggtgtgatcagagcaatgtgttggtctgaggacccttttctggttccctcgtcctccattccctcccttcagcaagttgaaggctgatttgattattgcttgttgaacactgtcccctgctggctactagcagaaacattttccctcttccctatccctagctaggagctgctgagagcctgaaaaagagaagaaatgacctgactggggacaaaggacgaaggaattgcaattctgcaatctggaattctctacttgtcagagatttctggaaggtgaaggaggcttgaaggctgactaggggtaaacagagtttagaattcataggtggttcatttacatatattatggcctataattttcagattgatttttttctggtctgtgtctgtttcatgtattgtgtgtctgtgttatgtgtgtgttctgtatctgggcgtgcttacctgattctgtggtttttgaacacgtgtatatctgtgtacttttttgtgtgtgtgctctttttaatataggagtctgagtgacagctggcaggtatggagcaaggagagggagctgtcgaatttcctctttcctagaagcccgttctccccttgaagttttacctttgtctcccagctccatgagctataacctatggctatttataggttacaggttttgttctggctcctgcccctctttggacatcccaagctcagagccttgattcgctctaacctgggactcttgggcctcccaagcagggtctccagtgtggttcccaagtgagaatctctactgtctatgtcccttttatcctttctagcattaaactccagcctccttcttttataagcttgtagctacctctttcattggttgatttcaatttattcagtgcagcatgcctttatggaatagccaatgtataccgggcactgttctggattctgaaatacaggatcaggccctccccaccacctacttgggagggagtatgggagacaggcatgtaaacatatcagtttcccaacagtgagaggcatctgcaaggaagcgagtgattacctgagagagggtgttggtgaggaaggcagccggtaaactctgagctgggttttgaagaccatgagatacgtacagtgaattctgtggtgtgctccactcacttctccagctgtggaagtgttgactcacagctgagtccctctccaggaattgcctttggaggaagaaagccgccttgcctgaggtgttgctctttccctagggcaatgactggttgatgtggggttacaaagttatcccagcttgagagcccccatgggatggacagaagcctctgttgccattgcattgcttttcagtttctctctcggcttattgcagcttccctcacacctcacaggtgttctcaagaactctcctgctggcactctcctgtatacgatctcagagttcaggaatccacttcccagggaaccccacctacaaaggaaaggcactgtaggtatgaaggcatggaaccctgagaagctctggtgagcaagagcacactattagcagtgtggtattgttgggacattaagtgcaaggggctggtgggacaggaaagtgacggaatggtctggagaggtaagcaggggccaggtcaggagaagcataatagggagtgtgtgcttggccacacagtgatgggaaaccaatgaacattctctagtggggtagataaacactatcatcagatgtacactttagaaatatcactttcagaacatttctttctttctttctttctttctttcttttttttttttttaagagagagtcttgctctgtcacccaggctggagtgcagtggtgcaatctcggttcactgtaacctctgcctctgggttcaagtcattctcctgcctcagcctcctaagtagctgggattataggtgtgcaccaacacacccggctaattttttatttatttattttttgagatggagtcttgctctgtcgccaggctgaagtacagtggggtgatcttggctcactgcaatcaccgtctcctgggttcaagcaattcccctgcctcagcctctcaagtagctgggagcacaggcgggcaccaccacgcccgactaattttttgtactttagtagagacggggtttcaccctgttgggccaggctggtctcgatctcctgacctcaaatgatctgcctgcctcggcctcccaaagtgctgggattagaggtgagagccaccacgcctggccactt

SEQ ID NO: 12313 - DNA, 189817 bp, Homo sapiens
  misc_feature (1)...(189817): n = A,T,C or G, or insertion/deletion polymorphism (see Tables 1-2)
acagatgtgcacacactcacagacacatacactcacatagacaatgcatacacacagaggcatacatgctcagaaatacccatacacacagatactcagacacactcagtcgctcacacagatgtgtgcacagtcacatgcagacagacatatacactcacaaatatatagccagacacacacagacacacatattcacagggagttgtttaatggaaacagagtttcagttttgcaagacagaaacattctggagatgggtcatacaataccatgaatagccttaacactactgaattgtaaactgaaaaatggttaagattataaattttatgtgtattttaccacaattaaaattttttttaagacagagatatttactgtaagaaggtgggtacattagttaaatctttctttcctaaggcgagaacagctttcttccatttgcctgccatgaggtgaggcagcccccagcaatccatcactgctcctcgggaaggtagattacaggtgatcgtagatccctggcaagagtgggctatgcccagggaagccaaagcaaagagaaaactcctgccatctgcacctgtccctggcatgggttttcatctttcctgaaagaagaaggaaaagaggctgtgggagacatggtcctgtcttagatcccacgccctattgtggtggcaactgcgatgatgctttataaattccttttaaaatgtcattgccagactttgtgaaaacgctcgtgaggctttgaaaaatatgtgaatggatacagagggccgcttgccttcccccactgctcactactgtggctagaacctgactacaaactgcccacccagcctcccttccatcctctcccccaggacacttccatctggagtggaaagttttctccagctcctacaggatgaagggcagtgcaggagaaagactctcccaagagacgaacttgggtcattcatgtcagagggtctggcatctttgaacaaggccagttgttatttatgtatctactcacctccctctggaattacatctataaccaacaaaatccaggtcttgttcagctggaaaaaaccagcagcgtccagacatgactgggttttttgtttgtttgtttgagatgtgaagttttgcatgtaaatcraatagagtttgccagaaaattcattgcctgaacaaatatggtctgctccttgggtattgccaagtaggagaaagatggtttgtctggagagactgcagagaaaagtgtcaataccatagaaatgaaaactcagaattaaaggatcaaggtaaggggatccggaatccctcctcccacgtattttctgtttactcacaactcccaaagtttactacatatttctgagagacgccaggatcccagagtgatgtgtttaggaatttttaccctgcttcttggggaggcaatggggtgagcccttcagcttcagaagagtgagaaggtatgcccaggcccgtgcagccagagggagttcacgtctccttggaggtctcatgctgagctggtaaggccaagaaagtaggggcagaactggattacccttgtgacgttctcattggagtctcctcgtgctccaggcctattgacatctcatgtgagggactggccatgccatgatgaaagagcacagtgtgttgtggcagtcctggaactgtttgcccagagagcctttcctcaccctttccctgtatggatgcagtaaagagttaacatagcaaacctgaaactggcttagaaagccctacttgcaagcttggcccttgtctggcatctgggaacttggacttcaggagtcttcccactgttccctaactgacaagtggggctggctgggcctaaactgtacaaaaattgtggctcatgcttaacacctgcttccttcagggagtctggaaaatggctatgagctaggtagagggtacctatgtgaccagccccccataaacaccctgagcactgagcctctggtgagcatccctggcagatgacattatatcagtgttgtcacaactcattgccagggttggtaggcacagcccatgtgccttgattaggacaggacctttgggaacttctgcctggtcctccagactttgcccaagtgccttttctctgctgatttggatttgtatcttttcgtcatgatttatcgtgtagtatatatgatatatgtacatttgtatctgatcatagctacgtgggtggccgagtctggtgagtcctcctagtgaatcacagaacctgggggtagccttggggccccagcacaggagtggtggggctaactttgcaggcggtattttccagagtcctttgtcaactgattctagtggagttcagcaaaacggcagacaagggagggagagggagcgggaagaaagggacaagctaggatcattcttccctccctcttgacctcagacagtgtttcttggaattatgggatctaaagctcccaccagacaggaccacacggttccagtgcctgacctaccctcagtcctcccgctacaacgacaccaactcctctctgctgttgctaattgtggagttgattcaccttctcgtgtttggtttcttgtctcttctctcacctgtgtaaccaatcccctgccttaaattccttcttttagaaagacctaaagtggtttttgttttcctggatgaaccccgtctgttacatgccttaaatatttacatggctccacttccatgccaggcagggggcattcagaaataaaagacaccatcccatccttaaggacctcagagcctatgcacctgtggaagttgcatccctagcacagttcaagattcactgtgtgaccagaaacctttgttctgatgtctcagccatataaccatgaggaataccctgtaaaatgaatgggcttcaaccgcattctagggcttggtggcttagacacatttttatcgactttgtttagcacaaggaaagccattgcatttatgatgctcttgaggttagtggtttgggggagtcagaaagccaaccactgtgtgtgtatgttcacaaagccaataattagtctaaggccaaaagtgacaccgtggaggtggttgtgagggtgacaatcctgttctgaatgcacaactcaaccccaagtcccaggggtacctggcatctgcgtaacctcatctgaagggtgcaagggtggctgctcatcctccaaccccacatggatgagggtatcttggaattctagacactcagatttgatgtttgccaggagaactaccagaatatgatcgttaaggattgggggagggtttaaaaaatactgaggagacctgaaattgtatgaatgctgaggggaagcagtgctagacatctttagggtctttctctagcactcagcaagggatgtggcaaagacggcctttggatagttaagtggtcagcagcctctctccagggaactctggctggagtccctacctttttgtactctagtgcaggtacagccaaggaaacagaaaatgatcatgcagtgtgaggagcactacaacaaggcaaactccttgcaagacaactggggagtcagtggagggagactgggcagggaagaaagatggcagaggaagatgatagggaagaaagatggaagccaaatggcagaagcttagtgatgaagaggaggagaggagaaacaacagtggaaggcagggagggtagattggtgttgggggaaggttttttaaaaatactggagacctcaaattgtatggatgctgagggaaagagcagtgctagaggcagggtccagcttgtataggccttgtcagtttcagcttgcaatttatccaaaaagcaaagagaagtagccatataagggctttgtgcaaataatttgatttcrgattttagccctgaaatgctcattctgactgcactgtagagaatggactggaaaggggtacatacacgggtagattcaagggctgtttaagaggtaggatagaaaatatttgctcaaggatcggatttgatgattgagggagagaaacaaggaagcctsaagaatgatgcccatgtgtctggtgtaccacctgcgtgcaaagtgatggtattcattgaggtagggaactcctgagatgcaccaggttttccaggaaagtgatacatctcatgttagacatgatgagcgtgtgttgtcactgggatgtgacaaatgaggatagccagtaggcacttagatacgggaatctgcaattctggaaaagatcttggctaaagacccagatttgggaggtgtcaggatatagatggaatttgaaaactatgggagttcctcagacaatcaaggaatattgcgctgcactggaggaaaccacagagtgttcaatgtcaaggaggcctaggaaaaataccttcaaagacagagttcaatgcttccaaaaggtcaggtaaataagaactgaatcctgtcttttggcctgagcacaggccttggagaccgtgacctccactttcagtagaatgatgaggcggaagccagatggcagatacttagtgatgaaggggaggagaggaggagtaacagcaggagtggggacataggttgggggaggtttttaaaaaaatactgaagagacctgaaattgcatgaatgctgagaagacccactattagcaagcaggagcttgaagctgcaagaggaagagtacrtaagagtcacagcaaagccccggagaacaaggcaacgcagaagcctggtttggagatgcagagggaggagggacctttccaacttcagtaacaagaagaaagaggaaaagatagataaggttgcaggcaggttcatagattggtagcagaaaattgagagaatttctaaccaatggcatctttttttttcttctttataacattgggagattgagtggcagggtcagaaatttgaagacagtaaagaaggttagaaatagccatgtttgactgggtgcggtggctcacgcctgtaatcccaacactttgggaagccaaggagggtggatcacctgaggtcagaagttcgagaccagcctggccaacatggtaaagccccatctctactaaaaatacaaaaattaggcgggcatggtggcatgcacctgtagttccagctacttgggaggctgaggcagaagaaycacttgaacccgggaggtggaggttgcactccagcctttgcaacagagcaagacttcatctgaaagatagaaagatgaaagaaagaaagaaagaaagaaagaaagagtaaaagaaaaaaattaaaattttagggggaaaattttctaatttttgaacatgcactaaaatgattttcagagaaaaccaagtgttattttctaatctgcatggcattattaaagatgtttactcatcttccttggggctaggcatcccattcctgcaggaagtcttgtggttaggcggtggctgtggctctgggatgattcaggaatgcagaccatgccttatttgcacaggagggacacgttgctctcactgcatgcatggtcacaactgtctgtgtgacctgtctgtgggagggcagacccccctcctgccaagccacagtagcagctgacctgccaggcaaaagcattcctttgtaaaggaaaccctcccagaccctctgaccaaaggggacgggtggggacttcctggcactgcagggccccttgcctggtactcccagcaactggttgcggtggggagggcagatctagggrtggggatggggaggagaagtgggaatgggaaattgggagtcagaggggcaagtgggagagaagggcgcacctgccgggataacaggccagatgaagtaaatagaaaatcctctgagctcccctactggctccagctgtggagaagggggaggagaaaaccctgtgggacaggggaggagggtgagggctcctcttaggaagttatttaagagccaactgtcttgtctttcccgagtccgtttgaggaagtccccgaggcgcacagagcaagcccacgcgagggcacctctggasgggagcgcctgcaggtaagccaccgmccctgcaccctatgagccagggmccgctgcgtccaccttctgcacctcggtttcctggttgaaccagcaagcggcttgctctgggccctgtggcgccggtcacaggcagctccacttgcccaatcctggcttcccgcccccaactccgcacctgcccagcccagcttctaagcgggacttctctcaggctctcgaggcagctctcccgaagccgttgcttgcttagaatgccaccaaatggggatgggggagttggaggtgcttccccaagggacgagccccctttcctcagggagcagattatggagctggaacacaaaaggtggagggagtggggccaagtgagaacagcctgctagactggaaccccgccggcttggctccccactcctgcgcgcctccccactcctgcgcatcgcctgcctccrtcccaatttggagctgaactcgagccacttctcctccttagacccgcccagaagcgagggctcctgcccgccgcactcacccagccaggcgtgcacctggggctccccccttctcccccttagcactgtgtctcccgacagcgygccacactgttctgcacccctggcaatgccrcagcctaccttcggtatttctcactagaggatggctctcgcagccttctccctatcattaaccctttttcgctcttctccctcccttcccccstcagctcaccaatgactgtaaatatatttatctatacttatggatacccattcacaccttatgcatccaaacactcctgtctccttctcagaccagacaccttaggcgtggttgtcttttctccagcatgttgttagtgctccacatgtctctggaaccatctctctactctggtggcctctataatggggactcttcacctcttgkgggtgtgcmtggtttttgaaaatagccaagtctccaggagtcatgactgggtaatccaggggatcaagggggaaccttcactgggcccagaaacaaagtcccccttcatttggtcatttggtcaacaagtacttactgggcactgaccgtcaggtgtgtgttgtttaaactggctcagtgcctgcacaagctccaagggaaggggaagcaggcttggggaatgggaaatgttggcaaccctgacttcttaagcctattgatagccctattgaaaattgcatgcccaacctctccacctccttatcctcytccatgtggctcaatttccaaagcagttcctacctcctcacccctaagtggatttacttayggctcttcttgggctccaccctaaccctatcagactataatctatcagagcaaacattctgttttgttctctgatgtatcccatgtacctagatcacagcctggcatgtcataggccctcaataaatattggttgaattaaattgcaaatgtaaaygctttagaagacaacatttrtctggacatgsttgtgtgcgtttattcttaaaagtgacttataatctcataaatctgtatgaaatgaacatagatacagcacatgcatataacaggaaacatttcttgcgaagatgctgctgtaggattatggagggtggsggaatctgggtctccaaaaatcttttaatttttaaatttctttgaataagccccttttcttctgctttccatatgttttgacacatacaaaaatctccccaagatccttggggaactgtattccatcattagactaatccttgctgccacttctcagtttttatttatgcaaacggcaaaatgtgttgctcaagtgctatcacacacagatatatctgtttctctattttggaatccttgtctcaaatgttactcactttacatgccttttctgttgtcttctttttttttttttttctgaaggaccttgtaaagtcaaaaatgtcagaaacttccaggaccgcctttggaggcagaagagcagttccacccaataactctaatgcagcggaagatgacctgcccacagtggagcttcagggcktggtgccccggggcrtcaacctgcaaggtatgagcataccccccttccccaccactctgggtccaggcacagccgggccctggcccctcttccctgcaggtaaacatcctctgtctccactggggttcccacaaaaggaagccccctgccaatctctggttttataaaggaagaaagcaaaagctttcttttaagtggtgaaagcaccgaagacccagagccttgtcccagttctgccccttactgaccttgtaacctcagagaagttgctttgtctttctgcctctcaactatttcctctacaaaaccagagtgctggattagctagggcctcttccagccctactgctcaatgctttagagaattttctctagctggaatattccacttccaaaatattgtggctgttttgattgtctggcttgcacctccttccttctccctcctccctcctccatccattgctgtgaatttcagagccggggagaagtgccagactctgacagtaatagagatagaagccctctatttctctccagagcagcctggtgagctggcaaggcaagctgcttccccagcctcttgcctctgcctgatccctagaaacctgttccgggtacagcagccrgcagctgacctcctctcagccctgtcagtggtgacaaggyccaggtgccagcactggtttggtgatacagacatcattcccctgggccatggsagggacattcagactcatgtccccgagtggcattgagcagggagtcttttttgtcaataacattcatgcaccaaaatctaattttactcctaagggtgttctgtgctgggttycactggggataarcamcyatttgctgggataggtgagcatggtcatgctggagctgtgtggtcgattcccctcattagaaggagacsaatgcctgaaagcccagattgatgcagctctccatatagcaaagggaaaggggaagtgcagtttatccagcaagccagacacttgcccaggtgttgtggactggtgtcattgtgttactgtcacactagatgatwtgatatcaaatagtgaaatcagggaggtatccagtaccatccaagtttgggaaaagaagttcacagaacagaagggcatcttcagtcaggtggtagagtttgaggggctaagacgaacttgtagttctgaaatctgtctcccagctggatgccactctctaaaaccccaccttgacagccacagaactgagtttaagaggacttgctaatcaatgaatcctcatccccatgttatatgttaggaaatagaggctgaaggtaagcagttgatattcactgcttacccagtctacgagtctttttctttaagaatgcaaataaaatgcaaaagcctacagatatcaaattattaagcaggttgcctttgtgtattccatcttctagcaaaattcccctgtggcccaaaagactctgggcccccggaaagggggtgtaggcactggaagaagtgggcagtaagaacaggaggagtaatgacacaaccgtccttgccacgaggagtcaggacacagccacccttgccaggattgggaaaaacgggaacctctacaaaggcagtgcagggaagcagggaagcagagagcagaggcagaagacctggcttcctgttccacatctgccacttcttgctcactctgggaaagtcatattggtgcccaagcctcagtttctccatcagcaaaatggaagcaatgcctacttcacagattgtcgtgagcatctagtgagcagtgtctgtgatcaagtctgacccacagcacgtgaccaataagtgttcattgactgggaatgtgcaacttatcataycccagcaaggtcaggaaagcactccagggaatacttgttcctatgaggaatatgtacgacctgtagcccccataaatctgacatctgaacaaaatgctgctagtaagacattaaaactgtcagagaacatgtgcaggtaggccaattaagaaaaataaaatctgggattactgcttttgttgatttctggaggcacaggtggggagcagcataactgaattactctgaaaaaatcagtcattatttacttggcagacatatgtgtccacaacccaagtgacattctgggatatccattagaggcactggcataggaatatgaatgtccagtgrctgtagaatgaatgaacgaacagtcaatcacttgtgaattgaatgactcatagctctagtggcattataatttattattaataacaagctacagatttcatacatatgcattcatttaatatttttcacagacaagataagtgttacatgctctggggatacggtttctgaagcccagaatcatgacagcaagtcccagatgagaaggacaggaaaaaaactatatatatatatatatatatatatatatatatatatatatatatatatatatatatatatatgcacacacacatagcagcacacaaaccatctgaacaaggaggtctatctcctggttaccttttgcatttcagatttatatttaattgttctaaaagcaggttttctggcactatatatcaagttttctccaagtcactaagggaygaaatttgctaagcgactaaaccttggaaagmacackcatttttaaaatgccatcttcatgcagttcacccagtggccactagtggcctctaagaggccttgtatccgcggttaccaatctgcggatgatgactttggctccaggaacaccagcmccaagttaaaytcttgtctccatttttttcagtggccactcttccagttagcaagctgctcttgtaatactgactgagaaatgcagagaggcaagaagaggaaaaggggggaaatggcggstttttcatttctaatagttctgtagcagtgagtcctgcccatyactgygtgtgatatayacagtgttctaaggtatactgagtgtatataacgcccttaagtcatggctttggtaacatttggttaagaattattttggtaaaatctrtattttaaaatgtataaactcatgtaagtttcctctcatacacaccatgatattcaagaaaaaraaatgaaatatttgaggtaggcacggaaatcccagaggtgggaccagccattcagtggtagcgtttgacatctttgcatgattttaggcatctttaatgtcaccctttgaattcagttgtagccaggaaaggtactgagacgatctcctcagatttggatttgtatcaatttctaatagactgttctgcaggcttagttggtgtttctgaaaaatctctccactgccttcctggtctgaaaggttatgtgtagctggaaatgtaatattccagaagaaaccttatgttgttggtctgctttggctctatattgttaacaataggcgaccatttgtagcagtaattggaatcatttaacagttctattgtattgaattaaaactggaaagcaagcctggccctatttaaaaactgggttctagtagtttttcaggctaatggggtcttatrcctttctaagaatctcctccatcccaccactccttgtcagaattaaatcaaccaattaatgataaacctcctctttgtgcagagtaaacctctctggattgaaggttactgagagactaagaggcattcagtgtatgactgagaaatgctattgtccagcagcagttcctcctttcattcagttcctggaaaaatatacactggttttcacatatgtgtcaggagctgctccaggctgtcccttgggacatgaagttgagtaagttagtccctggcctcaagaaactctcagtgtagaagacaaaataaataaaagatcattgcaattcagtgtrataaagactgtgactgtgatttatgcaaattgcagtgaaataacagaaatcaatgtctagcrgtgtggtggagtggggaagaggatgaggagggcttcctgatgcaaggatattggagccgagacttagaggatgagtatgagtgttcctgacaggcaagcgcrtggaaaagtgtttgcagtagagggaacagtatattgcaagtgaggagggactaaaagatgaaagagaagatataagcctgggaaargatggcaggcatcacaccataccaggccttggggatcttgctttcctcctgcagataatgsgggacttgagaaggattctaattagcagaaatacataatcagaattatgctttacaaagtggtagggagggctgggcacggtggctcatgcttgtaaccccagcactttgggaggccgaggtgggcagatcaccagatcaggagttcgagaccagcctggccaacatggtgaaaccctgtctctactaaaaatacaaaaattagcctggkgtggtggtgggcgcctgtaatcccagctactcgggaggctgaggcaggagaatcgcttgaacctgggaggtggaggttgcagtgagccgagattgtgccattgcactccagcctgggcgacaagaccaagactctgtttcaaaaaaaaaaaaaaaaaaaagtgtaaggagaaaatggagaacaggagatatgtttggaagctgtagagatactccaggctagaagaggaatagaccagagggrttttagcccctggaggtatggggctcatttctcttgttscagcttcctctgagcacctgagcaatccttcaacattataggttccaggatgtattaataacaacactttataaattaagccacttaagaaaatgcttttaatcattctaattaaggacatgttaaaattctgggtacccaaaagaaatgtgagaaagagttatttttcctgtttttttttaaataaataaaccagtttctcatggatagcatttatgcttatagttcaataayaatattaccaaaaattgcatggagaattcagttcactagggaattcctagtatataaacctaaacatttaacttatttcaagatcccatctgtgacaggtataatcattctctgaagaatattttacaacctagggagacaataatttacattttgttcatattagasaaaaagyaggaggacagggaggcagttgctcctccggagatttttttcttttctttaacagtccattttccgatatgtttggaattaggctaaattgtgttaggtagacagtttgaaagctgtcactttgaaagagcgagctgccaagtttctagctacmgtatttaaaaaaaaaaaaaaaaaaaaggcggcttagcaatgarctgttccattttgccaggaactaggcttggacaggggaagcaaattcatttcctgtttgtggcaaacggagtctggatgatgataagactttttccatctaaactgccttgtkaacccagtaaacaaagcaaaaatcaatatgctagattcatcaatgcttgctggaacacactccatggcaagggacatttcctaggcaaaatggacaatggaatgaacaatgatatttttatgtctatgttcatattttatacagtcatcttcagagtctttgatactatcagctgttataagaaccaaatacttggttgacctgtgtgtggctgactcatgggcaatgaaataaattttgttgaatcagtggtattggggacctcacctctatccccaatactttggacaacccattaagcttsctcatgtcttttccatttgactacagtctggaacattatttctttaaactctcaacctctctgtgtagcttttaatcttccccttcttagccaagttttattttttttttatgaaatgtctttctttgtttaaatcattttaagacagactttttttgtttttgttttgagacggagtccggctctgtcgccaggctggagtgcagtggcgcgatctcggctcactgcaagctccacctcccrggttcaagcggttctcctgcctcagcctcccgagtagctgggactacaggcgcccaccaccactcccggctaattttttktwtttttagtagagacwgggtttcaccgtgttagccaggatggtctcgatctcctgatctcgtgatctgcccctctcgcctyccaaagtactggaattacaggcatgagccaccgcgcccggcccccaagacgcacttttaagagattatacaggaaagttttacttatcactgccttagtttttccccacttatagtaccactgtgattttatgtttttcctgaggcattggcttgttgaagtkatattgcaacagagaatcaaaagatcacttagaaaaagtaacatgttagaaaacatcatgcttagaattaaatgtctaaagtataccagtatagatgatataatttaaaacaaytgataytatcagctgtcataagaaccaaatacttggttgacctgtgggtggctgactcatgggcaatgaaataaattttgttttatacgtataactttatatatatgtaactttatatatatawaaaaagtttgcttatatataatatatatacacatatcatatataaatatattgtttataatatgtaaacaatatatacataaataatatataaaaastatatattatatatgtaaacaatatatttttaaaamccaaactcatgggtttatagttttttcatagtgaaaacaaacaaatatatagtttgcttatatctattatatataaacagtatataatatataaagatataaataatatataatatataaatatatatttgtaatatattatttgtttatatccatcatataatataaacacatgtaatatatataatttatatgaacaatatataatatataaacaatatatgtttttatatattatatgtaaacaatatatgtttttatatattatatataaacatatatattcatgatatatatgtatgtttgtttacactatggaaaaactataaacccatgagctggggttttgtctttttttttttgacttaggttttctattctcaaaggcattaatcagcaccctttttctcacccttygttatcaacatataagcaggctagraagacagtattttattccratgtgaaacaaaactgctgatctggagktcttatgttataaattcccacatcataccttcaactatatatatgtcctgaaactagcatattttgagaataaaatggkaaatgacatttaaaggacacctatggttaatcctacagtaaatgagataatttattttgaaatgaatgatcaactctacgctccaaattttcacgtaaaaggtgttcaggtgaaaggaggcatatttgctgtggcatttctgcacactgccccaggcactatagcaagataattaagacatggtccagtcttcaaggggattacaatcccatggctaaaaaatcacctatataaagataatacaaagagacratgatacttttttttttttaaaaagaagacagatgtttcctgcgaatcaagaggagaaatgctttctatttacctgtggaaattcaaagcaagcctgtctgctcagaagayaaggagtataaaatggcatgcttccctgggaaggctggaaggccactgctaaaaagcttcccagggacmttctttaccttgtgacttccattgctcagattccagcctcrcaccatgccttctcagatacctgactacttaatgattggtcctaagggccaatccaaatgctcagtgctattatgattattattgccatcaatttctgagcatttaccatgtaccaggccctaggatagagcactcggtgcattttctcatttaatcctcacaccaacttcattttgcagatgagaaaactgaggcacaggacatttatgtaacttgccaaggtcacaaagacagtacgtgagagttgggatttgggttcaggcagcctagctccacagtctatgctcttactatgctcttctacttctcttaataataataacaacaacaataataataaacatttattaagaatgtacttgstgtcagccactctataagataggtacttcattcccatattaaagataagaaaactgaggctcagakagattaaataacttttctgaggctgcacaatwagtaagtagtgaagcatttccaaaaacatattctgaaaaatgcagatctccaaagaaaaaagtttccatagtcatttacrtttggaaaccattgcccctctgagatatctgtggtatacatcagcatattaaagtctcacatgaatgcttcagtaaagaatcctgatcagctttggttaggcyagcattttccacactggtttaaacatggagctctaattcttccaatacctgtcaatatcccataaaactagcactatgccatgatggactgactctaaccagtctcactagacattaaccaggtacactaggctaggaggtaaagctggaaagccaggttttcatttgcaatgagaactaggatggatgagacataccaatgataccaaagaaatactcgaatatttctccgtctccagccttactttgccttgtaggtagagctgcttgggaagccaaggcaggactcatttcagggacacattatcatgcagggagggagggtaggaatagagaaggcaaatccaggagtaccagaggagcagtgccttgaacccctacatgcaggctaaactcacgtggcccctcacccagaacactgcaacagcttcttaactgggttcagcttccagctttgccccttccaatcccttttccactctgccaccagaagcagtttcaatatatatataaatctaatcatgtcagtttgctgtttcagattcttcactggatccaccatgcaattaaaacccaaactccttcgcatggtctccaaggctcgtgtgatgagcaggctcctccttactcttccaccgtggctcccactagtacatttcagccaaccatcatctttcaatttcttaagcaactatgcactctcttgcctcagtcttcacctatccttctttctcygcctgaagcattcctctccacccccctttccacatggacaactgactcctcttttgctcactgcttatgtctcacttccttcagagaaattccttattttctaccccctaaatgtgggttaggggctcctccctgatactcccctcagttctctttacttcctttgtcagagatgtctgacactgtgtcataattatctgtccacattttagcatctactgctgtgcgtttacttagttagtagttattagacagttgcctaatcaacatttatacccatgtcttgagtggcaacataaaatagcacacttataacattcccagaggacaagaagctagggagaatattaaatatattaaatgcatacttaggggttaaaatgatcttaagagcatgggacagtgagccaaattcaataagaagaaatttaacccatgcaaagtcttaatatcgaactaaacagaagaaaacaattgcacaaataaatatagccaaatagcaacatgagtgggtgacttgtaggggcctcaactgaattttgatccattgttgctagaaataacattagaatgtgttttaagggaggctgaggcagggggattacctgaggtcaggagttcaagaccagcctgaccaatatagtgaaaccccatctctactaaaacaaaaacaaaaacaaamaaattagccaggcatggtggtgtgagcctgtagtcttagcaacttgagaggctgagacatgagaattgcttgaacccgggaggcagaagttgcagtgagctgaaattgcaccactgaactccagcctgagcaacagagcaggactctgyctcaaaaaaaaaaaaaaaaaaaaaaaagaatgtgttttaagggttttgctttatcagatgcataatataaatcaacagtgagttaagagtatccaagacactgacaatatcttgatktgaaataatagactgtttattttaaaagatgtaatggtctcttttttttttttttacagaaaaaccacaactagagtaatgtacttaattccagaaaataacacttcaaaagagaaattgacaaagtggaaaatattccaaaacagagcgttggataaaagttctagaaataacttcttaaaaacagttaaataggctggatgtgatggctcacgcctataatcttagcactttggaaagccaagccggcggatcacctgaggtcaggagttcaagaccagcctggccaacatggtgaaaccccgtctctattaaattttttaaaaatacaaaaattagcggggyatggtggtgagtgcctgcaatcccagctactcaggaggatgaggtggggaggattgcttgaacccaggaggcagaggttgcagtgagccgagatcgcgccactgcactccagtctgggtaacagagcaagactctgtttcaaacaagcaaacagttaaataaatgaagaatgttttactcagaaaaaaaaaaaatcctatgagcagtctttaaatacctagagagtgccagctaaaatgaataagaggacttattctatatttatctagaagtcagaacgaggacccatggttagaaaaattacaaggaagcagatgtcagtttatcttaagagaagttttcaaataattagagttgtttaaaaatggactgtttgccctatgaaaaaatgagttccctgttcaaatggaagctagaagcccaagtagtagggctctcatgaaaatgtttcatgcagggtatagtagttctaccagatggctgagaaaatgctattgctgttctgtgagattctgtaaggatgtaatatcagtatattccttccattggtgctggtaaacggagaactgatgaaacccatttctaaggactttggtgtttagctatttttaaaaaaaaaaytttaaagcccctgtgctaagaaagaggaccagaggagttgattgctaagctccttttcaacaggaacatttgtgctcctccagctcattcttgggctggtttatcacggrgattgtggtcttaataagaccagaggacttaggagaaaggcagcttggaatagagaggtctagagaattaaacatctttagctcacagcataatgsaaagaaagtgcccttcaggggaacatgtatacaacagggttctgagaagaggtaaaaataaaactgcatcctgcactttctgcttgccgtaatgctgcagtcagggtaacccggggagcaccacgccctgtgaaatggctgtcacagtttaggggcagtgagccacagtaagcctaggacccactatgtgccaggcatagtgccagacccactgcaccgttatctcattgagccttcatagaccttctcagggtattagtatcctcattttaaaataagaaaattcagattctgaaaggtaaagtaccttaacgcagtaattttgacacctgagattcaaactcaggattgcctgaactttgaattgctcagcagtgtttcaggaactcctggactttaggaccgaagaggatcttaaagagcccaacttcttggttttgactatggaacacaatggggtccaaagggaccaggcatcctgcacaggatttatgtgtggaggtaaaggaagccattcgactatggcaggagatgccccggcatgggtacaagctcagcaactgtgctttctgcgcacatggtgcttatagccatgaaggcaaatcatgcatcaggcaggggcagggagggggagggcaagaggccagggcacccctgccgacccttctaccctcccaccccaccttctccccaataactctttacaatgccaaatgcacatgcagaaaccagtctctagactagatcttctaaagtacagtgaggacagggagttaggatgacccccactttcagtcatcattcatagaggggaaggggaaaagggcaggaagagagctgactttcatgtgtcagaccctttgctaaatgcttgcatacgtgtcatctcatgccgtctcctgtcacattcctgtaagaagtggaacatgttaggctatgaaatgaatattagtgtctccattctatgatgaagaaatgaatttaagtcacacatacaaagttagacaactaagaaacatgtgatttacgtttacactcctgatgccacaaatcaaaagaaaaacctgtgaatgttggcatcagacagtccaggttttgacttttgaactggcccattagtagctaaggaaagctgaggatagtttctgtgtcactgaaaacaatcacacttayctcatggaaatcttagtgtcctttctccagacctgctccctctctttcctgcatttgagggatgagatctacttttagaattacagagggaggaggcatttgaccctttttgaggtaaaaggagaattttagattaatggctaactttgtccttcgaatgtccccttgaggctttgtcagatttgattccttcctttggaaagataagaaaattgaagtggctattccctgcttctgcctggttagtcacagagtgaggcagtgacatgatgggaagcttctaacataacgaaaactagcgtgagactgagaacctgaagacttcaactctggccctagcttctctgtatttggatctcccagacaggcatccatctatcccacagtgagtgccttgtggtctgaaacgagatcaaaggtggaaaaagctttaaaaagctctcttcaaaaacaagaatgtcacaagaggctgactctcgagactgtgttcccctacccctgcctcctacagagtttcattcagcagaccttgctacctgccttcttcagggaaaataatcttgtttttgagtttatgtttaaactaaagttagttgattattttcttcaacccttgtttttcttgttcatagagtttcttaatgtcacgagcgttcacctgttcaaggagagatgggacactaamaaggtggaccaccacactgacaagtatgaaaacaacaagctgattgtcygcagagggcagtctttctatgtgcagattgacytcagtcgtccatatgaccccagaagggatctcttcagggtggaatacgtcattggtgagtgccatgtgcaagctccagtcttgacaccatgggttgcattgtagagagaggtgggtacaggcacagttgtgtgatttcctagtgtcatatgtcaacagtgkcaggagctggaatgacatscagcccctgaattaccctgtgctctaagactggtctgtatagtgccaaatattgataacttgggcccacccaaggagaaaatctcatataaataaaagtaaaactggtataatgtgttgcttaactaaattattcttcctcaaacaaatggttttggcatcctatgattctaacttttatctccatgatttaattggtctcgtgctgaaaatgtttgtaaatcttagcatgcaatccaagtatgcattccgaaagttgattctgctctgatctagtcccatgggatggcccgtgaaaaatatagtccaataaacttcactaaacactttgtactttaatcacccttttttttttttttttttttgagacagagtcttgctctgttgcccaggctggaacagtggtgtgatctcagctcactgcaacctcttcctcctaggttcaagcgattctggtgcctcagcctccagagtagctgggaccacagttgcacaccaytacgcccagctaattttatgtatttttggtagaggcagagtttcaccatgttgtccaggctggtttcgcactcctaacctcaagttatccacccacctcagcttcccaaagtgctgggattgcaggcatgagacaccatgcccagcctttaacctcctcttgaagattaacgatgcacattagcttcaaaggtctggggaaggaccatttaactttggtctggtgcttcttaaattaatttgatcatggaacccttttattaagttatagctattaacttttgacacattttggtaaacatttctataggaatttataagattatcaaggaaatacatgcacagagaagcaggggtggcacaacataggaaatctgcccatataatcctatgcacaaattaaaggaaaaaattaggcaatcaaatcagyagtcacagaaaggtacatggtaaaattcagcatccagttttaggaagagtttaaggggaaaaatttagaaaaaaaacacctcaatgataataaagattgcttacatcaaaacaacaacttttgatatctaagtggaaaaaagttaacaaatttcactgtaatcagaaattagaaagaaatgcctgctatcatcattccctttttaaaaagaagtactttaaaggytttagtaaatgaacaatgtaagagatacatctgctataaatgctggaaactaagaagtaaaactatatatttgctaatactatgattgtgtatgtagaaaacccaacagattcaagggaaaaaagcactgtattaataaaactttgtaagttggctagatagaagataaatatataaaaatcaataacttttatcttccccagcactaagcacccagaaatagacataaaaaaatttcacatgaccaaaactataaaatgtaggactaaaacctgaacacgcaacctatataaaccagctattaaatcttaataaaaaacatgagaaaccaatgaaaagtcaaacatgttcttgagtgggaagtctttctgtatacatttttagtctcccaaggggttggtcaaagaatacaaaatttcagttagatggaaggaatgagttttagtgacctattccacagcatggtgactatagttaataataatgtatatttccaaattactaaaagagtagattttaaatattctcaccacaaagaaatggtatgtgaaggaatgaatatgttaattagcttgaattaatcaatccacaatgtatattttgatcaaaacatcacatattgatcaaaacatcacatcccaaaaccccataaacatatacaattatgattgtcaatttttaaaagcctcccaaaattaatatgtaaatttaatgcatttccaattagaatcccagtggagttttgagttgtctttggctttggttttggttttttggacttgtataaaataatcttaaagttcatttgaaataataattacctggtgataaccaaggaaatcatacaaagaaataataagtaagagtattttctttctgaagcggctatcagaacatactatgaaaaatatttagtaggacataatagagaatccagaaatggatttcagtatatgagttaatatgattgttggtttcatgaagtaagaagaccatatgagattttawctgtttgcttgtttgtttttacataaatgatgcagaaataactgactctccractggaagaaagtttaaaaattgaccctcatcttrtcccatatacagtagtaaatctcagatggaatgagtattaatgtaaaaaagacaattttttgaggaaatttaacagacttaactaaaaactggaaactctgacactgtagaagaaagcaagaaccatgtacagttatgtgccacatagcaacatttcagtcaatgacagatyatgcataggtgatcttatgagattctgatggagctgaaaaattcctgttacatagtgatgtcatagctatcataatagaatagtgagattacttatttttttaaatgtactgtagcctaagtttatagtgtttataaagtctacagtagcatgcagtaatgacctaggccttcgcattcactcaccactcacccagggctacttctggtcctgcacgttccattcatggtaagtgtcctatgcaggtgtaccattttttacttttyatattgtatttttactgtactttttctatgtttatatataaatgtttctatgtttatatataaatacttaccattgtgttacaattgcctgcagtgctgtattcagtacagtaaaacacactatgagtctgtaacctaacagcagtaggctctgccatatagcctaggtgtgtagtgggctgtaccatctttgtttctatgatgttcacacaatgacaaaatcacctgcctaacaacatattacatcccgtgcatgacaacaaattcacgtttgaagctctggaccacagttctgctgcaattatgagggaagttttatctccatctttaaagccaaatatttagggtggggagaagaggagagggaagcttcaattctgaattggacttgtctgaggtttgaaacactctcataggccgttcagaaaataattatgataatggaagtcttagaaaaactggtaagatgaatgtcttagatcgggttactaggaaataaactctgagaagaagacttgtgcgcagaaagtttactggggagatctctcaggatcaacatctgcaagggagtggaggaatcactgttggacagagggaggagttgaactgcagtgcagacagggcccccgtggatctcaaggtgaactctagctatgggttggatcttcagagttgtctcgccttgagccaagggcatgggcctgttataccttttataccttgactggggttacagccttggtgtaattggttctctgtggctgagggtaacccctgaaagcaactaaatgaatgagaattgtcagccaccaacactcccaacaatgggaaaggtccaggcagcccaccacagcatccattacagtgaacattttaagtcctcttttcttttttacacaagaaatactattacttttgttccctcaataaaagagggggaaaagcatagctaatttgtttttgagataaaatctgtatatttttaaaccaacatgtattctaaacctttcagaacccatgatgtgtgcgttcagagttaagctgtattctagtatgtgtgggccattacagggccacatgtatttgaagattttctattataggtcacacacatttgaagatgtttcattgcccaacctgttgtagatacaagaaaggcaagtgacaaaattccacactctactatttagtgtagaaattaagcacacttcgaggggcgtggaaggacccatggtagaggatttatcttgatcagagtcatttctgcatctcacatcaytcaggaagttacatgagagcctcaacttcatggctgccatagttgtaagacaggaagaaaaaagaacattgctggggaaataattmtcttaaaattcagtgcctgtttcaataggactgaataaagccaaggaaattagattttaaggctaattgctataatgagaagagacaagtatagaacgtgaactagaaatgaaattaagtgcaaaggtttctatatacaggtgcacctcaatttccagaaactcagaaggtaaaagtgatggtttaaaaacgaaaaagaatataatttctattcatttttaaaaatctggcaacaccatttcaagagaagatccattttagctaacgttttacaatcagctaaatgtctaaacatttgagatatcatttactattaaaagtgaaccaaaatgtaacataaattaaaaaaaaaaacagacgagaataaatactttgttaaaaataaagggcacttaaaagaatctcggggggaggagccaagatggccgaataggaacagctcaggtctacagctcccagcctgagcgacccagaagacagtgatttctgcatttccatctgaggtatggggttcatctcactagggagtgccgcacagtgggcacaagtcagtgggtgcgtgcactgtgcgcgagcygaagcagggcgaggcattgcctcactcaggaagtgcaaggggtcagggagttccctttccgagtcaaagaaaggggtgacggacggcacctggaaaatggggtcactcccaccccaatactgcacttttccgacaggcttaaaaaacggcgcatcaggagattatatcccgcacctggatcagagggtcctacgcccacggagtctcgctgattgctggcacagcagtctgagatcaaactgcaaggcggcagagaggctgggggaggggcgcccgccattgcccaggcttgcttactgaaacaaagcagcctggaagctcgaactgggtggagcccaccacagctcaaggaggccagcctgcctctgtaggctccacctcagggcacagacaaacaaaaagacagcagtaacctctgcasacttaaatgtccctgtctgacagctttgaagagagcagtggttctcccagcacacagctggagatctgagaacaggcagactgcctcctcaagtgggtccctgacccctgacccccaagcagcctaactgggaggcaccccccagcaggggcacactgacacttcacacggcagggtactccaacagacctgcagctgagtgtcctgtctgttagaaggaaaactgacaaacagaaaggacatccacaccaaaaacccatctgtacatcaccatcatcaaagaccaaaagtagataaaaccacaaagatggggaaaaaacagaacagaaaaactggaaactctaaaaagcagaccgcctctcctcctccaaagaaatgaagttcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaagcaaggctcgagaactacgtgaagaatgcagaagcctcaggagccgatgcgatcaactggaagaaagggtatcagcgatggaagatgaaatgaacgaaatgaagtgagaagggaagtttagagaaaaaagaataaaaagaaatgagcaaagcctctaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggttgggttaccctcaaagggaagcccatcagactaacagcggatctctcggcagaaaccctacaagccagaagagagtgggggccaatattcaacattcttaaagaaaagaattttcaaccccgaatttcatatccagccaaactaagcttcataagtgaaggagaaataaaatackttacagacaagcaaatgctaagagattttgtcaccaccaggcctgccctaaaagagctcctgaaggaagcgctaaacatggaaaggaacaaccrgtaccagccactgcaaaatcatgccaaaatgtaaagaccatcaagactaggaagaaactccatcaactaatgagcaaaatcaccagctaacatcataatgacaggatcaaattcacacataacaatattaactttgaatgtaaatggactaaatgctccaattaaaagacacagactggcaaattggataaagagtcaagacccatcagtgtgctgtattcaggaaacccatctcacatgcagagacacacataggctcaagataaaaggatggaggaagatctaccaagcaaatggaaaacaaaaaaaagcaggggttgcaatcctagtctctgataaaacagacttcaaaccaacaaagatcaaaagagacaaagaaggccattacataatggtaaagggatcaattcaacaagaagagctaactctcctaaatttatatgcacccaatacaggagcaccaagattcataaagcaagtcctgagtgacctacaaagagacttagactcccacacattaataatgggaggctttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatactgggaagtaaagctctcctcagcaaatgtaaaagaacagaaattataacaaactatctctcagaccacagtgcaatcaaactagaactcaggattaagaatctcactcaaaacggctcaactacatggaaactgaacaacttgcccctgaatgactactggatacataatgaaatgaaggcagaaataaagatgttctttgaaaccaacgagaacaaagacacaacacaccagaatctcagggacgcattcaaagcagtgtgtagagggaaatttatagcactaaatgcccacaagagaaagcaggaaagatccaaaattgacaccctaacatcacaattaaaggaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctaacaagactaataaagaaaaaaagagagaagaatcaaatagacacaataaaaaatgataaaggggatatcaccaccgatcccacagaaatacaaactaccatcagagaatactacaaacacctctatgcaaataaactagaaaatctagaagaaatggataaatttctggacacatacactctcccaagactaaaccaggaagaagttgaatctctgaatagaccaataacaggatctgaaattgtggcaatgatcaatagcttaccaaccaaaaagagtccaggaccagatggattcacagccaaattctaccagaggtacaaggaggaactggtaccattccttctgaaactattccaatcaatagaaaaagagggaatcctccctaagtcatttcatgaggccagcatcatcctgataccaaagccgggcagagacacaaccaaaaaagagaattttagaccaatatctttgatgaacattgatgcaaaaatcctcagtaaaatactggcaaaccgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacscttcatgctaaaaactctcaataaattaggtattgatgggatgtatttcaaaataataagagctatctatgacaaacccacagccaatatcatactgaatgggccaaaactggaagcattccctttgaaaactggcacaagacagggatgccctctctcaccactcctattcaacatagtgttggaagttctggccagggcaattaggcagragaaggaaataaagggtattcaattaggagaagaggaagtcaaattgtccctgtttgcagacgacatgattgtatatctagaaaaccccattgtctcagcccaaaagctccttaagctgataagcaacttcagcaaagtctcaggatacaaaatcaatgtacaaaaatcacaagcattcttatacaccagcaacagacaaacagagagccaaatcatgagtgaattcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccagtgactttcttcacagaattggaaaaaactactttaaagttcacatggaaccaaaaaagagcccgcattgccaaatcaatcctaagccaaaagaacaaagctggaggcatcacactacctgacttcaaactatactacaaggctacagtaaccaaaacagcatagtactggtaccaaaacagagatatagatcaatggaacagaacagagccctcagaaataatgccacatatctacaactatctgatctttgacaaacctgagaaaaacaagcaatggggaaaggattccctatttaataaatggtgctgggaaaactggctagccatatgtagaaagctgaaattggatcccttccttacagcttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactcaagagcttctgcacagcaaaagaaactaccatcagagtgaacaggcaacctacagaatgggagaaaatttttgcaacctactcatctgacaaagggctaatatccagaatctacaatgaactcaaacaaatttacaagaaaaaaacaaacaaccccatcaaaaagtgggcgaaggatatgaacagacacttctcaaaagaagacatttatgcagccaaaaaacacatgaaaaaatgctcaccatcactggccatcagagaaatgcaaatcaaaaccacaatgagatgccatctcacaccagttagaatggcaatcattaaaaagtcaggaaacaacaggtgctggagaggatgtggagaaataggaacaattttacactgttggtgggactgtaaactagttcaaccattgtggaagtcagtgtggcaattcctcagagatctagaactagaaataccatttgacccagccatcccattactgggtatatacccaaaggactataaatcatgctgctataaagacacatgcacacgtatgtttattgcggcattattcacaatagcaaagacttggaaccaacccaaatatccaacaatgatagactggattaagaaaatgtggcacatatacaccatggaatactatgcagccataaaaaaggatgagttcatgtcctttgtagggacatggatgaaattggaaatcatcattctcagtaaactatcgcaagaacaaaaaaccaaacaccgcatattctcactcacaggtgggaattgaacaatgagaacacatggacacaggaaggggaacatcacactctggggcctgttgtggggtggggggaggggggagggatagcattgggagatatacctaatgctggatgacgagttagtgggtgcagcgcaccaccatggcacatgtatacacatgtaactaacctgcacattgtgcacatgtaccctaaaacttaaagtattataataataaataaataaatttttaaaaaaagactaaaaaaaaaagaatctctaccagtacatctttaagagtgtttataacaagagacttaccaacaaagattgacttactgtcactcactatattagtcagtgttctcttgagggacagacctaataggatatatatatgtgtgtgtgtgtgtttgtacatatacgtgtgtgtatatatatatatgtgtgtgtgtgtgtgtgagtgttgtgtgtatatacatataaaggggagtttatttaagtattaatttatatggtcacaaggtcccacaataggctgtctgcaagctgaggagcaatgagagccagtccaagtcccaaaactgaagaacttggagtctgatgttcaaaggcaggaagcatccagcatgggagaaagatgtaggctgggaggctaggcccatctctccttttcaagttttkctgcctgctttatattcactggaagctgattagcttgtgcccaccagattaagggtggatctgccttccccagcccactgactcaaatgttaatctcttttggcaacacctaggattaatactttgtatccttccatccaatcaagttgacagtattaaccatcacactcactatatacttaaaaaaactttttttttaggttcgggggtaaatgtgcaggtttgttatataggtaaaaacatagctgtttcataaagcaagctattattatatttaaaatacagaaaaaataactttatacttagttgcttccaatttgcattcagtttttttgttgaggttgctctctcattccctgtgcctgtatagatgagctgagatatgttagtacactggagtttccctatgttgctgttctcagaacctaggtcatgggatttatttatgtgattctgccttctaaccaatttccttctctccctccctccctccctccctccctccctccctccctccctctctctctcactccctccattccttccttcctccctcccttcctcccttcctcccttctttccttcttccttctttctttctaaatatttaaataaatagggctcttggatggtgtgctgggctctgagtagagaaggtgagcaggagagctactgccttacctggccacggcttgatgagctgtgctgcaggggttctttgtgctttgataactgcgttcatgagttgctggcagagcacagctatctctgtgttaggtgggaggtgttaatgaatctgaggaggtgggtgtggctgaaaaatgccctgggagtctgcagggccttctctctctctcacctctgagcctgcagcctcgacaaatcatgaaaggcaaggaggggagtggtaatcacaggttttactaacctgtggctgagrctgtgaaagcttgggagcagcttctggtgttaatttgctgttactttgacatgggcccctgcttttttgatacccagttgagggtgaaatcccaagctgtatttcttaccaggtctccccctcaaaacggcagaggtttcactccctgaggagccctccgaagtgacagtagggtccatgagcaagtttctttctccctggagttcaaccacaggaacctgggggtgtccaggtcagcgctttggagattctcctgacctttccctcaattctatgatggccctcacagattcaagcttcacatttctggttacagcagaaagatgaggagaaggatggcattagcatgccccaccccacttatcaggaaaacaaaagctttcccaggcacttctggcaatcgtttatgtttcatttgctacccttagctgtaaggcaagctgtgaaagtattccctttttccagtctcttcagaggagagggatggggcagagctgaaagtgggtgctggtggacccgcagtcatgtgtgctgggcatcccccctagctgggccatcctgtgagtataaaagtgctgtcctaatgctggcagccttgaggcaggttgttcatcacccgctcaagcatttctaggactgggtcaactgcacatgttctgcatcacaaaccctataaaacatggaaatgtcatcagcaacactttaatatctttctttcacttatttcttgagtagcatttatggaaagccagcggcggtgttggatggtgttttcagggtgggagtgacatggatgattctcatttgagatagcttgctctggcccacttcagggaatcagggtaattcaggataggagaggagatgatcagaagagagaggatgagaaccggggttatggctgcagttgtagacatggacaggagtgacagggtttgagaaatayttaggaggcaaaatctgcaggayttgtgttggggagtctgtgaggggtggaagggaggagggtcaaggtcracttccaggtggctggcttatgtgactatgatgacagatgctagcacttccaaatgagataaagaatgcctggaattccagaggraaaaaatcgagtgtggaaaatgctaatggaggtagtagcttcattgataactcattggcactgktgctgtgcagaggtgctgtatgcctcccatttaattgttcaagcagccctctgggcattggactatggccatctccatttttcccatgagataatggttgaaaggattaagtaatttacccaggtcacacctggaaagtgctgggacctcaatttggacccaagcagcctcttctacttacaatgcttactacctccaccragggagcctccaccaaggagatggtggaggtatgaatatgcttctgtttgaattgatgagtgtgaattasttgagggactttcaggtaaacctgtccaatagayaatatgagtctgaagcttcrggaggaggtttgggttggacaggagataatttggatatcatacacacgtgggcaagctcactcagaaaaaggtaaatcaagtcagcagtggactgaggcttaagccctggggaaaacaacttctaaggcatcagtccagaaactagagcccctggaggagacaaagaccaaatgagcagataaacagaaggaaaataagggggttgcagtgtcactcaatccacgagagttgtgtgtttcaagaggaaagcatgaccaatgttattaaatataactaggagatgcagtgagataggaacttcccactggagtcaacagttgggggacactggttgaactcgggtagattccaaattttaatggtctaaaagtcaaggagatgtgaggaaatgggtgtagtcaatttggatgaatctttaaagaaatttgaaggagaggaaaagaaaatttgggtggtaactagagaggaatgtgggtgagaggaggggtgtttcaatttcagtatttgtttcaggattggagggactggaacatgtagcaggcagagagggaagaatcagtcaaggaagaattctgaagattcaggagggactggaggagaagcatagaggacaggggcacgggtgaggggctgagtaggaaggaaaattcctcatcttccaaggttgtcgagaaagaggtgaaggagggtatgactgccgtaggtggagaagtatgaactaagcctcatgcctgacaatctcaagttatttaaagatgtaggtggtgagcaggtgctatagggtcttagaggggcagatgagtacccttacatctgaaaacatcatccatatcctttaagactatgtcttcctatggattttgtttcagaaagtccaggtaaaatcatcatgctgatgtgtgattttcacatacataacatactttctctattgagaaatgtcttgccccaaactgtgcagcttgtaacgtgtagataactatttcttagcctrtactctttcaactattttgtgctgcattttggtgaaaatagacagcctatttcatcattttgaagcaacatttatatagaatgtcatttcagatttttgctcctatgggtttctgcattgatgatcaacgtgtttatttttaagcatctctgtgaagtgactaataatggcatctaagaaagtaggacagtgtttcccagagtgtrttctctatgaacacctgtcatgtgagattctccttgggggaaaaaagttccatcrtcaaatayagttggatcatgctgtgttttgtgtctcttctcatagaggcccaaggcacattaatatataaaaggctatgagtagacacgtagtcaaaaaatgaatcttgtttagcccaataattcccaaaattgttctactataaacactaccctaccacatttttatttttataataccattgaataaggtgcagaactcattccaggaaatgctgaactatagaggcatattacctctattccatacaacactgaggcaggtggctgacagaacttgaacagatttgtagtctatgtgttgtgataactttatatccattttttctttttgacacttaagattttgtgcaaacattgaaataactattaatttggcattcatatttagtaacttttcaaaaataattgttaagagtatgtttttatatttatttttcagatatttatttggcttctttcaaccataaagcctatttattttctttttgaatgtgcttattgaactcttatttaatactttgtatgtgcaaagcaccatattgggattagagtagtaagatatgttcatcccttgcctccagaggatttgttgtccagaggggacagtctgagtaggaaaggctgtgttcaatgccaaccttttgaacaaaatgcttagaagctactttggagggagtgactgatggcaagaatagttgaaagaatcctccagaaagtgctatttgaggcgggtctcaaaaaacgaatagaaattgacccaggggratggaaattgtatacattctagaaaaaaaaaaatagaaaagttcagtggagcatgacattttggaagcacactgatgtctttgtatgacttgataagaagtttagatgtaattctataaacagccagaagcctctgtagtagcattttaggtagagtattaagatctgatttttttctactttttagattactatagcagaagtgtggaagataaattggaggamcgagattttgttagggacattagtaagagactcaagggggaaaaaaatctcactaataaatgataggataaatggatgctgcatgagtttgtatgatttttcccctcctttttttcccccaaaggaacttatgtttacttctataactagaagtagtaaaatgtgtgtgtgcgtgtgtgtgtgtgtgtgtgtatttgcatagtaaaatgggactcacctgtagtgaagtaacacactgtggtctgaggactaacaatatgccccagtggctggccctctgccatttgtaggccatctcagggatgacagctcacgtgattaaagggctaaatgaagccctttttggtggggaaagaggsggcttggactcaaggcagtgcccagtcagaacccgagctccaccatggatagcagtgacagaatcactttaccccaccccccatcacattactgtttcctcacctgcaaataaggactatactatttattttaaacagccatttatgggttaaaggagataatgtataggaaaccacttttttattctcacaataaactgggaggcagggaaggtagaaataaaacttattaaaaacatggaaaccaatgttcacagggattaagtgatttaccccaggttgtgggcaaaggatctgagcaaacatttctcaaaagaagacaccaaaatggccaactggcttatggaagaatgctcaacacctctaatcatcagggaaacgcaaattaaaaccacaatgaggtgccacctcatacctgttagaatggttactaccaaagagaatgataacaagccttggcaagaatgcagggaatagagaaccctatacactattagtgggaatgtaaattaaggcagctgttttggaaagtcgtgtggcagttcctcacaaaactagcaatagaactaacgtgattcagcaatcccacttctgggtatgtatctaaagaaaattgaaatcaggatgttgaaaagatgtatgtagtctcatgttcatttcagcatcactcacaataaccaagatatgaaagcaacctaaccaatggataaagaaaatgtggtatatagacacaatggagtactatacagcccttagaagaaggaaaattctgccattctcaacaagggtagaactggagagcactatgctaactgaaataagccagrcacagaaagatgaatactgtatgatctcacttatatgtggaatctgaaaaagtcaatctcagaaacacagtagaaagttgtttaccagaggctggggcttgggggcaaggaatgaggaaaaagaagatgttgatcaatgggtacaaagtctcagttagactgaaagaataagttttagtgatctactgcatggcttggtgaccacagtttaaaataatgtattgtatatttcaaaattgctaaaagaatagatttttaatgtcttcaccacagttacctttcttttttccatgtacatagaaaagaaaggtaactatgtaaggtaataaacatgtgaattagctgattgaatctttctacaatgtatacatagatcaaaacttcacattgtatcccaatagattccccataagtgattgtctattttttaaaaaacatctacacacgcacaaagaaaatgcttccaaaagcaaataggagggcattgctctcatgtcttttgtctcctggtggcaaagacaaccatcactgaacctcccaacagaaatacccagtctccttgttacatccattctgacagcttcattagtcacataggggctctgacaatccacaggccaagttctgcctggaattatttgcccatagttctagctgaagtgacagaaacagtttaatctcaaagtaggtgggattgccatccatattttggtgccagagaccttaccatgtgcttcctcagccctgccctgtcacccacatcatgtctgcagagctggagtttcccagtgaagcttatggtccctagggtaatagagtcgctgatgtctttgtcacattaagggtgccacacagagcacttatgaagggccatgggtatcggaatgagaacactcagmacatccacaaacgcttcctccctgactgcctcctgtgctttctcccctctttcctattcccctaatttgccttcacccttgctcctatgtctgtttctctctgtcttcacacttgtatcttatgatgacctctttcacttacaagaattcataaaygtggctcatttgcacccacataattgaaactgtactccaccagaaagcgctggtctgaactcagggaggacggactgtgggcattccctggcttttccacataaattctaagacattcttgcagcatatgaagcaagaggtgaaaaaggtgggggaaaatatttaatgaaaacaaatgtgcccactgcgataacttgctcttgagtctctaatctaaaaagagagcatgcaagtggaattacagcccactaaagaaaggatccaaatggactaaatattcttcatctttgccctccagttactccagaagcatgttgtaaggattaatgagggaataactggaagctctttgaactgcttcgtgatagttccttcctaataagatgacccaattaccagscttattttcaatattgcaactatgtaggaaagctaaattcttatggtattccttaaggaaggataaccttcataaaatgctactataacagcagccagagccagacaggtattacacaaccataagacaggctataaatagctgtacctctctcttgctaccctcttcaccctctttcttctcagtatcttggcctcttttctgatcttttctcttctttcttaagatttctattactttcatcccggcctgtctgtttctgtcttgctcttcctctctgtctgtctctcatgcatacatacacactgtcctgtggatgcacgtctaggtgttagtggcagcaaatgtactggagtcccacrgcaccaaagtatgttagcagcagtgaatccayatggatctacagcagcctcaattcttgcctcctcataaggcaggagagactggggcaagttttagagcaggagtgaaagtttattcaaaagctttagaacaggaatgaaaggaaagaaaatacacttggaaaagggccaagtgggtaacttgaaagacaagtgtacagtttgactttgacttagggtttttgttcgtttttttgagacagactcttgctctgtcacccaggctggagagaagtggcgcgatctcagcttactgcaacctccacttcccaggttcaagtgattctcctgcctcagcctctccagtagctgggattacaggcacttgccacaacacacggctaatttttgtatttttaatggagatgaggtttcaccatgttgaccaggctggtctcaaactccttacctcaaataatccatctgaaagtgctgagatgacaggcatgagccaccgcacctgactgacttcaggttttacctgttggcatacttctggggtcttgcgtccctactyctgtgattcttcccttaagtggtgtgtctgcgtgtgcagtggcctgctagcgcttagaagcggagcatgcacagtgcgtttactastgttgtactcgtgaccacttgatgcattttttccttaccagttgagtgtccctggaggaaggccacatactggttaaattccgccattttggctcttagtgcgcatgcctgagcccactcacccaactgctgaggttttattgggaagctgctgatcaccagtttcaggtatttctgtttattgggagactgcccttccctagcactggctgggaccaattattattttagaaggacagtttaacaatgaccgtcacctgatggtcgcctgccattcctggtgtgtgcgtagtgggggaagccctctcctcccctactcatgcctgactaggtacctactgtagcataggtatttactcatttgttagagaagtaatgggagttacccttgggaggtgggtctgaccgtttttgtgtctgttcatgagcatttctttagccttcaggaagctggggctggatgtgctaaatgtgctgcccatctctggctaaagcctagcttagccattgggatgctccttctctgcactgttggaggttttgctttggcttcttcaacttccttgtctatttcctttccaattctgtttacaaatctctataacatcttgtcccatgtctggttcagtgaatttgtgatgcagaaacctctgctgtgtccagcagtttgtgacaccccagagggggtttaagaggaatgaaagaccccatctctgtcttttttctttttgagttggagtctcgctctggtgcccatgccggagtgcagtggcgtgatctcagctcactgcaacctctgcctcccaggttcawgtgattctcttgcctcagcctcctgagtagctgggattacaggtgcccgccaccaggcctagctaatttattttttgtatttttagtagaaacgggatttcaccatgttggccaggctggtttcaaacttttgaccatctctgtctttaaagagcttactgtagttggagtgagaggaattccacaaacaatgaacacagtcagagagtatataattgagctatactgatacagttgccttccagaaatgtgtgacacgactggccgaagtgactctgggcagtcaagagcaagaggatcagctagagttgaagggtaaaatctcagaaaagggcagggaggtcttgagatgactcttgaggaactgggagcattccaagagggctacgaagtatgtaccctccatgcaaggaggacggcattcttggtagtccaggagcttattgttctgctgatgcaaacaagcttctagtgagaaggaaatatttccctgaatcaagtgtctggctgcatttggagtttggacaccactcagtttcaaggctctggagttgtaagaagcttgcagcggcaggaaaggcccatcaggcaggcccatgaggaatgtgctcccctcatgcaatcagtctgctgttattgcttggttagtgcccagggtggacaggggccttttgtattaaagcaattaattttacaaaaagaggaagaaacccttatgtttctgtgactaaaatgacggaaatgaagtagtggagacagctgcagtggcattttccatcaaacagcttttctatttgtgcaacatatttctaagtgatagaaaatgacacactctctccattacttcacttccatcatttccatcatttcaaccttttctaactttcatatttgtgaaacaaattgctttaaacatgtcaaagacatttgagtggagtgttagccaaattttaaaaataaagatgattcataaagacagtgcttgtgtttatagccatcaagacaaaatttcaggaaaaaaaatcacagtcctaattactgaaggcgcatgcataaggtaatcatatttggaagttagaaacaaatctctttttgctctctgcctcttttcccttagatttatatgggttggtaaacctggccttgtggtactcaatcatccttgcttcagtgattcactaagtaaccccttgcgagttgatttctccagcctctggatttatttgcattgttatgcaatgggtggaacacctcactgctgttctgctcctcagcagttagttctatcttctcttacagctgatgcttcttgaggggaaaggccaccttgtgtcttttgttagagataggatgttgccaagggtagggcaaccaggagggtatcccttagcatgtaactttgaagaatcaagattggtgctccacacaaagttcgttcaaaaatgtttctcttaagaaacttaaaaacctacatcgctgatggaaaaaaaaaaggaaggacatgaatatacaggataattgtacaaaaattgggtacatgtattgttgttgtttaaaagttttttttaaatttcgaaacaaactccactttacagaaaatttacaagacaaaccatacaaagaactgttttttcccagaaccgttattagagttgtcaatctgatgtctcgtcatccctgaatactttagtgtgtactacctatgagcaaagacattcttctgtgcaaccatmaaaataaggaaattaacactgatatttgatggtagtctaatctttagaacacatttgagtttttctacttgttcagtaatgtaccttatagcaacagaagctagtccaggatcacatgttatatttagatgtcatgtctcatgtctttagttttctttaatttggaacagattcataatcttgctttgactttcatgatttgacacttttgaacattacaaggcagtaatttttagaatgcccctccatttgggtttgactgatgtttcctcacttgatgttaaaatcaagtcacrtatctttcacaggaagattgcagaaatgatgctgtgttcttcttggtgcctcctacctggttgcacataacttttacagatcccattactgatgatgttaacttaaccactcgattaaggtggtggcacaggttgagtgcccaggaagtagactgtgaaattagcatgcaagctgttgattagggagtgctgttgggatcaactcctgtggaaggaagcagtattaggtagtgggggagtcaggctgcaatgcactcacaccaaaggcctcagatgaccctctgtgaaactctggagctgagatagctcttcatagtgctcctgagatgaggacaaagggatggggctttgttcctccatagtgatcagtcactggatgtgagccacccctggaatgaggtgtgaccctggatgaggcagttttctyctgctaaggcaactcccaaggaggcctgaaccaccaaggactattttctgtcatcactcccagcagctgaggataagcctgtcggtcatttccgaaggtgtcttgggcagaacatcacagagcccaacacagaggtgactgttggggttacccctgcaaagttattctttgttccttttatagttaataagtactttataggaaattatcttgagactataaaatcccatttattaccaaaattattattgatagaatgattgattaatacctggatgaatcctgattttctcttttaattaaataggttacttaaatcttttattatcattaaataacttaatgttcaaacagcctcgattttgccagttggactgttccaactagtttcagtatccttacttcctcatagtctgttacagtaagatgtttcaggcccgttttgagttttccctgcacctaccctcaaaataaccatttatctaaggagaaacatttctccaaagaactccacttcattttaatagaaagtagtatttagaaaccaaggtctagatcctaggtgtgctcattagtattttacctcctttcagtatttcccaattcaacctaggtatatctcacttaccattcttttcacctctctgtcatacctatggtgacccctgattcatgactcttgtcctccatacatttttttttttttttttttttttgagacggagtctcactctgtcgcccaggctggagtgcagtggcatgatctcggctcactgmaagctctgcctcccgggttcataccattttcctgcctcagcctcctgggtagctggggactacaggcgcccgccaccaggcctggctaatttattgtatttttagtagaggyggggtttcaccaagttcgccaggatggtctcgatctcctgacctcgtgatctgcctgccttggcctcccaaggtgctaggattacaggcgtgagccaccragcccggccgtcctccatacattttttatctttgagcttgtcatttactgagtcttcacaatgtgccaacagtgtgctctgtgtttgcattagttttatgttgctgttgtaacaaaatatcataatcttagtggcttaaaacaacaaacatttattattttgatataaggtataatgatatataaaaggtgtaatgacatcttaactgagctcctcctacctagtgtcgtcccttagggaggaatcagtggaattcagatcctgattattctggctctaaatggtccagaataatcaggatccgatggctggtcctggtatacctggtctgacactgggcctgggatctggaaaggtcttagaagaaattacattgagactgtaaaatcccctgaggaagaagacaaggtcttcagaatgtgaagtaaagagcatgccctctcccaattttatgcaatgagtgaaattctattatggcaatttattcatttaagatatgaaggaattattttctacaaagtgtaaatatggaggtaagaagaagtattagcactcttcttagacattaacattttagcaaaatgaatttattagactcttgccattaactgttagctgagaccagttcccttagaacgagttgccaaatgaccgttttcatggggagccatgcgatgttcaatgactaggtgctgccagggaaggctggcccagctgagtcccaaagtgaggattctccagccactccgcaaacagtatgaaactccagggtacatgcttaaagcactctggaatttaagtagtggcagatgttttagaagaaattccactgtgccactttccaaagcactggaattaggtgttatttacggaaggcaatattgtaccccttcaagcccacaaataaagaggtactcagcagtgacctttattaaaggcaaatcagtggggaacacatgaccagaggaaatgagagaagattggaatatattctaaggccttaaaaagatgtcaagaacaattgtgttcccccacaaggcatcmttaggcaaggatggtccaacctcaatacggtttctttacatccctgtgtttcagctacatccgtggtctcytgtattgtttatctatgtcacttgcaaaaaactaggcttgaatacagttttttaaaagtgatgcttttaaatataagcggtaatcaacttatgaaggaacaatgaacatctatagtaagcaaataaacatccacacataaatatacatatgaataaacaaaatgcaaatgtgtgtcattctttctgccagtcctttgagttccatatttgttgtcatgtagttaataaagtcgttgacttcccccacggtctactactcttgctctgttattctcatgtggcattagtattatgaattaaattacagtctaaacttgcgtatttaattataaacccattgagcacaggaaatgtatcatatctcagcacattcaccaccctgtctcctccagattaagtggtatcactctgctcatcataagcactagtaaacatctgtttaaataaatgtttattgagtatgtattgtaaatatccacttgtaggttaatactagatggactgtaccatactccttagaatgttttctatgttgatttttgtttctccartaattgctttaatctctggcaatgcaaactcatttaacacttgcttttatatattgcattcatatatactccaaagacaaacaaatgctttatcagaattaccagtgatttattctcattattgttgccattcaattattaacaggaattgactgttttagcaaaaatgtcatcagttggcctgttttgtttggaagacattcagctaaactttttcctttgttggctaatgacactttattttttaagtcagttgccatgattttaacgaaatgagcctttcttgtaaaacctagaaggctcattctgctcatataatggatggaacacaagcaaatgagcaaatggtgctttggctccatagacttgccatttgctgggggaaattcagttgctgtaggagattctttacggcatgtgttctgagctgactgagaacatgaaagagatgggtctcgaagatgctaaatgcagtgcatctggtcagtgaccttcatgttcagtgcaaagtgtgcctccccaccaagtccctctccaccccttgggcttccagaccccagcacgaggggtcagaaacccaagaaatatggaaacattctttgtcagttgaaagaattgcataacagttggggtcagatggggcaaaaagctgggtatgcagtttggtttataactgtgaaatctggcaaactacaataaattagacattgtgacaccaacatcctatttctctgtctcacatctctagatcttaaagagtttagccttcatggattgatagaataacacagtcttgtttaaactcatgccaaggaagggctggaaactgccctagaaacaatggtcatgtagatgaactttgtgcttctggtggccacattttttataccatgtcccctgagcaagtttccctatttccaacctccactttcctccctatttccaacacccagttccagcttttaggaaaggtacatagtgcagtaaatttaagcaaacacattgcctttcccagggatataaacatttcagcatcatctctaatttctcttctgttggtaggattttcattaccaacaagcaaagggggaatattgagaggtcaagagatcttcatagcaatcctgattgctctcctgcagtcttcacagaacaaccaaagtgattttttaaaagaacttaaagcagaccatgcctcttttctagtgactgcttttctcaatcagaataagatccaaagtcctacaaagccctgcttgatctggctgtctctgacatcatcttccatggtttcccctgctccaggaactttctcgtctcccacaattcccctgctcaggcactgtcacctcccacaattccctctgctccaggcgtctaatctcccccaattccctctgttcaggcacctcatctcccacaattccctctgtcccaggcatcttatctcccacagttccctctgctcaggcacctaatctcccacaattccctctgccccaggcatcatacctcccccaattcccctgctcagatacctcacctcccacagtttctctgcttcaggcacattggcctcctcaagcatgccaagtaccacctcccacagggtctttgcactgatgacacctgtcccctgatatttgcactgctcattccctcacttttctcaagtctcttctcaaatgtctcctctggccactgtctctaaaatagcacccccagctctgaccctctctgtcctcttaagctgctctagtcattttttcatagcacttgtctccgtttgacgtatcatgtatttatttgtttattgtccgtatactcccactagactatacactccattaatctttatgtgttgacactgctgtattctcagtacctagaacagtgcctggcacttaaatggtgcttaataaataacctgttgacgaaaaagatcctgaatcgtgccacagcaacaattacttgttaattgaaaaatcacaaatctatacatttggaaaggagtctttatttcttataaaaggttacagcctgcagagtgactatccggacaggctgagaagcacagcctctggcagaggctgaaaggtgggcacttcaagggaaaggaagatggaacaggaatttatgctgagctggttggccaaatatacatattccacaggttacaggaggagctatgaacatttatgaagagggtcttaatgtatgcatactgaataaacatgcatgttatgtgtgacccatgttcgctttggggtgagacttaacatttatatgtgcttcagttaggccctatacatcaaaaggtgaagcagggacaggaatgcattgtagtgtgcagcttcggtaaatcgtccagaaccagtccatggttgatagtctcttaccaggagaaagatgctgaaatcagtctcttacgcaatcaaaactgtagttgtggctggtggaatgtgagttagttagtcagcatctggtgatggatgaactgtagttgttccaacattgctcatcttgagaccagggcttgtttagctgctagacaaaaagaaaaactttgtggcagttagaacatagtttattctttaaatgcaggggttcatgacttaatccttgcctggtgtggccttgggtcttgtttataattatatattttattgccacagtgtcagtcttatgatctctattttaacattgattctgttcaattttgtctaaacagcaaaaggaaagggaatatagtgaggtgtgtaccacctcccatcccatcatggctgcggctcagtttttaaggtttctctggggtccccttagccaagaaagagtctgtacagttggttgggagtggggtggggataagattttacttttagttctcacaccttattcactacctgtgtggttatgctcagaaataaaaataaaataagtttagtaagatttctttgctattatagccatcagacaccatataatacggagaataataatttgttcagtttatgaaatgcccttcacacacactattgtttaatcctcatcttctggaatgccaattttacagatggaaaatgcactgagagggttcattagcctccccagtcacagctctggaccaagccgacctgggttcaaatgattgttctgcatcctgatagctatgtagcctagagctagttacttaagttacctgagcctcagttttcccatatataaaatggacataacccttaaaggtgatagagcaaatagaaactgctctagatttgtaagcagtgggagcttactggaggcaattgggtacacaagcgagtgaatgactaagaagccaaacaaacgacatggtgaggcaacccaggaattaggaacagtagaaaactgccaccacaccaggagctggaggcacayggaggaggaggtcccatcagaacccagaaggcatcagcaggtgctggagccatggaggagactcagactctcacctcaagacagagagagcacaggagacacaccctgacatctcccctcctcctgcttccaatcctctctttggccgaacctacctcgaagtcagagagcagaggagcrtgggaacatggcttcctgtggaacctgacagaagattctaggggtgcaggcaataggtctgagaacagccagtctgtcaataggtggagttgctgagacaaactataagtggttgttattcccgaatggacaacaggaaacacaagtccagattctttgactcctgttcctcctggtccttcggaattgaatgggcaacgtgaacaaatctgcagtgtaatgttatgctctgtaaccaactttgtctacattgtagaacattttctgctggttattttttcttaaagactaaaaatatcctgtcttctcttaaatgaggcaacacacatgtgggttagggaatttctagaaaactagcttcctggagtaaatttgtatcgcagttaacaacaccaggtcctaacttttggagcaaactcctcataaagcagcatgttctcccatgcttgaagcttagtctggaatctttgggttagagggaatgactgtttggttcrtggctgtatctcacttaaaacagtgcctagggccaggcacagtggctcacgcctgtaatcccagcacattgggaggccaaggcgggtggatctcttgaggtcaggagttcaagaccagcctggctaacatggcaaaattccctatctactaaaagtacaaaaattagtgggtgtggtggcccacaccagtagtcccagctacttgggaggctgaggcaggagaatcgcttgaacctggaaggtggaggttacaatgagctgagatggcacccctgcactccagcctgggcaacagagcaagactccgtctccaaacaaaacaaaacaaacaaaaaaaataaaaaaaatggtgcctggcaccttgtaggcactgaaaaactctttcaagaatgaacaaaacctggggtcgcctatggctctgcccccctacttaatgccaacatcaaatacctgttgcgtctacttcctgcttccrctggcacccctccacttaccttcccccgagagtcagtcaaagacaccatcatgcctcccttgagcacttcagcaccctctgactggtttccttgctccactcttgtccctctcaaaccattttccatcttgcagacagactgatctttctaaaatgtaatctcaccagatcacttaagcttttcaatggctcctgccccatctccatcccctccctaggacacactctacatacctttgcacagcgttggaggtccctttgctttttaccctccctgggtcaaatgcttcttctgccacaggtatcctgagtttcctgccattccctttatgcaccatcctttccttattccctcagttggttactcccccagctgggaagacttttctctaccttttccacctttaagattgtatcccaaaaccacattctctgaggaatcttcttcaacttccacagacactgttagccacttcctcctctgggtttccacactgtgttcctcgtgaccagtagtcccaggaagaggctggcatgctgtaggaatgtttaaaatgcatgcacatttcactgaaggggcttcacagtcctctttctcagaaataagccattcttagggagaaattctcctatctcaatgctgttcgtattttctctgaagttcatgttatgttcttacttcctgtgaatgccactggcatcatcctgagacagggtgtcctcatgttcacattcctgccttggttagccatctaagtggtgcacttcttaaagccagggaccaggtagtcagcatcaggtgacagccttatgatttmtttctgattcactcaaaaaacctagcacgatgctggtttcatgtatatcccacaaaattacgccttacrtttactccaaaagaggctttaagtgatgtaggaagcactgaaagaaaagtaaaataaaatcaaggtagaaaagacaccttaacaagtacctagcttccatttgccaaatatttattgagcacctactacgttccaaacatcatgcaagctgctgggtatacaaagttaaacaaaactccatctctgtcttcacaaagtttccccccaaccctwcctaagtttgcctgagctagaataaacatggccaggaaggtctcttttctttaggaaacatctggaaatatgtatgtaatctgccaatggcaacttagcaatggaaagggcggatttctacagtcctcaaagagatgatttgcttttgaatacttgtgtttctctcctcttagttgctatcatccatgatttctgygcctttttgattgtttcttttttggtggtggcattttgtttttgtagctggtaacctggtatttctaagagttattyggtgacttattcccacttggtctcagcacactccctttccatcctaagactgttagcacaagttttgcttccttttccaaagcaactgtattcacacttccagcgctgccacatacatcatgctgttaccttcatacttcaagggcccatttggaaatagattgattattttgaacatgaaaggtgcgccttgggaaaaacaaatgaatcaaatggaaaaatgaattaacatcatgaaatttaccttctcagctgaagacatgatagattcctgtgttccttagagacagtcctcttataagaatgaactcttaagggaagtctgcaggtagatggagtcagggctcagcttaaaatgtgtttatataagaatggaaaacaccctctgaggaagaagcttagaaataaaaaagtttctttcttgtgaggggtgcttggattgaacacccagattgctgtgggcatctcattccagagcttctaacatctctatgatgatcttagtggggcttgccatttgcagagagctcagttcagcctcactgacatttattaggtaccgactgggtacaaaacactgtgacattctatgggagctatacagacatattagacaatgtcttcagttcagtttaacaagcggaatagatatctaagtgaataaggagaaaaatgtttgtttgggcttttctggcaaataattgttataggaaaaggggtctcgatgcagaccccaagagagtgttcttggatctcatgcaggaaggaattcagggtgagtcacagagagcagtgagaagagatagtttattaaaagctgctccattacaaagtagggtatcctcagaaagcaagtggaggaatgcgctgtcattgttttaagcttttcttacataggagtcttgtctatgtaaagactaaacaaagctgtgcttttgtgtgggtaggatgacagcatgacaaaatttattattctattgatttaaagaaaactatccttgacattttagtgtgtgagtatatcaaagcataactgtaattctcttgaaagtatatatcattatgggtattgggacatctggactttctgttgttgtaggagtttgtccttgcaggcattactaagttgtttccttagctgtcaacatcttaggaccatgggttttgactggcaaggaaagtgccttgctagttttcagatgcagttgatttaaaaaggttgtgaccctggctctcctacgttcgtttccctaacgatatggccagaagtcttcttattactaagtatagcatatgaggggcacagactgcagccactggacttacagatgacatgcccaaaagaggagagaagtgggagtgtcctgagttatcagcttctttattttggagcacgagagggagcagtgattgatagatgtgtctactcagtcactgataccaaccctccttgatggcaagtatgttcttccaggtcctaggcatgagagaggtggagtcagaacagttctattaggaacaatattcaaccatactgaccataccatgtgctatttgatgtcctttctagactacctgggaacctaatcaccacctaggacattgtatttttaatgtaaaaatatttcaaagccatcaactaacccaaaagattaattttttaaaaggcaatgaattcttctagtgggcactaccaatgcagggctttgcgtgcagtgggctctctggtctgtggaatgcattgaaaggttgagaggacattttccccagggtcacatagcactgaatttgagctgtggctagatttctctttcctatcttgtgaagaatactaatatcaagaaactgtgcacaaagctcaatcaagcctaggtagctaaggttggaaaagagtaacrtcacaaatggaattaaagattttcatcttcttcctcctacatcccagctggggggattaaggtaggtctgtgtaaggagagtgaggccctcagtaaagggacaatgagacattcgaatataggcatatggtccaagcggcttttgccttaaaaacattagttttgtggcctcaataataattcacaaatggaagcaagcactgaaactaagagcatatgttaatttctagatcacttgggaagatggcactagtttttgataagtgtgaaaaaatgcaattggtaattataatatttcctcatgtttagtagtccaatttcaaaggctgcaattattaaaaacaaaacgggattcctttcttggatgctgtctttcccgatgtctttttcttgccctgatgtttttaacgcaaagttgcatgatttgggggagaaaaacacatctatccaggcattatatactctaggcaaacacgtgcatggaggttccctgtatggagccatgttttccatccagattgggccaaggatagctgatgggcagtcatggatgttgatggatgggttttccmagggtagctggattgtggtctcgtaaccatgccgactcctggggctgagaagggctatttagtgaaatgaaatactactctgtcacaacttcctcactcacaattcaatcatggagagtacttccccagtgctgtcactgaaatcattacattcagaattaaacatgggtgtaatagagcagtccctgaggttctattggcacatcaggttccacattcctaaccagctttcccatacaggaatatgaaaagcctgccaatcaggattctttttccttcctttggaattaatctcaccactccctgtccctgataacgcttccataacctgttcccgggccacgtggcatcagcgtatcagcaggattgctcagccttcaccctttggtgtctgacattactttggaagtcttcccaatgcaaatcacaaaaaaatgagttggcccagagagaccctcatgcaggttctctccacctggtcttccttctcttcactcactcagttgttacctcctttgatccacatttctggctcacacaactcttatccayggcagcatattttctcaatgtcccttttcctcatattcctttggactttccagttttattcttctcttgtctcctttcatctccctagatcccttttgccattctccaccttcctccacagaggaagcatgacatggagcaaagagaacaggcttccctgtccccagttctgtctccacttctgcctagctatgtgatgtgcacacatgacgccctcaccaagcctcagtttcccrtctgtaaaaatttcctcacagaggttttgtaaggaccccaagaaataaaacttatttcctgtcactttatttgcatcactatgtgaactgccttggcaactctaaacaacttttgcaatcttaaaattgaatattttagccatgaatcataaaatcaataaaaagctacaaacttcctatgttttcaacaccccctgagactgtggggaatttaggcgactttaaggaaactaaaggttgacctactagtagtacagatgtttgcgaatagtttagaaacatatttctccttggaaggagaagctaggtgatggtattttcttcttaggctcaagtgttagacttcaagagtctgtaataaatcgctccttaaataaataaaatgtgaaatcctctaaggcagatgttggcaattgtttactgtaagggccagctactgtgttaggcgttgcagaccatagggactctgtcacaactactcaactctgctcttacaagagtagggttgtattgtagcacaataatacacaagcaaatcaacataactgtgttccaattaaactttatataaacagtaggtaggctgggcgcagtggctcatgcctgtaatcccagcactttgggaggcctaggcgggcagatcatgaggtcaggagatcaagaccatcctggctaacaaggtgaaaccccgtctctactaaaaatacaaaaattagccgggcgtgatggtgggcgcctgtaatcccagctactagggaggctgaggcaggagaatggcatgaacccaggaggcagagcttgcagtgagccaagattgcaccactgcactccagcctgggcaacagtgcaagactccatctcaaaacaaaacaaaataaaacaaacaaamaaaaaaacagtaggtaagctacatttggcccgcagactatagttttctaaccattgctctaaaggatgaatggagattacattgatcattaacaactcagaaaatcagaaattatgattgaatgggaggtttcaggtgactccatgatgattctggaattattaaggcttttggttactaataaatggcaacccttttttttttctttttttacttctacaagttctcctgatggaaaaatcagtcagctcaaggttttttagtttgggatgaattggcctttgaaatagatttgggctttgataggtttgttggcaattggtaaacccatcctaatttcccacagatggagcagagaaggatcacttagaggaatcagaaagcccaggacaacagggaagtaatgataactaccaattattaagctgccctccccatcacaaactatgaccaccatgatctccattttgtagaagaagcaaagttttagttgacaggggatgagtgctttgcccgagatcacacagaagtgttagagccagctgaattgctttccccttagccacaatatctcaatcaacacaagtaacgtactttccttgggacattcacctttcttcagattcagaaccagagagsaaaaaagaaatcaccccttcttccttctgcctttactttctagtagaagttatacttaaaaaaaaaaaacaatttgccaggcatggtggctcacacctgtaatcccagtactttgggaggctgaggcgggggggaacacctgaggtcaggagtttgagaccagcctgccctacatggcaaaaacttgtctctactaaaaatacaaaaagttagccaggcatggtggtgggtgcctgtaatcccagctacytgggaggctgaggcaggaaaattgcttgaacccaggaggcagaggttgcagtgagctgagactatgccactgcactccagcctgggtggcaagagtgaaagtccttctcaaaaaaaaaaaaaaaaaatgagtgccccctcagccagcccctactgtgtgctaagcataaagctttcattatattataaaatctattgtctttttatttcccaaactaaactgcaaagaatcaagaaaatggaagctaagacaagtaagtgatttgcctgaagttgcaccagtagttaatagtggagtcagaatttgacatggttctcatcaactccaaaacattttcaactcacacagctgccatagagcttagaacaggccgactctcaaaccagatggtctgggttcaaatctgaactccactatttgctagttgtatcaccctaggtaagttgcttaatgactcttagtttcctgatttgtcaaattaggatgatgataatggtttccttctcatcttttgttatagggaataaaggggtaataagaacatggtaagccacatgctttggctttttctgtggaatatcagctctatgagcacagaagttattgtctgttttcttcactgttgtatccttagcacttaggataatgtctagcacatagtaggcaatatcaatatatgaatgaaaaatgtcagaagtagtctttaaattaggttatgactggattcaaagtcagcatgaaaaagcatagctttccttttgctttactatttttgtataacttggatttgataggtgaaattcaatatgagtctttgaagtcttaatttaaagtgtaacagtggaaactagtgattgtcttcattctttccatgttcccaacaaaagtagaagttagtacaaaggtgaagcttttaaaacaaaagtggaagttagcacaaaggtgaagctgaggttgagcacataacaggtacaaagagtgctttcagatgtacttctctagttttttgctattccccaaagtgcatccttacataattagctttaaaattcctttcatcccttatttttttttaaatctatcattaacacgtagatttttatctctaagtttatttttactaaacttgcatctttttaaatacgacgtattctgaatctaaatcagtatttagtgacaacagctgctgggaaccactgtaataaatgaattatgggtcccatttacctggcaagattgcctttgatgtctacacgtcaacagtgaaaggggttccagagaaaaacaaagcctctggtaaaaagggcaagctcatcccaagattgagtatgcacgaagagggagcagaaacaggagatgggtgcctctggaacaaacatgcttatgcaggtgggtttatggaggggctcctgagaggstgagtcccatgagtcttcaagagcattacttagatgccatggcacctaggcagaaaacaatgtttaaatttgtgctggatttacaagtatatgtgatattcattctgagtggtataacctatatccctaatagcaaagtgttgaagttctaatctttctcagtggtttgcactgtgtaaattattattttcattaagattaagcatcctcacagaattgcacagcagtaacttatgtaaccacctccttagaatgttctctctctgacaatatgcctaccaaagactcttttaaagatctttgaaattagtaattagggaggttamaatggagcactgtttgcttgtcttaatgtggaatcctctacatgctttatagaaaacaaatgaagtgaataagttttgctcttgaaggttctcctgcttacaatcaaagtaatttgcagacttgcctgatttgtatgtttcttcaagtcaagaataattctaakggattactcctgtcccttcagctataagataacagagtgagaacaaaaatggcttgtgaaatcaacctaacagagtatttcttctctcttctcataggtcgctacccacaggagaacaagggaacctacatcccagtgcctatagtctcagagttacaaagtggaaagtggggggccaagattgtcatgagagaggacaggtctgtgcggctgtccatccagtcttcccccaaatgtattgtggggaaattccgcatgtatgttgctgtctggactccctatggcgtacttygaaccagtcgaaacccagaaacagacacgtacattctcttcaatccttggtgtgaaggtaagaggcagacatttagttttctcatttaaaaattcacctatttggcggggtgccatggcacatgcctatactcccagctctttgggaggccaagatgggaggatcgcttgaggccaggagtttgagacctagtctctaaaaaataaaaattaaaaattagatgggtgtggtggtgcacacctrtactcccagctacttgggaggctgaagtgggagaattgcttgagttcgggarttggaggttacagtgagcaatgattgtgccactgtactccagcctgggcaacagagcaagactccgtctttgaaaaaagaaaaaaaacaagctcatgtatttccaatacatctctttttgaaggggtagtaagattattctaaatacatatgcctctcctacatataccatctttaatgattgaaagagaaagatagaaaaytcatcctccatgtgtatgargataaaacctctatatgtgaagtcaatgctgctatacatttatttcgggattaattggagattgtctaaagttgcagttagttatttgtggagctattaattgcagttttgtaattaaaagtaattgcaaaaatcacaattacttttgcaccaacctcaccaacctaatatatgttgacagtataacctctgtacactattactctgtaaacaaattgggcttattaagcttgattatcaaaactattagagtctataactctgacttcagaaaaataaaataaagtcgacgctgttcatagtagaactaacctctctatccccctactttaagaacagaaagtctgtatatctaaaggattccacaaagttgtttatgtgcatagtgggtgcaaattttgcaaaccataactctggatgtgcaaagatgtagctgtactttaatataatataacttgatctctagtgctattttcagtcttcctttctgtctgcggcagaagcttaatctagttatattcaaataaaactcagtcaagttcaatgatttctctatcaattctgttttgtgcctcagtcacacatagcattttctcctcatcttcatctctgccctttcatacctctcccctgctcccacactttgtacgaagctgttttaagttccagaggcagatgcagatgttgcagcagcatcaatgtgggagagaccacttctaggtcctaggaaataaggcagtgaaagatatgaaagctcacatggggcaggagacttcccatggcaccctaccccatatgcactgctctctaacatcatccaaaatgagcccatattattgctgattttgaatgatccttgtatgtgaaagtcacatttgaatcagggttaatctgtcctagatatagataagtgcacaacaatatttgctactcatctagaacatacaccttggtcctactgatcttttctttgttttatatttatatttatttactttttgtagagacgtggtgtcactatgttgtccaggctggtctcgaactcttgggctcaagcagtgctcctgcctgagcctcccaaagtgttgggattacagtcatgaaccaccatgcccagcatggcttgggaattacctgttccactagtgttggcaaaaggcgccaagctattcctacactccctatacatccatcctcatcatattgtacccaacactcctatctatgagacagatattcaaggtaaatggtaacaggaaatgttaactgggccatgtgcagttcaaaaaatgaactcttgatagtaatcttaaaaccagatgtgaggcatttgcaactggttgatggggtgatatttacagagatgaaaaatactgagaggatcagagttacagatatataaattaagattttgaatatgttaagttggagataaccatagatagacagcagaaatgacaaataggtatgtgaatctggagaagaaaatcagagatatatatttgggagttatctgtacctagggagaaaatatagataaagaaggaaataggatatagtatctagccttcaggaacaccatcatttaggagtccagtagagaaggagtcagcaaaagagaatgagatggaagagtatgtaggaagcaacctattctaagaaaattgtatttaaaaattcatacttatcaatcaagagtttgttattgactttctttttattacaaaaagaaaatcctaggctacatataactgttcagaactctaggaaatttcaggaatgctataatttacccagactttggtttgtttgcaacttttctggattatatcatgtgtgtaaatgggatatgtgtctgcattcatttcaacttatgtgaccactcttcttgacgggaaaagggttagttaagttgcttgacatattaactttcaggataactactcaggaggtggacaatctaataaccttctaattgctgccttgatcttcagttgtatccatgatgagcagcttccagatacctctgttctgaaaaagtcacttaggtctggaggcgttcttgttctagaggctgtacagggacctcccctaggttttcagttcatggaaaggattggaggaaggtgggacaaaaaccagagaccaatttggaagctgtggtctaggacaaagatgatgataaactaaacatgstggtaccagtggagatgagaaggggttagattggagatctattttgtatttagaacaaaaattgcacagggattcaagatgagaagtaaagaaatgggaggactcaagaataactctagatttcttgttagaccaattgggttgatggcggtgccattttcagagctgggaaaactgtgggaagtggaggggaagcactgggggtgaagctaagagttacattcagaaatgttaatttggtgatgtctatgagacatgcaaatgaaaacgtcaagtaagcacttgaataaagtgaatctagaactcaaaggagatggctgagctagacatgtaaacatgggcacggttaggagcaataacggacacaaatgattcagggtcattaacaattaagagttgagacaaaggagaagtcaacaaaggaggctgagcaggagcagtcagtggagcgcaaggagatcaaaagagcccagagccagacacattgatagattcaagacagcagtcaactctgtttaatgctatgattagttgaataggataggggaggaaagtggccatatagtgtggaaatatggatgtcttcgatgatcttgaaaaggacggtttcactaaagtgatagagacagaagccagggagatggtcatgggctgtgttgtaaacaggaggcgagaaagtagagacggcrggagatggcacctttctcaagactttctgtagcacctagatgttgaagcgaaggtcaaaggagaattttttaaagacaagagagagtgggtgttattttatggtgayggagaggaaccaggaaagagagtttgcagtccagagagaggacggtggttcacagccttggctgcacgttgcaatcatctgggaagctttgaaactatggatgcttcagtcccccatgcaggcattctgatgtaattgctctggactgcagcctgggctttggggttttttaaagttctgcaggtgattcttggagctaaggttgagaagtttcaggagtgaaatccttgagtggttggaatccagggaacaggtgaagaagggcctgtgatgggtggggctatctactctctccagagacaggagtagagtagaagaagaggggtgcagattttccagtttaatggaagaagaatgaggtgattgccattttgtgactcctttttttttttttttgtcagtgaagtgtaaagcaaagtcatgtgttgagaagcagcagcaaggaagggcatgaaacgcttgatagggaagatgtgagctagtcatctggagggtagaaggtgaacttattacagggacatgccgggagggtgctccctgcttccagaacacagggcaaactagcacaatcttcttcattacttggcctgtggaggcccaaacatctctgcaaattctttagggatttctgacttcatggctgcctctgcctctaggagtcctactcacacttgtgctgctgcaagtgagaaacttgaccgtcaccttcaatttcaatgttggcaacaacaacaaaagcagccacacacaacayctgtgaatgcccagaccttaactgcagtttgggatggagggtgagagcaggaaggatgcactctgtggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggcttgttcagccacttctgtgcagcaccctcaggttgagtaggtctgaggcctggcctgagaatttgcatttctaaccagttcctgggagatgctgttgctgctggtcggggtcaacacttagcggaccactgnnnnnnnnnnnnnnnnnnnnaaaagcagccacacacaacatctgtgaatgcccagaccttaactgcagtttgggatggagggtgagagcaggaaggatgcactctgtggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcagcacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcasccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggarcacatcagaatcacctggagggcttgttcagccacttctgtgcagcaccctcaggttgagtaggtctgaggcctggcctgagaatttgcatttctaaccagttcctgggagatgctgttgctgctggtcggggtcaacacttagcggaccactggtttcataataatcacgaaacaataaagctgggcatggcccccagagcagcctgcggtcccagctacttgggaagctgaggcaggaggattgcttgggcccaggagttcgaggcagccccgccagcctgtctctaagaagaaagaragacaataagcaataactttaaaactcaagaggcagggccgggcccagtggctcacgcctgtaatcccagcacttcgggagaccaaggcaggcagatcatgaggtcaggagttcaagatcagcctgatcaacatggtgaaaccccatctctactaaacatacaaaaattagctgggcatggtggtgtgtgcctgtaatctcagctactcaggaggctgaggcaggagaactgcttgaacctgggaggcggaggttgcagtgagccgagatcgtaccactgcactccagcctgggccacagagtgagactccatctcaaaaaacaaaaacaaaacaaacaaacaaaaaacctcaggagattataatttactcttcttaaaatttcactggctctaccctgaacctaattccagtctctctcccttaccaccccttctctctctcctactgttctcctttattctctgaacttttctctcccattctgtcccaggagcaaattctccttccttaatgcagagggatccagtgagctttattatttttgttgcttgatctcttccaacaaccatgcttttgggccctgaacaccatttttttaaatgaagtgagagaaagagttcatctccccacttattgtgtggtttcccggcctagcacgcaaagcataacccaaaaaggggatgatatgatgaaccgctccccccaacacacacacaagcacatacactgtagcccagcagtcccctgcagttttatgcttgtgtgtgtgttaatgcataacaaargattcagcgctatggcctggtaactggaaagtaggtcaaaagagaggggtgagactgtcrcccaagtgaaaaagatagcagaagataagaaggaaaactgtttccagaaattgtcaaaagacagccaggtgaacaagattgtggyccgakgtggcacaggatgctgggctgaaaattacagcagcatgcacagcacttattgataggagaatgctcagctgtgctcctgagggcccttcagcctgctttgcattcataggcaatttatcctccttaatcactaaatcattaatggggatcaatagcaatgccacatcagwgaaggcaggggtgcatgcggggagaataattgcttgcttagtttttagtttagtggtgctaaccgggcttcgggtccattctgggaggaaacccttctcctgggtgttagagagaactgtacccacaaaggcagcaggagtgagacgggcagttattatgaattcatcatgtttttctaactactcaggaactctgaactattgaatgtatttcactatttaaatatagaatgttccagtttggtagtctagcactagtgccagatagtgggtcctgaaagatttagatttctgatatctgtgcctagtactctggagaagcagtgagcagtatttttgattgggcatcagttacctttaagggatctttctcctcttgataagttgttcccccattccattctccatcactgcttttccctcacctcattcgacctcatatccttagcctctggcacacttgaggtttaataaatgtttgctgtgttgatttaataatcccaagtaaatactctaggttcgccgcaccctgtcattacagataacttgtaaatgtaatctcagaccttaccatcttgagaaaagtcaaaaacatatctggtgtgctgggaggagtgtgtctgtgggtgatgtgtgtgtggatttctctatctcttagcatctgacaccaaattagcatctaatatttcctttttattcaatgtgttttttcacttttctttaaacaaataaatcaatttaatttaatatgaagaaatcaatatgttcccaatatcttggatgcttttaacagcaaataaataaatatgacctgcttgtattttatyattaaattcatccttagccwatttgctttgtatttatataaggtctttttagcccctttcatacagaatggagtaagtaaccaagactggtgtcctcagagtaacaatgacccacattccttctcttggagactcttgagcccagaccagcatttacgccctcaggctagagccattcatccatcaatccacaaatattgatagtatgtcgcatcccatgcccatgacaacacaatgacctgtgcacagtacgacagtattatgtattcattcagaaaaattcaaagtcaatactgaattaggtactgggactatggcagtgaaaaaggcagacacaatcttcgtatagcttctagcaaggattttacaaatgagctcctaataaaaaactgattacaattgtaaaaagtactaaaataagtcagtgcacaagaagaacacaaaactggggactccgacctatttggggaacgaggagagactggccagtggcttagctttgcaccttggctagcacccagaacagtatttgcataggatagtaatcaaatagttggttaattgaatttttatgaagttttaataaagcttatggaaaaattttaacctttatttactcaatattcctcttaaataaaatagtatgcatcattcttcctagtatctgagtcattagagacttattatgctttttatgccaagcgaggatcatttagtgtggccctgtaatcagaaaggatcccagagagctcacagtaaaccttcttttcaatggcatgtaggtgaccccaggattgaggtgcaaaggtctttacaaggtgtttctagaaagagcatggttggaagtgtctaatgcagagacacattcacccaccaattcatgtggtttacaattccttccttgtagagtctcttatatgcttcaaagtgtgctcatagtcagtatctccctagattgtgtgtttggaaggtgtaatccttatctcattcagcctttygtggtgcctggaattgagtcaatgttcagtaaatgtttgctgaactgaactgataatcaccattctgagaggcaaggagacgattattagactcagatttcaagagagaaagcaggttctgtgatgttacgtgcatttctcaaagtcctatagaaaattaagaaacaaactgaggctaaccctggagcatcctgactctgtcaaggtaagcacttatatttttaaaacaaaagccatcagtatctggcattgtgtaacaaaagaaaaaaaaccaatagatggccagccgagaagattctgtaatgacctaatcaacgtggaaatttctgccataataaataaatacataaataaataaataaattcaggttgatatttacaagatcaaatgaaagctttctctgggaaaaaaaattaaarcataccaacaagggcacaggctcccttagaggatatgtgctaagtaaagaagctctgacattttctttgtagaattgcttcatgaataatagtctatcttctgaagatatctcagtacactaaaaagcccttaaccagcaaaacaggcaaattagcacaaatccagtaaccttctcaagctggtgtgagctgtaatgcagcatgtttgtaaggaatgtaaactatgttgtactatgcacgcacggatgattgtgctgtcgtgagcactgtgggagatatactatcaatatctgtgaattgatggatgaatggcagtagcctgagggtgcaaattctggtctaggctcaagggtctccaagagaagcggtgttagtcattgttatttcgaggataccagtcctggcgaactactctactttatactgaaggggctaaaaggaaagaagcaaactcaactgactattgaggaamcatttgcttgtgcttcatagattgattccattccagtgttactagataggmaagcaacgtctctggagtggctatatgaaaccattttaggaaggcagtgcgtttggatccttccagaataaaaagctcagactctaaaaatgccattccttaatatgctcacaattgccaccgacaggaagttactcctggtatgccacagcacacacagcctgttagaatctgccaccccttttgatgtactttgtgatggaaaaacatatcatggtgacaccagtccggagtcacatttgctctgcagatcaagccactccctctaagagtgattacacactcccagcatgaatctttcctctttttagtggtgctcagcttttatataaagggggaagcaagtgtaagtgattcctaatcccctcgctctaaattccttccttccctaaatggtgactcattttgccttttggaagggccaaaccattattccttctaaaggattagaaacaacaccaaactctggtttaaactgttgaaagagaccatgtaggttagctgttctagcaccatagttttgtttaattcctgggctccctttgccagacttgagcctaatgaccaaggaaatggaacttgctctgactttgaaatagcatgtaaataagcagaaggaatgtatcagcccatgcaatgatgaatgatcttccttctcacaaagaggttatacagatactaaaatcagtaggctcagcatttgtttttacatgtttgttataaatccttaccttctctgggtcgggaggacagtgggaatgtcagagggtgactgaaatccaccscaaattttcttggcccactcttttcttttttaactacccttcyattcccaccagaggaacagtaaaataaatgaggtcattattcttcactacatgcctcttgtaaattgttagtcagcctgcaagggtggttatttacgaggcattttgaaggtctgttctggtgacagagttgctctgggcagtggatggaggtgctgtgtcacactcaccaatggtgccatgtgtaatctgtttttctcagagttttatcgtaatggtggttgtctgccagaggtcacctacgatcaaagagttgtcagttggtccaaggtgcagccgctcctactctgggagctgtctagaccttatttctcccctcagtcctcagttaagtatagtttccagctcccacattccacacaagcctcatacacgtctaccttctaccagtccaaattgttgggtttctagaatagtgagttgtttgttagtttgtttttcctattagtcgagccttccattttactaagtgaagaactagcttcccctgaaacttagtgaaaccccaccgctctgaagctaaccaaaaatttaaaaacaaacgaaaacactatcaaaaagccaacagcaaaaatctccaagggcaaatgattacatttttctatttttgttagccttccaaacatagggagtttttttggagtttccatcgtgatacaattttttttaaccttgctttggacaactatattttaaagtgacagatctgaataaaaacgggaaataaagcactgctttccaccctcaatcttctttttaaaatcataaataaatttaaaattaaaatcgagccttcccatttgacttccttgccatactgtggattcatgataatgtctgcctgtttgaggtgagatttaattcaagtgttggaagggaaagggtggcctagtctggagctccagaactcctctctatcatgctttgccacttaaatttatcacttcccatcaatactaacgcaaagcccaaaggtaaatccttcattttcttggacttcttccttactctctaagctccagacatcttccccatctctcattctttcagtacacattgattgatttcctaccgtgttccaaggcacagtgttgggggctggggacgcagtcatccgatcctttggacccaagagccatggactacttagaaggcagcttattcaaatcctagcttcacaactcactagctgcatgaccttggaaaagttatgtttctctctgcctcagtttcctcatcagtgaaatggggctactttcctcacaaggatgttatgagtgttgatgagttcatgtgtcttgttataaagcacttagaaagttcctggccataaataagcagtataacaatgcttatttacatgctactacttaaaaaaaattaagaagtaaatacttaaacacatacttattcaataaatataatcattaaacggcaatgtccatacagtgggataaatgttacccccgcctccatagggcactaagggaacaaggtttaattcaatctgtgctggaaaggaaagggttcagggagacttaaagaaggagaaaaaagttgtgttgaaggactctgataataaaaaagagcacaaccctatattgctcttaaagaaaaactaatgcacaaaagttggacttgttaatctctttttaaatgggtagcttcacttaaatggaaacacattttagaaaataactttatctgatggaaaagtctcattatagaaataaaaaataataaaagcataaaaagagctcaaagatctacaaattagagacactaacaattaacattttsttgtaatgtcatccatttaaagtattttcagtgcttttcatttttaattggcaattaattgaatatattgttcttttcaaataaacacacatgtacatttacatggctaaaagaaaactttccttttcaccaatcttccaatcctagagaatccccagggaaaaccaactttaactgtgtatatcattacagatactttgctatcattttatgtattgatggcatatatatacctagagaatttaggttttttaaaaccacaaaagagattgtgtcaacctgttgctctgtacctcattttctcactcagtatatcttggagcgttttctatatcagtacctgcatcttctttttaatggctgcttggtatggtcatatcatgttgttttggtgttttgtttacaactatttggattgtttcccatttttactatagcacgttatgccattttgaaggttgcacatacattttgtacaaatgttactgtagaatagacatctagaaatagcattgggcaaagtgaattcacattttaaatttgcatagatattgcctaattacccttctaaaaggctgcagtattttacactacagccatagtagatgagagtatccatctcttcataccctcattggcactggtggttaatcatttgttttaatatttgccgatatggtaggagaattatggtatttcattggtatttcatggttaatttggtttttatgtctctgattgttagtggagttgagcattttttcatatatttattgaacgttatgtttctctacctgcttatatctggaacatgtcaggtgaaataaagatcgtcagggagagacacacatgtgcctcttaaatctatggatacagtttgtatatagtaggataaagagatcttactgacactttttttcttacatagataaccagctgtcaaaacaccacgtattgatcagatctatttttacctattgattttaagggccatctttattatttactaagatttaatacacatctagctccttccatatatttgtccattactgtgctaatgtcagttttaagtgtagctttgtttcagttagctataatcacactaatgctacattaaaaagaaccagaaaatcttagtggcatacaacaataagcacttactcagggatctggggcttggctgggattgggctcatccagactgggcttgactagccagctctgcttccggtgggaacagctggagaggatccgtctctccctgagagctccggagaccctctgctctggtgcctctcatccttctttgaccagtgggcttgctgggtcatattttcctcagggtaacagcagatttgtatgatcacatgctcagctgcgcagtcatattttagacccctacttgcttctgctaacattgcttctgctaacaccccattagccaaaataagcctaaagttaagagaggatattccacatttagagggaagaactgctagttacatggcaaagggcatagatgcaggaaactataaattggggtccaaagtttaatttacctttgggcaagtccttcaatctttcttctttttcaacatattagtttttggctattttctctctctctctctctytttttttttttttttttttttgggacagattctagctctgttgcccagcctggagtgcagtagtgctatctcrgcctcctgggctcaagcgattctcctgcctcagcctcccgagtagctaggattacaggcacacaccaccatgcctggcttatatttttatttttagtagagatggggtttcactgtattggccaggctggtctcaaacttctgacctcaagtgatccacctgcctcagcctcccaaagtgctgggattacaagcatgagccaccacgccctgcctggctgttttctttcacattgttttttccagataagcttttgaatgagcatgcaaagttccaaaacttctgagtagaagtttggttgggttcmcattggtcatatagactaatttgggtagaatttatatctttacattastgaatgttcacatccaattggaaacattttgtatgtgttcattttgtatttcagttttatatcttttgacaaagttaatttttcttataaatattttcagatraactcaaaagcagaaagagtagcacaatgaatatctacttatatgactctcagagttaatggttatcaagattttgccacatttgctttatctatcccttttttccttattttttgccttagcattttcaagtaaattctagtaatcatattattttacctgtacatattttagcgtgtagctttttaaaaatagacatatatrcagtatacatagatacatatgtacatatgtgtgtatgtatgtgtttawgtgtgtttgtgtataattattgcagctaatacaaatcaacaagagctccttggtattatctaatgaaccatctttaatctaattttcccaatgtcyaaaaattatctttttagttagtttatttggattaaggtctgtagattaaatttggttggtatgtcacttaaatcttttcctctagagtaatyctcttcatctgtttcttcatgccacaaacttatggctgaaactgagtcattttttatgtagaactttccatattctgaattttgctgattccatcccccggtgtcatgaaatatttttctctaaccactgtgggatttttttttaaccactgtggcattttctgttaagcagctggttagatctacagactctgtcagattcagctccaagtggcattttttttttggaggaaggggcaaaaatatttcataagtcacrccattgcttcctaggacattcatcctggcagaagatacatatatttaggtttgtcaatagyatctggttcacgttttatcagtctcatccacccgttacgaagttctcttcttaacgaattatttctgcctcaattcgttacttcattagggattgcaagatcgtgacattctaattctaccattccttttgcatttattataatcaattatttcgttaccttgaggtagaattcgtgtaaaaacgcttagatgcctgtcccaaacacacacattttcctgagtgcgatttacacttgtagggtcctgtctgtgttaaagatgctttgctgctctcccaccaggcctgggaataagtaccagactgatgatagacggggaggatgatcctcctgaaattctagccacagggaagaaaagtccttgcaatgaaagacactrgccagggaagctggttggacacacacacatacttgcacattcacaagtatctttcattaaaaggagatgacctactgsttccctcctgccagtgatgggccacaaaacagacatgacacgtgggccttctcacgtgtcccagatttgttttaaaartcattttcaattcatctagttttctrttaatgttaaaaggttggaaattatattttaattagtgttagagaygtacatcagcatcatagaattctgaaactactgatgcaacagaatcataaaatgtttaatgagacatatcaatttaattctgctgcttggaacttaaaragccagagttcgtcagcattttgctaacaaatgtcatcatttacagactgaatttggtgctgattatgttcaccattactaaaaatattgggaaatgagctatgcttggtgaaacaaagggcattttttwaaaatttggctgattaaatgtagtttagaaacaaaataaacttgcataaacttgcaagtgtttggaaacagtctggtttggtaatagtcactatgtttaaaccctgatgcagatgatgctgtgtatctggacaatgagaaagaaagagaagagtwtgtcctgaatgacatcggggtaattttttatggagaggtcaatgacatcaagaccagaagctggagctatggtcaggtgagccacttaaaatttgttattgtcaaggacatttttacttcatattttttgtcacatgtatccctrcaggatcycatatatcgatattagacaagcayaatttcctgctttttaggatctgagactccwaggcagwgagcataggagtagggactcataaagacaactgcgtaatttatcagctgaaaccacatatctctggktattacagtgttacagaaatgagagattccatgaataatgtggcattctattgagaaatgctttggccacttagaacagtgaaatctcattagttcaacctggcttataaagaaaggtattttcaaagtgatgcaaagaatactgcaaggggtgtgcccaattcaaagaaatagcttctttttktttttttttaagtgttagcstagggtactgctaattagaaaagagtgttatcatttcatcaaaggaagggccactgagcttttacatagraagattttatcagctgcaagttgattgtctagacacaaagtagcaaatggcatttctttaagrtgttcagtcattcaaactatttcagtttggtatctttaacaatggagcaaatgaatgatattttaccaattttccataaatgaatgcatgtcctgtgatttcaaaatgatttttaattagcgacacaagcgggggcgaatgtcatttctcaggagttttggctgggatggctggaactgtgcatcattgcgctgggcatccagcagggagttttcayrgaatctggtggtcacagggtactttcttggctccrgatgccttgctttgacttccatatgggatctccctgtgttcctyacccactgctccagtaccygtgttatcctgcctacctggctttgtgaacagcttccctgactccggagaattacatgcccagtgctcaggctycccygcctgcatttctaatgtcctgccaagctacaagctagttggcaccccctgttcttggattcctgcctgactccctggtttcaagccatcccctcctcagtgacatgcaacctttgactatactgcctactgcctgatgcccttgtcttgggtccccaatttctagcctttagcctggtgattctatttatggyccaaatatgacaatctatagatagctaamaaggggaaaagtcatcaaggtgggcagcaaggaggtctggaaaagtgtcccaagcccagtcaggkcactcttcgccagcttgcctttgggtaggcaccctggagcacagtcacttgattgtatcttctgccactcaaagaggctattggtgtgtatcctttggccagaataaccagccaagcrtgtttacagtgatgcagggaatcaatccgttctatgactatttccttaactctccarttagttgctatcctgcccagcaaayacagctgagagaagctgcttaataagaaccaaaatactgagctatttgcatacctgaagaactagtgcaattacccattactgcatccatcctgtcagtttgggatacacccagagtgggtattctaactggactgaataaagaattgtgtggtaattagccattatgattgtggtttctgtcacaagcacttgggtggatagcacacaaggtttctctattcaggaaaatctcttactacagtgaggtacagtataggtaaaatcttcctgtcttgctatttgatctttattcctttttaagaaaattctggtattgcytgtggctagcagttctttctaagragactgaactggtaccagactcctcccttgatagygtaatctactttctgcagccttctgccctctccttgatcctggggtccaccttgtctcagaagaggggaaaccttagagggacagtcactatatgaggtctcctactattttgggtgcaaactaagtagtgtgaagcaccttcctgtgatacacctgagagctctttattttckaaatgcacgaggattcacattactttcgaggtcctaagactctggcctgactttggtaaatgattcattccttcttcttgggtacaggagccaatatgttgaaaagaccttctaaattgaatcattttctgaagaacttcaagtcagcttatgatccctgagtatatcaactctctagtatttctgtttatgtttctggcttgcttttatattcttattcactttaatgaaaaacaaaagaagatgtctcattccttctactttaatatttcatactaaagattatgggagatcactatacaggaaacacacatttctaaacattaggttgtggtttcatgttatttttcatcagagaatattttgcttgcagagtgaacactagtttctctttgtttttctttctccaaatagtttgaagatggcatcctggacacttgcctgtatgtgatggacagagcacaaatggacctctctggaakagggaatcccatcaaagtcagccgtgtggggtctgcaatggtaagcagcaattactgatacctaaaatctgttacacctgtcatttgcctcagtatatatgccagttcattaagagctgctgaaatgatgacttacacttaataaactttcatttgtaagattctagcttctgacacccagttatagctcctggaattttctgagcttatcatgtgctataaaacaaaattatcgtctcaatactgtatgtttctttggctttagaaaacaatgatagatataatgatactgtagaccagttattcttaagaaccccttgcctagagactgaggagtgatcatgacaaaaatgtcaatgmctataatcaaacagttgatcaaccaaacatcaaggtgcacagaagatgtgcaaggcacagcttttctcaattttcacactgatagtaagagtgaagaaatgaatggctacatctcatcctaactcctgtcacaaggatgtgtcactgtagggctttctcacttacgaagtgggtattgattctttgcaggatcctgtgtggtaagtagggcagccattactcatgsacttttacaagttaggacacagggtaaggacagctttcagtgacaaagccacagctagaactccggtctgctgacttcaaatctagacattttctacttttcatgccgctctctgcaggatatcctaaaacaactttgagaatgcagagatcttgcagtggaacaactttctgagaaaggagatagaactcccatgagtgggaagggtgggccaggcataggacgtggattaaatgggatgtccaggacccatgcagtcctggattatatcaatgtacccaacatggagagccagatgttggtacagagaagtagacccartctggctgaagagtagattatttctgaagaaatgttaaactgggtggtatttcaaacaatcaaagactgaaaaaaagaaatacttatattaccaatttccctaagttttctaagaaatcctctttttgaaagaatgttatgtttgagtttggtttgtatattcttttgagctaaatgaaatcaatattgttaatataaaaatattagactgtgaatgatatgaaatataatttctggttagcttttaagaatggtggcttttattttattaataactaagctacatgtgaatttaagaaacagcagagcataaaaagtaaaaatagaaaccaacatgtaaaggcagttttgtttcctatgcatttacattccataatgggaagccaatgaattccaaagatttgggggaatgttgaatttgggaaatgtttaccaaagtgtcatgaccgtttataacaaatatattagacttgcatctgatcactatttttactgtttcgcccacaagatttctctttttcttctttgaagttaccataacaattttgcagtaagaaaggaagcaacagctagcagtggttaaatttaaattaattccttcttaagcattctaaaatggcacactcatcagcataagcttactcacacactgtgtgtacttttacgcacccagaagtcagaaatcactgcctarcagaagccagtgcaaaagagaagcagacaggaagcagttaacctaatgtgtctgtggtggcagctggctaagcggaagctgttaattattgaataagcacacatactcctaatgcaaattgccctgagattttattaatcatgtaaagcctatgaagttctaagtttgaaaatttatatcccaattaaaagatttaaaactagacagagaaaatccatttggaaaacggtttggttttatttttggagggggagaatttgggtgttaaggggtagaggtcctgacctgagacattttgagcaatatttccatttccgtcatacccttgtttatatacacaaaatrttcaatggttttcaaaaacactttcacctctattagctcctttaaaccttagaatacctctgtgaatctttccaaaatctgttccgttttaataattttaaaagctaaaatactgagcctccaaaaatcaatttaaaaaatgacacagaggaaagatcaagtgttctttggtcattcaggcagatactctcccgttcacaaatcctggaaatctatcatgaaatttctgaatgcagttaaacaaagaacaaagacaaaaaaaatctttaaatttctcaatgaatgatttgactttattagtatgaaaagatgtgcctagagagcccacaagaaaatgttctgaagttgtggactcttagccagaaccctgttgcaggkcgacagagctgtgtgtgttttctcaggggctgggcccaggcctcacaggtaaaacagaggctggtgcagagttgttctgaattcctctcaaacacctcccagcctggtcatagaggctagaaatcccattcgcaggttgcaaatgccagagcagcggtataggtggcatgtggactctccagaagaaatagcacatagatctcagttcatccccaggtgagagtgaaggaaggcagaactttcctgagggcacttgctgctgggaaacagtgaggatgagcagaccagtctttgctgggtatctggagagagtggagctgggtggggacaagatgcagagcacacgactggggccccaaagacaaatttgcttactgtggtccaggacaagtctagcactgaaggttggcaaggagttttcaggcaacaggtgggtgcatgttgaaaaaagcaccgataacccaaattgtgcaaactttcaatcataataagaatctgaatttgggccaggaacggtggctcacgcctgtaatcccagcactttgggaggccgaggcgggcagatcacctgaggtcaggagttcaagaccagcctgaccaacatggagaaaccctatctctactgaaaatacaaaaaattagccaggcatggtgatgcatgcctgtaattccagttactcaggaggctgaggcaggagaattgcttgaacccgggaggcagaggttgtggtgagctgtgatcacaccattgcactcaagagtaaaactccatctcaaaaggattttaagtgcacaatccccagataaaaatatttattgttcagtatatttatatttattgtatgtgaccttgggtaattgtttgttgtagaaggttgtcctgtgtagaatgtttaacgacatccctatcttctacctgggggatgcaagttgtcataactgttcccttaccagttgtgacaactcaaactgattccacatattaccaaatgtctactgggggtaaaaatcacccttagtgaggatgacagcactaaacccctctgtgactcagtttctccacctatggaatgtaagtaacactctcttctcacctgcatagcgaatctgtcttcctaactcactcaaaacctgctggttttcatccttgactgaaaagaaagtgaaggcagcatcatatgggaagcgactcagctcgtgtcgagggattggaccttgattctggttgtgctattaacttactatgtgacccagggtaaataactcacctctgctggcctcgcatctttgtctttaaagtgaaattttgtctctgtactcaaaccacattggcagcaagaatactcttttattcttcaaaatagtgctctcccttcttctattttttcctttatacattcagtaacttcccttgttcttatattgagttgctgttatttcactttgatgtaaaagtaggaaaagttatgacaatctggacagcctggggctattggagtttcccaggagaaagcaagtccaaaatcctgtattctcatcatctagagattaggcctgagatattataaccttacataagctaacttttgcttaggctcctttaaatactgagtggtgcattttaccaagctatactgcagattgatttaagagagaaaagaaaaaaaagagaagcaattagaaaaaatgaagaaacttgcccacagttatacttctccctttaaattgcattgcttgattgctgctttctttycaatgcatttctgatgtgacagttcccaccaggaaaattgccagagaaagctaaggagaatgcttaactttgtgccatccgaacacttacttccctcacatggcattaataaagcattctattgctagccccaagtttctgtgaataagccagacatggactctgagccctgagtcagactatcaaagaaggtgggccgtgacatattgtgacaagggcagcatggttctggggaaaagggaaggctgtgcaaccacctggcattactgcggcgtggttacctgtctatgcctgttcctgcctcccgactgataggatctggcagcaactatgggcagagaatttcccccaaggagatgcagctgcttctgcaaaggctgccgytactgcagataaaggctcgttattcactgtgacacacctacatgtaccacctccatccatatttgctccagtgggtcaaggcattaccagtggaggatctgtgtcgaaacacatgctgaaccagcgtgtgcaatggggaggactctccaagagtcttctgggtgaggaagcagaagcccttggaagtggtgtccctcactcaaagtcacacagcaaataagtggctgagctgaaaccagatatggtccttactctcagatcatattaccttagagggccactatcaacacgttattgccaataacacaataattatgtaagattgarttgccatttcctagaaaagaagagagccccaagggaatggagcccagatgaggcaaattattgaaaatggggaataagtgaagaaaggtatcaatcagaggattctaaatagccataggcactggggccctggagaatgagcttccaaagacgatcaggtaccaaatatgatatgataatggtggtggtgtttggtggtggtggtgatagagttagtgatgatggtggtggtgacggtggtggtgatagtgattgtgataataatggtggtgatggtagggtgattatggtggtgatagtgatgatgatggtgatggtggtggtggagatggtgacggtgatggtggtggtgatggtaggagtgatggtggtgggagtgatggtggtagtggtggtgatggcgtaatgtggtggtggtggtgatttatgatggtggtgatagtggtagtggtggtggtgatggtggtaaaacactcagtatttactcatttgtttgacaaatgtttatggcaatctaccagtctgaacactggagtacaattgtgaacaaaattaagtttctgccttcacaaagcttacagtctaacagagaacacagactagtaaatagaaaattttagctcagcatggcaaattctgtgatggaaataagcatagggttgtatgggaaagcaaatctctcaaatgtagctcaaaggtttcccaggactaaacattggatcaaaagatagaagaatgtctgaggtcccacagtaattaaccatgctattatttgaagaaaccctttctccatggtggaaattatatacaaacagctagtcaccaaaagcactgaagaaaaatgtagtagrgggttatttgctcttctgggggcttgtttgttttgcaattcagaaaactaaggttgacacaactgaagtttattccataggatctcaacatttacagttacttgatccatggtattctgattcagttgtagtaagaaaaaaggtaatattaatgagaaaattaggaaagtaggaggagagaaaaaaacgtcaatatagttacatatttttaaatttcagtgtttgtactgctgccatcctggactatccagcttcccttgagatgtatgcatttatttttaaccctggccttttgctaatatcgaaccacaatgccatcattaatccccattaatactttgctctgactatgmcttttgggaactaactcatgactaaacttttttaaccaatcgatgttcgatgtactctttagcattgtaaaaaaatcttgaacttcagctagtaaatcaaactgaccacaattcggagtaggtcctggatttttctaggacacagtacaagatgaatgactgtagacctttgagatgaaatggactttagtgcttctgatcctcatgcatctgtgatcctacagataaacagaaaataaagttattttccctttgtccatcttttcctccccctctttttgtcccagtatttagaaagatttttttctttccaygcatgaaaaagacagtaatgacataactacttttatatcttgccaagcagctcctcaaggggttaactataaaaccatgttttgttcattttctttcaattgtttacttggtcatcttataggaagcttcacgttgagcaaacctcttcatgcaacaaaccttaattataaatattcagattacatttaaaagttcactttgattagaaatttcacacctgagtcatcccaaatgaactgtaaagacagaaataaatatataaagtttgtatttatttctaaagtttattccttgatcatacagaccagtcacaaggtactttcgtaacagttttattaagaaaaattttaattacaaagcaatatctaacccatcctttggtttataaagcagcttaaacctctttttttggagtgaacggtcrtagatacatctgaggacccaggtgctcaatgggcattgtccttggcatttctaaatcaccaaggaactttttyrcatttacccatatggattttaatttttgaaaaagttcatctatcaaaacaaatcatgattatgtaataataccttgttaccccattcttgtgtcagatttatataactgccaatgggaacttctaatgatggtggcggtggtggtaatcatctctaccagataatgagtatgaccacactgaatatgattcggtgtcactttgtgggggtaaagatacaacttccatctggtcttttataaaagcgacaacagcctacctgcattactaacccacagatgcctagaggtcaaaattccccaggtggtgaccactgccagatgtaggttccatcatggacttgagtctccatccagagcttctgggtctccaaccctatcagcttttatttaaaagtgttattgtctctttctatgattcatatcaggaatgaaatttctcagtttggaacagcakaaaaaggcagaagcctccggtgttccttgcaacctttccaattrtaacgcatatcaattagtargagctctcggggtgacaactttgggagaatccactgatttatattaatgaagagtgttactgtagtccaacagagtaaagtactaaattaccaactctaaaaagattttttagaaaaccattaaagttaaagtcaaggtatttctaagaatgaaagtcatttctatgattctaaaatgacccagggaattcaatgatgaatgagaggtacagactcaaagcaattctctaatgtattcaaagtaaacaatacyataaggtcaccttattcaccagggattttcatttctgttcattgaagatttttwaaaaattgacagatatattggaagccagtgggaaaatagaatttatctaacagaaagtatcttcatagccacttttgagaaattgcataaatccattccataaataaccaaagtgcaggtggagagactgaggcatcaggaagttaagtaactttatccaaggttgctggtagcactgggggtgggtcatgagttgcctggccccactaattcacacacaatgttctatttcccctggatttgtcctctgtctgtcctctctccmggtcacatgagctccttggatacagatataatgccttttacatgtcctgtctgattcaatccttctctttcaggtgggggcagtggggggacgatgaactgctcagacattatcttttttctcttatggtaaaagccagcagtgtaatgaagtttccatttgtggtcaaacagcttggtttctcaattattaagcttacatttcttatgcctcttcaccccatatttttggagaaaaacagacatttattacaaggcatctctcgaatgtgataatcatgggcaatctaaatgtctgctttccctgaattgcttcctggaatgaggtttcaatgctgcagctattctgtaatcacacaggctatttctgaagcacagggatgctttacagcactccctccaagctgagcggttggtgctgctctggtctcctggggccagcatccccaggatagatggatagcaaaggagcaaagcaaagccagctcagccctttaggatatgcacagcttcatgcaccttgggttcccttcataccctctttctttcccctgtctcctcctgttacatccttccctttttcctcytcctgctctgcatttttccctctctcatacgtccattcctttaattcagatatttttgaggcctgttctataccagctctacaccatgcagcagtggtatggcaatgaaaacagcaggccacacttggagaccttgaaatctcagttttctctctcagtccacatttgcttatttctctcattattgtcaattagtaaaatatgttttggccaaatgagcatcctcagatactgagagagacaaggttaataatttcctgtggtcatagttatcatgaaaaatgagtctaattacccacccctatcagagcttgggtcatatatataccaaaggacattcatatatcggtagttatatgcttcatactattcattacagttagttacaggattttttttaattgaagtaaaatttacatacagtaaaaaatcatggatattaaatgcacaattcaatgacttttgattggggtaatcaccaccccaatcaaaatatagacatttccacaagctcagaagtttccctcgtgcttcttccggtcaatccccacctcattaggtagctactattctgatttcttgcaatgggttacatttgtctattcttcaactttacataaatggattcacacagtagaaatagggctggcttctcttactccatcaactgttacatgtgttttcaatgctttccttaccattactaagaagtattttattgcattgtatatcacaatttgtctatccattcacctattgatgcatgtttaagatgtttccaatgtgaagctattatgaatacagttactataaacattcttgtacaagtgtttttgtgtatgtgttttcatatatctggagtaaatagctaaagagagcatgcctagatcagaaagtatgtatatatttaactttataagaattggctagttttccaaagcagctctactgttttacattcctgccagcaacatatgagagttccagtttctccacagcttcacctattcttgatgtcttgaacctttttaattttaaccaatcaaatgggtatatagtggcatttcattgtagttttaattttcatttccctgatggctaatgattttgagcatcttttaatacatttattggctatatatatatatatatatgcagcatgttttcaagtctactgattttcttattcagtcatttgtacttttattattaagttatagttgctctgtgtatatacctctcatttgtcagatatgtatagaacatattttccccaaactatggcttgtagttatattttataaatggcatattttaagtaacaaaagtttttaaattttataaaatcaaattttttcattgttctttaatagtcatccccagtaaatgttctttccacatgaagactttcacatgaatcactatttgcccatgtttgccactatttctcctatgttttatttttgaagctttataatttgaacttttacattgtggtctatgatccrtcttgagttaccttttggtgttgtgtgaggtagggatcaaatcttattttttccaaatttatccatttgttccaccagcatttgttgaaaagactgttggaaaggctttcattcgttgcaaagagtttctttgttgaaaagactgtcattttcttcattgaattgctttggtgactttgtcagaaatcaaatgtctacatgagtatggatctatttctagactctcttttctgtttcattagtttatatgtatgtccttatgacaataccacactgccttttttactgctttcctctagtaaaccttcaaatcaggtagtcattcatttttgttcttctttttcaatattatgtttaattattctagatcctttgtattgctatgtaaattttggaaacaactttccagctttaatgaagtgcctattggcattctaactgtcccgttgtcttgatctattaaagaagtattaaaatgtagcctatagccatcttccagtgatagcacatccattcattcaacagaacttattgagttcccactctgtgctagccctgggaatataaagtcaaaacagcatagtgccttccttccttctgtgaacataaagtctgggaaaagaacaaggacagtctaaccaatgacacaatacaatgtgataaatggatagtactatgcaaagagtactatgtgatcaaagagtaaggacatccaaatcaaggtgataagtaaagattcccagggtgaaaccagctgagttttaaaggatcaatagggcaccaggtaaagaagaggtttgagtgtggatggacattccagggagcgagaataacatttccagcaacaacaaggcagaaaacagcttgttattaagcaaaccactatgaaaaaccaaagacatggtagatgattttcctttcctttcgaccaagtatgtgaccctggctgttgtaagtgccataaaagcccagaagaaaatcaaggatgaagagccaggcaagggaagaaatagaattgctgctaccctatttcttttttcttgtgcattttctgggatgcctgcccatggaataacctgagtacttgaccttcagctcatctcccttcctatccttacaacataacttggcaaatggcggagcaggcacaaaaacagatctctacattcccagaactgtgaccttttaaattttattttttagaacaattttttcaaacagcaattgaatccaaatacataaaagagaaaaagcagagcagctattattaaagaaaggtggtgactgcagccttgactatcaacattcaattctcacctgccccaccccacaacaccgtaactactgagtttcttttgcaaaaccctagcatgtcatgaagcacaatytgacatccaccacaccacttccacctgtgattaagtctggtcaccaccacactgtagctggggatttgtggttcacaaaacctggaaacgattttctacaggaaataattcttctccttgccaaacttaacgctaggcctttgatgttagttcgtgttacccaacatcaaaattcatttccaatggtctttgagaaaccattgtggacaaaattaggtataagactattttctaaaagagttatggaaatcctagcctttatgaggacataacttttaacaatgaaatttaacggaatatgataggtttataacagagaaaagtcatttcatcatagccatataaaatgcacacagaggagaaaagtacccttgcatatttttttaaaaagcagaaagaaatagtaactatacaaaatgtaaaggtctgcgctacaggaaattgaagaatcaagaaatgtcacatttctttatttttcagtatcaagttagaatctgctcatattccaatgaccaaaattaaacagaagtccagtacgggtcatgttttagggctatttctattctttgaattatacaggagaaataattttaaaatcatagataatattatactatagatgctggtttaatttaaaagtcttcattgattttcacagctttattgagatatagttgacaataaaatgtgcatacttaatgtacaattggataatgttgacatgtatatgtacccatgaaacgaacactaaaatcaaaataatgaatatatccattgcccccagaagtttccttattgtaatttcttccttaaaccactccctgctttgtgtaccatcccccatcactgctcagccttctgtcattatacattgatttgtgttttctagacttttacacaaatataatcatgcagtatgtactccttgtgaggcttcttttatgcttccttactgtattctgagcttcatccatgctgttttttgtttcagtagttcatwcctctttattgctgagtagtagtgtttcattgtatggatgaatcactatttgcccatgtatttacttgtggatggacatttaggccattttccgtttttgcctcttacaaataaagccagaaactttagcttggaagactttagtaaaagtctttgtatagacgtaagcttttatttctcttaggtaaatacctaggagtgaggtggctgggtcataagctaaacataggtttaatttttaagaaactaccaaactgtttcctaaattggatgggcattttacattcccaccagcagcatatgagagtctaaagtgttgcatatcctcccggacacttcatatgatcagtctttttaatcttagacttttaaatagatgtccaatgttaccttgctgtggttttgatttgcatttccttaatggctgatgatactgagcatcttttgttgtgattggccacccacgtattttctttgatggaatatctgttccaatatttttctcttgttttaaggttgtgtttgttttcttactattgagtttcaagggttctttacatattctggatacaagttttttctttttaatcagataaaggatttacaaatatcttcttccactctagttttattttttcattctcttcacagggcctttcaaagagcaaaggttcttaatttttatgaagtctgatttacaaatttttttatggatcatgcttttcatattttatctaaggaaactgcctaacctaagatcacacaattttctcctttgcttccttttagaagttttataaccctaggttttatatttaggtctaaggttcattttgagttcatttttacatatggtgcaaggtatgaatcaaagctcgtatttttgcatatgaatatccaattgatgccacctcattttttgaaatgattatcctttatccataaaatttcctttgcaactttatcacaaattagttaactgtatttgtgtgagtctatttctgtgttctctattgtgtcacattgatctgtttgtatttataccaaatggtgtcatgctacttaatttgaaagtattacatgtaattgtacccaaattctatttaattttaagttttattgaattttactttaataggaaagaaattaaattgcaacagaagaaattattaaacttcaaataaatatttcttcactacaagagatatcatttcttaacaggttttcctaaggttattaaaaattataaaaaccattaaaagaataaagtaattatgtacttttaaattatactttaatgttagatggtatcaattaactgagagacccacacactaaaacattaccattttcactgttcctctcctctttctcctatcttttttcttaggatgattattgtttttatattatcaagtcttaaaattcatctgtaactgtaaatcccaaagatgcttaacttatatagagttttctcacccctgaatctgttatcacagagtctctgttcctgggttctttgtttgactyagcccctaattattttgatatcactttcaagtattaatagtttggttatgataggtaccatattccctgaagtacttcatgttcgacaatgtgtgtaaaagggggctgaatgcttgatttgatgctccacttggtcactgttgatgtagagaagagctaatgatttgtgtacattaatcttgtatccagaaactttgctgaattcttttatcagtcctaggagctttctggaggagtccttggggttttcaaggtaaacaatcatatcrtcagcaaacagtgacagtttgacttcctctttacctatttggatgtcctttatttctttctcttawcttattgctctggctaggacttccagtactatgttgaagaggagtggtgacagtgggactccttgtcttattccagttctcagaggaaatggctttcaacatttcctcattcagtattatgttggctgtgggtttgtcatagatggcttttattacattaaggtatgtcccttgtatgctgattttgctgagagttttaatgataaagcaatgttggattttgttgaatgctttttctgaatctattgagatgatcatgtgatttttgtttttaattctgtttatatggtgcatcacatttattgacttgtgtatgttaaaccatgtccacattcctgttatgaaacccacttgatcatggcggattatctttttgatatgttgttggattcagttagctagtattttgtgaaagattttagcatctgtgttcatcaaggatattggtctgtagtttccttttttggttatatcctttcctggtttttgtattagggtgatgctggcttcatagaatgaatttgggagggttccttctttctctatcttgtggaatagtgtcaaaaggattggtagcaattcttccttgaatgtctggtagaattctcctgtgaatccgtctgttcctggacatttttttgttgataagtttttaattaccatttcaatctcactgcttgttattggtctgttcaggatatctaattcttcctgacttaagctaggagggttgtatttttccaggaatttatctgtcttttctagattttatagtttatgtgcattaaggtgttcatagtagccttgaatgatcttttgtatttcagtggtgtcagttgtaatatctcctgtttcatttcttagtgaggttatttggattttctctctttttggttaattttgctaatgatctatcaattttatttatctttttaaataaccagctttttgtttcatttatcttttrtatttttgtttgtttcaattttgtttagttctgctctgatcttggttatttcttttctcctgctgggttagggttttgtttgttcttgtttctccagttccttgaggtgtaaccttagaatgtcagtttgcgctcctttggtcttttttctgtaggcctttaggtctatgaactttcctcctagcactgcctttgctgtatcccagaggctttgataagttgtgtcattattgtcattcagttcaaagaattttttaattttcatcttgattttgtttttgacccaatgctcattcaggagcaggttacttaatttccatgtatttgcatggttttgaaggtttcttttagagttgctttccagttttatttctgtgtggtctgagagatggcttgatataattccaattttcttacatttattgaagcacattttatggcttatcatatggtctatcttggagaaagttttatgcactgttgattagaatgtgtgttctgtggttgttggataaaatgttctgtatatatctgttaagtccatttgttccaaggtatagtttaaatctattgtttctttgttgactttctgtcttgatgacctgtctagtgctgtcagtggagtactgaagtcctccactactattgtcttactgtctatctcatttcttaggtctatttgttattgttttataaatttgggaacttgagtgttcagtgcacatttgtttaggattgtgatattttcctgttggacaaggccttttaccattatataatgtccctctttgtctcttttaactgctgttgctttaaagtttgttttgtctgatataagaatagctacccctgctcgcttttggtgtccatttgcatgaaatacctttttccacacctttactttaagtttatgtgagtccttatgtgttaggtgagtttcctgaaggcagcagacagttggttggtgagttcttatccattcttcagttctgtatcttttaaatatagcatttaggccatttacattcaatgttagtgttgaaatgtgaggtaccattacattcatcatgctctttgttgccygtgtactttggtttttttgttttttgtttttgctttttaacttgtatttttgttycataggtcctgtgtgatttatgctttaaagaagttctgttttgatgtgtttccaggatttgcttcaagatttagagctccttttagcagttcttgtagtggtggcttggtaatggtgaattatctcagcatttgtttgtctgaaaaaggctgtatctttctttcatatatgatgcttagtttygctggatacaaaattcttggcygataattgttttgtttgaagaggctgaagatagggttccaatcccttctagattgtagggtttctgctgagaaatttgctgttcatctgataggttttcttttataggttacctgatscttctgtctcacagctcttaagattcttttctttgtcttaactttggataacctaatgacaatgtgcctaggcaaagatctttctgcaatgaatttcctgggtgttgtttgtgcttcttgtatttggatgtctaggtctctagcaaggccggggaagtattcctcaattattaccccaaatacattttccaagctttcagaattctcttcttcctcaggaacaccgattattcttagctttggtcatttaacataatcccagacttcttggtggctttgttcatattttcttattccttttcctttgtctttttggactgggttaattcaaagaacttgtctttgagctctgaatttttttcttctacatgttcaattctattgctgagactttccagagcatttcgcattcgtaaaagtgtgtgcaaagtttcctgaatttttgcttgttttttctttaagctatctatttccttgaatatttctcccttcacttcttgtattattctttggatttccttgcattgggcttcacttttctctggtccctccctgtttggcttaataactaacctccttaattctttttcaggtaaatcagggatttcttctttgtttggatccattgctggtgaactagtgtgatttttggggggtgttgaagagccttgttttgtcatattacagttccttctcatctgggtaggctctgtcagagggaaggtctagggctgaaggctgttgttcagattattttgtcccatgggatgttcccttgatgtagtactctcccccttttcctatggatgtggcttcctgtgagccaaattgcagtgattgtctctcttctgggtctacccacccagcaagtctacccagctctggagtgacactgggcattgtctgcacagaatcctgtgatgtgagccatctctgggtccctctcagccaccggaayagcgcctattcyggtggaggtggcagggggtacaatggacactgttagggttcttagctttggtgtttaatgctctatttttgtgctggttggctccctgccaggaggtggtgctttccagagagcagtagctgtggtagtatggggaggaaccagtggtgggcagggccccagaactcccaagattatatgccctttgtcttccactagcagggtaggtaggaaaggaccatcaactgggggctgggctaggcgtgtctgaggtcagactctccttgggcaggtcttgctgcagctgctgtgggggatgggggtgagatttctaggtcactggagctgtgtacctaagaggattatggctgcctctgctgagtcatgcaggttgtcagggaagtkgggggaagctggcagtcacaggagtcacccagctgccatgcaaaccaaagggccagtctcactcccaccgtgcccccctcaacagccctaagtccatttccaggcagagggcaagatggccttgaaaacctgacccggtctacccacctcccagctgcaaaagaaaagggtttggttcttccacacctgtggagtctgcacaccggatttgcaccctcccccaagttttggccaggaggcttctcaccccattcaaattgctacaaagttsagctagagatttccttctccatgtggagttttatcctctgctcctctgtccacctttctgatggatctctgtggtgccaggcagggatggcctgctaggggacctagcaagctcccagggcctttctgctgcttcctctacccctgtatttccctcagctctccaagttgacccagcaccaggtgaagtcggaaacttctcccacaaacagaccttcagcttctccagtggaggtttgtgttcgggagaggagggtctccctttcccacttgcatagttgggacactcacagtatttgggggggtctctcgggtcctgcagaagcagtctgcttccttcagagagtctgtggtcctctcaggattgctggtttgttcttgcagtcgacctggatctaaaatttacagcacgagcctccacatgctgctctgtccagagctgcaatccagtcctgcctcccatccaccatgatgatccaaatccttgggttctctattttaaggacactaatcatccttatgttgtatcatctttgttttccataactatggtactattagaatctctctaaataattcatcactttggttttttattagtattttctttgatatctcaagttttcttctatgtcattaatttttatttttaataatatgtattctgtttcttgcagtttataatttattattagctctgtaatggtatgatttggtcctcaatttgttgccttggtctgtgatctcctaaaaggttgtgagaaaaatgacttatgctccttaatttcgttttcttctatgtatattttttcatgatctctccctctctctctttctgtctcttcctctgcatgcagtttcttttccctatatttatgctcaaacttgcatcattcttgtctctagacgttctatttgctgtaataaatgaaattcttctcmatctaaggttagtttgatctcacttctgaactacaatttgaggccaatgtaccacattctatctactcttcagtactctgcaagagattggagtgaggactacagtattagaagatgaacaatctttggtakcatgcttagggtctgctctttcccttaagattctcctacatctgtcactccagaacccacccccacaactggaggcatatctcagttccattgggggatacgctcagcttgtattatttcccaattgtgttccagaatctctacctcttttaaggtgcagatactttttcactcgtttctccacagcaggtgtttccaccattctgttcagaacaataaaaagakcagcttttttttttttttttttttttgagacaggatctcactctgttgcccaggctggagtgcagtggtacaatcagctcactgcaacctctgcctccccggttcaagcgattctcctgcctcagcctccagagtagcggggactacaggcatgtgccactatgcccagctagtttttgtatttttagtagagatggggtttcaccatgttggccaggctggtcttgaattcctgacctcaagcaatcyatctgcctcatcctctcaaagggctgggattacatgcctggccaaaaagatcagcattttgattatatttattactttctagawtttaaaatataaattagaaatctcaggtttttgttgactagctggtaagatggttaaggttaggagctgakccatgttgcctctctgctttactccatagtcctcatgttttgttgggaccatgttttgaagtttattgcattatgctgataatgacttttaggggtttttgaaatttttttctaattttgtaggtattatgggagggcaatttagtgtagccttaatgaagttgaataatgcctcctgtaygtagtcctggacttgtattgtctacttgaccaccagtgactcaagaccaagacactttattctgccactggtcaaaccctgagatcatgagagggtgttaaaacagccaactgtggcatgaaaaatgacaaacatgtcctccaaacatatcttgttgcttatgaggggagatattattttaaccctttacatctgtcactaaaaacttacctctttcatggcctgagctccctagaaatcaatgttctaattagaaaacagtagctaatctgcccaaatgctaataaatgagggttgtgatttatctagcaacaggggaacagctcagcattaacaattaaaaggtctgtagaggacagagctttttttccttactcttcyccttagctgattgagttcagccctatgctataaatagcccttgtaattaatggctatctgtttgaaaatcagttatcaggaccacagtttaggagcctttacctctgaaattcatagagcctattttatgtctcagtgataagggaatgataatgtgagttcaaagctaaacctacctacccacaaagaccaaaccacatcatagcctaccaaggcattcttcaatcttcacgataatggatacagatttttaaataatcaatccaactgcaaggagaagtactgatctttaatatagccataatgtttggctaaagcctgctgcactccagtcatttcatgactctataagctaaagtcaaaatttatatcaaaggcatgagtttgcaattagctgagcaaggtcttttagagacccccaaagagttcattttttcctacattgaacaaattaactgtgtggttcataaagttcttcttcactttaacctgactggacacagagttaaagggggaagatagcatgtctaaaccaaattgaatagtgatcttctagacaacactccccagaagggaccctccttgggaaataccactcagtgctagagtaaatctcaaatttcagtgaaggctttgtcattcacagtaaaagatgcttgcacatcttgcatgttttcttctagtattttttttatttcgttcggtattgcctacttacataatacccatgcagagctcctagaaggtcccagagcctgccatattgtttcatgacactacacatttattaaaactgtttccactatgtagatggccttttctggccagtttgcctgtcatctccctctattaggccccccagcatcaccaccaccaccctccaatctaactgataactcccttcctcaggttcccactctacctctacatttttctgtcttaataccagtaatctttacatccacttgattggtttcttgaccatctctctccaggcataaggtcttattcttactcaaatatacatttcctatatgtttgttgactatataagtgattattgaacaactacakagcatccagtctttgctaacacttggtaraactcagaaagacggagattttttttctttgttcccaatgaattgataaaccagcggggaagacagacttctctacaactagacacagcaagtcaaaaagaggggtctaggcaggtgatgaggctgagttgttagttggtgaggcagcaaacacataaaagctcaccatgttttaatgtctcttctgtgattttcataatcaaaacacacatgcttcaatcatatgtttcacattgcttactaatgtctttgcattataactcagacctgtgcttctaaacgaatgtgcacacaaatcacccagtgatcttgttaaaatgcaaattcttattcaagagttctgggaggggcctsagattctgaattcctamcaagctcccagggaatgccaatattgctgatccatgaatgcctcaagtagcaaggctccacaccattgtaatgtcaatgtaaacattgttgaaatggcaccagtttttggaaaagctcctggactccccacctaaactcttctgactgtaattaaacatgatcaacrttacaccaagagaggtagattcagcagtgcccagaaaaaaactggcaagatgccttgaaactgttacctcttggcctttgttttactatgtaaacacaaaaggtctttgctcctgcactttaggtctgctgctacaagatgaatgtagtctgaaggtgtggcaagttttatccagatattcaagattgcctttctctgctaaagtctcttccatatttaaaccataacatcccaggttctttatggaaacagaaataccttctaagaaaactctaaaactttaatctgtttaaacaatcataagaaagaatacttaagtgaattttacaaagggaaaaagaagctctgggccaggcatggtgacttatgcctgtaattccaactctttggaaggctgaggcaggagaatcacttgagcccaggagktcaagactagcctgggcaacatagggagaccctggctctacaaaaaaaataaatttaattagccgagcatacacctgtagtcctagctactcgggagcctgaagtgggaggatcacttgagcctaagagttcgaggctacagtgaaccatgatcgtgccactgcattccagcctgtgtgacagatcgagaccttatcttagaaagaaagagagagagagagagaaaagaaaagaaaaaagaaacaaaaacaaaaaacctctgtaagcatcccatgggaatctattttcttaactcttaatgattccaagacaacatctgttaactttttcaattcattagagtctaccactcaaaatgacaacatctgttaactttttcaagtcggtagagtctaccactcaaaatgaaagtcaaaatccattagaccactaatttctcatttgtgagttttgagttatctttccaccaagacaagttccctacttgagattttatcttttgtaggtcttcttcctctcttccccacatcattcttgagcactaacctagcccaaaccaagtgtcctatgtatgtcttcttccaatccggtaggtgtcacactcctcctatctgccgttcaactttgccttgctataatatgcgatttaacaggcaatcttggttacttggtctcctcttgcgtatttagtttttgcatcttttttttctaacaatgtaatggtaaaccgaacagaagtggaactcttttcactgggcacaacatatagaaggcaatggcagccatagcttgcgccatgcatagcctggagtagacaaacctaaatgaactttcttccttctcacttctcayggactcatttaggtgaatgccaaagatgacgaaggtgtcctcgttggatcctgggacaatatctrtgcctatggcgtccccccatcggcctggactggaagsgttgacattctattggaataccggagctctgagaatccagtccggtatggccaatgctgggtttttgctggtgtctttaacacatgtaagtatccaactgagtaatttctttttaatataaaggaaacttcactctaagacattttttctataacctaacaaagagacatagcagcccctgttgacactatagaatttatgggtgagccattctgggatgtagtcaatgcataattaaattgtagtgggccaaatatgctcatagtttctctttgactgcagaatctttatagaaagaatgatagactatatcctgtgtaatccatcacttaacacccraagaaatagagggttacagtaaaaatayagagaaaaaagccattttctttycagccaccacattttaaaaaaackaaaacagttaaaactaaaataataaataacaaaagatatatattgcttatttatcattgagaagttgtataaatatgcrtatttatttattattgagaattttataaatatatmcacttaatttttatcccagttatggaaggtattatagcaggtggtctcatattcrtttttccacatttctcaatgcccctgagcaattagagatcagaacataatgaacaatctttccctctccagtttcccctctggtttttaatccacccaacatccaatctgtagaggaaagcatatgagaacagaattattctcttcagtgtcaygcatcatttttcagaggcatttgcctctctagacccagacgatattacaattaattcagtgaatatttttaaaaatacatttatttcagtatgtcttcatcactggtaatgattttcattcacaagtcatttctacagccttggagaaacattaagctcaagttggggtgtcctttctgcctgctcattaataaagaatttttacctagctaacattttttaaatcaaaaacaaagggaggggttggaggctggagggaggtcatttaaaaaaatgattacaaawcctatttgttttagctcaaagtctcaacagtctaagacttggtgatctaaatttaaaamaaaaaagtcatgagttttgttttgttttattttcccatagtatcaaacaggataagattattttyttagccatttaaatataacccagggaagaaggaatacatatttcttgggagcaatgaaaatcaaaagtatagtcccctagaagcactggtctctgaagttccagatagaagccggaacttcatggtaggttaaaggttggaggtcatcccatccctcgaggctcccaaaccaagacaaggtaaaagatgcccaacagaggcaaccactcttgtgaaatgattttagaagacagaaaggacccaagttctccccatgcctacaatttcactatcccagtgtaattccttccggctcacaacaagataaaatagtgaacaccttacatcygttcgtgtctttggcataaaaaggttatccaatctatgcctgaaaacaggctttggcggtaaatcaagaaaaggcagaaacacacagtggggaagtcacaacgagagtaaacctgaagatggaaattgggggaaggaggaacaggtgccctaaagtcaagcctcactttcttgaaattatgagtaaggcagagtcttgaccaagtcgtgtctgggataatgtgaattagtgttcakccagaaacagaatgagagtggcaatcgttttattgataagaccctgggtgaacagggctgaaaatcaagaaaggaaratgggaacgggaggcccgtgrcagctgccactgttgtttggggcattaagatcargtcctttaaggaggrggacccttgaatctctaccagactccagtttggacttccaaggttgttctgttgaaggaggtgggtagtctttggttaaaaatgctaaactattctgaaggagaaaataaaaaggcaagccaagtcattaatcttaaaattgtcagctgaattattttcaatgagccctgatgtctggtgtcctgggaggcakggagggcatttggattaagtttaatcagtaggtacatatggcaagaaaggtattcagataatttgttatctattaaaaygaactaaaatgaatctgtggtgtcacccaccaatgcatgtcacaggagcaaattctggccaagacagcaaattccaccaaggacctactctgtaaattcctaacttcctattagtgggtttttaaaattgtattttcrggaacatagtcccattcatgggactaaaataatactacgttgatgatcaaacgcttagaaacgaaacaattagaaccctgttgggattctactctagttggcttcacctgacaccagctgcaattctgaaggatcacacagcaagatttctctctaccgcccccatggggttgaatgaccacccttttccagcatggaacatttgagaataacatgtccaaagggcttttcatgttgggtcaggaagaaagtcccctacaagaagggttttttcactctgtgtttattaaatgctggtgatgtgtttagctgtggtctgtcctttcctgtagttttacratgccttggaataccmgcaagaattgttaccaattatttctctgcccatgataatgatgccaatttgcaaatggacatcttccyggaagaagatgggaacgtgaattccaaactcaccaaggattcagtgtggtgagtttgattgacartggcattggctgatgtcacattatagtaatgttacacatttaccacaagatagactcaatctgatgtttctgttctattttgaggaccattcaacagcacaggcagaaaactctgattgtcaaagaatgttctagcaaatgattagwaatgttactgaagagacagtttgggttcctagtgataaaaatcaatcattccttataatagcaaccaccaaaaaaaggtcatagttttagctgctgcatatgcctatactagttcctctctacyttgatatattaatattacagttaatagcagaagtattggagccaagcrttctctgggtcagtgccctgggactaatagagctaacatttatttagtatttactatgcatcggtcttggtgtatgcatgatcttatccagttctttttagttgtatcaggtggatgttattaatatcgccatttacaaatgaggaaactgaggcccaaaaaggcttgctcacggtcatacatctgttgagctgggaataaacccaaatgcttctgaccattaaccacaaccttttaaatgacttcagcagtataggttttcttttcgaatgtaaagatgagattctccttgattatattgtcacctttcattgagatatagaaatgggagtaaagctgaaattgttccccaaaaccagctgtggggttctctcactgccctgaacagctttgttacaagctggctagagggaacttaagatcccagggaaattccatttttccttgagaccccctaagtccaaatcaatacactaagaagaaacgraaaaaatcctaagagtttaagtaggaagaatttttatcaaggtctgtgtgggaggaaattggggcataagttcctctgtggtcaggcattgagctaggtagaacttctaagccaaaaatgagtctcatgcacaaataataaagctaaaacactttctgttatacaagcatccaaatggggatggtaggaagttacaagttcattttaagcaaaactaaaagttagaagtgcctgaacttcatgttacaggaatggatcacagttgtagcagcagtattaactcaccagtaggggcacacattcattggagaatgttgaaatgaaattgctgaatgagtagcaaagtgctaccatgaattaaaaatagttcggttcattggaagggaatgagctgagccatagtaagctggagggcacgtgtaagacaaaaccttgtctctgtaaattgaacagaaatttaaagaacactttaagcctgcagaattataatatagcagccctgcatgtatatgggatgacaaaacagaccaaaatagtcaccccaaaaactcattgcaattgttaaaaatgacaaaaagatagttatttggcattctccatatctcttccttaaaaacacacagacacacacacacacacacmgacagacacacagacacacacacacagcctttgtagctaagtgcagttcaaagttatctttcccagctccttgattcaggtacctcccatcatcaaataagtccctatgaggcactcctacaaataaccccacaggccctaaacagagttaatacaaaatagcgaaggtagatcttgcccttggtaaccctgtcctcwttcaggtccctgctccaaattacttccccttttcctgacaccatttgttcctttggtgccttactcaaatatcccatcaccctgagactgttcttcctggcctgggaccctcacccaccctccactgcagaccactgcccgagactcctcttcccttcctttgcctggcttgtagtaggttttcaacgcatgatgcctgatcagatgctctgactgactgcggggctgagaccagcacaactcaggacgtgcccagaccatgaagcacagggattaaagggctcagtgggatctgaggccaagacttggctctgctactgcccaagctgtgtgactttgggcaaggcacaacctctctgtgcctcttttctcctctaaagtggagagaacaatattccctgcttcactcatcacagagccgagcataacaggtgcctaatgaacgttagctgctattattgccttcattattagtcacacagctggaatttcttagaggcaatatgtttccatcaacccaagtacatcaaagcggtcagaaaaagagggatgcccagtgtcctaagatgactgygctatttctgttactttggggtatttttaaagaaaaagcagacacttggcctcaccagtgcaaacacccatgcaccttagaagttataggtggtccaggaaaacaagagtatggctaagactctcctggattgaggaggttagtgcgggctgtccccagacagatcagccagtgcatgatcaccacagccacactcctatgtcaagctctggcttgggcagctacttgctgtgtggctttgagaaaatgacttcacctctctgagcttcattttcttcatcagtagaatgaaagtaatcttagtagttaccatttcccgatggagtgrctataatgattaaatcaggtcatccaggtagagtgcttaccatagaggtaggcctgatgctgatttaattattattggtcactggtaagaagcaggggctgcctgagcatagggctggtgaggaagggtgagggtgagggtgarggtggaggctaaacaggggctgaggtgggggtgggaatgatttgctgggcatcagctgacctctgtgaggtcagtgcggtgtagactggcgacacatggcctgatggatttcctagcaaggatctcaggagctattggcctcatacttacctccctccacaggctctggtcaaacacacccacctcaacctgtcttccccgctcctggttggtttgtggctggggcccctctcctctccaagtaaaggagacctgagaacaatctctcatcctccaccatctatttcttcttcaacactcaggtcccaatggtccacagtttgtgatgaatcagtttgtccagttaggtctcagtgactcagggtgtcctcttctccatgactcagccaaatcccagcctgccgaaaccagaaatcagccagcagggaggctcagaggaaaagtacaagagggtgtgagaggtgtattctgctcgccacactccagagccaggagtgacaagtttggctctgtctcttgctgtgacccttctcgccttactactgcagaccatcaaggacagactgcttcctggtttgccaccgtaggtcccctgcatgaaggatgtttccttccaagagggagcctcacctcaggggggctacagttttgcacagagcggccccactgttgacgccaacagaggccatggtctgagctccttagctgttcaggagagggmtggggactcaggaacctcagaagggcagagcagggcagagtaattagatcccagggtagcaaatgaaaccccaagtgggcaaatgcaaagtagcagatcccagaaggagcaatttcggccgcctgtccccagygtgctgatgagttctgaattatgtgtaacctctggggggaaggcagctatgaatcactggacagtttaatgaagacgcttgctcaatgtttagctgcagtccaaacagcaaatagaatacgagggctcagtgaggagggagtsagggctactcagaggggcagggggacagcaatggtttggcctcaccttggaagagctcagcttgatcacctcattatacaaaggtcacagtcaaaatggaaacaattttaaaagacagagacgttggcacttactaggatcaagaaagatttttcaatgaaaggcttcgctccttctaaatgaagaagcctccctgtgttcttttgctggagagagtgtggtctgataggatgattctgggtgagggttggtgtcctcctctcagcttttccccaccggaatgcacccacccacagggggagcagtgtctgatctattttatttttgttgttttgtcagcatgtaacagtrtgcagggcatagagcaagcactgaataaacagaattgcttggaaaaaatttttaatgcataaaaactccatgctgcaatgggtggtcttaatctataaacaaasctttttcaaagcacattttagagcagaaattaaccagctttcacacctgggacactgccctaatcagtgtataatcctaattctcattatgtcctcagtactcatatggtgtttyacacattgtaggtgcatttttgaaattgagattgttcttctatacattattttatttttatttttatttatttttattattatactttaagttttagggtacatgtgcacaacgtgcaggttagtaacatatgtatacatgtgccatgctggtgcgctgcacccactaactcgtcatccagcattaggtatatctcccagtgctatccctcccccctccccccaccccacaacaggccgcagagtgttatgttccccttcctgtgtccatatgttctcattgttcaattcccacctatgagtgagaatatgcggtgtttggttttttgttcttgtgatagtwtactgagaatgatgatttccaatttcatccatgtccctacaaaggacatgaactcatcattttttatggctgcatagtattccatggtgtatatgtgccacatattcttaatccagtctatcatttgtggacatttgggttggttccaagtctttgctattgtgaatagtgccgcaataaacatatgtgtgcatgtgtctttatagcagcatgatttatagtcctttgggtatataccaagtaatgggatggctgggtcaaatggtatttctggttctagatccctgaggaatcgccacactgacttccacaatggttgaactagtttacagtgccaccaatagtgtaaaagtgttcctatttctccacatcctctccagcacctgttgtttcctgactttttaatgattgccattctaactggtgtgagatggtatctcattgtggttttgttttgcatttctctgatggccagtgatggtgagcattttttcatgtgttttttggctgcataaatgtcttcttttgagaagtgcctgttcatgtcctttgcccacttttcgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctcttgagtttcattagatcccatttgtcaattttggcttttgttgccattgcttttggtgttttagacatgaagtccttccccatgcctatgtcctgaatggtattgcctaggttttcttctagggtttttatggttttaggtctaatgtttaagtctttaatccatcttgaattgatttttgtataagctgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagagctctgttttgttccattgatctatatctctgttttggtaccagtaccatgctgttttggttactgtagccttgtagtatagtttgaagtcaggtagtgtgatgcctccagctttgttcttttggcttaggattgacttggcgatgcaggctctcttttggttccatatgaactttaaagtagttttttccaattctgtgaagaaagtcactggtagcttgatggggatggcattgaatctgtaaattaccttgggcagtatggccattttcacgatattgattcttgctacccatgcgcatggaatgttcttccatttgtttgtatcctcttttatttccttgagcagtggtttgtagttctccctgaagaggtccttcacatcccttgtaagttggattcctaggtattttattctctttttagcaattgtgaataggagttcactcatgatttggctctctgtctgttgttggtgtataagaatgtttgtgatttttgtacattgattttgtatcctgagactttgctgaagttgcttatcagcttaaggagcttttgggctgagacagtggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtctgtgccagttttcaaagggaatgcttccagttttggcccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgtggtttttgtctttggctctgtttatatgctggattacatttattgatttccgtatattgaaccagccttgcatcccagggatgaagcccacttgatcatggtggataagctttttgatgtgctgctggatttggtttgccagtattttattgaggatttttgcatcaatgttcatcaaggatattggtctaaaattctctttttttgttgtgtctctacccggctttggtatcaggatgatgctggcctcataaaatgagttagggaggattccctctttttctattgattggaatagtttcagaaagaatggtaccagttcctccttgtacctctggtagaattcggctgtgaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcatagaggtgtttgtagtattctctgatggtagtttgtatttctgtgggatcggtggtgatatcccctttatcattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttattgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtccctgagattctggtatgttgtgtctttgttcttgttggtttcaaagaacatctttatttctgccttcatttcgttatgtacccagtagtcattcaggagcaggttgttcagtttccacgtagttgagcggttttgagtgagattcttaatcctgagttctagtttgattgcactgtggtctgagacatagtttgttataatttctgttcttttacatttgctgaggagggcttttcttccaagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttrttttgagcctatgtgtgtctctgcacgtgagatgggtttcctgaatacagcacactgaagggtcttgactctttatccaatttgccagtctgtgtcttttaattggagcatttagtccatttacctttaaagttaatattgtcatgtgtgaatttgatcctgtcattatgatgttagctggttattttgctcgttagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattcggggttgaaaattctttctttaagaatgttgaatattggcccccactctcttctggcttgtagagtttctgccgagagatccgctgttagtctgatgggcttccctttgagggtaacccgacctttctctctggctgcccttaacattttttccttcatttcaactttggtgaatctgacaattatgtgtcttggagttgctcgtctcgaggagtatctttgtggtgttctctgtatttcctgaatctgaacgttggcctgccttgctagattggggaaattctcctggatagtatcctgcagagtgttttccaacttggttccattctccccgtcactttcaggtacaccaatcagacgtagatttggtcttttcacatagtcccatatttcttggaggcttttctggtttctttttattcttttttctctaaacttcccttctcacttcatttcattcatttcatcttccatcgctgataccctttcttccagttgatcgcatcggctcctgaggcttctgcattcttcacttagttctcgagccttgcttttcagctccatcagctcctttaagcacttctctgtattggttattctagttatacattcttctaaatttttttcaaagttttcaacttctttgcctttggtttgaatgtcctcccgtagctcggagcaatttgattgtctgaagccttcttctctcagctcgtcaaagttattctccatccagctttgttcctttgctggtgaggaactgcattcctttggaggaggagaggcgctctgctttttagagtttccagtttttctgctctgttttttccccatctttgtggttttatctacttttggtctttgatgatggtgatgtacagatgggtttttggtgtggatgtcctttctgtttgtcagttttccttctaacagacaggaccctcagctgcagatctgttggagtacccggccgtgtgaggtgtcagtgtgcccctgctggggggtgcctcccagttaggctgcttgggggtcaggggtcagggacccacttgaggaggcagtctgccccttctcagatctccagctgtgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggccgctttgtttacctaagcaaacctgggcaatggcgggcgcccctccgccagccttgctgctgctttgctgtttgatctcagactgctgtgctagcaatcagcgagactccgtgggcataggaccctccgagccaggtgcgggatataatctcctggtgtgccgttttttaagcccgtcagaaaagcgcagtatttgggtgggagtgacccgattttccaggtgctgtctgtcacccctttctttgactcgggaagggaactccctgaccccttgcgcttcccgagtgaggcaatgcctcaccctgctttggctcgcgcatggtgcgcgcacccactaacctgcgcccactgtctggcactccctagtgagatgaacccggtacctcagatggaaatgcagaaatcacccgtcttctgtgtcactcacgctgggagctgtagactggagctgttcctattcggccatcttggctcctccccctaattattgtcacttctatacattattttagatgctgtgtatgactcatctagttggacttttatattgtaaaattatcttcaattttaatcactgtctgcaaagcagaatgatctaaaaacgaattccaagtaaaatagtagagaagaaaaattcagaatgtagaccaaattgcttaaagatgcttaagggtttgtaaaaatatcccatgatgcattgcagttgccaattctggacagttatcagagatkcttattttcaaacattttcttgttaaccatatttctggccaagttggttttaggaaaatcacctggagttagaccatgagccttagcattagaggactgagaatatacactgaaggyacacaatagtgttggaaaaaacattatttgccaccttcaaagaataagagtagctcatgttcacaaaaatacttttttttgcaatgccctgatttaagtgctgacatgtaytaatttacttctacctcttaacagcatgttaaggtaattactgttagtggcacggtaacttaaccaaggtyccagccaataagtggcagaacctgaattacaaacccaagggggctgaccccagagcccactctttttaaaatgacatccttattgactgggcgtggtggctcacacctataatcccwgcactttgggaggccgatgcaggagkatcacttgagatcaggagtttgagaacagcctgaccaacacggtgataacctgtctctactaaaaatasaaaaaaattagctgggcgtggtggtgcatgcctgtaatcccygctacttgggaggctgaggcaggagaatcacttgaacctgggagacagaggttgcagtaagccaagatcatgccactgtattcctctagcctgggtgacagagtgagacttggtctcaaaaataaataaataaaaataattaacatccttattaaaatatgcttcacggcctggygaggtggctcacacctgtaatcccagcaatttaggaggctgaggcaggtggatcacaaggtcaggagatcaagaccatcctggctaacacagtaaaaatcccgtctctactaaaaatacagaaaaattagccaggcattgcaggctaactgtggcaggtgcctgtagtcccacattgcaggctaactgtggcaggtgcctgtagtcccagctactctggaggctgaggcaggagaatggcatgaacctgggaggtggagctttcagtgagccgagatcgtgccactgcacttcagcctgggcgacagagcaagactgcctctaaaaaaaaaaaagaaatatatatatatatatatatatatcacatgctacaaaatttacaaaattcactcctttaaagtaaagtacacaattcaataatttttagtatatttttatttatgtattattattattattttgagacaggttgtctctcacccaagctggattgcaatggcaagatcatgactcactgcagccttgacctcccaggctcaagcaatcttcccatctcagcttccctagtagctgggactacaggcacacccaccacacctggctaatttttaattttttttttttgtagagacaagatctcactatgttgcccaggctgctcttgaactcctggcctcaagagattctcctgcctcagcctcccagagtgctgggattacaggcatgagccacggcactaggccatttttagtatatttgtggtcttgtataaccatcattatcatcagattccagaacattttctctcccctctgccatacctattagcagtcactccccatttctccaactctggcaacctcgaatctactttctctctctatggatttgccagttctgatcatttcctataagtggagtcatgtaatatgtgaccttttgtgtctggcttccttcacttagcgtaacgtgttcaaggttcgtccgtgttgtagcatgtatcagtacctcattccctttcattgatgaatgatatttcattgtgtggataaaccaggttttatttatccattcatcagttgtacatttgggttgtttccatttttggctttcatgaataatgttgtwatgaacattcaggtaaaagtttttatgtgaacatatgttttttatttctcatgggcatatatttagagtggaatttctgggttgtatggtaactctatgtttaatttcttttgatgaagtgccaaactgttttccaaagcagctactccattctgtattcccactagcaatacacaaaagttccaacttcatattcttgcaaataacttttattttctgttttttttttttttttaattattattgtagccatcctaatgggtgtgaagtggtatttcatggtgggattaattttcatttctctaatgaccaatgacgttgaacatctttttgtgtttttcttggccctgtgtatatcttctttggcaaaatggttattcatatttttgtcccattttaaaattgacctacttttgtattgttgaattgtaactattctttatatgttctgcatataagctctctatcatatatgtgatttgtaaatattttctaccatccatgggctctcttttcactttcttaatggtgttctttgaagcactaaagaaattaatttttataaaatccaactttttaattatttctttggatgcttatacatttggtgtcatatctaagaaaccataacttgatccaaggtcacaaagatttgctcctctgttttgttctaagtgttttacaatcatagatcttacatctaggtctgggattcattttgagttaactttttatgtatgtatgaagtataaatagaaatggagaagagagaaaaataagagagcgaataagagagaaaactaaaatcatcttattgattatctcttgtacatggtaaattatttttttaatgttgtcttaaagattctttgtttcactcaggtctgagatttgaaaaagaaaaaaagtaaaaaagagattctctatttgtcttcagcttttgacagtttgaatatgatgtgtctaagtgtagatatcttaagtttatcctacttggagtttttgaactttttcaatgtacataataatatctttcattgaatttgggaaatttttggctatcgtttcttcaaatattctttctgctacttgctctctttcctcttcttctgggactcccattaggaaaatgttaatatacttcatcaactgcataagtaacatctcacctgtttctggggctttgattttgttttagttttttgcttctgttattcaaattggataatttcaattggcctaccttcaagttcattgattcttctttctgcctgcttaactctactgttgaaactagtgaatttttcattttggttattgtacttttcagttccagaatttctatttggttccttttcataatttctatcttttcattcgtattctctatttgatgagatataattctcatggtttcccttcagttctttgaacatatttataatggctaatttaagatctttgtcttgtaagtccaatgtcttagctttcttaataccaatttctcttggctgcttcctgtgtatgggctatacttttctgatcctttctgtgtcttataatttttgttgaaaactgaacatttaaaataatataatgtggcaattcttaaaatcagatttcctgttctctagcacctattgttgatgtttgctgttgttgttgtttttgctgctgctgctcgtttatttagtgaccttcttggactaattctatgaagtctgtttttcttgtcatgtatggccactgaagtgagctgagttagcttagtggtcatataacaattggacagagatttccttaaataccttgggccaaaagctccccagctttagccaagtagcgttgtgtgtgtgttggggaaagtctttaattaacccgcaggcagtttaaaattcttcattagccttcacttcctgtgtggacagagcctcaagatcaaccagagatgagagatgaggaccttcctggggcttttcttttgggcatgctcacagccctgcacatgtttgtggctatctatgtcagagtttttcaaagcctcctatggacatcttattccctgttttttctttcaaagtgttttggatagcccttttttagtctcaagtggtattgccccttcaggcattatgatgttaaacatttgcttctattttatttttatacattatatgaatagggctgattcagaatgagctgtgaatcagatcaaataaaaacaagccctgagaatggagcttttcagagagctgccaggcaagttaagcagtggcaatttggagagaaagagctttcggagtgttcaaaactcattttctctccttcattggtttctaggctgcaagtttgcaaagctactgaggctactggtttttaagactactgtggaggtggggtgagaataaggcaaattaaaactccacaaagtcactcttcttactgagatttatgtttgtttgtttttttccttgaataaatgcccctcagattgttgtttgcttcacttccagagttctggaaaggtcagctgtgatcatatttgcaagtgttctcattgctctatggaggagcagatttccagtagtccttactctgccactctggaggtgtttcccagagcccactcttaaccactacacaagtgcttcctaccacactgctaaggtgctttacattttgtaagaatatttttggcatctagtagagtcttcctgacatatatctgctgaaacacatattattgtatgtatatccttttatttctccatttctcccatacattacggggcatgatattgatcttttagaaaattatgtatgtagaaagccatctatggatttagtttcagcctaatgaaggaatgtaaaaaatatttgcttaaaaacaagaagggggcattgctctttgaaggttggaaatcactgccctacactctcctcccgttcctctcaggtacccatccattcctgctgctggaatgtctccaaagagcgcctgaagccctcattccactcaagtctcacttgagagtaaaccaaggggagtttgggggtaaaatgtcagaggtcattgtaataacttcttgggaaattaggcagaaagggaaaaaaagtgggaatcatttaataaaccacatagaaaacactccatatggcaatggaatcatgttctggttaatcataatttttgcctacaagagtcatcatatataccgttagaaggttactagttttaaagtaattagaaactaataaagtatgcaccgcctaggctatactgaatgtaatgtaattccttttggtaattaataatacctctaggaacacgttacaaaaataagagccatcagctgtagaatatcatattcataaatagtttataatgcaaaacagtaactttggtacctactgggtctattggttggaattcttttaacccttttcaataattatggagacacttgtccagaatttattatataaacttttttatacattagacttttacaaacaaatgctctcaaaattcaatattttcttcatgttcagtcaggatattaattcctagcttgctatgccagagtggtaaaagggggtagggcttcattttcaaaatgaacccagcaragggaacccagaagtgctcagaaagggctttctgctaactaatgatggcaaacgtggtctgtgtgatggggtggcatctactttctgaaaatttttaattttaatttttgttgttttcgttttgttttgttttataacttgtgttttatttttgccaaatttggtttcattccctgcctgttccatttggaggtactacactaaaaaaaaaataataaaacacgtaatcacaccatggggaaaaatgaaaggagaagaaaaaaagaaagctggataatcagcccctaattttctaaaaattgctattaacaaagctgctktacaattctcttgataaatatccaagaaatctgttcttggaagcttaagaagagagtggaaaggctgtactctcaggactaaggaaggactcactccctaaagactttgtggatggaaatttgttcagtactcctgtagtgtgtatgtgagtgaggacatctggactggtatctagccaggatgccctggtagaactgcatttagcgttgatgtcctttccgatgggttgcaacatccatttggttcatgcctgtgtctgagcacttattaatggttttgactatcactcctactacacatacacctcatagtttaatggtggaagctacagcacctgtccaagtgcacccygccatctgcaaccccctccattgaggtctcttgtgctatatcagactgtatttacacgtgacttctcagtgagacttgcaaaaccccttgccttcacaggacaagtaagaataaacacattcatttcttcttttttcttggcggtcagttgattcctacaacagcatcctttactgagctgggatgcccatggcgccctccatttatctcccatatagcattgctatgcaaatgaggccattcatgactggctacccagggcttccccaggtggctcccagccagagggatctgaagcagctgagcctcagagaggacaggggccctggcctagtctccacctgactggactgctggcctttgacatgacgccagttaacatccaaatgccccttgctggtttcagcactccaacaggctcaaacaatgaatagctgtattctgaaatagtgtcatgctcgcagctccatcaaagattcctgcagcatgcctctttcctctgaataattcctttctgtcatcttccttcattatatttcctaacaagtttttttctaagtccaggctttcatttccactttgaaatgtcttgttagacaagcctcagagtccaccaaattgttcccacttctttccaacaactcccaccccatcctatccccactgcccctgaaatggccagagcttaataatccaggatgtcctgtcattattgtcaacaatattgttgtctgtattcggaatgtattagcagaaccagagaggtagggctacacccatctgctacaaatacacaaatgatttgcaagatagacagtgcctttctttcaccccctgccagttttgctatgaaagaattcaaacccttggtttacagttgaagttggtccaagacatctcctccagggctttctcttgatcttatttgtgctctcccctgagccctaataaagctgcacaaacaaaattacaagcccatatctctttcttcccttttaagaactccttttctctgaaacatttctggacagatagattgtaaatgagatgaccctgtggactgtttaagcagttagttagccaagttaaggtcagtaaaggactccttgtttaaattaaccactttattttcttcaaacacatagcaccctgaagcccatgttggtctcagctgtgttctctgtccagctcttcaccaccccataggctcctatacctctggatatgaccttagccagaaccaagacagattttgaactactgtgctctactgggttttggtaaaataaatacataaataaataaatagtcctcagtgtttcggagggaacctaatacatgtttattatgcagtattttaaatgttgcagaaaaaataccaaagtaagaagtatcyattttctaactactcagaacatctgtaacatttccttaacccttctgtaatatgtctctttgtgtgtcgtatgcatgtttttaatgctgcataccaaagtaccaaagtaccacaacgtaacagcttaaaaaaacacaacttatcatcagacaattcctgtgggtcaggagtttggtcactggttgactgggtctctctgctcagggtctcagataactgcaatcgatcagtgttggctgggactgttgtcccatctaatgctcagagtcctcttccaaattcattgaggttcttgaaagaattcagttccttgcagctgtagaactcatagatgcttctatcttctttgaagccagcaggagaatgtctctgctgctttgaatccctgacttgctctgtctctgatctctagacccagacttaaaaggctcatctgatgaggccagacccacctgataatctaccttttaattaactcaaagtcaacagattagtaaacttaattacttctgcaaaatcctccttgacacataaagcaacatagtcacaggagtactagcctgttctgtttatagatttcacctacactcaggggagaaaattatacaaaattatgcaaaaggtagtgggagtcatttaaaattctgctctgcatgtgattttgaaacactaatatgccatggatgtctttcytgcctagtcaatatagatctgcatttttatggctgaatagcattctattctgtttcaaaatacttgatcacatgttggacagttaggctgcttccatgcttccactttccctttcttacaccatgatgaacattcttacataacacacttgtctttgcatttgtatgattatttcccgtgtacaaattcaaagcacatggatttactgaatcacaacataaactatgacgtcccatgtagggtcccccagcaggggatggtgctgctgttctagtgaagtactgcctttggtgaaggttctctgagtcctttgtaccaatactgctgaattattagcatccttgaaaggagttctaaaaattactagctgtcactgcacggaacacacaggaagaaacataaagcagagatgtgttcttcacttgtcatctccatcgttatcctcccaaaggttgttctcatcttgattaaacaagtctcaatgaaatgaggcctttattttgatttctatactgcttctatagaaagaggcaacaaggagatttagaatttttttactttaaagggacacggtaccttttgactgtatagtgagaacttaagtttcaaatgaaggctccgagaacataaaaaaccatgaatcttaaagagaaacaaacaagcaaargtttaataagaacttccttgctagatgtcctcatgatttatttagccaacacttactgagcacctcctaatgactgggccctgctctagtgctggagatgtgtagaagaataagaccaacagagctcccaaagkagatttatgcactctacaaatgcatgatggaattgcaagatgaaaacagaaaaactcttatggatctagataaagaagctttagaataaaaagtagcatttcaggaatcagttggtattttccaacctggagaatcagtagatgaaattaggaaaagtctgtacggaaggaataagtgtttgagatcaaatatacaacatgttgkctatagttaattatactatactatatatttcaaaattgccaggagagtaaatttcaaatgtttgcaccacaaaaataaatatgggaggtaakcgatatgttattaacttaattatcctgcaatgtgatttgattttatatatatatgtaaaatcatcactttgtaccctataatatatacaattatacaattattatgtgtctatttaaaaaattaaagatatgctaaaggaagttttccaacacaaagggaaatgacactactgtatattgaaaattagatcctctgacacgtatgaattgcagcaaaaatgctaaatatctgagaaaaatgctcacgcctgtaatcccagcactttaaaagactggggcaggaggatggcttgaggccaggagttcaataccagcctgggcaacatgagaccctgtctcaagaaaacaaaacaaaacaaaacaaaaaacaggaaaataaatgtctgtaaacattagcctctttcatggaggaacttgggatataaaaaactgagcatgcttaaatagaattgtgtaatgtcagccaaatggaaactcttgaggcacgggtggcttaggacacaattcccctagtcattcctgagtagagaggattgcatggtgaaagagatccccatggctgtggaggtagcaccctctcgttctcttcatgggctgtctgggagctgagccattagctttccacccattgatggaggcccagccctactgggagcatttgcttcctccccacctcacccactgcctgcaagttcctgaccctgttatgaaactcccaccctaaatacacagataacgtctcagccatgagtgaaactagaagagatcatgtgtaactaattagatgkcagagtgagagaaaagaaacttttccccgggtcctggtcatttgaaaagaaatattatcctcaaagaaaagtctttacttgagatctgaagtgcaaagcatatttatcttgttccaggctaaccttgccaaggatatttgaatttaaataaggctattctggagcctattaatctagggtgatggtgtagcagtgaaagccagggggtcactaaacacttcgggtcgtataggaagcaggacggcgtccattcagggttgcaaatgttttattgctgtttttccctgggtccttctgcctgatggggcaaccttcactgctctggagagaggctagcagagtcattgtctaacatacacagtgacctcccttccagcttccaagcaaagatggaggctctcaggtgggaactgacctcatgttcctgctcagagacctccacaccttcaccctaatccacatctgtacccttctctccctgcagaccctgccttgcttcccacatctgtccagggtgttgctctcagcctcatcctcttgcaaccttggtatttcagctcccttttatattcccactgtctctaccttcctccattcctccatgaacatgcctcagtctcttttaatttgaaaataaccgaaacagacttccctgcattgcattacatgctagcccctgccctatcttttcttctgtcttacaacctagatcacttttttttttttttttttagacagggtytcactctgtcttccaggatggagtgcagtggtgcaatcatggctcactgcagccttgatctcccgggctcaagtgatcctcccactcagcccctcaagtagctgagactacaggtcagctaacttctttaactttaatagagacagggtttcgccatgttgcccaggatggcctcaaactcctgggctcaagcagttctcctgcctcggcctcctaaaatgctgggattactggtgtgagccactgtagccagcctctaagtcactcttaaggaagaagctacctctttcttccctcctcattcatttgtcagctggctttgcccagccctcctccaccacccaccaatactcccgcaacctcctcctccgcttcatccaatccagagcatcacaagtgtagacaaaaatgcctcttaggcctcacctcctgggtttcccacaggcactcaagctcatcctgcccagaattgggctggtcatccacccatcaccaccagtcccaacacagactttcttctcttccttttttattcacagtcttggtaaacaaaaccatcatactacttggacaggcaaaagtcttccccaactcatccgagtccctcacatctccctaaacctgtgggttgtatccccaatggcttctctccctctccatggtgctggccacctgaatgcctttctggtccactattgcagttcttcaggggtgggggacagccggggaggactcagctcaatctccagccttgcctctccatccatcttccacgaacagagatttgcaaatttagatcttcttcttaaattattccaatggctttttatagcctaagaataaagcatgaatgtttartttgatatcaaaggatttcacaatcttatcctyacctatatcataggtcagtgttgaagagtgtggatttcagagctctatcactaactagctgtgacctcagcaaggttcttaaccttcctgggtttcagcttcctcccctgtaaactgggggtaattataatagtactgttctttttttttttttctgagatggagtctcgctctgtcgaccaggctggagtgcggtggggtgatctcagctcactactgcaagctccgcctcccgggttcacgccattctcctgcctcagcctcccgagtagctgggactacaggtgcccgccaccacgcccagctaatttttttgtatttttagtagagacggggtttcaccgtgttaaccaggatggtctcgatctcctgacctcgtgatctgcccgcctcggcctcccaaagtgctgggattacaggcgtgagccactgcgcccgaccaatagtactgttcttatagggtgctagggacatcagatgtgttaacatccatgagggttttagaacaccacttcgcactaaggaagtgttatatgtatttgttagtttcgtgcattgcctgccatcaccgttctcctatgaacctgaatgttcaaacacgctatgctccagccacaacacacagcagacagttccacaaacaaaccatgatggctatttcatgccgctgtaactttgttcttcctccttttcttgacctcctaaattcccatttatctttcgagcctcagctcaaacatcacttcccaaatacctggagactttgctccactgagactccatggcaccccaaatcaacacccgttttaccagggatcatttaaattaattatttttcaaagcctgagagttaccatttttgagcacttaacacatgccagtctgtgttcgaaatacatgtattagcttatttaagtctcacagcaaacctatgacagttttgataattggtttacaggtttgtcatttctcctagaagattaccctttatgggtaagaatctatgttttgatcatctctgagtctccagcacctaccaaggtgcctggtgtgtagtgggtacatagtgaaattaatatctcttgaaccaatcaaaaatgggctgcactcagagaaagatgggagcatgggcaaacagctgacatygaagggcgtctaggcacggaacccgtggtagttgaacctgaaattcatcagtgtcataaacaaagactgctgtaactacctcaccacattattaaayctttctttattactatatgaacattttctatagtgctgaggggttaatgtgctctcatttgattctgtactgtcatataatttcaggtcttttcaaggacataataatacaattcatgatggcattttattccatgctcttgcttccagggtcatattcaaatttctgagaagttttccatgacccttagcacttttaataaagggtaaagagagattcaccctgacaacgtattcttcttgttggacacgagatggaaattgtagagaattatagtcaggcataattgttgtagtttctacagtaatagtctaagaccacaaacacaagtattttttgcttaattgctacaaaggaatatgctttttctaaataggaactatattaaaaagttcaaaataaatatttcagttttggttaacttttcttccccaccctgtcggyacctagtaagttctgtttcgttagtsagcagaaaatggttaagattaaaactgttcaatgcactgattcmaatatctttgggtggccttgaagctgctcttagcagagggaaagagacatccagccatktgagtgtcctgagggatgccaatgagaatsaatctgcccagaaaacccaagtctagagccccaggatatctccaggagccctcagatttggcttaatccattctaataatctgtagatagcatatgcacaggatttggggtcacttttttttttttttgagatggagtctccctctgtcaccaggctgaagtgcagtggcacaatctcagctcactgtaacctccatatcccagattcaagcgattctcctgcctcagcctcccaagtagctggractacaggcacccgccaccacacccagctaatttttgtatttttagtagagacagggtttcatcatgttggcaaggctggtcttgatgtcttgaccttgtgactcacctgccttggcctcccaaattgctgggattacaggcatgagccactgtgcctggccgtcacttcttgatctcttggagcattgggtgtgatgggaagtttaacctttctgggcttgtgttttctaaggaactaccactgctggaatgaagcatggatgacaaggcctgaccttcctgttggatttggaggctggcaagctgtggacagcacccccyaggaaaatagcgatggtaaaactgtgtcctccctctgggaacttgcttcattgctgatytttgttttgcttttatgcttgcatttgatgtgtgggaaccacgcccattgggaggcaacatctgaagtgtgcttcctgggcacatgtacagtattagctaccttccaatcaggtttaatttcatttccattgtcagctttaccctgattattttacagattttagagaaagaatataaaacaacgtataattcatccattcttgctttgctaagcagttttgaagacaggagagaaaatatctgtaagcatttttactaggctataaaatatacttcagccctttgtggtatgcactggtaagatataaggcaggagagaaaatagagaactcgaaaaataattatagatcatcctttaaattgtttttccagaacctrgcctccttttatgtcatgtgatttcctccaaagcttcagtatgtgggtatttgtcttctaacttgccaactatgctaagcagctgcagctctgacctcccccagatttttataaaatcacatcataagcctccatctctctttaatatgataatataaagaatcagtagactgtggatattatgtttatttcctcaggtgttgatatatcgatgggcacacacaggaacatgcataaacattcaatggatattcatactgaaaccatattataatcctaggctttaaggaagaaagtttagcactttctggtgttctggtatatatatcatggggacattttacaggtgactaatagcagctaatctcttattaactatatagataggtggttaaaatttaaagcattttagaagagtaacataggccytctgacttcctaaatgcatggtgggcatggccaaaatgcacaggcaatgtccaaattctccagttaaacttgacatatgttcataatgtccaaaaacaaaagacaaaaagcaaaacaaacagcaacagcagcacaaccacagagcacacatcaacatttccaacatttcagataccacctgaacaagagataaatgctgtgtaagccacctgcttggcatcaacacatctgggtatgtgtctgtaggtggcagagtagatgcaggaatagtgttgccttgtatttatttccatggcttcaatttttggcttgagggggcatagccaatggaattctcttcagccttggaaagcatctgggctaaatcagcaatgaagttgggaacactggtctttacagagtcaccctcagtgccatgaatcttgcagtatctggacagaattggagatgacaaactcacayygcccttcctctgtgcaatgcaggcatgtatcrgtgtggccccgcctcggttcaagccatcaagcacrgccatgtctgcttccaatttgatgcaccttttgtttttgcagaggtaagcaggaagctggaggaaagtgctgtttttytccccaacctcttaacacatgaaagagtaagctaaaagttgttgtttctaagttttccaggtacatagcrtatgcttcgtgttgacaaaggtaactaggcattattccaacttccaggctattaatgctaaatgcagttcttgtttaacrtttttctttccttgatgttttgggattccctactcccaaaagtaaatgctttactaacattagcttagttctctgcacccattaagtatcaactgctccagagaaattatatgactaatggatctctcaactaacctcattggaagagatgggtcatgaattgaaatttcaggacatgccacttccctctgggactagtccagcaatccaggtaagacaaaatccacatacacacacccaaccatggtcttaccctggcctttgcaatctatgtcctgccatcccacaccatcacctgtggccagggagggagggttgagttgccaaaggaggaaggggagcctggaggctactctaagagaggaatacagcccacctacagggttgatgggaatgcctgggcaaaggctctgccatttcagaagaactaggcagggactggaagcagaacaggctgttaaaggatactcaaggagagctctgaaaatcaaattaaatgtaagagatgttgggtaaacgagaaggctgggctgccggcctaggaagacttgaaagactgagaggcaggacttccccagggtatatttgcaccagtaaatacactgaaataatgtctttcactttgcctaccattggatgctcttagcaaccttctaaaattgataattcttcccattttacagaaaataaaatcgaggcaaagagtgattaagtgactttctcacaaccatctagctaataaatagcagtgctaagatttgaagccaggcagatacctgaatgcayactggtaaccattgcactctagtactccaggaggaacaaatagttattattaatgtacaccaggcattgtactggggggaattctaaggttcragtctttaagaaacgtatttctagatgccaggtgacagggcacaaacacactgaacatgaaataacaacaatacttgtcaggtgggccatgtagagagcacagatctgcattcatatgatgcatgagttgggaagtagaggccaagaactgaagcaggatggcaaagaccacaagacaccatctaggaaggaagggcgacctgggaacagacagtgaggatgcctgtggaagtgtccccaggtagtaagagcagagaactgtgggaccacatgggaaggagggatgattaggcaaaatgattagaaagaagccagaggaagggaggagtgcaaagcagggggatgagttgagcatctgaaagctttgtgggggcagttgaaagctgtgcagactcactagaacgccaaggatgcatcaggggtgttggaaggtggaggctgaaggaacgcagtgcagaggacctccctgagagacttgctccttgtccctcctgtaagtgagggagagttttcactgggtgggaacttgggcaaggtgctgacagccttgtggaacacggattggaggggttgttatgaagttgtggggaacatctagagggctggtcatccctccaagccagagatggaaagggcatgagctagacaaatggcaataatgaggaaaagaggaggcaggactgagaaatgttaatatttagaaagcaaaacgaacatcaaaattcagacagcaagatcaggaatttgaaacacacaaaagaccagtgttcatctcatcgtacctgcygtggcagtttacagaagcctttggagaccaagcttactggacttggaattttatcccctcgttttcactttgggatttgaagatttccacaaacctcccagctgtcatttgatagtttatgatgctacgagagcccctaatsaggagatcactctgaaatccacaaagccttgttttcagctttttattacactttattgctgcaaagaaggagaagraggacctccctccacaagcaagctgcctaatagctgtaaatgcaaacactttttgctattattaaatatagatcggggtgttatgaatgtcatcaggatttgcagattataattactcctttctcacccactgcagaggcgtgtctgacagagggtacaatttgttgctttggcatgggctgcgctccaggggctgagccattttkaagagatgtttgagttgatgaaaagtgtatgaggaatcttttctcaagggtgcctgcagtgggaccccatggggagtgtcatatgagtcgatatgactcaggttcgagtctgtggctctctctgctctccctcgtccttgctgcatcagctcgccttctcttccctcccagcatgctgactttcttggtcattccttactcatttccaggcttgatcaagcatcatgttcattgactgttttttagtgttcccagggccttagtctccatgagtgaaagcagagcctaaaaagaagaggggtatgcctggaaaatgtcttaccttctgttccttttttctctcctcctccactttggaagttcaccctccacatttctgggtttctgccagggcttgaagcttatttctcttacccctcccttcccatgtcctccctgctgcagtgggttcctgtggatctgaagccccatctgcctatctccccagcttatggtggcctagggcttccaaataggtgagaggagatgagagctgttctaagcgtctggagtcgtattccaagattccatgttcacgaagccctcaggggttcttagtgaagaactctctccttcttgccaaagataactctcttctgtcctaacttctcattaactctgctgccctctttcacaccactccaccccaaactcactcacatacacacacacatgcatgcacacactcctgcctgccctcactggcgctgagatgattttgacaggagcaataactggctccctgggaccacagcaaccatctcatcactcaagaagctaagccctcctctgctgtgggccagcagttctcttatacaacgtgtggagatgttttcctgtagattattcattctcaattcaaacttatttattttgctactatcttatcagatgcagcctatttttttggcatctcctacttggctataaaataatccagtcatttattcaaatagcatacaaaactytggaattattttagctttccttcttaacctcccttatgcatcttgccaaaaataccttcccaaaattatcataaatccagccacttctacaatctctatcgttaccctctgagctctgtacaacactgagctccataaagttacctcctaactcctcctaactcatctccctgatccccctcttgctccttttctgtctattccccacagagcaagagaattattctttaaatgtaaatacaaacatcacactcctgccccaacccttctggtggagttccaccacccttacaataaaactgaacataaattcctacaagattccatggcttcccttccacttcatcccttgtttatttccctccagccatactgagatttttctcttcrgaaagcatccacacatcctcttgtgtcagcacttttagacatactgctccttttgctaggaaagctcccctcactatctttcactctgtgtaggaagaatgctttgcatgctttgttccctctctgcattcaagtctctgctctggtcacctcttcaaagaggccttcgctcacccaactscacctaaaatatcaccatctgccctgttgttttcatcctccaaccttagtgtgtactccatttctcccttctagaatatgagctccatgaaggtagaagctcttgtaaccgcattgctgagagcaggatctagggtccagtgccaggaaggcattcactgcctccatatgccctctgagaagcagcattttctctgcagagcctgcagacaaggttatctccacttggaaacaaataaacaaaccaaagcaaactctgtccagggtcctgaaagcaagagcacgtctctagcctcagtggtgaagagcatatcttctgccacctgtggacaaatgttcacattctatgggcccaggtggacatttgcagagagcagcccccaagcctgctttccaccccacctttactgagaagctagggccctgaccaatggtagaggctactatgtaggaagtgcctgtacttaagasgcaagggtgtggtgttgtgaaaaaaatatccaatttcatgcaccaatgcccagattttgtgtgatgataacccttcaagtgtagggatagaaaaaggggatcactaacattacattcaaaagaaggaagaaaaattagccgtaaatgtagggctttcacaagtagtaccaatctatccaccagcccgacaaggaaggtaggctcagagagattcagtaactcggagggaggagccaagatggctgaataggaacagctccagtctacagctcccagcatgagtgacgcagaagactggtgatttctgcatttccatctgaggtaccgggttcatctcactagggagtgccagacagtgggcacaggtcagtgggtgcrcgcaccgtgcgcgagccaaagcagggtgaggcattgcctcactcgggaagcacaaggggtcagggagttccctttcctagtcaaagaaaggggtgacggatggcacctggaaaatcgggtcactcacacccraatactgcgcttttccgacgggcttaaaaaacggcgcaccacgagattatatcccgcacctggctcggagggtcctacgcccacggagtctcgctgattgctagcacagcagtctgagatcaaactgcaaggcggcagcgaggctgggggaggggcgcccaccattgcccaggcttgcttaggtaaacaaagcagccaggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcactggttctcccagcatgcagctggagatctgagaaggggcagactgcctcctcaagtgggtccctgacccctgacccccgagcagcctaactgggaggcaccccccagcaggggmacactgacacctyacacrgcagggtatwccaacagacctgcagctgagggtcctgtctgttagaaggaaaactaacaaacagaaaggacatccacaccaaaaacccatctgtacatcaccatcatcaaagaccaaaagtagataaaaccacaaggatggggaaaaaacagagcagaaaaactggaaactctagaaagaagagcgcctctcctcctccaaaggaacgcagttcctcaccagcaaaggaacaaagctggayggagaacgactttgacgagctgagagamgaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaagcaaggctcaagacctacgtgaagaatgcagaagcctcaggagccgatgcgatcaactggaagaaagggtatcagcgatggaaaatgaaatgaawgmaatgaagcaagatgggaagtttagagaaaaaagaataaaaagaaaccagaaaagcctccaagaaatatgggactatgtgaaaagaccaaatctacgtctcactggtgtacctgaaagtgatggggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtcgggttaccctgaaagggaagcccatcagactaacagcggatctctcggcagaaactctacaagccagaagagagtgggggccaatattcaacattcttaaagaaaagaattttcaacccagaatttcatatycagccaaactaagcttcataagtgaaggagaaataaaatactttayagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaacgagcaaaataaccagctaacatcataatgacaggatcaaattcacacatgacaatattaactttaaaggtaaatggactaaatgctccaattaaaagacacagactggcaaattggataaagagtcaagacccttcagtgtgctgtattcaggaaacccatctcacatgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagttcttagagacctacaaagagacttagattcccacacattaataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatacttggaagtaaagctctcctcagcaaatgtaaaagaacacaaattataacaaactatctctcagaccacagtgcaatcaaactagaactcaggattaagaatctcactcaaaaccgctcaactacgtggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaatacagacacaaaaaacccttcaaaaaattagtgaatccaggagctggttttttgaaagaatcaacaaaactgatagaccgcaagcaagaccaataaagaaaaaaagagagaagaatcaaatagacacaataaaaaatgataaaggggatatcaccaccgatcccacagaaatacaaagtaccatcagagagtactacaaacacctctatgcaaataaactagaaaatatagaagaaatggataaattcctcgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccaggcagagacacaacaaaaaaaagagaattttagaccaatatccttgatgaacattgatgcaaaaatcctcaataaaatactggcaaaccaaatccagcagcacatcaaaaagcttattcaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaaattctggccagggcaattaggcagaaggaaataaagggtattcaattaggaaaagaggaagtgaaattgtccctgtttgcagatgacatgattgtatatctagaaaaccccattgtctcagcccaaaagctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaatattccatgctcatgggtaggaagaatcaatatcgtgaaaatggccatactgcccaaggtaatttacagattcaatgccatccccatcaagctaccagtgactttcttcacagaattggaaaaaactactttaaagttcatatggaagcaaaaaaagagcctgcatcaccaagtcaatcctaagccaaaagaacaaagctggaggcatcacactacctgacttcaaactatactacaaggctacggtcaccaaaacagcatggtactggtaccaaaatagagatatagatcaatggaacagaacagagtcctcagaaataatgccgcatatctacaactatctgatctttgacaaacctgacaaaaacaagcaatggggaaaggattccctatttaataaatggtgctgggaaaactggctagccataggtggaaagctgaaactggatcccttccttacaccttatacaaaaatcaattcaagatggattaaagacttaaacgttagaccttataccataaaaaccctagaagaaaacctaggcattaccattcaggacataggcatgggcaaggacttcatgtctaaaacaccaaaagcaatggcaacaaaagccaaaattgacaaatgggatctaatgaaactcaagagcttctgcacagcaaaagaaactaccatcagagtgaacaggcaacctacagaatgggagaaaatttttgcaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttgatgagactgtaaactagttcaaccattgtggaagtcagtgtggtgattcctcagggatctagaactggaaataccatttgaaccagccatcccattactgggtatatacccaaaggactataaatcatgctgctataaagacacatgcacacatatgtttattgcggcattattcacaatagcaaagacttggaaccaacccaaatgtccaacaatgatagactggattaagaaaatgtggcacatatacaccatggaatactacgcagccataaaaaatgatgagttcatgtcctttgtagggacatggatgaaattggaaatcatcattctcagtaaactatctcaagaaccaaaaaccaaacaccgcatattctcactcataggtgggaattgaacaatgagatcacatcatcattctcagtaaactatctcaagaaccaaaaaccaaacaccgcatattctcactcataggtgggaattgaacaatgagatcacatggacacaggaaggggaatatcatcacactttggggactgttgtggggtggggggaggggggagggatagcatagggagatatacctaatgctagatgacgagttagtgggtgcagcgcaccagcatggcacatgtatacatatgtaactaacctgcacaatgtgcacatgtaccctagaacttaaagtataataaaaaaaaaaaaagagagagattcagtaactcatccagagccacacagcctaagtccaataatccttgccatacactctgaacttatctattgttctaccatagagcgtcaattgattttgggtggggccaatcattccatgcttttttaagctcctagatgattccctagtacaaccagaatagagaaccattccactacaggccgaaaccaaaaagaaagcttgctaatgtcgcttggaaagaataatttccctccacatcccaccccaacacacatatacaaaagccaccccatacaggtgtttctcgtctcctctctccgcaaaggacagtgctgttggtctgtcctgagatttyagcctacaggaatttctgaagccatattcaaggtgggggggcaggaatcagccactttcatattttgcttgtttccctggaaaaccacaagctgttataaggattgttattaagaagttatttatcattattgttgctacgatttgaaagtagagggggtcgctgtttgtacttacatggcttcctccagagggaatkcccgaattctcagacagctcatttaaagcttccaaaatgacaaatattccacaggtatctgctgcgtcctctcctgtcctgattcctgacttcacatttcagcctttcacaacatgtggctagcacccctgagttctggctgctctgctgaggggcagggccaccgtttatcaccctcagaaatctgagccgcaagtgtggaaccatctcaccactcaagctggggctcatgctcccgcagggtggtgtgggaaaggcggtgtgccgtgaaggccaagggccaggttatgggctgtcccagggcttgagctgcttctccagcagctcctagccatgaaaccacaaacactttgcctcccccttctgagtcttggtgccctcatccataatacggttacaatatatacctcacaggcttgttgttgtgaggttcaaactaaatcctttataaaatgtccctgaaacaytgtaggtatgcaacaaatgttggctatctcccccttagtagaaatccgacttcatgtgcactcagaacattctgtgagaaagtaaaattgctctctttaacctcaactttaaaacctagggatatatcttcaagtttccccattacctaatgatgactattatatttttactcaattttgaaatttacaagtcatgttcacatagatcttatctcactctggcctaaaatgctcccataaaattggcagaacaaatttaatcatttttattttatagaatcaggaactgaagttcatagagattaacatgcactttctacaaggacacacccactatcggaacccaggtttcttgcagcaaatctagtattcctctcaaatgccatctaggtttcaccttggctgttactttctagccaacccttgactccactgccccatgtgctcccaaagtatcttgtacttattctttcatggtacttatcgcactgtattgcagggcttctcaagcctgactatctaacagaattatgtgagactttttgtaaaatataatggatttagggcctcacgtgatttaggtcccacctccttaatcaggcgtctatttttgtttaaagttctccaggtgactctgatgcacagaatcatgcttactaaagcataaactctctaatggcagcaaccaaatctattttgttcatcattaggattctgaatccttaaacaatatctggcaatactattcaatattattatcaataacatttactgagcatttactctatgccagacactatgataagtaatgtgtgtgcatttgtttctgttaattctgccaatcgtcctatgaagaaggagttattatcaccctatttaaagagtgggtaactgaggcttggagaggagcttgggaaacatttagtaaatacatcaatgactattagcagtacaattcatgcttcctacctgcttccatgataataactggaaccttcaagaaagtgattataaaatatgtaataaaggactctggtacagtcagctttcaggcacacattagtcattgtctctagaaagtagaatagtaaagcagagccttgggagagcttgggggcagacagcatggccccaagacactatttctgagtcccacaaatagcacattttagttgctgaaccaatagaaaatagcctgaattcctcctagatcatctaatattattgttcaatttaaatacttttggcttcaagtagcagaactaatgtggctgaaacagatggggactgattttctcatataagaaatcctgaaataggtggtcctgatgcgggcttagccatttaacagcatcattaaggcccccaaatccccaaacgcctctcagctttctactctgccaccttctcattgtcagcagtgtttctgttcactgtctcaygatggccacagcagcttcaagcatcccttcacctgaaaacacctgaaaacagctgaaagcagaaggggaaggacaaactcatccatgtacctctctcctttttcaaaggggaaaaatgtttcccagaagccacctagcagacttcctcttcctcctggcagtaggtcacatagccacagttagcccaaaagaagtccagggaagcaagcgatgggcatggtggcatggcattgtcttctctcctrtgagaggtaggacttatcacaaggacagaggagggagaaaaatggttgcttcttagacartttattatctcagcctcaaataatctttatttaaagtactactaaatcaactagattcgcctttagaatattttcaaaacctgtttggccctatgatacgaatccartgttgttgaagaaaggggcatgtcagctccagagatctctagacgactgctctatggacagttaaagactttggcaacagcagacatgtgatgatggctaatgctctcctctcctgtttccaggtcaacagcgacctcatttacattacagctaagaaagatggcactcatgtggtggaaaatgtggatgccacccacattgggaaattaattgtgaccaaacaaattggaggagayggcatgatggatattactgatacttacaaattccaagaaggtaatttactaccactgaatgaagatttatttgcccaagtccattgagtacttattcattgtcactcagagatgagttccagagaatgcactggcatttgcagcatttggtagcaacagcagaagtataaactttcacrtgtgaaagacacgtcacatatgcaatttttcattgtagttttctttgctagcttgctttgggcagaattctcattcacstggcttgtaaaatgatttggtttaaagtcatacctaatttaacagaatatagaatatgttcttgctcacaagaaccttaattttaaataatcctattagaaaacactgtataactaatgtaattttagtccaataatagaaattaaaataactacttcacatttgtttagtactttaccaattatttccacatacattgttctattacattatcatggaagactacaacgtagayaatacaatattaataggacaatgcaatctctctaactcaggacaattaggtcgaaggccagtttcaattccaaaataatgtcatggtgggtttttgttaacttttattgcatagaatgtttcaaatggcactactgagtttaattctatctcaatcaatgcttagtgtccgstcyatgcctgcaattggtttggtgctggcgattccagcagtgagcagractcagttcctgtcctggtccragtgacaggattattgtgcagaggggtctttggaaacaataagtaggggcatttagtccaactgattcagaaaaagacttgagaagagaagtcgtggacctcggttaaagaagctggacaggggtttccagacagtgtgaacatgaccaaagttacagggcgtgcagcagcccggtatgtttagggggatcctgcaggctcagaatgcccagtgactgaagacaaagctgcccgaggccagcagtggccagaactggaggaccgtgagtgtcctgatggggaacatgcaacatattttgcaaatgattcactgccagaggttcttaggagtatttatttttagtaaatggataaaaatgacaagtaattagcatatacctaaatattcattggaatccatgaagtgctaaggagtgcagaatttattttaaatagtttagacagtctccctgctcttatttacaaaagtaatttgcactacaaagaagaarcttgctgaattgagaacacttgtgcatagtctcagaaagtcagaatttttgttatctgaactagtgaattttcactgtattttttaaatgcttcattttcctcttctgttggttatcatccattgcacaacacagatacaaaggtggtatttttttgtcatttggatttttccttaaaggaaaatttaaaacaatataagtgcaaataaaacaaaacaaacaagcaatgccctcttactgtagagttataagcaaaaaaaggtttggagaaacaaaaaagcaagttcatagaaaagttagctgcaacatccactcattcatacatacatccacacgacagctggctcttaccatctgccatcttccagtgctgtgtagagctggatacatgtacagccctgccttcccatgcagctggggagaaaagcagaaggcagccctcactgtgctgggtgagaattgctctggcacagggtggacgggtgctgccgggcacagagaaaggctctcagccaagaatcggcagttggggaagacctcgtggaggaagttagtgatgggctcactaagcccaaaggacacacaagaattggcagatgaagctggggaaagaggtccccaagaaaaggcagtaaggcaaggactgtggtgagaactctcgtatttggaagaagtcctgaccagacagagtagtgaagaaaagttgcacctacaggcagctaggggcagcaggaagcgagctgtccacatgacagatgtctcttggaaaccatggagccgagcacagytgccattagctgtcagcatggaggtgacagtgaaggccaactcaggaatgggacagaatcagatgccacgagaggaaagactaaaacccagtccacgaaacaggagtcaggggcttggctgggggtggataacaaattaaaacaaaatgtgtccgcactgcatgaggaagacatctgaggtccaggcctctagagtttagcaaggaggcaaggctgagggagagggacagtgtggaggtctggtccaactagaagaatccctaaatccacatagatggttgtaagcgacgactcatcctgcttcggggctggagtttgaccccaagtggatagtttcttaatcaagggtggcatacacatttcaractggaactttggaagtgaccaagtagaatgttgttttgagaagaacaccaagactgcatctgaatgtggcgggtagaaggattgatggccgccattggccactggcatgcagtgaggactcgtcatatccgtggctcagtacttaccaccctgattctcaccgttgaatctcttataatttctctgatccacaaatgctgagtgtagataccaaaatatggaaatgagtagaatcacaggaaacaaattattactagatttaggacttaactattttaatgaattaaatcatggaaagatcaggttcacttcaacttactaaagcttattattaactttataacttttttcaagatatataattaagaaacgataagactttgaaaatcagaatttctgaagacttctcctgtggcaatatatcttctttgataacagtgtcttgattccattccctctttgctccttcagttacttccagggtcactgttatttccacctctccctctctattttctccttccaatcagcatttaagcaggctcaaatatctgctgtgttaaaaacaaaaattacaaaaatctttttcaccactgtctcttcctcctcgcctccttgccgtcctggagygctgcctggacttgcgtcctgctgtgttccttctccactccttccgcgcacactctgtcctgatttctgctaccagcacttccttgaagttgttctcaaggttgccaagaccacccaattgtcacagggaagaaacattttgcagacttcagcttacttgaccttcctatacttcctggtgctgttgttcactccctttgcttgcaattctgtcttttctttgtttctacaatgttactttctcctggttccaccccctcctgcctgaccctcttttcctacctctttttgactataagcttttcccctttcttcacccttttcaaattccatttcattctaggcatctatccttgggctccattcccacccacctgatgttcttcccacatagctggtgttaatgttcacatatgtaccatcaccccatgtctgtgtctccaccgggactttacctaaatgtcctacagaaacctgacacggaacttcccaaatgacacctctcactctctccctcacctcaggtccgtttctcccactccccctactctggtgaagagaaccaccatccactcaaatttagctacttaagaatgagttaagcaacaaatcctctaaatgtcccctctgaaattgttctcgaatgcatcccctcccctccagctctgtagcctaaaaattaaatattatctggtgtgtacaactcttaatatagtgcctgacacataataagtgtccaataaaagtttcccctattactagtaattctgttattcctgccatactactgctattagtttgggctatgawtagttttctcctggaaaaatacttgctctagcttcccaattccacctcacctcctcaggccctccttccctcagtctagcccctgccttgctgccaaagtaatatctgaaatgtaaacctgagcctctcccagcactgcttaaaagccccacccccccccccctctccctgtggcctccagggcatccagtcctaactcacaaagcctcttgctaagtggcttttcggcacctggtcactgcacctcctgagcatgcccccacaggtattgtatgcagaggccagggacctgccagcagttcctccaacaagccaagccccccacctgcatccctggtcttgccctcgctccaaaaactccgagaggcctcccatgccccttcctttccccatgcactgcaggccaacctccgtcccagcatctgtggtgagcacctgtgtgctgccattgctcttcacgtgttccttctgcaccagtgagggaaagactgtttctcctctgtgcctagtgcctagcacggtgtttggaacattatggggtttccaacagcatgagatgatttgaatgaatggttactggggaggcactttcacagctaggcttagttgaacataaaatgtcctaaactggactattatgaagaggaaagttttgtctctggctgaaagcaaaatgcttctccaaacctcaatccttcagatcctctgtgccaggctgggtttcagggcctggggatgcagaggtggacaacatgtctctgttctcatggagcttgcattccagcaaggaagataatgtcacacagtaactagtactgtgacaaggaagaggaaataaaaccaggtatgtgttagggagagccgagaacactagggtttgaggacacattacacaaggtaagagggggaggacaggggaggtgacagtggagctaaagccagaagaatgagaggcttcgtccaacataaaagggctctcttattacatcctagttaatggaaagatatttttgactttgcacccagaggctgcagaagaatctcagaaaatataatctggctttggatatgtctctcactgcactaaaatgttgcctgtggccctgaattatgtaagatgccagagcacgcagcataactgtagagaaacaggaattactctgccaggctctgggaaagccgtgcagttgttttctcctctctgggcstgcgcttcctggaacagccccagcctgcttctgtttggcggtctccgctcacagaggacagtgcttccccagaaggaagctccaggttcctgcacccatggcaggctgtgaagttgcttgtggctggcttcaaggcttcttctcccattcacctcaccttggccagctcagctcctctctgatgtgttmctgatgctcgaatttscctcctgcattttgcctcaatgcatctctggcccgcatccaaagtgatcatcattaatgttctcttctcatggatctattggccagatgatttctgctaaaagatttcactgcacttcccttgtcctcactcctccttccctttttcttacctccctccgagtgctctagctgatgcttgtcctagaccaactgttcctggcacattcttgcagtcttgacaatcagggaaatcgttaatacacacacacactacacattcacattcgtatgcaatgccttctggcattttttctgtctttgcagagtagcttccatttattatatatctacttcctctaattcacctaataaacctaggatgtagacacccttattttacaaacaaggaaagtgatggtaataatagtgtctgtcttatagtgttgttatgaggattaaatgacacaatgcatcataagcacttatgccagtgcttggcacagagctagccctcagtgagggttctgatgattcattgacctctcagtcaccattgcattttattattaactagataaagtagaagacaatacctttaaactagcataattataaaagctaggattcttattttaaagtgatttttttttcactagccattctcaagcctagtttttacaagccaaggaatttgccttcatcttctcatctctatccttagggatacacaaagataaacccaaaggtatttaggatggaaaagaggatgatgaccatccctcacatctgcatgagccctgtttccaagscraagccttttgtccaaggctctgtaaggaccgttctcccaccttcccagtgtctgaggcataagctccttctgaggcctgacttgtatctgtattttctgcctcatcacttagacaaagctatgtttttcttcttctggaggttaccctcctctttttcctcccttcatctccaccacaaccactttgcaaaccctgcacaaaacattttcctaaaagcagcacacacacctcgaactgcattagaacttaggtgcaccacygcctgtcaacagatgtccctcaaaaaactgccctccgtgtcagatgagtttgggaaaccttgtgtaaagaaaggcaaagaggtgtccttgctgctgggcttcacttagaacctctaatttgctaattaaggtggagaacatctccaggaggcgctggacaactagggcatctccaagggatctgaccggagcaccttgggcagggtcgcctttttaatgtcttgccagagcccagcatccttggggactgggggatgcaagttttggtagaaccttctgccatggcatgggtgttggggrcaatggcaattgagtgagatagggaagaacggggcaggagccctcaagggtcagctcagcaaacagcaagtgggacaggcccargtggaaggagagatgaggaagacaggtcttattggggggcaggtattcacaaatcagagagaaaagttacattgcaggaggtggaatggcaagaggcaattatttccaattattagaggtccccaaattctagccacatggctgggactaagaaaagcaagcaaactgacaccacagtttaagaaaagatagacattgccaattttacctcccaccccctgaaatagtggccccggagaaacccctttctggatagatcccaacactgtcacctcctaacttgcagcctaggctggtcactgactgtctggcaatctgactttgcagaatttataacataggaataatgacggcaccctcctcctggggaggtctgaagcttgtattatagaaacaccccaacaagtgcagtacacrgtgcatccattaatgtgactttctctctggtggattgtatttttgcctgtcattatctctggatctcccccaggtcaagaagaagagagattggccctagaaactgccctgatgtacrgagctaaaaagcccctcaacacagaaggtgtcatgaaatcaaggtccaacgttgacatggactttgaagtggaaaatgctgtgctgggaaaagacttcaagctctccatcaccttccggaavaacagccacaaccgttacaccatcayagcttatctctcagccaacatcaccttctacaccrgggtccygaaggcagarttcaagaaggagacgttcgacrtgacgctggagcccttgtcctgtaagctaacaatggtgtggttctttstgagactcgctgtctggcccctgtcttgctaggtgttaatgcccgttatagctttatatcaaagttaaagttccctccaagatctcagaagtgtgagcctcacagggagaacccactcattctgcaaaagcctccactttctttttttttatttttattttttgagatggaatctcgctctgacacccaggctggagtgcaatgmgaygatcttggttcactgcaacctttgcctcctgggttcaagcaatcctcctgcctcagcctcccgagtagctgggattacaggcacrtgccaccacrccaggcaaatttttgtatttttagtagagacgggrtttcactatgttggccaggctgatctcaaactcctgacctcaggtgatccacccacctcggcctgccaaagtgctggaattataggcgtcagccaccgcactcggcccaaaagcctccactttcatcctcacgtctcatgcacagaagtgaacattgaaaatttcaaagcctagagccccatgagttgtgagaattaaatgtaacttcttgctactcaaagtgtggtccatgagccagctgcatcagcattccccaggagtttgwaaaaaatgtagaatctcatgtcccaccccacaccctctgaatcaaaatccatgttttgacaagatcccaagcagactggagtgtacaggagagtttgtggagcatggatctaaatgatccatctcagaaacaggccctctgctggtgcctctcgcccaagttaggaaagtcttttgggggctgtccagaatgaatrgtgtgctttgctttcccattcaaaaagatacacgcgctgacataggccgcttcttaaaacgctgtctcctgtaatctcagcactttgggaggctgaggttagcggatcacctgaggttaggagttcgagaccagcctgactaacatggtgaaaacccatctctactaaaaatacaaaaattagcccggcgtggtggcaggcacctgtagtctcagctactcaggaggctgaggcaggagaattgctcgaacccgggaggcggaggttgcagtgagctgagatcgtgccactgccctccagcctgggtgactgagcgatactccgtctcaaaaaaaaaaaaaaaagaaaagaatggaggctggaaacaaagctgtgtcatctaggaggggcctaggaagaggttttctgcctctgccatctcttgtggggcctctttctcgtccttgcatgcacatccttccaagcattttcatcactgtaaaaactcagaatattttaagcagatcagggtccacgtgctacagcttgccttggggattacaatctcaaaaaatcacatttcctaggatgttcgtatttggtgggcacaacagttgaccacacgatgggcaacacaagtccattggaagaaactggtctctaggcagagaatgagttagagcaggttgcaaaggacctcgatactttggggcaccaatttctgttggcctgacatggggcactgaagagaaaagtgtacaaataataattttgacaaagcaaaggcaagcaaaactaatacgctcccctgggatggtcaagccacaagtctgaattgctctcaagctctctggattttgtggctgtcacagatcatggtccccttactgaggttttggaaaatattcccagaaaaatgagaaactattttttaaaatcctaattccaaggaacttactcaaatttgaaggaagcaaatctccccagcttcagtaatggagctaacaattaagaaatcactatagtggggccaggcatggtggctcatgcctgtaatcccagcagtttgggaggctgaggcgggtggatcaactgaggtcaggagctcgagaccagcctggccaacatggtgaaagctcatctctactaaaaatacaaaaaattagccaggcgttgtggcaggtgcctgtaatcccagctacttgggaggctaagacaggagaatcacctgaactcaggaggtggaggttgcagtgagccaagatcgtgccactgcactccagcctgggggacagagcaagacttcatctcaaaaaaaaaaaacactrtagtgttttctttggaaactaaaagctttggcacttttcctattcctagggtagtaaaggtaattttcatggaaaagaatagtcagtgtaaaggactgaagaggacaacagtcatggggattgtttaaaacaggcagccacatttgatttcagagagttttgcaaatagacaattctggatgtaagcgatgactgtgtcacctaccagctgtgtttcctgagcaaggtacttaagcactctgagctgtctctcctcatcygcaaaggggaaaaacagcacacacaccccggggttcttgattcattcccctaacctttatttagtgcttgcaagtccaggttctgttttatgctggagacacagcaatgcctattctkactgaatttctgatctcatgggggaaccaaacaaacaagtgaatctatagtatagttatatgggtaatagaaaaatacaaagcaggttaaggaaaacggggagtacctgtggagatggtcagaaaaaaaaccctctctaatggggtgacatttaacagagacctgagtgaaggtcagaagtgagcattccagccagaagaaactgtatgtgcaaaggccctggggccagagcatgtctgatgtgttcaatgagcaggaaggagccagaatcaggaacaaaggtggcaagggggcagtgctgggtgcagaccatataaagaattgtaggcctttataaggcctttggtttttattttgagtgagctgaggagcctttagagagttttgagcagaaatgtggcataatctaasttaggttttgaaaagaccactggctgctgtgttgagaagagactaaagaggaagtagggcggaaggttagagactggtaggatgcttctgcaatcactccactgaaaggggttgatagcagtgatggaagcagcgagaaccagtccgatctgggcatgtgctgaaggtggagcccgcctgattggctgagagactggatatgtggtgtgagagaaggarggtatggaggaagccaaatgagtgatgaatgtgaaatgtktgccacatggtagaatcttagtaaatggtaacttccaacatgtttacatttggggaaactgaagctcgagagatgagtcgatgtgttcaagcccccacacagcaatgagaggcaaagcagataatagagtagacagataatagcagtgacagtgagccagttcagggtaaacttggccccaagtgggccaggtcccttccttgtgctcccattacctggagtctagcacagatccttagacaaagaaccaaatgccagcccttttcccacctcacaagtgtcctgtctcataatctccttccccttccctctttaatccaattaaagaatgagcttgtatgggtgagtagaatgatatcattctctcagtcatcgacctagggacagctgaccaaacctatgcctgagtccataggaacacatctcccattcgcttggccagccccaggttgtcctgaataacttgaagggaactggagactctttgttcctttgccctgcaggcaggtggtattaactgtgaccaataaattgtatattgaaatataaattaaattgcagtgtattgcaaaaagccacataacttcaggccttgatcaagcattcttagatgcctctgctgcaaagaaagctttccaagtagaatgggaggcatactttccagattgatgattaaagggaatgtgtgtgctggaatcagcttgggagatctgaataacttaaacctctccgtaccttcaaaggtgctatcatttccacttggctatatttagttttctttgctttttggaaaagagatgaggcagctccagtctgtgtctcccttggctttccccagacaccgtaaatgatattggcagcatcccagccctaccrctcatagagcgaaaacctattcctccttctcctgccacgtttaataaactttatctagaacaatttcttgtgcagtggcaaaacacagcacttacataacatactatttcagaagcactgttctcttgggctctgaagcacagcctggtttctttagtgctatgatttagggagtgttctacctcagagaagaaaggggtcctgatactgagattataaaggtagcaagagcctctgtaaagaaatcatatcccattagccaaaagaaatccagtggtcaaacatagtcctctagaaatagtcagargaagtcattttattattgttattactggaaacagctagaggcaaaaggcatcttcttcgaggccttccaccttgccacttcatccattctatctagagacacgataaactgaccatttgtgctcatctgaggctgtaaccaatagagggccagaacctcactcatctaaacaattawttgcaaggggagccatggaggaagcagggtccaggcttaggtccaaagacagcaatacgagagcgggtcattccaaaaggcaggacctgggggccaaggtcaaggcaaggtcatagctttaaagagtcagctctaaatggaatagctctgccccaggaatcaagccaacaaagctagctctttagcgcttgcccaaaataggccaatacattctaataatccacctgccctatgcggggtttcttggtttcagcaccattgacattatgggctggatactttgttgtgggactatcctgtgcattgtaggatgtttaactgcatttttggcccctatccaccagattccagtagtaacccaccctccaccccagttgtgacmatcaaaaagttctccagacattgccaaatgtcccctggggataacattgcctcctattgacaactactagtctaggatgaccaacctttctagttttccagggattgatggggttctcaggatgcaggcctttcaatttaaaacccaggtagttctcagtccaccctaactctgccctaacttaccccttctgctgttagaacctcctgtctctcagagtatctcacacttcartaggcattgtctggggtcttattcaaatgcagatcctgacttcactggtgcagtaagaagtcagagaatctgcatctgtaacaagctcccaggtgatgatggtgctgctggtgtgcagaccgcaggaggaacagcaaagacctggactggaaagccatcccttccactggaacccaggctgtctgcagggctgattctacagggatgcccctggttgttggagtggcccttctcaaccctggctgcacatcagagtcagctgcagagctgttaaaaatacagatgtctaggtcctccaaggctctgatttaattggcctggaatgagagccagcttggtaggtctttaagggtccccaggtgattgtgatatagagccatgactgagaactcttcaatcagaagtcctggaagcaaggcacagcacttacgcatctgyaaagagacttccaaatagaagtgctgcccaagacagaggctttcccagcctcttggtcttcaaggtccagagcaagctgctgcagatccatcgcaggtgtgagagttcctccacagatgatgggcatggctcaatgcacccacaccttcgagccagtggggagtcaggggccctgccctctgctctggtgcatgcccatccacaggcaccccaccctgctgcaaaactgctgttcagtacagcaggctaaaatgaattaccctctgtgctcaaactgttggccatgaagctgtttccttcaataacttccacaggaaggggaagtctttggcaaaagccagaaactgagaaggaaagcagtaaagacattcagttctgtgaaggttcatagagtctgttctctgtggctggggatggaggaatgagtcacccattcacctgcggagtctgccagctgtcggcacatacaggcatctggctccaaccaggtagcagtgggtgcacacctgggctcagcctacagaaaaactgcccattgctctctagaatcctggacagtgggaaatgggagttagagagaaagtgagccagagccacaagatagaactcaccatcctcagcccagatggtaattggaggggagccaggaccactctccatcttccaaatgccattctcattggcttgtccccaggacctagaaatctgacatcagtgactggtttccattgagaaaacaattgtttggcacagaggtcttctaaatcacaaacagaggttcggagatagttgaatgcctttggtagaaactggtttcaacagcttccttctcttaaatagaaaaatcatatcagattggagagaaaatgtggaatgctacagagaaaatgtgtaggtagttgacaatttagtctgagtgtggcccatggcctaggtgagacacttcttatttgacaagggatcctatgtggaatgggggccttggacttcagcaccccacatgttccattttgggatgatcccrgcccaaatcaaagccaccattaaaacccattggtccttctttgccatgaaaatcacatcttttccatggcatttcttttacaacagcaaaagaactgtttggaaggtttgacacattttctccagtgagacttcaatgaatattaaatttccagcacattctttacctaagaagcaggacagcttatccccaattgactctttgttccacttgccccttacctttgctgtgttcctggtggcttccaggctaatgtgggaggggtagggaaacttggagaaaagtaaagcagaccctgtctcaagtcttgatgccaggcctgtgtgtgttttctcctactagtcaagaaagaggcggtgcwgatccaagccggcgagtacatgggtcagctgctggaacaagcgtccctgcacttctttgtcacagctcgcatcaatgagaccagggatgttctggccaagcaaaagtccaccgtgctaaccatccctgagatcatcatcaaggtcagtcttagcgtctcatcctggaacagagacaaaggcacgcagacttagtgttcatgtgtgcatatgygtgcttgtatgtgtgtgtgtgtgtgaatgaatgtcctgctcaaaaaaaaaaaaaaaaaaaataccagtgctaggatcctcttgttctttgaaagaagtaaactgccctatatatagacacatacatataacactttcctctcctctccagatttaaatatatagatgtggctgcagatataaatataacctgtgggtataaacacacttgtggaggaagataaagatgtgtaatggctacagatacttagaactttcagtgtctccagaataaagtgggtcaggcatgctataagaggtagataaactgcctgcaacattttggacagtaatattgtttatggaggtataattgtggatagtagattgcacagatcaaaatatacagcttgatgatgattttgtatgtgcgtgtgccttgcaaccacaagccagatgaagaaatggaggatttccaacacccctagaaggttccctsttgccttttacagccaataaccccctagactatcaccaagatagtaacttttctgacttttatcaccataggtttgttttgcccatttgaccagtagttttcatgatgcctctccagtgatcaccagaaatctctgcccaaatggctcaagagacttggcagaggaaggccgagggttgatgakagtggaagataaatgtgggagcctctgtgctcctacttctcaggcccacagctgtagcttctgggggcatctgtggttgcatccatgagacrccttyctgccctggaagcaggaacccaggcttctggcagtgaccctgaggagtgacatctcatgcagcccttatccaggtcttagagcccttccctagtctctggagaacaatcttcttgaagtgattaagagcaattagcacagatcctgctaaactacattgctctaaagtggtagataaatcaaagctttataaagttgatcacattttaatggtcctagaggtgggcagggtgagggtaggtagtccttgcttctcgtgaatcctttgctgtgagtcatttggaaagccaatgactgctgtgcagcattcagaatggcagtgtttcttggrtaactactgggctccagacgctgttcttaaagcactttacatggttgcattttcaaccaccaacaaccccacaaggtaaagagtactggcatyactttacagatgagaaaactgaagcacagagaggttctataactcctccaaggccatacagccagcaaatggcggagctgggcttccaaccccagcaggctggctgcaaaagcagggctgggaaccagctccttcaactgaacgttcttatggtctggtcctgtgtaattgacacagtgagccaccccaaggcaagtcccacccaaactcacgggcatgtaatgcccatcagggagcagaacaccaggcccttcttttctacaaaggcctacattgtcatgtctctttgtttccttcgcctctgtcatggcccacaggcccaccatggcgttgtgtgcacaggacgcctgaaaagaatgaaaacgaggctgtgcagggttggcaggcaaagggagaaacaaatgcaaaatggagaggtggggattagggttgctgcagaggtaccatcatccatgagaacgtgaagttaatagcttaaggtgcaggatgccctaaccccgaagctgttcttcacagctggctcttcctatagacatgtgggaccccctgctgcaggcctgtcccagctgcttggtggaagcagcttttgctacccttctgggctrttgcgcaggtttcatttatgagctcaaccctgaaccttccctgacagcagcraggcctgtgtgcgtacctaattatgaagtgacggcctgtccctgtgaaggtctcaggagagaggcttcccaagctgtgaagtgctcaaaccacagcagaaaatagaatttaattgcaccactgataataaaccggatgkatgaaggaaactgataactttcatcttttaggcactattaatttgcaggattatttgttagttatcttctgggtttacttaaagagcagtttaattccccagggcacaatcagaataccttatcccacaagttagcagacctgggcatgtagagagtactttaaatggagagttrtattgttttgtgtttccttccacaaagsaaccagagatgctgttcctggaggaaacttatttagaggtagggacatttgatagggaagagagcatgagagagatggagattctggcttctgtccatgccaagtttgttcaaaaaggtggaatggggcatcatcccataaactgtcctttaaccattagcccaactaactccaaggataacctaaatccaaatggagtagaagtgctcctgggtaaagcactcacaccctaaggaccacccaggagtcacggagctgtgagaggccctgagtgcagaagctccggcctgtggactggggacctgcctagcctcctggagaggtgaaatgcagagtcatagcaggggagggaaggagggaggggaagggagggagaggagagaagaacagaggggagaggagagaacagaggagaaaaggatggagggaggggaggggaggggaagatggagaggagaaaaagaggaaagaaaagaggaaggcacaggaggggagaggagagaacagaagagaagaggaagggacaagagggaaaaaggagcgagaatgggggggagaagagaaaaacggggagaggagagtaataagaaaacttcaagttgaaatattccaaaggaggcctagggagaggggtcagataaattgtataaaacacaactcaattaagagttattttttctccttccttccttccttcctttcctgtctttctatttttattttagatttgagggtacatatgaaggtttgttatgtagataaacacgtgtcacaggggtttgctgtacatattgttacatcacccaggtactaagcccggtacccagtagttatcttttctgctcctctccctcctcccatcctccccactccagtagaccccagtgtctgtttgtttccttctgtgtgttcgtaagttctcctcatttagctcccacctataagtgagaacatgcggtattacgttttctgttcctgcattagtttcttaagaattatagcctccatgggctttttttttcatatgcttgttggccatatctatgttcatgtcccttgcccactttttaatggggttgtttggtttttttcctgtaaacatgttcaagttccttatagatgctggttattggcaacatcaccaatcatcagagaaatgcaaatcaaagccaccatgagataccatctcataccagtcagaatagctataattaaaaagtcaaaaaataactggtactcgtggggttgtggagaaaaaggaacacttatatacggttggtgggagtgtaaactagttcaatcattgtggaaaacagtgtggccattcctgaaagagctaaacacagaactaccatttgacccagcaatcccattactgcgtagatacccaaaggaatataaatcattctatcataaagatacatgcacatatatgtttattgcagcactattcacaatagcacacacatggaatcaacctaaatgcccatcaatggtagactggacacaatgcagccatagctgtaaaaaaggatgaggtcatgtccttcgcaggaacacgaatggagccagagaccattatcttagcaaactaacacaggaagagaaaaccgaatactgcacgttctcacttataagtgggagctaaaagatgggaacatgtggatatatagagggaaacaacacacacagggtcctattggagggtgcagggtgcggcgtgggaggagggagaggatcaggaaaaataactaatggctactaggtttaatatctttgtgacaaaataatctgtacaaccctcatgacatgagtttacctatataacaaacctgcacatgtacccctgaacttaaaataaaaggttttttaaaaatgaggacttggaaagggagctaaatgcagtaaaagtacgaaaccacaatggctcagaggtccagaattacataggatatgtttctctaaattctaagaaaacgctcacaccctttttcaacctctttgagcctggatggacacacaactgactgagcctcaaggttgctgtgggcaaatgtgccaggcacagggtgaaattatgtgagagacagagaggagaccacagcccttcctgctcagctcagtcaagataagggttgggaccagcccctggtgattatgatgacagcagctatgatttattaagcactacattattaaacgcctctcttctatgatcttatttaaccctctataccatcctacaaggaggacgttactataaccctattttactgattagaaaactgagaggaccagagaaggcagtgccttgtagcacagtggtcagaacatgggctctggaaccaaatyatctgagtttaaagcttgttttctgaacatcataactgtgtaaacctggacagatcatttcacctctgttggcttctgcattctcatctgtaagtcaaaagcaatggtaactctcctcctggggtccttgtgagttttttatgagtcattggatgcccgagtcacagtgcacacctacatatgttggttgctgctattattgccattattgctgtttattagtaactggcccgtgatcacgtgcctgttgagggaaggagagacacttctggcccaggtcttcctgacttggaagcctgtgctggcagccgctgggctacaatggaactatcacaaaaagcagaggtggtcattgactttgcagagagttttgtattcaagggaggagagatcacacacacttgagtggtgtgggacatcaagaattaagactgtagaaagatgaatggtctccaatgaacagataacgttcaaccagtagagatggatggagagaccccttcagatactaggaagaaaatgttagcaagggctagagggraggtggacggcagtatgtagagcagtgagaagcgtgycttggctggggtggaggctgggagcagggatgagtaagggtaacctgaaaaagatagcttgaggctatgtggaggggagtctacaattttggatgagagctttatcatcgactctctgaacaaagaggcttcaagggagtttctagagtgggaatgtaacatgattgtcaactctgctctcccacaagtcggagccgctttttcttcctcccttctcttcaaagcctttgcccaaagcattgtcttctccaggaagtacccaactcagccttggaactggagtttcctaaaagctagtttccagctgttcttacctgattcccctttagatcaaatctaggccaatctggaacaatactgggctcacatgtctgaatccaagtcaccgtcaaccaaagcaggccagtggcttcctgtttgtgcatcccagtggacccagtcgtggatttyactggtccctgtggtgataaagatggggcctgggctcaatagtgctcccagtcaaccattcccagcacccaccatgtgtgagtcagagtgtgtgatcctcacatggaaacaggcagagagagacagtcattaaactttaatgagcacacgtctctttccccatgctatcaaaatattttgatgagaaaagaaaatttcattacaatcagacatagaatttttctctgccttcccatgtgttgcttgttctctctctctctctctctctctctctcacacacacacacacacacacacacacatcctctctctgaacttcagtatcccctttgcaaagtgaatacactatgattatactgctccttctattaagtacagtcacatataaaacactgcactggggggattgacatctgtagcaatgtttgtgagaatgcatggcccacgtccagacctagtagctgttggtaaatgttctttctcctctgtagtcccatcaatgcatgggggttgcttagggcagcatgtgggccactggcctgaagtgggccagtggcctgagtgtggccctcacctagtggcatggaatctcttgaatctctggtcaccaggtgttgagtgtatgcagcattccctgtggaatggggccttcctcatgcagggaggcccgccttggagatcctggagtaaggcctaggggagagaggagacactcacatgttcctccaatgatctctactcagtacctgccattctaaagcagctcaggagccagcacttgtgtggtattatcatgtggaaaaagtcctgcagcctttgcaggatgtcaggaagcaccaatagaactaattttctcatgtgaactaggaacaattttgctaggagaaaacataaccattttttatgtgtgtgatttttaaagttacaagcataagcaaacagatgtctccaaatttttcaaaaaaaaaaaaagcttttaaaatgaggacaattgactgtttccaagagtttttaaaagtaagcgtttgctctgtatttattttgtccattagctgaaagactttctagtttttatttatctctttatttagtcactcttgcattcatccattcttcatatagttatttggtgcccactctgtaaataaattgtagcaaatgcctagagctttcaaaaccattatcagagaggccgggtgcagtggctcacacctgtaatcccagcactttggaaggccaaggtggstggatcacttgaggtcaggagtttgggatgaacctgaccaacatggtgaaaccctgtttctactaaaaataaaaaattagccaggctgtagtggtgcgtgcctgtaaccccagctactcaggaagttgaggcaggagaatcacttgaatccaggaagcagaagctgcagtgagccgagatcccgccactgcactccagcctgggtgacagagcaagactcaaaaaacaaaacaaaacaaaagcaaaacattatcagagaaaaattcaacagtgagaacattttctttctttccttttttttttttagatggagtctcactctgtcccccaggctagagtgcagtggtgtgatctcggctcactgcaaccttcgtctcctgggttcaagcaattatcctacctcagtctcccaagtagctgggattacaggcgcccaccaccacgcccagataatttttgcatttttagtagagacagggtttcaccacgttggccaggctggtctcgaactcctgacctcaggtgatccacccaccttggcctcccaaagtgctgggattacaggcgtgagccactgcgcccggccaacagtgagaacatttttgttgcatttttctgaaatggggaaaggttgcgccactttctttcagcactggcccacctggaacagctccaggagtgcagttgctctgttttaacctgagctaaccagcacttacacagagcctggggtgctcctcttgcaaagacagtgtacatggggcctgtgaaagakgcttaacccacagaaatcgacttcaacaagcagaatatctgcatgaccagcactgattggtggggaattgtatagataacacaagatccatgggaagtatcactgttgacccyggagaggaggcagggaccttcctctgggcggcttccctccaggccagcactcacccctgtgcagattgtgcccatctgcaggtgggaaggagacagtgaggggacccagtccagcccactcgccaaccatcaagccctgcagcctggcatggagccacatccccccaaaaaagggggttcccttttccactttgcacagttgcatcctggctccagccccatgtccagatctcttccaacttgggacactagcttgttttttcttaacaaccatcctaatgttgtgttctaactggagcttttcatgagatgcccacaatttttaccgaggttaacagtagaatcctcttcagtctccctacggctcacaccctggaaacccaccgggatggaccaaggaagggtgggtggctgtggtggctgctgatctcactcctcccacatcccattcatacaactttatcccagaggacacattaaaattggggaaaccactgggcacggtggctcaagcctgtaatcccagcactttgggaggccgaggtgggtggatcacgaggtcaggagatcgagaccatcctggctaacacggtgaaaccccatctctactaaaagtacaaaaaattaggcaggcatagtggcgggcacctgtagtccctgctactcgggaggctgaggcaggagaatggcgtgaacctgggaggcagagcttgcagtgagctgagatcacaccactgcactccagcctgggcaacagagcaagactccgtctcgaaaaaaaaaaaaagaaagaaaaaaaggggaaaccacttgagatataatgagtgccccaaacaaagtacatgacagtgactggctacactgtgagacttaactgtagtttcatttagtgctgtaaatatcacaaacttcattaaggtggaaaatgggaacagactatgtgttctaattattgctgaaccctgaccattttcccctccatgtccacaaccgagcacgttctctctccagcctcctgyrctctctgtggctccatcgcactctcgtcaccaagattcacccctgcccacacccacacccttcatggggaggccggggatgggaaccaggaggtgggcttcttcacctctcccctttgtggctctcttctctaacccctgagaaaccgaatccacgtcattctccatagaagaccctataggtgaggaggttctcagggtcaccctggcaacatgttctccctttaaacctcatatttcattaatgctagtatgtgtcagatgctctgttgtatgatattacattgagtcaccccactaactgcataagaagctgaggcccagagaagtcaagcgacttgtctaaaaactcaaagtggcagccccggtcttcagcccctgcatccagcttgctctcccttcagcttggcctggaatagcaccactgtgtgcatcccagtcacctcagttatgtccgtgacactgtttcaggttatttgtggagtaaatcagaggtatctacctatgagtcctgagggactctgagcaaggaaagcctgcttaccccaggggaccctaggaggggacaccttcagccctgctcccatagctgactctcsatcccctcgtggctactttcacagaggattgtggccgtgggaccaaaccgtgggtgcccttagccaggatagatgatcgtaaactatgtctatgagtgagccctcctcatcgaaggtgttcatttccatctctstcttcaggacagctacagaacagtrcacattttagaatgaaaatgaggagtcactggtaactgcggtacctaaaacataatttgctctgtgcatttcatgtttgctatttttttgaatcttaaaaagagacacacatgagaataacsaatctcacattccagtcctgtaatcccagtatgtttgggctactgattctctttttaaaagtggcatctytcatttttaaaagagaaaatcctagatagtgactcctattatcatcaagtaatatatatcaaggccccaaggctamcttgtcacattttactctggcatagaaatctaattccttctctataaagtcaaaaagagagaggtgagttatagatgttttctaatttagttyagggtcaacttataatcctcgtcctcaactgatggtttagcgataacttaaaaggtgatgctgcaaatgattctttgctggatttcagaaaataaagaagctattccagcaaaaaaaaaagtttctatttttacctstattctgtcagggatcacagtatakgtagttttgaagatgaawgttttagagtcagaaagacctggatttatatccaacttccgccagattcctaactctgtaggctttttatttatcttctaaatttcaatttcacgtaaacagaatgggattaataatcatgtctacccccaagaccatagggctgtagagaagattaaataaggtagtgtaagtaaaytgatgaacagaatgcctgcattactaagtaaacactaactaaataaatgtaagttacttgttattattgttgtcattaaccagagtcaggatcacgtgttgctgagcaacggctatggccccagactgtctacatttgaatctctcctaccctacttactaatggtgtgaacttgagcaagttacttaactcctctgtgcctcagtttcctcatctataaaatgaagactcctaatatttacctcttagtgttgggaggattaagtgagttgatagaactttctagggtaatgggaacattttaaatctgctccatccaatgcagtagccacgagccatatgaggcttttgagtccttgaaagatggctcgtgcaactgaggaactgaattttttacatttcacttaattttaattaatttaattataaatagccctaggtggctagtggctactatattggaaaaatatagactgagaacatttcctaaccaccctagaaccattagcattggtcagtaagtgttcatctaagtgtcagctaaaagcaggggcagtgcctgtggtgatgagcagagtttgcaaacaagaaattgcccattatcaaaaatgatcacaggccaagggggagggaaaaatacagtttccagaaatacgtgcaatacatgattgaaagtacttgaaataagagctgttaggtgtgctaataaatcatgtatttcaaattgccaacctcacttattgttactctttctcaaactttttccttcatttcagtttcaattttgaatacagttatgtatttttaaagcatatgcttagtggaagatatcttgtgatttctaaaaaagtaatttctttccaaaaagtttatataagagaaagagagtatgtgtgtgttagtaactttcytgtttaccaaagaatcagagtagcagctcattatcatgaattagtataaaggacaggaatgtcaatatcagtaagtgatatgtaacttgaaaaagcataytacgggttgatttttttaaaacagagagagatattttcaayagaatattgagaaaaacttaaggccatcaagtatatgcaaaagcatttgacgtcaccaagtaagacatatgctttattcttttctctggcccaagtaatgaatactcttctctaaagcaaatacacataaaagtttcttcttgaactaaccttctctaaattgcctgaaggctccctttatttaaggttttatgagagcaagaaaatgaaaaatatgactgygaaaatgaaatgaaaatatgactatgcagatatggaattatgctttcagcaataaggaaaagggagctttgcagattcctaaaataatgtgatgcaaacagatattttctccccaaatagtcattgttctcagcattttgtaggtaccatarcatggtgcatcactgaaatcaacacataacgtgaaaacactatgtgttggcagcattttcctcaaaagaagcaaggagagggagacacctycagttacatttcccaagcagaacacastgatgtcgagcattgggtaggtttttacatttagtttggtttgagtgtctaaggctcattatcatcagtagtcagggacaggaagtttacattctcggtgcaggagacaagtgtcagaaaagggacactggtctttgttaattgcaaaagaaacacactacaaccagagaagggcttctcctctcacccctccccatccttctccctgctccccactccagcatcagggaaatctgggcagaattgatacacccatgccagcatctaattacagagacaatactggaagcaaactgattaggcatgacatatgaaattacctgagaaggtttaatgtcctgaacatattcagatctgaagcctatctatgatggcccarttgcatgggccagtttctcaaatactaagcattccttctcactgtcatcagtgacctggaagggtgtatttcactttccacagcgtaggaggcttcatgtagagccagtctactggtatggraagggttcttaatctagggttcaygggcccctagaaaaccatgtatggacttcataggtctatagtrcatcccctaaaaatacatgccyatattgtatatatcttgtatttgtcactgtgtatgtctgtgtagaggaaaggtcagtagctactatcagatatacttttgaaggggcttatgcccatccttatatagcataccatggagaagacagatggctccaaaatattttttccagaaagaatawagtgatcatagcaaacacttttgccaataatgtctctgtggcagctccatcttcttcagtttagagagcttttgtaaatgctatctttattttgtattttttaaatccaaagatgtttttgaaatgtttcttaatgcaggaaaaaatatattggacacacttgagaatgaaatcagggacaccatgtaaagtattctgawgtattgctacaccttcaatatctaaattgattgaggcagggcctctgggaagaaagtgaaaaattcagtctgtcttccacatgttttgtctataccagtggtttccaactggagggcaattttgcttactaaggaatatttggcaattgctggagacacttttggttgtgatggctggggtgcggggctgctcctggcatgcagtgggtagacaccagggatgttgcttaacatcgtacmtggcacaggacagctctgcaacaaagatgcatccagcccgatatgtcagtagtgttgatgctgagaagccctgatctagatcatgattastgtttttgccacagccttcaaaccaggcttctctctccacaccccatgtgccagccagcctaaaagtaacttctggttcatgttctagtttgcctgtcattgaaccagtctcctccccattaggccttatccattctcagtcttgtcagtgtggcttcaaatccaatgttgctcccaccggtttgaaaatctcccttactttctgactgccgttttttttttttttttttggacgtcagtacgaaacagttttggttgtcttgttattgctgagttgttggcttttccagctcctctgacctcagagtagcactctatcttagagttcaagatctccagttagacagactttaacttcaatcccaccttggtcatttggcagcttcaaatcctcattcaagttacctattttcctgaaccacagttttctcttttataaaatgaaatgcctggcaccagtgatcctgccctagaaaacctccttcttcttaagggaataactattattatagtctgatcgagctgatacaaatatagcccttgtgttgygaggcttatgtgagaatatatgtgaattatggttgtcagctggggctggttctttgtaatcaacaggggtgcctcaaataaatgaattacaggatccacccattaccagactgaggattgctggttaaagtgctggactccctgcctggcacacgatccatgctgtctaggtgcacctgctgttgttgctaccatgaccatcgtctgccyctctcctagttcccctgaayccagctctccaccactgccctccaggagatgcggatttaaatgtaacaaagtttagggagttggctgaaagtttcgtttttcttatagacttaagaaatcccatagccataaatttagtcacaaagcatggcttgatgagtaaagccataagagtgtattcttcttttaatcgatatataataattgtacatatttatggggtacatgtgatttttcaattcatgcatacagtgtgtaatgatcagatcaggaagattttattcttgactgtagcataagtaagcaagggtcctcttctctgggcaatgtccttcctctttacgtccattcttaaaaacgsctcatttccatatattttctcccatattatatagtggctaaagraacatggaatagtaatggctgtgttgtcatmtggaagatccagacatccagtaaattccatttytgagccattgacttaatttaataaatatttactggacattggtattgaagtactaagtattggagttaaaagtgggctgaaatataaggtgaataagacaaactacccagagcattgctaccctaaaaagcatcaactgtaatgcatygggcctttgccatgtgccttgcaatatgtttgccgttttatgagcatttttcattccaaacctttcttgcaagggaagaactattattcttatcttattcccaagttacttagagcttatacagatccatycatttggtatacatagctcctaaacaaacaaacaagtcttatagccacctggcattttgcggcacattgcgtttatgttggaaaagcatatggttctraagtgtgtggcatacagtaaacacagcttaaggtatagtaataataagagcattctacatagatcgccccataaaagtgtcagcccattttaaagacaagaaaactgagtctcagaaagcctaaatcacctgagtccccactgttaataagtgttgaacctggcactgagctctggctgtctcctgtggtgttcttccaaatacctgatacttctgagagtcataatagatcaactcaccaacaaataaccttttattttcctggactctggtactgtggctgtagaagaaaaatctcctttccttattttagtatccaggttcctcttcatgttcaacagtaaggactccatccttggcatatttcttgcgaatgtgtctaaaactaagaaggcacatgtgccctgaagcattttctacttcttaaactcaggaatcccctttgttccagcaggaaacttgatgcctatccagaagcaaagttcacttggccgccctcaccgtggaaacgtgttgccacaccaaatgaacwtccccctcctgctgtcaaagagcagtcagtggccaccgctattgacctgagctctaattagkctggttttataatgaggaaaagagtgygattctaattagtaaatttccatctctttctcaataggtatcctccagtcaaagcaatcagctatcctcatcacactggttccattgccaaaaaaataactgtatcataaaactctagtaaaagtgatgatggttaagacaacaagagagcagaacgaggttttatttgstgctaatgacctgcattctctctcttaggtccgtggcactcaggtagttggttctgacatgactgtgacarttsagtttaccaatcctttaaaagaaacccygygaaatgtctgggtacaccyggatggtcctggagtaacaagaccaatgaagaagatgttccggtaaaccttgggttggggagaccgggcaggcagtgcagrgctgtgggaagctttctctgtgtgtgtcttttccaaacatagatctgctccccartgaaaatgtcttggaagctgcctcctccttgccgaccatttctgtagggcgtggagtaaaactagggttggtttgaccagcactttcatcatttaatccttaaagacaccctacgatgtagatactgctattrtctcccttctgtagctgaggaatttgaggctttgagaggttgactggttacacaggttcagttacacagtttatgaaaacagagccaagattcagactcaggctggtgaattccagaacccaagtttgaaccactttgctgtactacctactcacgtatggtctcttctcatctttattgagctcctaccacgtgtcagatattatgctgagagatacccccttttcatgggtgctttgtctccagcctcacctcacagattttaccatcccaatcagtgtctacaactgttggattcaggtttttttttagttgagcctaaagagctctagatggttccccattcaggggaccaaagacaaccccaggttctgtaatgatatgaatgaaactcagcctcttccacacacaggccacttcaaattgtgcttgacaggtctcagtttctgtgacttctactaacaaagagtgtgacccaacaagataacccattccatggtcaggtarctctaacagtaaggaaacakgtttttctaccatttgatcctgccaatgatcctaattctgccatctggactgacagaaagtaaggcccatctcttttccatctgatggtttgcaaatgtttgcaaacagctgtctcatcttccttgaatcttttctacctggggacaaatatctgtcctgactttatttycctctcctctaacatggtttcagctctctctctctctctcccacacattccaatttgtcactactcctcttaaagtgtgacacccagaatggatcccaatctttgaggtttattactttcatttctaccacagataagtccttgtcagcatcaatcaatctagcacatttcctgtggagtgaccttctaaggcatagaaagggaggtagaggactttggaaactgcctcatgaccagatatgtcaagaattttcccgacaccctttatggaagcgaccccactctggaatctgtgggataaatgcaaggcctcacttataccctctggggcaactttattgcccataaagggctctccgcatttctttcaaattacaatgctcrtagcttctgcatctcatcatttaagagatgccttattgcagatgcaataaacaacagagaaaataatcttagtgcttttgaaacaacgcaagcacaaaacatagcaaccttcctgtgctaacaggaaagttacaggaaaaaaaaataagtaaattagtaatcaaccccagctacatagagaggtcagcagccatacccctgctttcgtcagaaacgacagtctcactcacccattctcgcaccttcccactcaaatcagatgcaagaatcgttcaggcaaagtgaaacacgtttcctcttccatacagccccctgctgtatccaactttttccttcccagacagtaaacccacaarctttatctgagtgtacyggaaacttctctatctttacaccttggctatccccctagaattccaccttggtcaaggccaacacatgaaaaaagacactgtgtgtcttagacaaaagatgaattattacacagtgaattattacacagtgcaatgacccactatttgggaggcctcaggctcaaaataggttaaatctccagatggtttgtttattgttaatgtctgacattggagtggagcaaagtggagtgaatcgggaraaaggatggataaggccagtcccttcttggacacagatgtcctgcccacacactggcttaaggtactrttagtagttactgcaacacgtaagtctaggcagacaagtagatagacagagagctagctgctcttagtcagtttgagctgctgtaacagaaatgccatagactgggtggcttatacaacaaacatttatatctcacacttctggagtctgggaagtctgaggacaaggtgccgaccaattcggttcctgatgagggctcccttcccagcttgcagatggctgtcttttcactgtgtcctcacatggggcagagagagggagggcaagttctctggcacctcttcttcgaagggcactaatcccatcatgagccccaccctcatgacctattctaatttagttacctccccaaagctccatcgctaaatggtatcacactggagtttgggtttcaacaaatgaatgtgtgaggaccacaaacatttagtccgtaacagtcctcaatctctctttttaagttttttttactgacacattgtaattstacatatttatgtggggcaatttgatgtttcgatacatatatatgttgtataatgatcaaatcggagtatttagtgtatccatcaccccatgcatttatcatttctttgtggtgagaacattcaaaagcctgtcttctagctcttttgtaatatacaatacctactgttaatcatagttaccttatcatgcaatagaacaccagaacttattcctcctatttaattgtcactttgttctcattggccaacctcttcccatcttccccttcatgttctcctcctcagtctctggtaaccactgttctgctctttgcttctatggtataataatttttttttttttagtgtctacatgtgagtgaaatcatgtagtatttgtctttccatgtctggtttatttcacttaccatgatgcccttcctccaagtctaattcatgttgttacaaatggcaggattttattctttttatggctgaatagttacagaaacccagcttcagggtggaatatctcccagacaagagaagctttatttctcagagacagtcaaaacttgggctaaaaatcatgacatagaaaacatttgttatctaagatgggcttacaacttggagcaagtgccactttctctgtttactcctcactccagcacacaccttcacaaccaagacctgagccagtccgtgcccacttccatatggtcagataattagaagcactccactgtgccctatgttgccaagatctgatctaggagcgccagatccatgtaacaacttggacgcctagaaagtgcaattccacaaaaccaaaatcctttgcaagaccgtatttctttctagaatacagctcttaaatagttggggaatcaccacccccactcattcacccacaccctgccagatgtggtgtctagaaggcaggggttattgaacccaaagcagagggcctggaaggtgaggagctggtaaacagggaattggagccaggaacaaagaaggcggtgctgtgtctcacccctcactcgcagtgagccaactctactctgaaatggtttatcttcctgctcttcccccactgcctccggcctgtctcagatgtgcagaggttccacctccacagactcttaactttctgcacttgatgcttccagagcgtcaaataatttatcttccagatttattttgctctttagaaaatgatccagttcaatatgttatttcaagagaaaaactcccccactttgtgatttgggcttaaactttaagtttctcaaataggacagaagctaaggtctagamgcacagaggacaaaccatgggcagttgcagtttattgtaataataatctyatttgcctgcgtgcattcaagatgataaatggccggtatctcctgatggctcagcacgttactgagaatcgtttatcacaacatccatccccagaaaataggattactccaacattgctccacttatcaaaatacttttttctctgttatgaatttatctgtatgtaaaatagcatgcatacgtatcttcatgtatgagtattttcatgtatgagttttttcgtatgtacacatcattatgccggatggttttatgagtaagagaaaatgataagagggggctaaatacttagcttctatttgaggtggttrtctacagtacatggtctcaggtcgggtccttaaccagggccactgtttcacaaagtgcttctgattgatcacttgggggaaccagaggagagagaatgaatggatacaggtaacaatagcacagctgttgagaaataaatatcccaaacttatattggtattgaattgagcactgagaattttctctctgcatacaggcaggagaaactttcctaaattatcttgcaaagagttcaatgaatcctccatgaacacttccaggacactcttattactaagtcaaaaagtatctttcctgcttgagaaataaaacctatgaaaaagtaagcacaatggtcagaaaaagccttttcttcttttctttttttatttctataggtttttggggaacagttggtgtttggttacatgaataagttctttggtggtggtttctgagacatttggtcacccatcacctaagcagtatatactgtaaccattttgtagtcttttatccctcccacctttcccctgagtccccaaagaccattgcgtcattgttcattgttatgcctttgcatcctcatagcttagctccagcttatgagtgagaacataggatgtttggttttccattcctgagttacttcacttagaatactggtctccagtttcatctaggtcactgtgaattccattgtttcattcctttttatggctgagtagtattccatggtatatgcataccacaatttctttattcactcattgatgggcatttgggctggttccatatttttgcaattgcacactgtgctgctataaatatgtgtgtgcaaatatcttagaaaaagccttttcttatagaacatatggtgtacacttttatgaagtgcagtgaagaggagcagaaagagtatgaatatgggactcagaaaaacccgggttcaaatttcatctctgcccatttaccaattatgtgatcttgaaaaagggacttcactggttaccttccatttttcttgatcataaaatctgctgaatagtatctgcctcaaagaactgtcatacatataaaacctgaatataatctcccaaggtttataggggaggctatatgtgaagcaccccagagaacactaaatctcaccaaccctgattagtctcagtctgcactgatgtgggcttgttcgtgacactcaggaagacttcagggcaaaggctgggaggaagaggagaacactagaaccatgaaaggctatgtcattagccgcatacattagggcattggcaacaaatggtagcagaaagttgcataggtggaggggcccaatttggtggttgaaataggaatttgaattacagaacatgaagattctcaaagtcaaatggcagcaggcagggctatattccagatgctgagcctgggmacaaggtctatcccaagggagttggcaaaagctaattcgagtgtcagggcctcagcaaaggcagctgggggattcayataggactgtaattccaggaggaaactagtggcaaaaactgagctgaggctcagaagatcagtcacatagataaggctactatggagggcttggrgacaagctagagttcagytgattaatggttggatgggaatcagcccagctcctgatggccactgggaggctggcggatgcatcccagtggaaggaaccatgacccaataagactgtcagtgacaggttctgcagagctttatgtgggggcctcatttggggcataacttgctgaatcagccagtgagagtcttcagtgtcctaagcaccaactgagagaaagaaagcaagtgacttaggcaagagttttcattgcttcctgatcaaagtggaaagctggatcttccaacctctcctctcttttccatcctttcagtgaaatccggcccaactccaccgtgcagtgggaagaagtgtgccggccctgggtctctgggcatcggaagctgatagccagcatgagcagtgactccctgagacatgtgtatggcgagctggaygtgcagattcaaagacgaccttccatgtgaatgcacaggaagctgagatgaaccctggcatttggcctcttgtagtcttggctaaggaaattctaacgcaaaaatagctcttgctttgrcttaggtgtgaagacccagacakgactgcagagggcyccagagtggagatcccacatatttcaaaaacatrcttttccaaacccaggctattcggcaaggaagttagtttttaatctctccaccttccaaaragtgctaagcattagctttaattaagctctcatagctcataagagtaacagtcatcatttatcatcacaaatggctacatctccaaatatcagtgggctctcttaccagggagatttgctcaatacctggcctcatttaaaacaagacttcagattccccactcagccttttgggaataatagcacatgatttgggctctagaattccagtcccctttctcrgggtcaggttctaccctccatgtgagaatatttttcccaggactagagcacaacataatttttatttttggcaaagccagaaaaagatctttcattttgcacctgcagccaagcaaatgcctgccaaattttagatttaccwtgttagaagaggtggccccatattaacaaattgcatttgtgggaaacttaaccacctacaaggagataagaaagcaggtgcaacactcaagtctattgaataatgtagttttgtgatgcattttatagaatgtgtcacactgtggcctgatcagcagragccaatatcccttactttaaccctttctgggatgcaatactaggaagtaaagtgaagaatttatctctttagttagtgattatatttcacccatctctcaggaatcatctcctttgcagaatgatgcaggttcaggtcccctttcagagatataataagcccaacaagttgaagaagctggcggatctagtgaccagatatatagaaggactgcagccactgattctctcttgtccttcacatcacccatkttgagacctcagcttggcactcaggtgctgaagggtaatatggactcagscttgcaaatagccagtgctagytctgacccaaccacagaggatgctgacatcatttgtattatgttccaaggctactacagagaaggctgcctgctatgtatttgcaaggctgatttatggtcagaatttccctctgatatgtctagggtgtgatttaggtcagtagactgtgattcttagcaaaaaatgaacagtgataagtatacwgggggcaaaatcagaatggaatgctctggtctatataaccacatttctaagcctttgagactgttcctgagccttcagcactaacctatgagggtgagctggtcccctctatatatacatcatacttaactttaytaagtaatctcacagcatttgccaagtctcccaatatccaattttaaaatgaaatgcattttgctagacagttaaactggcttaacttagtatattattattaattacaatgtaatagaagcttaaaataaagttaaactgattatatttgcatctgtgcagaagtgaatgcttttaattttcaatataacacactactaatcacaacttcttgagaaaccatccttcctccgcagtagacaacccaccctggataggaaaacaacaagcatttatcctctaaagaaaatgactctaacaggtgttaatgtcacagttttcttcacctctctctttctacattttattaactatattcactgaaggatcaagttgcatattagttcaaaaaccagcttccagaaactataaaatctctgtagatattttctcataaataatcttatgaaccattatggtgaatcagtggatagccagcatggagacctagcataacgaacacatgttatggtcttatgataatcacgtataggagatcctatattcatggcagacatcactgaacaattgtagctcagataagacctcagaatctttctcatttccaggtagcaactagcaattgattttaaactggcacacaatcaatagcttaccaatgaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagctgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaggcctttgacaaaattcaacaacccttcatgctaaaaactctcaataaattaggtattgatgggacgtatctcaaaataataagagctatctatgacaaacccacagccaatatcatactgaatgggccaaaactggaagcattccctttgaaaactggcacagacagggatgccctctctcaccactcctattcaacatagggttggaagttctggccagggcaattaggcaggagaaggaaataaagggtattcaattaggaaaagaggaagtcaaattgtccctgtttgcagacgacatgattgtatatctagaaaaccccactgtctcagcccaaaagctccttaagctgataagcaacttcagcaaagtctcaggatacaaaatcaatgtacaaaaatcacaaacattcttatacaccaacaacagacagagagccaaatcatgagtgaactcctattcacaattgctaaaaagagaataaaatacctaggaatccaacttacaagggatgtgaaggacctcttcagggagaactacaaaccactgctcaaggaaataaaagaggatacaaacaaatggaagaacattccatgcgcatgggtagcaagaatcaatatcgtgaaaatggccatactgcccaaggtaatttacagattcaatgccatccccatcaagctaccagtgactttcttcacagaattggaaaaaactactttaaagttcatatggaaccaaaagagagcctgcatcgccaagtcaatcctaagccaaaagaacaaagctggaggcatcacactacctgacttcaaactatactacaaggctacagtaaccaaaacagcatggtactggtaccaaaacagagatatagatcaatggaacaaaacagagctctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacagcttatacaaaaatcaattcaagatggattaaagacttaaacattagacctaaaaccataaaaaccctagaagaaaacctaggcaataccattcaggacataggcatggggaaggacttcatgtctaaaacaccaaaagcaatggcaacaaaagccaaaattgacaaatgggatctaatgaaactcaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcgaaaagtgggcaaaggacatgaacaggcacttctcaaaagaagacatttatgcagccaaaaaacacatgaaaaaatgctcaccatcactggccatcagagaaatgcaaatcaaaaccacaatgagataccatctcacaccagttagaatggcgatcattaaaaagtcaggaaacaacaggtgctggagaggatgtggagaaataggaacacttttacactattggtgggactgtaaactagttcaaccattgtggaagtcagtgtggcgattcctcagggatctagaaccagaaataccatttgacccagccatcccattacttggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactatcgcaagaacaaaaaaccaaacactgcatattctcactcataggtgggaattgaacaatgagggcacatggacacaggaaggggaacatcacactccggggactgttgtggggtggggggatgggggagggatagcattgggagatatacctaatgctagatgacgagttagtgggcgcagcgcaccagcatggcacatgtatacatgtgtaactaacctgcacaatgcacacatgtaccctaaaacttataaataataataataaaaactgagaaaaaaaaacattaacaactggtgaatgtaagtgaaggatatgtgagtacttattgcactgctcttgcaaatctatagaactaaaattttaaaaaataaaaatttgcaaaataaaagaaagaaaaaaagaaactggcacgcaagatggaacctgtttgtcatgcttacccttagagccagcccattccctttgatagctaggatttcatacatattaatgctatggctctaagagttatgatttagcaatgataacaagcaatgtgtctcaggtagcagcaggactgtgagttctaactctccctgagtctctacctgtgctagtcctcagtgtttttaaacaaatccttattggtgtttgggacttcaaagacaaaagaggggaaacataagaaacataaatatttctgtttctcctgggggatatctcaaacaacctcaacaacaacacatataagatgatagatagatagatagatagatagatagatagatagatagatagatagatagatatagatagatatagatagattgttttgcaaatatttcacctcatcagccctgtgacagaagtaaatataactatctccataattaagaacctaattgagcctaggaagccatctatcatggcaaatcaatctcggggtggcagtgagcagtgaaacaactctggtttcagagtcaccatttgctgtacactgtttaaatcttttgttgcctccttagagttttaagaatgctggcttaagaccaacttcaggatgctttgaagagctgcagtagaacaacaaataaaaatatgtataaatttgtattagaaatgtcatgggaaattgagtttgtgctagactcattggcaatcaaaagtcacaaaatcccagggggaaagtcactgcctatgaacattcgtccaatgttattacaaagttaatcgtcagcgaacccaaccatcaattaattcaccttttcgacaatccagccatcccctgacatccagacaaccatctagccttccaagccatctatccatcctttttttccaacaatccacccgtgcacacatcaggtatcactttagagaacagggatgcaaagataaaaattccatggttcctgcccagaaagagttcataaagcagaggagtagcaagatatttaaacagataatccacaaccaaataatagagctatgcccagggtgccataggaatgaagacagaaagatgtctaaagaagccttcctcaatgtgcccaggaatcaaggaggaaaggttcagattgaatcttgaaaaaataataggtaagttggagaccatttaacaaagaggagctcgtgtaacaacatagagagaagaccatgaacatggcccccaactggcttgagatggagagatggtaagtgtccagtgagaagaggtggggccgaaaacgcaggaatgggtcagagttggagcacttcccgaaatgagaatttgtttattctcgtctgtattgtagagtagaactaagagaggctgctaggaacaaactagatacaaaactaaaagttatgcgtggctcaaggagtgacagggccaagaaagtagggggtggaatgccctaactcaggccagtgaagaaggtgtcagaatgggggtgtggccacagttggattcaaggaagggaaatgagacatacgaggctcaagtggataaagtgggagagatagcatgtagagacagagagctgtctatgtcagaaactatagaagtgtagacagacaagttccttctagggcagccaagtaaaatcaccatgagcaggtagcgctgaagacccagaatcttgcccctcaggtcatgcttatgtctgtctttgaggcaaaattctctccaacccagtatcgaaaagaaatgaactgcttctagagacattccttcacaccttaaggcaagttcgtccttctgttctcaccaccccaactcattcagactcaagtttgccttcccaagcaccttcctttctacataagaatgaaacaaacaaaaagccttttagtgtgtctgtaagaaattactttgtcgaaacaaacaaataaatgagaaacaaagcgcctcagttgcatcgggaaaagggacagggaaactgtgttcacctcaattgccaggaattatacacagcattttctagctctaaagacaatgaacatttttaaaagatacttggtaaactagctgttgatactactcatgaactcccattcattttcacactaatcattgttctaggacttacataattacctaagtaacgtttcaatagtcccaaaactaacataaggggtcctaatgagcatttcctattagtaaacagcatgtacctataaacgaagaggattctttcctctcttttctgatttgagcaagtttagacagtgggaaggtacaatatgaaaaatatgttaccaccagatttaggatttgttataaaggtggcagattttaaatgaccataaaatgattgtcactctttccattgagaaatggggaccacattccctctcctgcccttgattttaggtgggccgtgactgctttgaaagaatgtgataaaagcaatgctgccagttctcagctccaagccttggaaaactggcagtttccacttattttctcttgaaatcctcttcgtagaagccctgagcttctgcctaaaggctcaactactctgagactcccatgctggagaagccacgggtatacacacttcaaccctgctctgagctcagccttccagcgacctccgccaaggcaccagacctgataatgaggccatcctgggcgctccagatcagccc

SEQ ID NO: 12314 - DNA, 76559 bp, Homo sapiens
agtgggtgctgctgcatgcaacagtggactcagcttatagggatctgtttgctcacatgccaaggaatatggtgatggcaggtactgactggcttagatactcagctcccctctgtgtttttgcttggccatgcttttgtcctcattgttgtacctcacagtgagaagatggctggccaagctcaaaacatcacctccatgtttaaggtagcaagaatggggaaagatacaactattcccttaaatcaccaacacaaaacctttccagaaacccccagactttcatgagatgtctggaagttagatcaggactataccaaatggccacctttggctgcaagagagactgagaaagtaataatcttacttctatagtgatgggggccagggagaaggaggttggaagtaagggttgaagaaatgaacctatcatttctgccacaaaagctagcaggtgacagttggtgaggacctgagataggccaacggtaatcgagaaagggcaaatattgttgccatggactaaaatggaaaactcagaaatactgagtattgaatctagttatgctagatgaagacttaggtattgtctcggggagatgttcagcagggagctggatgttagttctaaacttaagtgaaggctcaggcctggggatatatttgagagtcattagaatataggtgggaagctgggccatcagaggagtcaagacactccaggacagcatgacatgagaagagcagtaggccatggtcatgccatacatttagacatcggaagcagagcatgagaaattcacaggagatactacaacaaaatggctggaaaagtcaagggagtagagaatttctagaaatgagtggtcagtaggatcagaaactaaaaggcccagtaagataaaaacaaaaactacctatagggtttggtaatatgattttgctgttggtctttccctgagcagttcagtgatggggttgggaagattatttttgcagtggaaagaaggaggcaggaagtataaattcctttccagtagagtttttgaaagtaagagaaataaaactaaggcaacaaataagtagggaaatttgttttttatttttatgggtaagactgggcagaggggatttagaggcagaggggaagaggccaacagggagggaagggttgaagttacaggagactgtatcactataagggtgaaaggcttaatcatgattggcttccaccaatcttagggcatctgccagggctgaggaagcaacccatcattcccgggcttattgcaccctttacctgaacaatatggggtttctaaaaccaaaaaaaaaaaaaaaaaaaaaaaaagaggggatggctgttgggaraggttccaatagtgtctgccacaccaaccctctctctacttaaaaatgtcacagcagaattgcatctgcagtgattcatatcaaaagcttgaacagtcttttcatattgcacattttaatttaaatactttctcacttcatggttctccttaggcctaacctactttcaattaagcctgagtctgtgaagacatactaacttgttcgagtctattttctctacatgctagcacacacaccctggaatttaatggatagtaaaattatgcaaagaatcactgtgtgcaacaagaactgggacatttcctgccaagcccacctccaatacaaacatgtacacacacccatcggtgctatacatagaacttgctcttaaataccaacatccatttgccacactgtggagcaaatatgcttccattctcatgattaaaataacaggaagtatcatcattcttgaagtcttggtatttataacaacaatataaccacaaaaaatatgtaactgtggagactcttgataaggtctattggcaaggcatctggtagcatccttggcttgatgaaaagccctgtatctaaataatcttacttttcaagcaatgctgtgatgtaccctgaggatccaatccaagaagggtaaaaactgctacagacgtcctctataacctccagcctgaaaggggcctytgcctcttcagccagtctggcaggtcatggaaattctactcttgcaaagagagctgtggatacaagcaaagtatttcttcagtatttactttgactggtgaaagagccacggcagatttttttctttttccccaagacacaaaatgacattttaaagaagaaaccactcttggtgccatagcgtcttttaaaaataatatcagaataaaagctcaaaggcatgttctcttaagcacagctgtccaaagcctcctatttcagggagaattcagccactttatgcagacaggaaaacaaaactgttcgttttagcatcttctctattgkaactatttttttgtactcagattgcatcagattcaaaactagtgacatcctcttatgctctgtttccccaaccagatcatgagctctttaaggttaggggccacattttgtactcctttatttcttgcagagttgtgtttgtcatggtgtactttcaggaaattgttgttgaatggatgaatgaatgaaagaatgacaaaaatgggagagcagtggtaggtgagttgctaggcagcctggtaaagaggattacaagagtcaggtcagattagcaggaaaggtggtgtaggggaaagaatgttgcattctgagccagcagacatgggtcctagtcccaggctggcttgcttgtcttcactcattcaacaaacatttcttacacttcaagtgagccaggcaggcattgcggcagacactgaagaaggcaaaatccctgccctccaggtgtggtggtggtggtggtggtgatggtggtaagggaagcatgtggagatcaggattatgggagagatgtgtgataggaggtatgatcacggcaagcacagggcacatggaagcaaggagaaagggcttctaaatcagactgtggattccaggaaagcttcctccatctgaaaggaaaagacagaggcacaaaatataacaaaacatttacttgagccaaagtgaggacagttgcccggaagacttagacccaagtaaccctggatatgagcttcatgccgcctttattacaagcaggttttttacaggcagaaaagggggacagggagtaggctgatatgaaattgtttgtaaggaattcacattggtttacagaaacaacattgctcactgattggctatgcactgttaagctataggctatgagtgatagtgtccagtgtgacattattaggttaatgtatagttacttgtggcaatagcaagcagtttcaaggatgaatacatagctcaaaagggggcagtagtgttactggaaagagttcctgatccagaccctaagagagggctcctggatctggtgcaagaaagaatttggagtgagtctacaaagtaaagtgaaagtgactttattagatargtaaagaaacaaaagaataggcagagcagtggcgtcggctgcttgactgattatacttatggttatttattgattataagctaaatggggtggattattaatgagatttttgcaaaagatgtggggaattcttttctcttcccagattcctgaaggaggagggttttgattcaagccttaaagatgagaaggtgttggcttgaaattgaccaagaaattgaccttttactgtaggtaaaaggacttacctgtgaggatgttgtattggagaattaaagtctcagcttcaggtgagacttcagggtggctgtgacgggagataaagttagagacataaactagagctactttccaaagggccttgctgcaatataatttagtggttaggagtggaggtttagagatcagacagaattgggttcaaatctcagctttggtacttaccagccatgtgataataactgatttttttaaaatcccatctgagctttagtttccttaacacaacgactacctgttatcagttgtctattgctgcataacaaattatcccaaaatgtaatagcttaaagcaacacacagcttcttcagcttctgaagctgaagctgtaattctcagttttggttggtctggaatcccaccaaaactataattataatctaaccaaaactataattctcagttttggtgggtctggaatctgcacctggcttagctgggtcctctgcttcagggtctcttgcaaggctgcaatcaaatgtcagccagtgctgagataccatctcaagacccaactggggaaggatccgtttccaagctcactgacatggttgttggcagaattcagttccttgctgactgttggccagaggctgccctcctcagttccttgctatgtgggcctccccgacataacagcttgcttcatcaaaatcaatgagagggaaagtcaactaacaaggaagaagccacaatcttatttagccttcttctcatcactcttgccacactatgtttgttagaaatcacaaggccagtccacactcccagggcagagattatacaggggaatgaacaccaggaaatggggatcattggagaccatctcagtgtttgcttgccccaaagctcatagcttagtaccactaaataaatgttagttattattattatgctgaatcgagagataaagtaaaactacagagggccagtagttttatatcagggagtaacttcagatgatgttgggcaagtcaagtcatctgtctttgaactttcatttcatcctcagtaaaataaaaatacctgaccccagaaagaatgagaaaatatatgtgcaagcataaatatatttttggaacatcaaatatacaactctccactctgaggaagcaaactgctttgggccagttttccattttgtgtctgctctatgagtctcacagtctgatgtcttcacgttttttagcgtttggtccagtgggcccataggaataaacacctacaaagagcagtgtgtctctggagagtcctttaaggcatttccaaggatttgctttttggtttttttctttctttcgttctttttaaatatctttgcttttaaggacctcatggggggcctgggagagaaaacagactgtctgggaaattttaagctcttgataataaaaatggtaataaaatctcctccagctcctgaggcttcgcagaggggatgtttatggtggatggggttcccyttctcctgcgcagctggtttcgaggttgtgcggtttccagtcctgcrgagcagctcaggttaccgcctccgtggccgcgggggagggcatctccgacggccgcagcaatgggcaagagatcagggtcttcccatccccgcgactcgcccctttctgcctggtaaccaagcgggatgcctcatcctactccccaaacggagcggatcacacacagtagtgtttcatggtctttcctgctgcggttttcccgggggaaggtacttccagagggtggccaagtcttccctagcggccggccttcgggagggggacagaacttaggagtcagccctctgccttcgtacaaaggctcgcttctcctcagggcgtctctgggtggagcgaagcggccgaggggaccacgacaatgtccctttgcttttcggaccgatggccaggcctccagagccaggagcgcccgggaccccagggcagggagcaaagctcataccgcaaccccgccacccgcccgcgccctgccagcctgttggggccacagcgcgcaggccagcagccgcactcgccgctgcggggttccctttgcgctgagctcatctcctgcaacgccgctgccccagaccttgcgggccatttggtcccgggggtggggctccttgggggccgcggggcagcccggatgagaggatgacccgggagctccctgggggcggagtggaaggggcagctccaggcagccctggccaggagcttttaccccgccagccccgctgctccagcggccgctgccttagaaaagttaacgagaaccagatgtggtggccactgccgaactttctcagagccggtgattggtccccagccgagggcctcagccaattagcttgctgggtgggcctggagtcccgccccgcccaggcgcccgcggagatccaggttcgaggctggcgcggcgcggagagtgggctggaggccggggcgggacgcgttgtgcagcgggtaagcgcacggccgagcgagcatggagggggaccgggtggccgggcggccggtgctgtcgtcgttaccagtgctactgctgctgcmgttgctaatgttgcgggccgcggcgctgcacccagacgagctcttcccacacggggagtcgtggkgggaccagctcctgcaggaaggcgacgacgaaagctcagccgtggtgaagctggcgaatcccctgcacttctacgaagcccgattcagcaacctctacgtaagttcagccccctcctggcacttttcccgcagcttcttccctggggtcggtctcacggaaaccctgyctccagaggggaggaaacagaccccackcctggagccccccagcacccttgcggtggtacccggccagagagcgatgccgctgcctgccccgctgctgtaggggagcaagaatgacctggaggggagagcaagaattgttcgcagccacgtacgcgtcccaggcagaaaaggtggcgttgctagggcggccagcgggctttgcagttaggaccgcgagaaggctgtgcccgtctgcggagctggggtgttccctcttcagacctggaggcttcctctccgaggacatggggctccggggttgtgaggggagtgagaagataggtgaacgagttttagggcccctggacctactgcagcgcggagctgggacagtcgcaaaagttgcgcttgtttccctgaatccagactccctggccrgtggggaaggagagagaggctttttgcctaagtcagttcccttccctccctgcgcgaaagggtagcgtccttgggcttgagcractgtcacctttttgtccctctcctctcccaggtgggcaccaacggcatcatctccactcaggacttccccagggaaacgcagtatgtggactatgatttcccyaccgacttcccggccatcgccccttttctggcggacatcgacacgagccacsgcagaggccgagtcctgtaccgagaggacacctcccccgcagtgctgggcctggccgcccgctatgtgcgcgctggcttcccgcgctctgcgcgctttacccccacccacgccttcctggccacctgggagcaggtaggcgcttacgaggaggtcaagcgcggggcgctgccctcgggagaggtaagtgaccagggatatttgactgctgaggaaattgaaggatgrgcttaaattctggggcagcgacccagggactggctcggagttgtttctgagcctactcttgcgctgaacctgaccttggaggcagcagggctggagtggcttgggagtgaggaaagacgttgtctctaggcatcttctgaggccctrgcaggtggtcactcccttgaggaaaaaaatgcttagcggatatgagagcgggagtgcagatgtgggagcccctttgaacataaggcaatttactgtttggttgcttatttttagaaccatctctaagtatacaagtatttctaattatatgttcattgaaggggaaaaaatcagaaaatacagataattttaaaaaagaaaacaaccactcattttcccaccactgataaacatttttctgcgtacattttcagagttttttcttctgcatatctttattgctgtctattaacaatgatgagtttacactgcacatactgttttataacttgcttttttcacagaatagtgtattgtaaatatgtttcaatgtcaataaatgtatttctacatcatttataatgatgcatactactgtatcctgctattatcctgtataatagtgggtgtaccacagtatgctcaaccagtgttgggccattaaggctttttctggtttttcattattataaataatagcgtgaatcactttttaaaaagctaaatctttgcacatgttcttagttgacattccaggaagtgcaattggtaggtcagagaggatgcacttttgrtaaagttcttgataacttctgcctaattgccttccaggtaccagtttacaagtttcttagtttataggagtctgccgtcaatgtgctttacagtctctacctgcggaaagtaaaaaattccaggctcctggtctttagtcttgtcatcaacatttgaagtcctccaaatggatatgagtggggccagcgtgcttggtaaatggcaaactgcctcattcctgaagaaagtaagggcttccttctatggaattagacctgaatctaaaataccatactctaggggctgaaaccatatgattcatctcaattttaacttacggaaatgcytcttcactatagaaggatggtacatgccccctgtaagaggtgaggttgcttgcccatgtcactgatctctatcttgtaaggatgctgtgacttatatcttttgtatggggactctttattttttaatttttgagggtacatagtaggtgtatatatttatggggtacatgggatgttttggtacaggcatgcaatacgtaataatcacatcttggagaatggggtatccatccccccaagcatttatcctttgtattacacacaatctaattacactcttagttatttaaaaatgtacaattaagttattattgactataataacctgttatcacaggttatagtcaccctgttgwgctatcaaatggtaggtcttattcattccttctatttttttttttttggtacccgttaactgtgtccaccttcccctgacccctactacccttcccagcctctggtaaccatcctgttactctctatgttgcataaggactctttaaatgcaaggtttttggaattaaaacttttgtctggtccttttctggggtgggggaggtttagggtagaagagatttgtaaattccatctctcttttacttttctaattaaaatccmcctgcagacattaccatttgctagttggcttcagaatgtttcattaagaaaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccttaaaaaatgatgagttcatgtcctttgtagggacatggatgaaattggaaaccatcattctcagtaaactatcgcaagaacaaaaaaccaaacactgcatattctcactcataggtgggaattgaacaatgagatcacatggacacaggaaggggaatatcacactctggggactgtggtggggttgggggaggggggaagggatagcattgggagatatacctaatgctagatgacacgttagtgggtgcagcgcaccagcatggcacatgtatacatatgtaactaacctgcacaatgtgcacatgtaccctaaaacttagagtataataaaaaataaataaataaataaataaataaataaataaataaaaaagaaatgggaaaaaaaaaaaaaaaaaagaaaggcaggattctgtttggataggggatgttctttcaattacccacattgaagtttcttccaatattttaaagagctctgggacttgagttcttgttttaatagttctttggagatagactttggcaaacagtaatctaatttgcttgaaggactgagttctacatggcgttcttaaaktttggcttactaactttatattgcaaagttactggaaactggaagattcaaagcaatggcatctttgccattaaaaacaattgcagttggtgccctttttctccatggatattcctgtcaggtgtgaccagatgttgcacctgatattgcaggaatgtcaaggtgtaattgtatctgaaaaaaaaatgtgaacaaatagtgtttgtcaattcagttaatctgagatttcttgaactctcataggtagttcacagagcaaaaaagttatggtgtagacctttgaaatacttattgatgggagacatagaggactaatgtttagctgtgctttttgtggggaaagaggagtgttttgtttttgtcattttagggatggggttagagacagctgagttatatagatctctgtaatgtggggaatrttttgtttatctggaatttaagtcaggttgaaagggctaaaaagaatggatattgagaatgaggtatcaagagagattgttctgagcaaaaacatgacccaggagaaggttgagagagcaacctattagcaaaggggccagagaaatggatgaaggagtcacaggcagtaacataagacagatgagtgcaaggttgcccgctatggttgaatatttgtcccctctgaaaatcatgttgaaacttaatcctcaatgwgacagtattgagaggtggggcctttgaaaggtgactgggtcatgagggctctgccctcakgaatggattaatttattcattcatggattactggattatcatggagtgggcctggttgctttataagaagaggaattgagacctgagctagcacattagcacactcagctttgtcgccatgtgataccgtaagtaccctggcactctgcagtcaccactagccagaaggccctcaccagatgtgacctctcaactttggacttctcagcctccataattgtaagaagtaaattccttttctttgtgaattacccaatttcaagtattttgttgtaaacaacagaagacaaattaagacactgcccaatggaggcctccatctgggtggagactgagacatgttgacttggttcaaaggttgatagtcattgatggaggtggttggatttcacagagaaaatgagaggtaaaagcaggactttattgtagctttttgacttctggagacaaggtttagaagaggggtggtctacagcccatccaagagagttcagactgagtctgagatatcactgtgaagatgaagagaatagagacatatatggaaattggttaatgctgaaccatatatggaaattagaaatgctgacgttttgctgaagagtatcaggaaggatatagtattagggatgtgatagcactcagcatttgtctttgaatttttggcaggatctgtaggatttagtgcagtaaaataaatgagggacagtcccccatgtgacagtgtcctacaggcagtgggagatgaagaactacactaaggaatggaggttagtgttcacagcaaacactggaggccagacccaatgatcctagagctctagaggacatgtggtcctgaggaagatgacaaagagaactttgtgacccctataagagtcaccctaattcttcatttccattttcattttcattttgataagcctctataggcaagccccttgaagaaaaggatgtcactattctgatttttgkccagatagctgcagttaattaaatgaattgaaaaaattagaaactcttagaggggtgtatgttgcatgcatcagcctggctctgatgagtgtcacttcaacattgattgggatgtcctgtacctgggagggagagtcaggctctggtttctgcagagggctctggcttttctctctttctgataacagggcctgcagccactcaccctgatcctctctgtgctgctcctctccctgtggaggcccctctctcctctctgggatcctgggggagctgggaaccagtgactcgtttgtcrggtttggcagcccatctgagggcttctctttggagacagagcctgtgcggctcttgcaaargcttgtatctaggaatgtgaggacctttcctgtttggaagccagtcaaggagttttttgrgagggggagcccttcaagacttcatgaagtgggctctttagcaattagatgtagaattttgtagaactgaccaagaactttacaagtgatcatttagtgtgtgggtggcttttaaacagccaaactcttttggcgtgtactttgggatcataaattctacttaaaaggaagttgtttccttcctctgatatttgcctattttggtggagacaargaaattaaatacttgccacccataatgagtgctcatctcaagaacagtatatagaagatgttgaataaattttaattgaaatgaatttgttggctggttgamtgaatgaatgaataaaataaagtgstaaatgcccagagttcacagcaaaaagtcagactctcctcttcwcagctctgtttactrctctcttccccccttccccatccccttcaattcttcacagtctctacaacctccttatcttatggaatttctctaaatttagaaccaggattctctcctatctcacatttattatggcagatcaatgccaggagctttgaaagcttagctttttgaaatggggttttttctccttcctctagtacttttctttccctagttgatttttctttattctgactaatgtataactctgaagttattgagtccacattagttgatgatgtcgactatcttatggatagacatgaggcagaacagcctttgtttatatttggcagtagttgtggcttcctagtattgagaagctctaaaaacatttcttgctttttgtttttggraaagtcaagctttgctgatgaacaatcaacaactggaacaataacaaataaactaggcacctgttactttgtgaattgaatgaatgaaaaaagcaaagcaagatgttgttttttctgggttagagaactaaaagaactgctgattgtattttattttctcttgaaaagtgtgttacatctatatttctttatcctattagcaaaacctcaaaaccttactttgaaattaaacattgaaaggaaaaattaacattagaaaagagctrgaacaactgtgggagtagacttagaacaaagggaagagcccattccttccttgctgtttccttcagtgaaatgtgatgttcttctctgtgcccgagtttgtctgtctagcagaatggaaaggtaatgatacttaccagtaaataatatttctaagagtcacattatttrtgaagtaagttgtgttttaaaaataccttcccagttccttactaaattgtaaaagtagtgtgatttagtgagagagagacagtttcagaagcctaaacataacagctttttgagaatcaagcactgttcacagatctttaggaggagcggtcgctgaatgaaggtaaaggcaaaaatctcatcttgttgaaaatatgagggtaaacagaatgttaaggagtgatcctataaggacctgggtgttgaattggcagctgattcaggctcctggtccctctctggtctgtgttggctcctgcagtgtttataacattcaccagctgcctctgtgacacctcccaacctccaccctgagatcctggacacacaccccggctcttggcctctaccaccttctccagtgactctcctaccatttcaaccatggctgtttcccagtcctacaccgtgagactctcctgggcaaagcctgtcttttgctccttcacatcctcagcatcaagcataacgtctggtgcttaagtagacacttggctgtttgaattagtgtatgaatgaataaatgaatggtgtttacaaacatataaacaactaaccaagcataatgaggtgaatgctcactagagatgcccataaaggtgttacagaggttcagagaacagaaattattctatrgggaatcacaaacacctctgagtggcagcatttgaaggttaggaggctttctaggcacagggaaccacgaacaaagtgtagaagcatccaaggacatggtacaaatggggactattaaatagtctgacaaagatgcagtggaactgagcctgggagggacgtatgcagccaggttacaactcaccttgaatgccatgttgaggaggggttagggtgtcctagggtgtgggctctagagctggctggcccaccaccacatacttgccacctgacctgaggaagacctgttagcccctgtgtctttttctcatctgtgaaatgaggataaccctgatgctcgtatgaaagggtagatggaagaggaaagagagtkatgctgtgagacagtwaggaggccttttgaccaactagtgcctaacacagtgcctgcccatagtggtcatttaatraatggatgaatgaatgaatgaatgaatgatgcaaatgagagatgctgagtgcctagggttataaactagggcagtgactgcaggatggacaagttaattttgctgattgctcttagctctgaaagagtttacatgagagaagtttgaaaccttacaaagtatatattttttaacctatgttttaccaatgcgtatttcaactattaatctaaattgacaaatggtatttgcaataataaataatattgcttatgaaattatattgttaacttgaagaggaaattttaaagaaggttatgtttaaaaacaatttggaggaatcctgaaaaagggkamrttctttgcacgttatgatgctttgcttgcattctgtttctttyttcttttatttgttttttacaggatgtttctctctctctctctctytttttytttttttttcctcacagctgaacactttccaggcagttttggcatctgatgggtctgatagctacgccctctttctttatcctgccaacggcctgcagttccttggaacccgccccaaagagtcttacaatgtccagcttcagcttccagctcgggtgggcttctgccgaggggaggctgatgatctgaagtcagaaggaccatatttcagcttgactagcactgaacagtctgtgaaaaatctctatcagtaagtaacattgagctgaagccctttcctatttgaatataaggacttttaggaagtacctgaacacaagtgaccataagaccattacataatatattggtggcttctaagtaaggcatcaagtcaaaaccaaggaactagattcaaccctggaaggatcaagttcaccaaaacataaaaggtcctttatttttcctgctctattgggtatagatactggaaacagaacagtatgtgtgtgtatttgtagagccactgaggcttgctatgaaaaacattgctcttggaaccacataaaaatatccagtcataaactgcccagtttgaggttttccagattaatcatttcacaggaggaaacattgtgatttagtcttttggacagatactgttaaacattaaattgagcaatgtaatttgcaggaaaaataactaagatttataggtttccagaagtctgaggatgtctctctggcttcattacctaaaatgaattgaacccattccttagactcatcagtgtctgcccataatgggcatttaataaatagatgggtgaatgaatgaatgatccagagggcttacttagctagtgcaataataagctcttctgcattttgccagtacagatagtgccagtaggatatttattgacttcagggttttttggggggtgtgtgaggggaggtaggggtgccctcgcttttattcgtttcctgaatatagaagccagatagaatacattggttacttcctggcctcctttaactgcttcttgacttcattaaatcaatcctgggtaggtatagaaacaccttacacttttagcatgccatccactctgctcggctaccagaaagagaccactatagccaggtttgcttactcagagctgacatttattgaaaacttactacttgccaagcatcatgctaaacactttccagatgttatcttaattaaaactcacaagaattgtaggttagtactactattttcccarttttacagaggagcttagggaagttaagtaaattgcctatgatctcaaagtkaagtggcaaagccaaaatccaagctcaagtctggagtgctgaactacttattttatcttatgctgagtccttgtttcctttcccatccttatgatccacattgggcatctttagggctccatctaggctgccgcttagtctggactctggagcaaactcagttccttactctccckcctctggttccaccctctcttctacttgggagctcatagatttattatyccatagatttattattatagagaggtcacaatggccaagcacatggaatacaaagatttctaagacactggtcctgcacatcagcagcttgtaccctattaggrttgatagacaaatagatmaacaattacagagccctgggtaagtgctggcrtctacacaggagacaggagacagtggggccaaaagacctgtgggaaaaagcagttgtgttccctgagcagagccataaaggtctcttggaactaacatccacaatcacgtgtgacacacaaacacacagacagcatttccacttaccccctttcatgccttccctcatttttatctttgatacttcccagaaatctctgaattgcttggcgaaagcagagtaagatatggggccaaatgactcacgtatttttctttattgtaatccatgcttaatacaaataataaagtacaagcaatgcagaataatgtgaaataaaagtaaaagttatccatgatcactacttcaagtgataacaagtgttaatggtccttctagaatttaggtatatacaaaacttttaaaaccaaaatggttcttttgctatgtaagtgktgttttcacattaatcacttcttataggggtcttttagtcagatgtctgtctatactaccattttaaggctacaaaacgttatgtcatatatgtataaagacagcttattaatgaacatttcatgtatttctgatttttcttgttataaatatcattgcagkaaacagcataataaacattgctcacattctcgtttctccctaaaacaaattcttaaaagtggaattgctgagaaagggtgtatgatttaaaagttgtacatttcagattgtcaaagttactggtcttttcctttctgattttggatcttgttgttattcttaggaagaacttctgtacatcaaatttatagaaatgtccttcaatataatcttctatttcacttttcattatttaaaatttcaaaaatatacagaaaagtggagagaataactagatgaacacccaaatrcccatcacctagatttatacattgtaaacattttgccatattcatttttttgtttgtttacatttttttcttttctttttttttttttttttttgagacggaggttcgctcttgtcgcccaggctggagtgtagtggtgtgatcttgtgctcattgcaacctctgcctcctgggttcaagcaattctcctgcctcagcctcccagtagctgggatwacaggcgcccaccaccacacccggstaatttttgtatttttcgtagagactgggtttcatcatgttggccaggctggtctaaaactcctgacctcaggtgatccwcctgcctcagcctcccaaagtgcagggattatgggtgtaagccaccatacccggcctgtttaaatgttttaaagtaagtcacaaacatcatgccagttcattgctaaatgccttagtatgcatctcttaagggtaaagttaggctgggcaaggtggttctaatcccagcgctttgggaggccaaggtgggaggattgcttgagctcaggcattcaaggccagcctgggcaacatagcgagacctaatctctactaaaaatttaaaaaattagctgggtgtggtggtgtgcacccrtagacccagctayttgggaggctgaagtgggaggatcacttgagyccagggggttgaggctacagtgagccatgatcaatcacaccactatgctccagcctgggtgacagagggagaccctacctctaaataaataagtaattaagagtaaagttattttcctagtcaattgttttcttcctcaaatttgtctcacaactgtgagctcaaaggtcataaattatatagttcataatgtttgtcatactcttcctctgcaaatttaaatacgaattcrcacgtgtatattttgaaatcatacttttctatcttctggaagacaagacagtagttaataagtatttatgatgtttagggccagtgataggcattttatttatttatttttttgagatggagtctcrttctgtcatccaggctggagtgcagtggcatgacctcggttcactgcaacctctgcctcctgggttcaagcttttcttctgccttagcctccmgagtagctgggattacaggcacacaccatcacacctgrctattttttttgtatttatagtggggtttcaccatgttggccaggctggtcttgaactcctaacctcaggtgatccgcccaccttgatttcccaaagtgctgggatttcaggcatgaaccaccgtacctggtcagtgctaggcattttaatgtggttttctcacttaattctcctaacaacccagggaggaaggcattgtcatcccattttgtaacccaattttcctttgtagaaataaattaagttctttctattactaagctttccaaatgaccttggattttaaaataaactcaaattggttacttttccattatgcataatgacaaaacccagatagtgatttatatataattagaaggttattttatttagcttttattggccataatctgtatttttccactgtttgaagattttatagtttctgtttctaacttcaagaagaaatttcatagttgcaccacctctaatgtgataataaactcaatatcctcagaacttcaggattttctcctactgtctttagttttccttatttgcttgccaataaacaccaacattaattcttatgaacttaacaaatatgtatagcatattgcacacaaaatcagtttttctttctatgcttttttccctaaatttaccacaacagtaaccacagcatatacatatatgtacatgcatacacacacacacacacacacaaacacacacaaacacacacaagagaaagacattttcaaattgtactgaaaaatattgttactatagaaatccacatgaacatgatgagtacccacccaaatgaaggaaaatcttttgttcttatacaattyagtgaagtttttattatcttattaggcatggactgttattcctcattgactgacttttgaggaaattccattgcttgggagaatgtgagcatagtgttttgtacaaatatcagaggagtatacaaactggcatattcaacctaaccagactcttgttcactcaagttttcccatatttttagaaatcatatgtagttgttctctttagggtataccattgactctaaaataatgggttattgggatatttggaaactcaatggagttcatgttcttttctcatggagaaaacgagagagctgtttccagaagtctttaaaagacttctaagctactttcttatttgctccttaactttttcagtgcaaaaacaaattttttaggttttggcatttgtatttatttgaatttttttacattgactcaccattctttgtggattarggaattaatcagttcaagtgaataaacaatgaaatgtctttaatattctgtagagtaatgataattcagatgcttattgactgcagtgtgtggtatggttttctgtcataatataacatagatgagtagagcatgggctttggtgttaactgaattcggatccaattgtttgttatgtgaccttcagaagatcagttagccttttaaagcctattttcccctctataaaattgaatatgatcacctctatttgcagattgtattgaagaatgtgaaacacttggcacagggaaggggcatcaccaattcatgaaagtatgtygtagtcatttgggtgtcagtatttggtagagttttaagcatacatttttaaaatgtgttatgtttccagacaagtagaggaaggatgaaacattcctacattccttgtttattttcaaatagccagattttagataaaccatttggattatggrgcagattgataatttgatgatctggcattctgtggcatacagctttgaaacataatgttaaataaaaggtagttcacatcaaaagtccagtatgatccctttagttaccatgtaagtctgcttttatttggttttatataccagtgaaaactgaacctgatcttaatagcctttcaggktttytgtttttttgagacagggtctcactctgccacacaggctggggtgcaktggttgcaaccaaagcccactgtaacctggaactgctgggctcaagtgaccctcctgcctcagccwactgagtagctagaagcacaggcatgtggcaccatgcctggctaagttttttagraaagggttttgtagaggcagggtstcactatgttgcctagactggtctcaaactcctgggcttaagtcatcctcctactwtggccttgcaaagtgctgggattataagtgtgagccaccatgcccagctgtctttccgttttaaaataagttgttcaccttctaggaaggtgggtgaatggacacktttgttacatttgttacaatgactgtttcctttttatttagactaagcaacctggggatccctggagtgtgggctttccatatcggcagcacttccccgttggacaatgtcaggccagctgcagttggagacctttccgctgcccactcttctgttcccctgggacgttccttcagccatgctacagccctggaaagtgactataatgaggrcaatttggattactaygatgtgaatgaggaggaagctgaataccttccgggtgaaccagaggaggcattgaatggccacagcagcattgatgtttccttccaatccaaagtggatacaaagcmtttagagggtaggatctcccctccagattctgatctgtcctcccccttgcatccaacacctacttattggccattctatcctgaaacagaatcttccaccttggatcctcacaccaaagaaggaacatctctgggagaggtagggggcccagatttaaaaggccaagttgagccctgggatgagagagagaccagaagcccagctccaccagaggtagacagagattcactggctccttcctgggaaaccccaccaccgtaccccgaaaacggaagcatccagccctacccagatggagggccagtgccttcggaaatggatgttcccccagctcatcctgaagaagaaattgttcttcgaagttaccctgcttcagrtcacactacacccttaagtcgagggacgtatgaggtgggactggaagacaacataggttccaacaccgagggtgagtgcattagaaaactgggtgctaaggtttcatcttaaccatgctggttttgcatagcgttgtgatttttctcttaagtgggtaggtgaaaagtttagcaaaaagaagattggatctaatttttaatccctgtgtttcaagagatagwgtaaatttcctttgccaaataaatcttggcaggcagattctgttcggaatctcttgatcattaataatgtttttttaaaatatgggcctcatgaagtgagtgggggaaaactgggtttgttatgccagctacgctctcaagtgtaatgaactatttcagtttgaaagttcagcaaaggtaaaacattttgcggcttcatacacattccagtgatggacgggtttgtgctttttaaagtggtgagttgtgctggctcagatgaacatgccagattcatactctgttgtgagacaagcctagcgcttcycttggttggggagatatgcttgtgatgtgtgggagaggagagcccacagggaaagaaaatgactaaacacctgtgtctgttgtcatttctggttcatggctatgcagctgtggcatgaacctccctggagccttgtcctcatttcatgacccactgatcggactgagaggcgaggagggagatggcgaaagcaggcggtggttaattatcatggacatggggtctatgtcagtcttctagtccttgttgagacttgtcatgccagctgtttcttccccatcagrcatggaaagatgtgaatgggaaactgactccagattgtttgttccagggactgctcatctgacctctgataggaagaaagaggtcagaggtgactgctttgttctgaatctccatgtttttccaccttttctgtttcctgtcactgttgtggcaaaaacatggctgacctagcagagagggccttctgggttctgctctggtattatctgcaggctattgcatggagaggtactaatttcaggagggaagaaaatattttctgactaatgtggcattgtgtaaggattcgagggagtacaytggtgtcggcttcgagtttgaatcctggctgccaagcttgctgggtgacctgaagtaacttatgtaacccataagcctctgatttctcaggaattacttgggaggattcaatgagacagcgtatgtgaagttcttggcttcgtgtctgcactcactggttcttaataaatagtggctgctgttactaattttagaagatttaaaacagtgggaatggggtggaggatgggtagagaatgaagaatgtgcttattaaagagtttcacattaatttgtgcctaagggaccacatttccatgaagttgaagatgtaaattttattggaagtctttagaaccttcagatccttctgagaatctccagaatttacagtatgagtttcctctaaatacattttaaggccaagtatcaaagattttcacaaagggatttgaggtaaagaygcattcctgaatggccttctcatttgtgggttgtgatttccttccctgggaagagcgtgggaatattaaaaagcagatctatggagtcatgtattaaagggttaagaagggactgcacaccctgcttygggctctgagagcttgagatcactggagtaaagtgcaggaggcttcaggaaccagccatagagtagaacagaggcacagctataacccttgtggggcatgaactatgatatttatcagctgccggatgcagtctactatagacatcctggtaatggcaaaaaacgcctgtgaaaaagctggttaatacgcattttggrggaagaaatctagaagtgtttgaaacttagacaaaaaaaatccagtttttgttttaaaagaatttacggggatgtatgaagtatagaagcatgcaattgttaaatacttttgaggggatgcagtgactgtttctttcacataaaacattggaggctcagaggtctgtctggtaagtgtgggcttcctccgggaagctgtggggtgggagtggcagagacacagaacattgtccggtactaagtacccagccatgtggcatctgcctggctttttctgctgatggaatagaaagcacatggttttggtgctggttggacttgaccttgactcccagctctgctatgtggtttggggcaagacatgtagtctgtttgacccttggctctcctcagctctaaaacagagttaatgaagacctcgtcatatacttgcaagaactgaaattgagcttgggaagcaccctgcccaatacattttagtttccctttgaagctttagggtagtcatcttgctaaaccaagaaattaagatttagttaaaggcccagaaaatatcactcctttttacatttttttccccttagggactcattttacagacctttctttttgttcagaaatttagattttcagatcatatctacaccaggcaggaatgtcctggccacactcgagctctgtcttcctaggccacagaacagcagtagatggatgtgcaagcatgctttctctgaggagtcttgtttccagggagctctggtcgttttgttgtcaagtcaaaaagttacccaagcacctgccgtgtacctgtctctgactcggtgctagtggaagttttggctggcatttgctaagygcagcctgctgctctaaagtgagaacttggcattagattgcattatcacagttagtcctcagaattgccctgtggggagttcgagaccagcctgggcaacatagggagaccttgcctctataaacaattttaaaaattagccgggtgtggtggtgctcacctgtggtcctagctactcgggagactgaggtgggaggatcacttgagcccaagagttccaggctacagtgagccatgattgtaccactgcatagcctgagcaacagagagaaatattgtctgaaaaaaaaagttgtcctgtagggtaggtacaatcatccttcccattttacagagatggaaactgagcttggaaatacttagtgacttgtctagcaagggcaaagactgcaacaaagtcatgaagaaattagagaaagctgtagggtgacagagagtsaaaggcactgtccaggagtgtcactgctgttggggaagtctttgtgaggaaggaggggcttgagccaggcctggggtcaaagtctgagagggagaatgtgtgaaaacattatgaacagagaagtgacaagagcggagttgcagagatgggaatgaggagggaggaaaggagggagagagacagagacaaaggttgattaaggcagtggggtgagagagttgccagtgagggcttcagctgcctgggaccatgggactgcctgtgttgtgagtagaaaggaatgaggtttactgataggggtcttagttattcttaagcctgctgaggcagtgctatacgcagcttaatttaatctcaatctgcatgatgagttaggaggaaggacacctggctttcagaaacctcatgtagtcccactccacttttggccttgtgaaaggctgcaggagtgtgttgcaagctcaacttccaccctgagaagaatttaagcaggttctgctgccagtgcaaccctccaggtgccaaagaccatcccctgggtgcacctccaggttgcagagggtctgtgaccaggagccgccgccccccsatgcctgtgaagacacctatatgaggagattccvtggtagggcccctctcccttcaccagaagtggagagagcctgttagtgtcatgccagcagttgtaaaaggccacccccagggtcgtgatcactgccaccagcatcattacatgccacacacatcaaaattaaacaaacatgaaaactggacgaaaaagcattccactgtttrttataaagttggatatggtttttctaactagtctgtcattctgagagatgggaaaacttagaagaatttttcctgcggtgaaaatgactttttttttttttgaggtagcagtaaaaattgttagtagttgctccagctgtcctgaagcagccctgtgcacgaagcctcctgtgtccctctgtgttggcccagtgaacccagtcgacaccatggaacctcccstgtgtctggsccagggccttctgtgaagaagggcaggccggccaagggctgcagacaggtgcttaagtgtttctgggaaaatgaagattgaaagatggctcagaacaagtgcagaggagaattttccatttttgttacgaactcctagttaggacaagtctcaagtcctttggcagggcatttctttctttcctctgatatctccccaccccatttttctttctattaaggacatgagaaaagttaaaaacaaacaaaaaaaacattaaatagaaaaaaaagagatttaaaaaatcttcatgttaagaatcctttagcaactatcaaacctcagttaacaaatccatgacaaaatgagttcattcaaacctggccagcctccaccctcctgctgtgccctgaggtgtcagcaracttctttatggtctgactctccgtggcaggagcttcctggcakagtgtgggtcccagaggaggccatggactagaaactgtatttctcaaagtgtgggcactcatccaccttcctctcactcagctgggagcctggttaaaaacactgatttccaagcgcctcctctaccttctgaaccagaaactgcatttttaagccacctcactccttcaacacctccaggcctctgcccaaatgtctyyttctcccgaggtcttccctgaccatactatttcaaagagccaggtgygcctgccctctctcaccctctkgtctgaccctgccatattcctctgcacttcagtgattctgatgccccctcaatttgatgggatttagagccagaagattgtttcatctctgtaggcctcaattttctcatttataaaatggagatatcttctaactagartaggaagaagtgcatgaaaatacactcaaagccatgatagggacatgmaaatgaccaccgaaaagaaaaagtgccacttttcctcgggtgkgtttatygcacatctcatctagctgggatccagatcttgattcccagccttcaagaagttcagcctctttgaatttcactgcaattcccatagaaatttgagcagtcacgttggccggaggtctggcttttctcgccctggataaatagctgcacgtgggctcagcaccgttctagctccaggtctcccccttcttcagggaagggctatctggctgctgtgcgtctgtattacyttcactaaagaatcttcacgttgtattcttgtggatggatgcccaaatgggccgtaagcactgagctcrgcttctcaggtggccagaaatgagcacgagaaatttcctaacattctgcccacccyaggagctgccaattggtcagattaaatttgttaacgacattgatgagcaacacctagctcagaaatccaaggcttgttgtatcccaagccttctatcaacaccaattggtgtgagaatcactkgcggggtggctaaagtgtagattgctaggatgcacccagagagtggaaytggtaggtctaaggtgggccctcagaatttgcatttttaacagaaatctcaggtgatcctgatgcagtggtctctggaatccaccgggagaaatgcagctctccgtgygaaggactgcatggtgctgtgctgagggtgtaagttgttattcaccccttggtgaatttccttgatgcctcatgctgttgtcagaactgaaccccacaaacctgctcctcctcagtctccctatctcagtaactggcagctccacccttttggtttcccacatcaggactgaacatcatcccacatccagtctaccagcaaaccctctcggttccaccttcagaatatcccagacctgggcccttcttatcccctgtaccagcacttcttaccaccaagggaccagctcctgtctgatttactgtagtcggagcatgttactcttctgctcgaaaccctctagtgcttcccatctcactcagatgaaagctcaaatccttcctgtgatctctgagaccctgcatgaatgacccaggccacctcttctctcaccatccctcccacatgcccacacacccctcctgcctgacacagcaccacgcctgccctcatctgtggggttcactccctcacctcctcctggcctctgctcagtcaccttctcctgaggtcttccctgaccatgctattaaaaagagccatgtacacctgccccctcccaccctcttgtctttctctgctgtatttctttgcacagctcttacacatccaccccactaagtaatttacttgtttattgactgctgctggggagaatgtaagcttcaggatgtgaatttttgtctcytttgctccctgccatgtcctcagtttctagactaggtacaggtctatagtgaatgctcagtaaatacttgttgaattagtgaatgaatgaacaaaaattgtaagaagcatttacctttcacctaacaagctgccattgtaaatggtaagtgtgcaaacctgtgtgtgcacttgggtatgaaggcaggcgtggaagagggattataaatggaggcttgccttcccccggattaggggctgatccatcttctttccttcatgtggctgttatgaagctgaaagagacagtgtgtgttcttggctcagtaagtaccatcctaaaaatacaatattccacaaaactgtttaaaaagactcccaggttagcttaacagtaactagttagcccattgtaattacagtttaagtctcataatagcctttcatgggagcctgctcattgttataacttcttttyctgtaatagaaaaatgtagtacagcttccaatctatttataaacctttgcacagttgcamttgtaagttgctggctgcatyrccctgcctctttttacttagataaaagctatgactccacctagtttaactctccatatctagactgtctctcctccatcttctctctccttgtttcataattcagcctyagaataagaattgggttgcagaataaggcttcacaaaataactgaaataagatacaatccaagcctgttatttccttaatttgtgggcagaacagcttgtaaagtttggattgatttttatctgaatattatgaaaacggctgcttttttttttttttttttttgagatggagtctctctctgtcgcccaggctggagtgcagtggtgcgatctcggctcactgcaagctccgcctgccagattcacgccattctcctgcctcagcctcccgagtagctgggactacaggcgcccaccaccacgcctggctaattttttgtatttttagtagagayggggtttcaccgtgttagccaggatggtctcagtctcctgacctcgtgatccgcctgcctcggcctcccaaagtgctgggattacaggtgtgagctgccgggcccagccaaatggctgttctttagacctatagcagattgcctttttacttggtgttcagaagtacattaagaagaaatgcgacttctggcaatgcaggggtgaggaagaggtgttctacttawtttagagatgaggaagctgaaagacacagtttgcayagtttccacaaagcccccgagggagggctgaggttgagtcctagagcttggcgctttctgcagcccctcattccttgagctctgggagaaagtcctgatggsccytaagccatgagcayactggtgagtgtgtgagtccctcctgtagctgcttccttacacttagttgtgaatttctgagctggagaaacctgagattttgacacatccaagttacattcatttccttttactctaaatgtttttttccctttcttaaactaatagacagtgatacagttttcttcacagccatctattttaccatgatccatcctgggtttttttttttttwtttttctgccttgagttttatatcacttttctgtttaagttaagcttgtcactttcttgtttaaataaagttgagtcatgcctaattttctatttttatcaaactggaatttcttagccaagtcatcaaggccctatactaaatcttgagtcataacttcattcctactatgttctaatcagattttccacttgaacctacactgtctgtcctgccaaccctcagcttgctgctttcccaaggatctgcaggcagcactccagtactgttcaaaagctaatgccgctgctgctactctcatttcttacctgtgctgtttttcaacatgctgtaatagtcatctcgataatcttccctgcttgcttctaccattaaacccagtttataaagtatgactcraattatacttgaagtctgtgctgattaaccccagacatgtgrtgacccctaatctagtgctcatgatctccgtacttggatcccattgaaggggtcgtggagagtagcagttaagattctccagctagatgtcctaggttcggttcccacctttgccactcactgcctrtgcgacttcaggtgctttagtctactgtgcctcagctttatctgcaaacgggttaaaaaattgtccctggccagagtggtggctcatacctgtaatcccagcattttgggaggcctaggtgggaagatcacttgagcccaggagttcgagaccgagaccaacytgggcaacgcagggagacccctccccccaacccaccctaccaaaaaataaagtaggcaggtgtgatgcatgcttgtggctgcggctactcaaaaggctgaaataggaggatcacttgagcctgggaagtcgagctttcagtgagccgagatggcaccactgctctccagcttgggtgacagagcaaaaccctgtctcaacaacagcaacaaaaaaagtccctgctacctagggttgytgtgcaaattaagagttgttggccgggcggggtggctcacgcctgtwatcccagcactttgggaggccgaggcaggtggatcacgaggtcaggagatcaggaccatcctggctaacatggtgaaaccctgtctctactaaaaaatacaaaaaattagtcaggcgtggtggtgggtgcctgtagtcccagctactcaggaggctgaggcaagagaatggcgtgaacctgggaggtggagcttkcagtgagctgtgatcgtgccactgcactccagcctgggcgacagagcgagactccgtttcaaaaaaaaaaaaaaaaaaaggttgttaaatgtaaagcttgtatatgttaagcgcgattgaagtgttaactttgttatatttttatttgctgatggaggtctttatcttggtgacattgtacctataatgctatgtctcattagctcctttactttctgttctccctgggaatactgggtaaagattgatctttggatttcttcctcccctcctgtctcctcgtttccagatagacctggaacacaactaccacttggtttttcctaagagtagggtgggtgtcctccttcatgccagcatccgtgtctcacactagaattccatgccatccctgctcaacagcatgctcctggagtctccagccaactccacctcctggggatgtggaggcagaggtgtgtgcagccgcttggcctcctggtggccatgcttgggattggcatatttcctagtgccccggagaaagcaccctcctgtccatccacaaccccygccacaccctacccccttggctatttcctttatgaactatggcatttgctcyagtttccccatttctttgcagcacagatggccctcttcttttaatgggcagaataagtaggaaatggaagaaacagctgccagagcactgaatttatcctagtcctccataatttcttggaagatctgcgagtggggcccaagctgtctgctactgcgtggaaatcatgcttgtaccatacccatcatagttaaaccctgccaagggcatagggcattttaatagcttgaatccctgttgttttgcsmtcctctgtccccttctccccatgccttttctttgaggtaggtgcgtgtgttctttaagacccttccctcaaaacaatcttggtagcgagaccagctattatcttttttaagttcagtgttmcctaaaagaaggatggttagacataagacatttgttagcttctctattatgtcttcctctcaggatgtgtttaggttgaaccatataaaagtgctgatatttagcccttttkgacccacaaaaatagtggtttcatgaagttcaacctaacatgwacttactggtttgctttcattttactgcactcaaacccacgggtgcagyctcatcttagttcaccaactctgcaatgggacccagccgggagcagtaagcaattcttcttgccagcagacaaagcagattaattcccttgggttgaaygttatgccggtctcttaaacatcaaaaactgtttgttatgatctaaactgcttctatggagcagatgttgtgtccccgatgcagcagtgacattggaatcatttagtccttttaaggcaagtttgttttatttttcagtcttcacgtataatgctgccaacaaggaaacctgtgaacacaaccacagacaatgctcccggcatgccttctgcacggactatgccactggcttctgctgccactgccaatccaagttttatggaaatgggaagcactgtctgcctgarggtaattgactggggcyrggaactcctgtgtgtctattcctgctgcttacctgtttccagctaccactgtgagctctgctttatggaccaaacatctccactacttaaatcagagtgctatcaacttgcaggtgctcaataaatgtgtgaggaatgaactggtttgggctgattcccaatttgaggattatccagaaatgcttccttctgccagctcattagagccaaagtgtagtggagagaaggaggaggggagaaaacagactggaggcaggactgtttcatagatggataattggttggttaggaaatcattaaagtgacttgctaaagagtgagttttggaagttgtcagtggaataattatayctgggtacacccatctctagccaggatgaygtccaagcctaactggatttgctgtcttttaggggcacctcaccgagtgaatgggaaagtgagtggccacctccacgtgggccatacacccgtgcacttcactgatgtggacctgcatgcgtatatcgtgggcaatgatggcagagcctacacggccatcagccacatcccacagccagcagcccaggccctcctccccctcacaccaattggaggcctgtttggctggctctttgctttagaaaaacctggctctgakaacggcttcagcctcgcaggtgagtagggcctctgagaaggccggtagtcagcattgctttggcagtggtgctccttggggcactgtctttaggcctttacgcagtgacagaggaatcacttgtttaatgtactagagccacatgtgtgtagttttctggccasaggttgttgggaatggtttgacctcacatcactgatttttgaaaggcagtgatttcgtctaaatgttctcccagctgttctgagaaacaggatgattccattcagaacatttgtgtcctcttaccccaatttgttgmagcatatttgtcaggctttttaaattatgcacagatctgtcaaatgcaaaaatggtacttggggcacctggggatgattttacttcatggggaaggggtgctcttctcctcccagctccacaacctataatagtataggccggtgcaccccagacttgaacctgcacacacatcacttggaggtcttgtcaaaatgtaaattctggttcagcaggcctggggtggggtccgtgattttgcttttctaccaagctaggaggtgaggtaccagtgttgctggaaaggccacccgttgacaacaaggatttagaagatactttttggattctcaccttccaacctgaaaacttgtttgctagaggttttatctttattgcattaaaaatagttttgtgagaagttctttctccatctttaactgcagagctcggtagctgttaataggttcttgctttaatcaaaatttgaataaagcccttgggtcaaaagtagataaaaaatggcacacctggataaatttgtatttcagataaacaattttctagtataagtattacccacatatttcatgagacatacttatctgaaattcaaacaaaaccctgaatgtcttaggtggtagtttatttgtttttgtttttttgttgttaggtttatttgtttgtttgttttttgctaagtctagcaaccttagagaaaagtcaaggacgttcccaagagtatttctcacagaatacaagcttgttcaaagagaagctgggtgaggtaaggcaggatgaaaccatattcttcaatggaaaagtttgggaacttatggaatcaacagctgatagtgcttactctcagatatcagataatctccttaggcacgatctccaacagcagtagaaattgggagcgggcagtatatactggtaactgtttaagcaagacctcttttcatccctgtgctgaatgtttttcatctccaggtgctgcctttacccatgacatggaagttacattctacccgggagaggagacggttcgtatcactcaaactgctgagggacttgacccagagaactacctgagcattaagaccaacattcaaggccaggtgccttacgtcycagcaaatttcacagcccacatctctccctacaaggagctgtaccactactccgactccagtatgtataaccagtcttcacatctgtaaaatggggattatgcccatctcacaagatagatacaaggcttaaatgacttacatggcatgtccttagaacagtgcatggaacataaaatgagctctattatgttattactcttattgttaccatgaaatatatyrtgtaagtgagcagaatggctgctatacataagaatatctatatccctacatagtattttcaaataataaaatcaatagcaacattgtccatggggtgggtagggatggtataattatatacagtttttaaccatcctactttctgcaacatggaaaaatagtgattattggaatttatatttatctcaaccttgtttcagctgatgagttcaggctgctttaaaaaaaaaaaaaatcacagaaagaggccaggtgcaatggctcatgcctgtaatcccaccactttgggaggccaaggtgggtggatcacctgaggtcaggagttcaagaccagcctggccaacatggtgaaaacctgtttctactaaaaatacaaaaattagcagggtgtggtggcacgctcctgcgatcccagctacttgggaggctgaggcaggagaatcatctgaacctgggaagtggaggttgcagtgagccgagattgtgccattgtactccagcctgggcgacaaagcaagactccatctcaaaaacaaaaccaaaaaacacagagatgctataatttattataaaactaatgctagatttggagtcaaaagataagaatttatatcctggacttgccatttaatatctatagggaaaggcctcttaatatctgagaatgtattttctcatctttcacatggaactaaaaatgctttttctatattatgtggtcaatgtgtgcgaagcgtgatgtgttctgtgaaagtactacctgcgcacaggatgctgcctccatcacagctgctgttgtgcagcacagcaatccggattgagttgtgcctttcctctgacccctgctgctcctatgctgagagctggcagcctggcaggagatgtagggaagacaaggggaagcagagacctgggctgtgaacaaaatggtcagtgtccggatcactgacctgagcttgactcctagactcagatggtgagagacaaccctttcccttctctggaatccttcagatttactgaagtgmgaggtgttggaagtcgtcacttctgtgaaatgtagaagatggattggtttaaaatttagggtgtagagtcaaaccaatgtgagtttcagttccagctctaccatgtrgcagcattgcatcttaggctacttaacctttgtgagcctctgatcacatgatttagtgcccacctcaccaggctgttgtgaggaataaatgaggcagtatgtagagagcactgttggcatggctggcccttagtaacacttattctttgtgtataataacatggacaattgtagtgccttctccctctcagcactgtggctttgcatccactcaggtttttgggatttccttasacattttttcatataaactcaggargttcccaagggaacacactccaagaattagatgaaaaamwctgcagaaaaatccacctcacatgaaaatctctgtatttaatatttttaaaaarttaccactgtgtttgttgcagctgtgacctctacaagttccagagactactctctgacttttggtgcaatcaaccaaacatggtcctaccgcatccaccagaacatcacttaccaggtgtgcaggcaygcccccagacacccgtccttccccaccacccagcagctgaacrtggaccgggtctttgccttgtataatgaygaagaaagagtgcttagatttgctgtgaccaatcaaattggcccggtcaaaggtaaggtttccttttttgttgttgggtaaaaatgacatccttttaagtagagttagaatgattcacagaggttactaagggttacctagygccatgctgtgttaygtgctaggtataaggatgaatagagcagatccttgcccttgagttggaaacagaggcagaaaagagttttagggcagggaacagtgtccctgccaaagtcaggaaatagagcatagtatgtgaagcyggtttatagcaatacccaactgtgcgtgccaatcaggaatatacctgtgaacaaggcagacyggaattaggagggagagtgatgctgacaagtatttgttacaagtgtgatgagagcagggcactgtgagtctagtttgaagattcagaaaagatgtccccaagaaagtgacattttagctaaaacagatgagaagaatttcatccaaaactaaggtggagcaaagagctagtatctggaaaaaccaaacatcatagaacttgatgtataacctccccctccatgattcccagaacattatacttaatggtgaaagactggatgcttttccctgaagcttaggaacaagacaaggatgtctgctgttgccacttttattcaattcagtactagaatttctagccagggtgattaggcaagaacacaaaataaaagccatctaaattggaaaaggacaaagtaaaattagtctcagatgacattytgtgtagaaaatctcaggaattcactaaaacactattagaactaaagaacaagttcgcaatgttataagatatgcaagatcagtacaccaaatygtatttctctatagtagcaatgagcaaactraagattaagaaattgtttcaaaaagagataaatttttaaaaagaagtgcagtacttgtacaytgcatcccacaaaacatttttggaaaaaaatttaagacccagttaaatgggaagatgttccacattcatggattggaagacttaatactgttaagatgtgaatacttcccaaattgatctattaattcaacataatccctatcagaatctcagctggctctttgmagaaattggcaagctgattctagaatttatatggaaattcaaagaacacagaatagccaaaacaatcttggaaaagaataaagtcagacttgtatttctcaaactcgaaatctagagtaatcaagacagtgtggtcctggcgtaaggatacatgtaaagatcaaaggaacagaagtgggaacccagaaatactcacattaaaagtcaattgctttttcaacaacagtgccgggagtggggagggatagcattaggagatatacctaatgctaaatgacgagttaatgggtgcagctcaccaacatggcacatgtacacatatgtaacaaacctgcacgttgtaaacatgtaccctaaaacttaaagtataataataatagaattctgatggttaaaagmcaaaacaaaacaaaaaacacagtgccaaaacaattcaatggagaaagaatagtctyttaaactattgttaactatggtgctgggaccactgagtgaccacatacaaaagaatgaagttgaaccttttacctcacagcatatccaactcaaaatgggccaacagacctaagtgtaagagttaaaacttttagaagaaaacatatgggtaaatttttgtgactttgaatttgctaatggtttcttaggtacgacactaaaagcacaagcaacagcaaaataaactgggtgtcatcaaaattttaacagtttgtgcttcagaggacattattaacaaagtgaaaacacagccatagaatgggagacagtattttaaatcatgtgatatttgttctagagtatacgaagtactcttacaactcaataaaaaaacaagctaactaaaagatgggcaaargctctgcaaggacctctctccaaaaagatatacagatacccaatgggcatgtgtaaagatgctcagcatcattagtcatcagggaratgcaaatcaaaaccacaatgagatactactttacatcatgtggtcgagtataatcaaaaaaygggtaataacaagtgttggcgagaacrtggaaaattcggaaccctcatacgttgctggtgtgattrtaaaatgatgtggctactgtgaaaaacaaaatagtggtttctcaaagtgaaacacaaagttaccatttaatggagcaattctactcctttctatatacccaaaagaaatgaaaacatagatccccacaaaaacttattcgtgtatattcatagtggcagtattcataatagccaaaaggtggaagcaacatacatgcccatcagttgatggacaccaaaaaatatattcatatactggaataytattcaaccataaaaaggaatgaagtacrgatacatgctgcaacatggatgaactctgaaaaccttaagtgaaggtagtcagtgacaaaggacagcatactgaatggttacaattatgtgaaatatccaaaataggcaaatccacatacatagaargcatattcatggttgcccagggctaagagataatgagagcatagggcgttaatagctaaagggtacagggttaattttgggggtgatgaaaatgttctgaaattgattgtggtgacggttggataacactgaatakackaaattgtttaattatgtactttaaacggatgaattgtatggtatgtgaattacttctcaactgaaggccaggcatactggcttatgcctgtaatcccagcactttgggaggctgaggtgggtggatcacctgaggtcaggagttcaagaccagcctggccaacatggtgaaaccctgtctctacaaaataaaacatataaatatatatatatatatgtatatatatatacatatatatatacacaaaaaaatttagccaggtgtggtggcatgtgtctgtagtcccagctactcaggaggctgaaacaggagaactgattgaacccaggaggcggaggttgcagtgagccaagattgtgccatcgcattccagcctgtgcaacagagtgagactccgtctcaaaaaataaaaataaatggaagcaaatastagtagaaacaaaactctaaaaccattctcatcgggtacartggcttacacctgtaatcccagctactctggaggctgaggtgggaggatcacctgagcccaggagtttgaggccagagttggccacataacaagaccccgtctcaaagtaagcagtggttctcaaatttyaatgaccattagcctcacctgtgaagactgattttaaaatgttctaggcatatcatgtcacagaaagacatgcaggaaacttaaaagcatgttgctctgtgaaagcagctagtctgaaaaggctacatacagaatcattctaaccatgacattctggaaaaggttacactatagagacagtaaaaagatcagtggttgccagtggttcaggaggaagaaggagaaggatgcataggtggaacatgggatttttagggcagtgaaactattctgtatgatattgtaatgttggttataggccattatgcgtttgtcagtctatagaactgtccaacaccaagagtgagccctactgcagactatgggcattagttaataatgtgtcagtattgattggggataacaaatgcaccacactaatgcacaatgttgataataggggaaactgcacattttgggtggggggatatgggagctctgtrctttctgctccatttttctctaaatgtaaaaccatcctaaaaagcaaggtcttaattattaaaaaatgtttcaagcaagccagaggatgagcttgtgaagtcagggaactctacagatgggaagtggctttgtcagatcaaggggacattttaattctgaaaaccaggtcatgttttcccctagaatgtaagagccacaccaggagaaaaaaaccatcttcctcaattcagccactgtattgaaactgttgagcccagagttagctcctcagtgaggtgaatctgtaagtgataygcggttctgtgctttgttattggagctragggctccttaagcctcagcaggctcaataaagaagtgttgcttcagcaatatgacaagattaaggtacaaggactagactcttttctaggatgcgaaagtgacttgtaatgagaatcccgaggtgctttggttttaagaaacttggttgggaatgtaggcattaggtgcccagakattggattgtaaggtagcaartgaacacatgaaaatgtgagttgattttagaggaacatgtaaattagaaagggaaagattgctgtagtagatttctcaaagagagatttaaacctactggggagaatggtctttacctttaaatgtccaggtcagccctgtgttgggtgtaggcatctgatctgtaaaagcaactgttagtgaaataatttcccaggctatggagtcccattcagattctggaaccatttaggaaaaagatgtgtctctgggtatatttttccyagagacataccaaatgagagtaagaaaggatcagagaaagcaaactggcaggtaccaagttgcttgttttctttagaattttatgattttccctcccaccccagtcaaataataatatcaaagsatggtttacttggtgccaagtactgttctaagcaccttacaygaattaactcatttaatccccacaatgacctctacccaatggtggggtgggggtggggttatttgttatcccattttacagaygatgagactgaggtatagaaatgaagtaatttgcctggtcatagtaagtgacctgggtgagctgggactcaaactcaggcactggctccagtacgcacacccttacccctcatggctctgctgttccacagtggcctcatgactgcctcataatttagaccaaactttgaaagaggcaatgtgtgtcttttaaaccctttgtgtttgaaccctacttcatccacacacagcagtactgttcattctacctgaataggagggaaaaaaagaaaaacaaaaaagaaacacccaaaagttttttctttcccctcttggtacacagcagtatcttcctaagaactgctcagtttttccagagggaactatcatcttgttggrattcatgtgaaacagcgcagctgyccacacctgatgtgggtgtggtgcgacttcccagggcgaggatgcagaactggggtgtctttyccagtgagtaattggagcctctgtccctcggtgacttctcaaccagcagtgccaccccccacyagttgtttgagctttaagctttaagtgtgagtcagctgttttttgttgttgttggttggttggttgttttgtggggtcataaaacacgatccaaaaatgcttcctgtccttccacttcacgggtccttttggcgagttgaggaggctctgggcagagggctgtgcagtgaagctgaagggactgttcctttaaggaaaaccgctcttccccttgattaaatgagtaaattagttccagatcctctgttaagagagtcaggcagtttaagagggtgagggcgaaatagaaaatgtcttaagaaggatactgtgttctttacttactataataggagaaaagcttacaagtcatagagaatgagtcgtgaaatggttttagaaatgtattttaaaaatgttttgggaagccaagttcagtgaatggggccctgtgctcagaagagccccatgcttggtttaacgctttgctttgamccatgggctccacattttcattttgcactggggattgcaaattatggaactaatcctgtcagtgacatacattttaaatcagtattgagtaattagggacactttcttctcaattttaggtaggataatatatcctgtccaagtttgcaagtcaacttttgagctgagattttttttttttttttttyttttaatgcctagcagggtggtaagctcttgatgtccatgtgaacacactaatctttgctggaaygtgccatggtgaaattttgatgctggaaagtactgaataagaaggctaagcattagtatttataaatcaaaacatgttgacaattacttcctgctttggtggggtatgccaggcattttgtacagaatcttcctaaaatggagaaatgatggggatgatcacgttcttgtcttacattgggtcctaatggatgargacatgaccttgtccttagttataacctattgaggactgactcaggaacctggtctaggctcaagttaactcggcaaccacaaccccagtgcrgtgcctctttcctgtcagysaagagatccagaggaacggacstccaaggatgtctgcatgcttcagggagctaggcttatgctgacatagttcatcaggtttaaaaagtgctggaattatttattggtcytttgttttggcaaagattctgttactccagccracaacattgtggtgaactgaggataaacccatagccctccttattttcagccaataatacgggaatcaataatacgggaatattccactacaagaatgcactgtggtgtttcttataaagtgggatggaaagagtttaccagaaaacaaggctgtctcagccaaggcatcccagctcacagcaggctatgacagggcactggaagagccataacgtgggcagtagggcaggcacgggggagaatgccagacacccygaaggacttgggagcgagtccagtctatgaggtcagctgcagcagtcagcacttgggatctagattaggagtcactctgggcaagtctccccccatagcagtggggttgtggttgccaagttaacttgagagtatagaccaggttcctgagtcagcatctgttacaatggagaacaacagggtcatgtcctcattgaaggctcagtataagacaagaacctgattctctcctgttgttatttctccattttaatagaagattctgtacaaagtggggtgggagacaygggtcagaaagagtgaaatgatagagaatccaggaggaggtggtaaaatgggtggtactgccagtgtctgcctacagatgccatgatgctggtgtctgtgagtagtgagaactggtgagcaggatgggactcagaggatgctaagctggctatcaagacagggcctcaggcacagaagtatgaggcagaagcctgagttattacaacttagatggatctccctttgtagcagagatggctcaatgtagaacctgacaggcttagctggggctctggaaatcttttgagtctaagattagagttaattctagggactgaggttgagctagaacctcaaataatgatgaacaktggccccactgagaaggcagaaggagtgcagtcagtagagactgggtagacctgccaatggggaattgcctttcaaatatgttctgttgggttttcttaattttctttagcaggattggcagatgtacatgttcctatttccattttacatggcagactcagaagtacacagaagtgccagagktgatagattcattctacctgagcatctgacactccttccaatacctctgtgccattggcttagactagataacttcatgaagttccttcagtgagggttgcagcaaagcggtggaaagcatgagctatggaaccagactgctagacttttattccagctccatccacctcttctgactgtgtaaccctgggcaggttatttggcctctctgtgatgcagcagaagtggagatagtattttcctcaccatgtagttagaaggatgtaatcaggcatcctcctatctgtttagaacaatgcctcacacataactgctcaatgagcattgactattatgtagaaataaatatatatattttaagacatggtcctgttctgtcacctaggctggagtgcagtggcacaatcatggctcactgcaagcttaagctcctgggctcaagtcatcctcctgyctcaccctctggagtagctgggactacaagcatgggccaccatgctcggctaattttctttcttttcttttccttttctttcttttctttttctttctttctttctctttttctttctttctctttctttctttctttctctttctttctctttctttctttttctctttctttctttctttctttcccttccttccgttctttctttcttttctttctttctctttctttctctttctttctttctttctttctttctttctttctttctttctctttctttctttctttctttcttttctttctttctttctctttctttctttctttctttctttctttctttctttcgagataaggtcttggcatattgcccaggctggtcttgaactcctggcttcaaactatcctcctacctcagcctcccaaagtgctgggattacaggcatgagccaccatgctcagccaaaatagatttctctagggragatttcagtygttaagtaatcgctacctagtgagtagatggatccttggtaaggctactcctgaagagtaaatactgggaaagtcattcctgtttagtcttagaaatctttaaaaarcaagatttttaaaattaattggatttacctataaaaattgggaattttagtaagagatcaacagatttagaaccaggaagttggagtctgagtctttgctgtgccacttcctgactttgtgagcttgggcaatttttcccatgtctcactygatttccttatctgtgaaaattacacataatggggamaacaactcaccacatagaatcatcccaagaatcacaggaaataatagagcaaaagcacttttaaacagatgttttgggcgtttttattccctggatgcaaacctactgaaagcaagtaaaggtactagttgtctatagkgtaggcaataggaagccatgctggagtttaaaactgaagtgcagaaaatccaccctagcttcagatatggataatttagtaaggtcttcmggtgtgtcacaaaacacagacatgcagtcagttccgaggactcctctatctccgtgacatttgcttaccaatagccagattgtgcttttatttcccctctactcatgcagargattcagaccccactccggkgaatccttgctatgatgggagccacatgtgtgacacaacagcacggtgccatccagggacaggtgtagattacacctgtgagtgcgcatctgggtaccagggagatggacgkaactgtgtgggtaagagccatgttctcgtgtctccttcttgtarcccttgtttttcctctgccctccccagccttatgtctgtagaagacaagtatctgtcacctttacaacctccattgtcaatgattttagcagctgttaatctgaatatagttatttaaaaattaaagcatagctgtttakgtttgaaaagatggtttggagtggagtggattttgcaccggggctgtgaaaagaaaacatctgttgcagttcctggatgttttgagttaagttttgtaattttgagcttttgtagtaagtagttcttagacttaccaaaaagcacattttctgattttctttaaattttagacagacattgtgtgtcttatatccccaaaaggcaacggtagaaatttcttgatattaaaaaaaattgttggttttcttccaagtatccattctttttaaaacagttaaagaattcttagaatattcacttaaaaatttatcttcctgtggtgtttacttgaatggcatgaaatttttactatttctgattatstgcaacatgcattcatatctgatttttaaaaattctacatctgccaaccatttgtcccattgaagcatcatactagtgagaaaacattgartttttagaccctccacttctgggacccttgaattaagcagaatttttctcttctcatttcttcttagatgaaaatgaatgtgcaactggctttcatcgctgtggccccaactctgtatgtatcaacttgcctggaagctacaggtgtgagtgccrgagtggttatgagtttgcagatgaccggcatacttgcatctgtgagttccaaaatcattttcctgtgtggccaaaatggtgctctttaatcttgctctttaatctatcagtgttttgacttctgctattcagaggctctgctatatggttttcttaagaagacagtttacatcaaaataacccaaagctggctggatgtggtggctcacgcctgtaatcatcgctttggaaggctgaggcaggtggatckcttgagttcagaagttcgagaccagcctgggcaacatagcaaaaccccgtctctacaaacaatacaaaacattagccaggtgtggtggcacacgcctgtagtcccagctactcaggaggctgagataggaggattgcttgagcgcaggaggcagaggttgcagtgaactgacagcatgctagtgcattccagcctaggtaatagagtgagactctgtctcaaaaaaamaaaacaaaaaaaacaacaaaatctctcaaagctatggctcagtttcagccctgtttattttcactgtttttccctaaatagatatttttggtgttgagttattgaaggatgcccacctcagttgggatttctggcccagtcatgtaacaagatgatgaacttcactagtaaacayctccagctctttagatagagcctaaagtatttttcaaattrgaagagatggatttataattcactgatgcatgtcctacttgactggctaaagagctccttctgtaacaaattacctcttctrtatttccagaaaatactacagacctaaaaatggatcaaaagaactatcccaattcatcccattgataaagatggatgagagtaaagaaaatgcactctttagccaggcatggtggctcacgcctgtaatcccagctactcaggaggctgaggcaggagaatcacttgaaccagggagttggaggttgcagtgagccgagatcacgccactgtactccagcctggcgacagagtgasactccatctcaaaaaaaaaaaaaaaagaaagaaaatgcactctttaattcagtgggatgagggtaaaagtrataggagaaactgcktgtgtgtgtgtgtgtgtgtgtgtgtgtgtgtgtgtagcaattgctctggagtgttataaactttaattgaggactgcttaggtgatgggtttttgtgcttagtattttaacagcaaattcataccagtacttgaactttaatagcatacaaaccatctaggaatcttattaaaatccagattctgaatcactggaccttgggtagggtctgagaacctgcattccctggtctgttgctgttggtctgtggatcatgccatgaggagtgaggctcatcctttgcaggcctaaactstggatgcccttatcttcttytcttttcagtgatcaccccacctgccaacccctgtgaggatggcagtcatacctgtgctcctgctgggcaggcccrgtgtgttcaccatggaggcagcacgttcagctgtgcctgcctgcctggttatgccggcgatgggcaccagtgcactggtgagtaactgcaggtcagcctcaatgactggaaagttgctttggatgcacatccccacatagatggagctctcccagaaaagacaaaggacttcctttgactctaacagccttgtggctgccaaaatagtgagaaaaaagcgtcctttgagttagaaaggggagccaagggtgatttcctctggactagatgggsgagcatatatggcttccttggcggagacgttcctgtagcactcgggagcttctaaccttggttccttggagccagcgcaggctggaggaatttagggaaagttgcataccttcctgttaggcggtctccaccttaattcaacacttatggttgtgctcttmtgctttaagtgatattttaagcaatctctaaacacatatgtaatttctaatttttctcctctttcaaaagagagaactccacatatataaaaagacacatatcaaaacttttctcccagaaatctatctttaagacttaatgcagtattttataaaagcaccaaaccatttgcaaggctagccattggaatttaacttagaaagaatgtgtgaggttgttatttaaaggctcgacataactctctgagtataaatgtccatgaaactaggattaggagtactttaaaatagaaatcattaaataaatcttaaatcacaaaaggttttccaaacataccctgtggtatgtgatcagattgaaactcagtttcacgtgagtcacacacacacagttagggtaaaacgacacactggggatgagagaatggtgggaaacgtgtttagaatgggaaagggcctgctggggaacatgaaccttaaaaggcagactttcycctgctcctggtgttgctgtgtgcatctgcctccatccrcccaggcccaccgagctgatgtgctaagaacagctttgcaattcctgggagctttataccagatccgaatagcacgggcctccctcctcctcaccagatgtttgattctcatccttctcccattcctttttcccctttggtttcagcaggatgggctgagtggacagcaggctgaggccatgtgttactgacagaacaaaggtcactgtgacagcagctcagccctccacttctctctggatggggcaagtgcacatggtggtttctgagcctcattcttactctttccacttgtgctgtacagaagctctgctgcatggttttctcgaacaatttatgctgaactaacccaaagccgtggctcagttcagcccttttatttttttctttcactaaatagatayttttggtggtggtattgaaagttgaagctatggcttgaatattcgtcttcttcaaaactcatgttgaaacttacattccactgtggcagtattgagaggtagggcctttaaaaggtgattggatcatgagagctctgcccctatcaatggattaatgggttatcttgggaatggaactagaggcttgataagaagggaggcctgcctaaaataacatgttagcacactcagccccctcaccatgtgatgtcctgcaccacctcagscctctactgagagtcccaaccagcaggaaggccatcaccagatttcaacccttgaccttagacttctcagcctttagaactataagaaataaattcctttcctttagaaatgactcagtttcagatattctattataaacaacaggaaattgactaatacagatggtaaccctcagttgggattcctgtgtgtcttggtattaggcccagtaatgtaagaagactatggacctcttgaataaacacccctagctctagataaagagtatttcccaattagaatgaggtagatttgtaattcacagatgtttgtcccacttaaccagccaggagctccatctgtcatagatatactggtgagaaaacattgagtatatctataatagatacactctttacagataccctctacaggtatggagttcagggtgaggtgccaaagcctgacagtgggaatgatgcttttccttcgtgtggaacacatcgtttgtttggtttaaccctagtaccagctctaagaaatgtgaatccactgagaaaaatcttgtctgtagaatttatttaaacatctggctgctcagatcagcagagatggtgcttttaaratatttagttccttagctctctggtttaaagcaaagaagttgaaattaatttcagcctagatatgatgagtgttaatcrgaatattaatttagattagrtgctgcatgctttgatcacttctacaatgattctctccctccttttttcttctacttgtcctgcaagactttgattaccttctggggtcatgttagggctctgaaattgactacttttccatattgggaatttaagtattgtcattttttaatttgccctatttttgtcattttcaattgtcccyattttatttctggttctctgcttttaggattctttccaaagcctacaaactaaaaatatgccaaacccatcaggtgcttcccccagtgtattggttatctattgctgtataataaattaccctaaaatgtagcagcttcaagcaatagacatttaatatcagtggtccagrgacctgggaatggctcagctgggtcctgtgctttaggatctctcacaaggccacagtcaaagtgtctggtgggtcagtggtctcatctgaaggcttaactggggaaagatccactcgtggttatgggcaggattcggttctttgaggaccattggattgaaagccttggttccttgctggttgttggctgccttcagtttcttgccacttgggcctctctaacactacagcttactttattaatgccagagaaagtctgctagcaagatggaagtcataatcacaaaaatgacatcccttcaatgttgctttattaattaaaagcaagttactgaaagggtggggattacacaagaccatgaataccactaggtagggactgttgggggccatcttagaggctgcctaccacagccacttaccatgtagttgtcttctaaactttcagattgtggagtagtagagaatgaatggtcattttcctaaagacccatgcataaatcaggctaggctaatcatgaaagtaacttgaagaataaatattgaaatatatgtgtatgtgtgcatawttaaaggcattccatagggtacatgtgtctcagtgaccamagaacagaggctgtattttgtgggtgctatgcattgttaaagcacatgctcttttactcyatcaaactaacaataagggggtgtgggagtttttctccagccatagtttgttaaaaaaacyggctccctggagaggctgcacttggatttgggttctcagtctggtctgagtcactagccaggaggcttttatccaagtagagttaaatcctctgcagcttccctcaatctggagtgatttcaaacttgtgttggtgtgagctggatatttctcagacatgtttgtccttttggattgttgtgacttggccaggtgcaaaagcagattgtcttgagttgggaccttcccaggaggagcaagtgtgagtkgaggaagctgggttacagatggcccattacccagagccatcattactcaggggcctgagggaagatactgacattattctttcttgggtttcctggcgttttttcttttcttatttttttttaatttttatttatttatttatttttttaggcagggtcttactttatcacccaggctggagggcagtggtgtgattacagctcactgcagcctcarccttccaggctcaagtgatcctcacatctcagcccccccaagtagcatgcccagctaattttggtatctcttgtagagatggggtttcatcatgttgcccaggcttgtctcaaactcctgagctcaatcgatctacccccctcagcctcccaaagtgctgggattacaggcgtcagccaccacacccggcctagcttctctcttctttgataacgaaagcatgatctccattatgtgcctggccaggtttcctgttccaagaatgtaggtagatgttgggtatggtatggtaaaatcagtgtggttataggaggaggcaaggatgaagcttgaaaggaagtagtttattacacttacaggtctggagtgggttcaccacatgccayacaggggtacaatcagcagggtgcccaattgaacagattgtgcagtagagagagagtgggacctgtgggttgaatcctttattgggatctgggatgggtttgaggttaattgatgccaagaaatttcactgggctcaaaggcaagtgggcagtggtgaaggggcgggagcctgggggaactcgaggccaggggttaggtttatcatccaacagttcctgctggttttgctcagtacttgggcagtgagaaggatgttgaagcacraaagcatgaactcgaaggatttttaacacattttccaaayaggttctttactagcttaatagagtgtaggattgcactgagattaagctacctctcattacctgagtgataaaggggctctacgacttcttgaacgtttttgtctttatagcagtccctacaggcccctgctagtaatgactaagcataagcagtggcctccttctccttctccaataaagttcctcccttgccagggggctgaaagtctttccatgttttctctcttgacatctgatgtcctgtgcatgcccaggtcccgggactctagtctctatcatggtgtgagaggccctccaaggaggagtcaggactgcgaattcagggagtctcaatctttggggcaggaatttctcacttgtgatatcttcagtctctttggggactttctcctccttgttggtcatttctaatagtttctgtctacccagaactttagtatctttgatgatgccaacagtatctgtggggaggaaggctggtctttcagattgagtcagaattcttaggctgaaggttctaagcacaccgttgatttatttggtagctctggggaatcccctctctcttgagttcaaaagtaacaataagaaactgctccatgggctccagaaataggccctgtgtctcaggaattcctgcttcctgtcattgcttggggttcctgttaccattagaagtacttttagcatgcgtattgtgaatagctttaatttcctgcattcrgctgaatgttaatttttacaggtttagttttacagccagttttacagcctattccaggtccaaggtattggatggtcaccagttttgcccagctgggcatttgaattgtcctgttgaagaggcagagccaagctcagggataattatgacaacattggttgatttcagggtaactgaggagccaatctggtttgtttctacccttgcagatgaattgatatctgctttcttgcctttataggcgaaatgatggtatccagggaggccaaccactcacctgggtggagactctatgggttgcawtgagttcagaatttttgggggaggactcctaggaactgatatatgctgactaaactccccagagacagaagataagcagaatacttaccttctaattataacataagagattcctctctagggaacagaacacctacgcttaatgcccagtgtgtgtacttaatggtattcgagaaagcacattagttattagaggatgacccagtgacagtgtggtctggacaaagggtggtgcaggtaactctagaagaggttccatgtgggtcatgggagcctgggtgaggagctagccctgttcccaacccattcacatcaaatttagggcttcaaatatctgtcttcccatgctgatgtgtctctaccatgggctgcaccgtattgatgcaacacattctcattttctaggtttcacactgatcacaccatcccacattttttttttttctattcacacattttaaagaaacttggttattactatggatggaactactgctttgttttattttcagccaagccttaatcggacctacaccctttgtttatcctccttttactctgaaagacttcctgtctcttaaagtagcttatctcatcccttgggcgttagttttaaccrttcaattctcagagctgctttttttctgctggggatgggaggggtgggtgacttgctattgtcggcatatgcggatttcattaaataaaaggaatgtaagttggcttttgtttgaagtgtcaggattttgttgttttgagaaatatgatggtgaaaattaatcctcatggtgctatgtggagagtgtaggggcctgaattgtttgtactgatatgcctggcaaatttagatttccattttgtaagtattatttcaaaaccctagataatatttttttcttatttcttctaaaagtggaaagtaaagaaaatacctggttaatgggggtgtggttctagatagtaagattctaattagtcaagacagaatgtgcttcttagctgaaaaatatttgggcctcatctggctcctttgcatctacagacgaatgttacagggagatggtgccaacaacgaaagaaaaaaaaaccattgttggatatatttgtctttattgcagcattgctgaaaggaagttaatgacttatagtctaaaggttagttcaaaggtaataacttccttgaattcactgtcaatgaaacatgctgtaagatgtgttgtttttttctgtgagcgactacccatttgatttctacactgaacacgtttagtctagtgtgttaactcacatgttccttgattttttttcttcctttctattaagcttacctttaggtgtcagcatttttctgctcatgctcaaaggtcttctgaagctgacacctcactgggtgttgatccacatatccaaagcccatgcagtcgcacagattgtgtgagtgaagtcatagtgttctttgcttctttcttctgtttctgacctctgcagatgtagatgaatgctcagaaaacagatgtcaccctgcagctacctgytacaatactcctggttccttctcctgccgttgtcaacccggatattatggggatggatttcagtgcatacctggtaagtttcagagggccagattaggcacatgaatctcttagctccttcaaggatatttttctatgacagcccactcttgatttagcctggtctggagccttggtggattttccaagctgtggatttttttccttggttacctcctgctgcctagtttactgatagttcactgattcgtaacatttctggaggcctgcgggagacgacccacccatcgtcctacctcatagcccctctggttaactgccctagtgatctgcttgaccttgatgagtgcaatttggatgaagtgttgagatcaagcttattaagcagagccttatgcgccggtagccagggttaagcccgtggcgaccgtgttagaggagcttggctagcttggtgcagtctcgtgagtggtgagtgccgttggcttgcagcttctcagacttaacctgtgggcctcagggcatgaatgagctttggcttgttttctccagagtctcttgggatgttgggcagatgccaccgctatccctcattttccccagatgacaatagggaggggccgggctgctttacacttagagccagctagggacctataggatgaactagaagaactggagagaaatgaggtaaatagtggcaaggtattataaaataagaatctcgggctccaaaatcccagcgcttttccatgccacgctgtgggctggtgaagtggatgggttgcaatgccttctatttctcttttgtgtcttcctctgccttgatcctggaagactccacctcaagcctgacaccctgtgaacaacagcagcgccatgcccaggcccagtatgcctaccctggggcccggttccacatcccccaatgcgacgagcagggcaacttcctgcccctacagtgtcatggcagcactggtttctgctggtgcgtggaccctgatggtcatgaagttcctggtacccagactccacctggctccaccccrcctcactgtggaccatcaccaggtgagcttaggcctggggctcaagaagcagaatggcactggtggtaggtagatcataattcctgcccagaccacgcaggcasggggccagtcaccatccttcatagcctctttcctcctgagaagacttgaataatagtgcgtacaaatatgcatgtttgtgtcataaggacatagagatatgcaatacatgacacatatgatctgttacacatttgcctcttagacccttgtccagtacaaactgaaagttgagattgtgtatgtaggtcagactgagaacactaccctagacctgttatagagcagcttagggagatctgacagttagaagatctggccagactggcgttttgaccagaaggaaaactgctttcctatgtaactatctcacttacctctgccttctgaatggcaggaaacagtatgaacgctctgttagtatcaataggaaaaattagaaaaataacacctgctagtggagccagttagttttctctaaactgacaatcccagccctctgtaacccagcccaacatctcagaggaggcacagacatctggtttctgttagcccatacaayctgagaacatgcctgctaccatctagagcattccccagctgggtggggcatggtgatcaagtgctcacagtcgattccaacagcaggcagataaggcaactttctgttccttgttgaattattcagggataggtaaaacttgtttctttaatcattacagaagaactttatttaatgaagagcataggattggcttgataccgttttagccaaaatgattccgacacagcttgctatccaaagatccatttttactattgagaagggttccataaatactagtcttggcttttaatgtgtgaaagtaagaagaactggagaattaccaatagtttttttcccttttaatggtgttaactgttgcccgggtatggtggctcatgcctgtaatcccagcactttgggaggccgaggcgggtggatcacgaggtcaagagattgagaccatcctggccaacatagtgaaaccccgtctctactaaaaatacaaaaattagctgggcgtggtggcacgcacctgtagtcccagctcctcgggaggctgaggcaggagaatcacttgaacccaggaggcagaggttgcagtaggccaagatcatgccactgccctccagcctggcaacagagtgagactctgttttttttgtttttttaaaaaaaggtcaggtcttggcggttctcagataggtaaaaattggtaatggtttgatccatagtcgctctttgtttctatttttaggaaaagattttaaaggtccaaaaaaggtacagagaaattctatttccctcatgccttctctttgaaaatgtcttggttctaactccatctgggatttgaagaaatcaaatggttgggaggtgcctttggggaatggttcagaattcgattaaatttattaagacaggcatgtgttaaggacaatgattttaaagggggaaccaagattttaaaggggggggaaccaagagactgagaagtgaatgacgaaaatagggtcgtgttctcttgtgcggactttttcctgcccacactctctcggcgctggtttggccccaactgctatctctgactggtctcatgtttgatggggtcagcttgagggagggtaaggacgctctgtgcccacaatttcaaaatacttaaacccttgccaaccagaagcacaagagaaagaaattcatggttgggttgaaaagtagcaaatagtaacgaatgaaagggatgcccatgtatgagtgatttgggacacccatttcccaggagttaggcatgtctctttgtttggaatgcagacacatagcacagggtggtcccttaaagcaaaaatggatccttggagttctgaatgtggagcaggggtggaattgggaacttctccaggaaatcctgyagtgtttgaggaagtagcatttccctctctgtgttccttgagacacatttggctgaagaagtcagagtcttaccttctccacggggtcttaaaaagagctttgtctyccatgggtcatgagctacagtgacaacttaacggcattcgcttcccccaattctggtgagtcgtgcagttgagctagagctagttgggtttgagctctgacaacttcattcgcagtcttttgtgttccaagaggaattgtaggtgctggaacctgatcataatgctcccagctttgttctttagagtcactggagggttttgaacggagtgacatgaaatgcctttatgtttaaaatgggccaytctggctgctgctaattgaatttacactggttttggagagagtgagggcatrgaagggtggaagcaggaaaaccagtgggaaggctgttgcagaaattgcagggagaggatgaggctttttgaccagggtgagggggtgcagtagtgagaagtaaagatattctaagtggattctgaagttacccctaaaaagagtttttgacatatcaaatgtggatggtgagagaaaggagggtcaaggataattaggtctgagcagtggaaaaatggaggtgccatttactcatatgggaaagaccaggggagcagctggtttgatggtgaaggcaggggctcagtttctattagtttctgatttctattatacatctaaatggtggtagcaagtagggttattggctatgtgattctgcagaccatgtgctttaagttgcaggaattaaaaaggaaggagaagcacctcctcttgtttaagttcctttgggtagtcctaacataaatgaacaagttatctcaataaccttctgcagcagagtcttctcagaacaacctgtattttggacaaagcctcaatggcactgtggaagcagcctgggaggaaactgctttgcaaccaaagccagcaggacttcaaccatggagtgagctgtgagggaggggacaagaggagaggatgctggagaaagrgggggaaagggcaacacggcaggaagctagagcctgcaggaaaagattcagctttgagataatcccaggcgcagggtggctaaagcaattctggaaactgggctgtggaagaaccatttttaagctgtttgccaccacctctgctatgctttactactaattccactcagttttacctttactccatgtagttttccagtgggtagacagagggcaccgtggcgctgggctttcagtaatactttctaagacacacactggccagtcgcaagatggccctctcctcagcagcttcgagcttgaagcttgaagcaagtggggaatgaatacaaattggctttaagcatcacctcggctactgagtccccaaggatcacctgcacaagtgctctgtcagcagaggcgcccgaggtacaggcaggatgggccttgtgggcctctcctggccagaaggagatcatgccccttcccaggctgagtgagctgcactgctgatcttacctcctcttgttctttcttgatgtggctgggccttgatgacagaccctcctggcaagaaagaagcatcacatgatctatttctgattcccatggtggagaagtacttagaacacatttgcttcccaagtttggtgtccacgggcttggctgagacctggacagtaggagaaggaaggccaggaggccaggcatggggtcttgagctacattttgcattctgtccttgactcacaatcaaaggtttttcttcttccctcttccccatctgctcagagcccacccagaggcccccgaccatctgtgagcgctggagrgaaaacctgctggagcactacggtggcaccccccgrgatgaccagtacgtgccmcagtgcgatgacctgggccacttcatccccctgcagtgccacggaaagagcgacttctgctggtgtgtggacaaagatggcagagaggtgcagggcacccgctcccagccaggcaccacccctgcgtgtaagcacctggccgcccccgctcccctcagctgtatctaaggcctttgctagggatggtgcctgctgtggtgaagtggggggacatgtggggtcaccaggtctaatgaaagaagtcactatgtgctatgttgatttataatctggtccacacaagatcccaatttgcgtttggtgtctggtttttgtcattagcagcttccataattggaacatctgcaactcggttcagcaggcagttactccccctccccagcccagggtgacaggggacacgtgtcactctggagtcctaaaaggaagctgacacaatgctggctctgttttttttttctcttgaaaaaaaaatctgttctgctttgttctgagggaagtgttttgctgtcttcttccctagtaaatggcagatttacataattgatccttaaaaaaaccctagaaattagaatttcttttgaagaacatctggagcacatctgcgtagggcgaagaacttttgatatttttggaggctctggtatgtggtaaagtaacttttcttcccatctccctgcctgcccttgttccccttcctgctctcccaccctctctcccacaggtatacccaccgtcgctccacccatggtccggcccacgccccggccagatgtgacccctccatctgtgggcaccttcctgctctatactcagggccagcagattggctacttacccctcaatggcaccaggcttcagaaggatgcagctaagaccctgctgtctctgcatgtaaagyggatttctcctgtagggggcagggctgygtggytttcccagtgggagccacctcacaggccctgttgcagtgaggtggactggtgcagggaagtcctggagggtttctgagctgcagcccatyggcatgggcccgatgccaccaccataggaccagggctctctcttgctgggagtcacctgtcactgaccaaggctgtgctctctggttcgttcatggagtttcagataatatggaaagggaactttagagttgtcagcacatggaggctgtatggtgatccaagggaaaatggaccgactcttaccctaagtccccagggttgtatgtcataacatctccatggaaatcctggaaatcaaagtgacaggacaacyagtcacaaggtgtgatctctgcgrtttgttggggactccaagtggaagtcagttaatgactgtctcaccgttgcagcccttccctttcactttggttctgtccctttgacccacttctttcctaaccttccctgactccatagatgaaaacttgaggagtgtgtgatgctgggagaggagtggatggagccttccccaggggatgtttgatgcttcctgagccagcagcctccctaatgcaaggcaccccattttggggagcgggttttctcaaaaatggaggaaaaaaaagggtggctgtctcgaatggcatcgacacagtggaaaatcatctgattccattgttgaacttcacactccaggcacttgctcatccctragaaagaatagtacggcattcaagtttacatttacttctgttaatgaacgacacttatttggttccagaaaagcttagaggcagccagtgtttaggaagagatgtgttctttttaagattcgagtttgttgggtcctgtcccctcccccaagaaaactctcacattgttttgtaaaactttctctggaagaggtagagactaagaagttgacatcactttaagctaaccctcttttattcaagtcatagagcttgattgcctttctgaacatgcccctgaccaggacagggtggtgatggtagtggtagtggaactgaaagaaatgggacgtgggttatttgcacattttaaggaaatttacttaaactgggactttttctctaacctgaggttatgacatgggtttatgaatcccatgattcccgggttaatggaagctcatttgaatgtgtactcttgcctgggacaaacgacttttcaattttcaaataaaagtgtagttgaccttaggcccgccccccatataagctgcctgtttttccactgaagccaaatcccgttttgtacaatctttcttggctgactacgctcccagggggcgtaagtgaagccaagccccaggaggctgttaggcaaggcaggaacttgtatgacctcagggacagccagctaacccctgaatgttggctttgcacatctgctgggcttctcagagcaggagcctggattggaaactgaatgaagcaagttctgcatggagttgaggaaaaatatcagactcagcattttttttatttttattatttttttaaaagacttgtcatttatttagcaatgaggaggagagacctcactagccagaggttggataaccactactccctagttccttaacccaataaattagattttttccttcttttgagacagggtgtagctctgtgttgcccaggctgcagtgcagtggcaccatctcggcttggtgcagccttgacttcctgggctcaagcgatcctcccaactcggtctcctgagtagctgggactacaggtgcgtgccaccatgcccagttcatttattttttgttttttagacggggtctcactatgttgctcagtctcgaactcctgggctcaagcaatcctcctgctttggcctcccaacggacagggattacaggcgtgagtcactgtgcctgactacactttctttagtacaggatataaccaacatcttgcctcctaagagtcaggggcaggagtataggtgattgtacttcaggtagaggaaagatctcattcacagaggaggggagagtagattttgttggcatatagtggcaaattttattaaggctctgggaaaagtgctgatgacattgggaaaagattcagtttttacccagtaaaatattaaaaacttattttgcttaaggccatgtcctctaattactgaaggggctgatttttttttttttttaaatcatcagtcataatagcacctattgaagggcttactgtatgccaattactgattaggacactttacaagcacttatagtattaatttttatagcaaccatrtgaggcaggtacactattggcctcattttgcaaatgagacaaacgcatagaggttaaatgcccaaagccacatggctactaagtggctgagcctagatttcacccgagtgcccacatgtccagctactctgctctgttgcctgcaggatcacagtgcagtgttgctcactgcagctgtgcatgagcaaggcagctgagtgtgaacaaaggggaaatgtaacctaattcttctaattctatgatttgatgcacaaagggctccataatcgtgggaattgattacgactgccgggagaggatggtgtactggacagatgttgctggacggacaatcagccgtgcyggtctggaactgggagcagagcctgagacgatcgtgaattcaggtcagcagcttcactcagcagtctgcatttcatttgattctacaaagtcacttgtctactttacgccgaagtctcccctcgatttttctccattaggggaggttaagttctaggcaagtcattttattgagctgtataagactagccccctctgtaagcaaacaccttcatacatacggaatgaaataggtgattcctactgtgcgcacttcttaaaagaattcatggtaagaattcagggtgacgccttcgtttattcagcctggctctggcactgtggatgccggttgtcatcaaactggtaggtctgctggtctagaagctagaggtagtggaatatgtaacaaaagtacttgtttctctattaacctggttcttggggacttggagacacttgggctttgytttcccctgctgacccccctgcccacccgacygttggagggcttcaggtttgccctccatatcctgcaaacactccagtcctgamtttgctttatttccaggtctgataagccctgaaggacttgccatagaccacatccgcagaacaatgtactggacggacagtgtcctggataagatagagagcgccctgctggatggctctgagcgcaaggtcctcttctacacagatctggtgaatccccgtgccatcgctgtggatccaatccgagggtcagctgggcttccctaattcttctcttacctgtagatcctgatgtgaagcccttgggttttaaatacaatgtggggaaggtcagaacaagagagtgaaagctcaaatgcattcakgtaacaaagatttactgaggatctaagaggtgtcaggacctgttctaggaaaagacaaggtctgttctttcatggcacttatattttattaggaggaaacaagactggtataaacaatattagtctgtgatgtgatatgtagaaaattcagatagtgttgtgagaactagggctrctctgaatcaaatgatcaggcgaggcctcagctgacacttaaactggaagtgaagtgggattcctccagcagcacatttagaaaccagggttgacrctcacagtagggctgacctacatcaagtgacattagccaaagctcagacacctctggcttcagtgttgctgtagcagaaatcaagataaacattttccctgtctgtataattgctaaggtcatcaaatgtgacatacaggatttgtycactgtctcagtacttgttacaatcagggagaatttttatatcttgagaaactcttgccatgtttaagtggagtttctacgaaatgaaattcccagatgcccttcaaatcagtaaagaaaaccttcagctttaattttcaggtaagtgctttttgactatgaaatacttagtgcagtgcctcaaaggtggtttcaaactttgggttctacacacaggaaaagtacctgtatccttctctattccagttgacttaacaggaattaatagccctcttaaaaactctttgcataggcttgcctttctgacatttggacatttggaaggtccttttttcttttttttttcttttttttgagacaaggtcttgctttgttgccgaggctggggtgcagtggcacagtctcggctgactacaacctccatctcccgggttcaagcaattctcctgcctcagcctcccaagtagctgggactacaggcatgtgccaccatgcccagctaatttttgtatttttagtcgagacagggtttcgccattttggtctccaactcctgaccctgggtgatccacctgccttggcctcccaaagtgctgggattataggtatgagrcactgcgcccggccccttattccttcttggtgcttgacctgaaaactggggagagctgccatcttgtaggcaatgaaactttggccatgtctctggagtctggggaaaaagcatacttttaagctgaaatccacatcacagccatgagtttaaatatgaaagtagaactttcttatccagacagcaaatataaatgctaaaggacttgaatttttaataaaaagaaaacccaccttgaaccaggttgcaatataacacatgtaattacatctccttcaactgcgtaacagaatggttgtcaagccttcctgcatatttctcatttgctttctatagatttcacctttacaactttcttcctctggcaatccccaaataatttacaccaaatatctgtgtgagcttgtttcagacttattgttgttgatgatattaaatcattttggggaggagactgatcagaagcgatgaagcaatgatatgcatgctgtaccctctggccacctccaccttagcgcaaagtggaaactgctttctagcttttgctctcagcttctctctgcttcatctgttgggcataagggatgaaattcgcaacaggggaaacctatggtttcttcctctcctctcactgaggttctctgtagcccaactgatttattcaaagcttctatagcttttataaaatagtattttataaaaagtgctttcaacattatttctgctctaacgataaacctgtttgtttccttataacctatttccacttaataggaccatatttcctcgttagtatctgttatgaatatatttcatttttaacgtggcatttaaaaggtaaagtgcttaacttaaaatgtttccatccctgggtgccaggtaccccttcaagtaccaaattgtatttttggcagaagaaagaacagtttccttctcaaatccctggtccacatctcttcaagttccatagtttgtatcgaagccattcctaacagctgtatttgtttctattctaaaacccaagatccaattcaagacttcaacaaacggagggttttggggcagttgagtcaaggggtatcttggaggcagggattctgatagtaacttagtaatgacttctcccacatagtgacaataatcagaaaaccttgtgatacaggtaaaagtggaatatggctgtgtattagttacctactgctgtgtaagaaattgcccaaaccctcagcagtgtaagataacatttagtctcacagtttctgtgagtcaggaatccaagtgtgtcttcaccgagctccctcaggcatggagtctctcacaaggctgcaatcaggtaatggccaaactgcagtgatcacaaggctcagctcggggaagacacagcccaagcatgctcacatgggctacaggcaagactaatgtctctggccaacagccctcaaggacatcagttccttggcacatgttcccctttacagggtagcttgcaacatggcatccagcttccctcaaagggagcaagagagagcccctaaggcagaaaccagttttttgagaccgaatatcggcagtgatagcctatcacttctgctatactctatgcactagmagaagcaagacactactaatgcagcccaaactcaaggggattgcttaaggctataatacatgaggagatggagatcactgggggctgcttagatgctgcctaccacaggctacatrgctattcttttacaatcttgatttttaacttacagcaacttgtactggacagactggaatagagaagctcctaaaattgaaacgtcatctttagatggagaaaacagaagaattctgatcaatacagacattggattgcccaatggcttaacctttgaccctttctctaaactgctctgctgggcagatgcaggtaatactactgatggaatgcaaatagataacctctcatcacagtgaatgtgagcactaacagattttactacaaaatgaaatcccatmacttagatctcctttctttggtctgtaaacttttaagtactagtaaatttaagtactagtaaatgagtcttaaaatgaactttctggggtttgggtggagggaaggatatatcaagcagtaagtttgtactgcttgcctgaccatgagtgcctggcatatttttaacagttaaaagaattagccattgttgaattgacaaacttaagtgaagttattcttatgyggggagagggtcactataacttacctataaacatctgttataatgctaaggacattctttggaaagcattgtagcagggtagcttccttcagtaataacatgggtattagcaacctacatttgtttgcttttatcagcacaactgaaaaaatgctgtgtgtctagttctatactaaagaatatgaaaaagactgttcttgaatttgtaatctaataaaagggcctaatgtacataggtcacttttataacccagttgtttaaaacaagttacatttcttaaaaggatttgaaatttaaatcggctccatgagaaatgtgaaacttggaaattcttgaatggtttagctattgtaaaaatttttaagactgattcctttacattgaaatatragttatgttaccattttagtcacttttttcctcctacctagaaaatattttaaaaatactaaggattttggttaaaaggttgcctcagtaattayagacatagcttacaaagggcaagtatttacccagatgttataatttataagctaaggcttgaaatcacacaaattataaaaataattatgtttaatgccctactttggcagaaacttaccagatttcagtaaatgcaatcctgtcttccaaaaaaggattgaaagtttgaatctctactaaaaactggagactagtaataggacaggtaattttacagttgctaatctatgactgtaatggaagtaaaatatcctatttccccattctatcactgtgtcactatcactatgtcacyatcatttttggcaaagcagctgaaggacctcattttccccctttgttttaaaaggaaccaaaaaactggagtgtacactacctgatggaactggacggcgtgtcattcaaaacaacctcaagtaccccttcagcatcgtaagctatgcagatcacttctaccacacagactggaggaggtgagccccacaaattctggacaagcctgaaaaggccaactgttccagaggacacaccacttgttttamcaaaagtcagtacctgacttgactcattaagccctctgaggcttttgtttcatcacctcctcattggcagataagatccttcaaggatgtttttcatcctttcatgtttttgaaatcatccttttacttcacccagaaatcgaatggtattgctcacatatagcttaaaaagtagcaaagctattggataatgtctcaaaagggagcatattaatctaaatatgttctttagagaataagactacccttgataccatgagctatattacagggcttaagttggcttttgacactgtggacatattgtctgagggaccgaaaaatactatttagactagttctcaaatgaggaactgtggaacattaaagtctaagccctttacaccatgccctacaactctgatttgatagctcatcatgtgattctaacatgcagctagagatgagcaatggatttagagcaatggtcttcaaacttcagtatggctttagcaccagccctgggacagagaaggctgccagaaattttcctctattgcaactgattttctgtggctgactgacttctttatctagtaaatgactgtccctgaattcactcttcctttctgttaccagggatggtgttgtatcagtaaataaacatagtggccagtttactgatgagtatctcccagaacaacgatctcacctctacgggataactgcagtctacccctactgcccaacaggtaaaaagtatgctttaggatgctcctttaaattagcagggtagagaagggatatatatggtatttgattacccctgctgcctgtgacactgccaccattgccttcttcctgccctgagggccagtctttactaccttaaatctacctagtttatacacaaaatgcaaagacttgctgttgcaacttggttacaatatactcacccaccaccctgtcccacccctgctcttctctcacaggaagaaagtaagtacagtaatgtaaaggaagacttggagtttacaatcagaacctggaccctaaagaacagtgactgcaaaggcaaagaaagtaaaaaaggaattggccattagacgttcctgagcatccaagatgaacattttgtagtgcaaaaagacttttgtgaaaagctgatacctcaatctttactactgtatttttaaaaatgaaggttgttattgcaagtttaaaaaggtaacagaattttaactgttgcttattaaagcaacwtcttgtwaacatttatcattaatatttaaaagatcaaattcattcaactaagaattagagtttaagactctaaacctgatttttgccatggattccttctggccaagaaattwaagcacatgtgatcaatataacawtataatcctaaaccttgacagttggagaagccaatgcagaactgatgggaaaggaccaattatttatagtttcccaacaaaagttctaagattttttacctctgcatcagtgcatttctatttatatcaaaaggtgctaaaatgattcaatttgcattttctgatyctgtagtgcctctatagaagtacccacagaaagtaaagtatcacatttataaataccaaagatgtaacaattttaaaattttctagattactccaataaagtgttttaagttttcctatgacttaaggatctatattgtctctaggacaaagctgggggttggcatatatgccttaaccacaaaggagaaaggtgatttatgcaaacatacagtacataataaaaattctactttcctaaactttattaaagaaaaaagcaataagcaatggtggtaaatctctagaacatacccaattttctgggcttcctcccccgagaatgtgacattttgatttccaaacatgccagaagtgtatggttcccaactgtactaagtaggtgagaagctgaagtcctcaagtgttcatcttccaacttttcccagtctgtggtctgtctttggatcagcaataattgcctgaacagctactatggcttcgttgatttttgtctgtagctctctgagctcctctatgtgcagcaatcgcagaatttgagcagcttcattaagaactgcatctgttttatgagaaaagaacactgcttcaatacataatttttacatttaaggccatttatttatttcctcccaagtattcagtctgtaaaaaaaatagtttgaatttaaacaaaatcacttacctcctgtgtcaaaaccaagaatatgtttgtctaaagcaacaggtaagccctttaaaaaaagaaagacaaaatgagagtatttatggttaagaatagcatcctttcctcaactgaaactgaaaagcacctagctattctggtgtcttaactcttttagctgcatgggcaagggaactaggaattttgtttatatttgctttgtgatgattgtgattagcgagttttccctatttcaaccggttagggggaaaagttaacctttaaatgtaccaggaagctctatagctcatccaatcctttagcccaggcatacaaaacaatatatccttattgcagcagtgccttgtcattactgctatggaaggcaagttgagccaggctgttactgtcttattttggcgacagtaagcaacagtataaacggcaaaaatagtaccttatattccatttctgagcacattaatttgtctttacaaattgtacgaacctttcagccagcatggtgtttgccaagattatgtataattatgtataatttaactttcaagacttgacttggaagttactttgaaacaaacagtctaggaaaatgaaaaactaaaccactcagcacctatggacatactaaagatggtgactatggtgatgccaaacttcacagaaacaaattctaaaatgaggacagtctgtacttcctgctgattatataaaatcactgccaagaaaaacacactacccgtactttcaatctttcaatgttacaacctgttactattcaaatgctttagtcactgctcaattcttgccttatctagtaatgtaaatctacgtaggctctgtctgctttaaaacagctaacacatgtaagtctgaagaaaccaatgggtacgaaagcacaagtgagcaaaattaaagagcagaattgtactgagtggctttatatgttcatctagtaccagaggctccacttttttttcctttgccaacaggccaccaagctacccctgaaaactaccatatgcctcaaatagtagttataaatgcttataagtacactagactgtaagaactccactaaattgttataggctggtatcttttgagatgacaccaaaattaaaatttggagcattaaaaataaaactaaattttactttacaaacaagagcaaagagatttggctaagcctttacttacactgccttccaaagcatagttttgctgaaggaatgaatgaatgaatgaatgactttattacaccagaacaatttactgtctgttctatagtgtgggtgaaataagctgatctttaacccaacttccagtggctcgattcatatacaacgagccagtaagaacctttaaaagaaaacagtgtctttcagagatactgccctggcattagtaaccttttaacactgcttggcctgcctaaaggggctggaggacaaaaggcattgggagatgggggaagggcgcagggaggacaaacaacatagttgtgcccaaggcattcactacaacatcattgctgcaggaggcaggtgttatcagacactgctgctgctgacctgaggacagtctctccaccgctgcacagccagtgaaactttaggcatctttggatttctgatataatctaaaaatgttccatattttctctttaaggggaaggtagtcatgggatatagcttttctcagcctacaaggtaggactgaaagataccatttcagtcacctgtaccttgaaccttacactccaacagaaccccctgtcccttcacctgggcagactgacaagctcatgcagacatccacgcatggacccttctccccacctaccgtaagagcacaggctctcaagtcagactgcctgagctcagtcacttaccaactaggtgaccttagccaaattactttctcatgttttatgccaggaaattgaataaaacaagaatttactctgaagaaataagagcaaggatagaatttagatagaaaaagaaaactaatttgtagtgaggtgtgttccttcttctccagcatgagtcaaaataatccagtaagtttcatatgggtaactcattttaaataaacttcaacgggccacaagcatgatttgtggactgtgcatgagctatttgtggcttttttaaggtacaaagtgagaggaacatgaagtttttcactcaaaaatgaccccctagccactgaatacattcaatttgctttaggaagcactgaagtaagctatcctttctctaagttgtagaacgtagaatggatatcttaaacagatacatgcaaagtttaaaatcacggccataccagaagaaatgttcattaacaacttatttaggatttatagaaacgtacctcttttgtttgatttgccttagcaactgcatcctgtgtcaggcgctcctgaaccaaaatccgaattgcctaagaaacccaaaaatatttttactttttataggctgtgtacctgtcatcctttcttctatgagcccagagaataaggatgctcattttgatgaagtcagaattacctaagttcattaataaactccccattaaattaaaaataaaaaaaacccactaatataacgtaacctttcacacttctagtattttaataatgttgaatggtgcttgcaacaattaaaaccattttttgaataggtaatgcacgtgactggtaaaaaacaactttaaatacagcaagacacatggtaaaaagtaggtctccttcctacctgagccttgcgatcccctacagattccttaccctcactaaaactgcgaaatgacgagcatgcttagcacgaatacacatttttgacacaaagggtagcagatcatacatactgtcttacactttgcttttatcacttcactctagtaaaatattttcaaacctttcaaaggacaccgttggtggttttaatcaccaaggcatttcattatggtaggcatgcatgcaagtatccatacacacttaaaaatcaaattttaaaaaaatggaattttaattaggaagatgacaattacaactcaaaaataagtgtgaaaacttaaactataatttttaaataaaaaaccaaatgctatctttgaaaaaccgaattcaaacaatgtttaacagttattgcagatgttattaaatagtctggttgccaaacagttaatatactgatgcttgtacttggcaaacgtactaagatgttttccatattatgttattgtttgaatgcctcttaaaataactcaaaagggacaaatgtgcagcaggactagaattttatagcattttgttgtagttgatttatactttatccccttgggttttgaagtctaacaaaagcatcccaaatacgctatgcattgtctgactctcctctcacttactttatgattaaagctgacatgatcactatagaacagttccaaggcaatttacataattgtcggaataaagaacaagcctttgaaatagctaaatttcactaaaaacatttttgtcttttggcatgcaatctggattgagaaaatccaagttaacattcagattcagtatagaaaattttaataacttaggaatacaacagtcttgttaaaactgacatttaataataaaaatctaaaaagcatggtaagttatggcttaatctcttctgggtagagtgatatttatcacaaagtagtttacatgcacaaggtctagttaaaagcttttaatctcttataaaatttccaagtctggtatcttaagtaccactcccctgatccacaccactgtactttcacgattactaggaataaatcttctgaagtttatgatttctctcagaaacaagagacctctttcagattactgggattcctgaagtatagttatgaactgagtggcctatctagcatcggggacagaaagattcatttctcaaagagattttggggttatatatttttgaccaaattcaccattactcatttggcattttcgaccatcttaacaaatgcagactatgaatcattaaaaagactcactaaacagaagtagggtaatgtgggaaaaacaatggaccacagggttatagtgcttaaaatcctggctttgtcattttctgtgtcatcttagacattatcctcattgagtctcagtttcttcatatgatatatatttttaaaaagatattagcagctgtctctaggattgttggcaggattgaatgagaacatctttgcaaaggatttagcatagtgcaggcagaaaacagaatccaaatcagataaaaccatgaaatctactttatgtttcatattcttctgtgtattttagtcattcaaccataattttaatatcaatagttaatatttagaaaataaagacatttttctatgtgcacagtttctgtcaagaatcaagaacatgaagctgaccttaagcattaccaggtaatcatcatgacgctgaatctgaagcaggttagccaaagccatcacaccagccttaaaatcaggattatttactataaaagattaaaaacaaacaaaaacttacaaccctgcaaacgtataattacaaacatatttgtgaacatacaaaaacatttttaacttttcggtagcaacaaatctcttagtttttaaaactgctactcacaagagaaaaaagaaagccctgtagactatcaacaattaaataaattggtaagataaaatggttttcctattactgtatgagacggtccccaacttaggatggttagacttgtaattttttgaccttacaatgagttcagtgggatgtaaccctagtgcaagatgaggaaaatctgaacttacagtggttccaactacaatttttcagctttacaatgggtcttccggggtattaaatgcatttttgacttatgatattttcgactttgggacatgatctcatcctaagtcaaggagtatctgtatttcatcagccaaactgaataatccaataaatgactaatttaactcacattatatttgtcctgtaactttttctgcaaggctaaattatacagcacttttaattaacatttcttcccaaggccattaattttagtacatagatcccctccatggatagttttcccaaaaccttctctctaagcagcagctctggagtgtccaagaggctcactcattcaaaagggttaactcctaaattataggtcacaatgaattagccagtgaacaaatattttacacatcataatttaggtaattagattcttcatatttttaaaaagggaaattactaaaagatatccaggacttaaaataatggaaaattttaccacttgtctgatagagtcattggattaaaagaaatttacacattcaaaaaggcaaacaatgacccccatgattaaatacaaatcaaaactccaaat

SEQ ID NO: 12315 - DNA, 26730 bp, Homo sapiens
gcagtctgatttgggcctgcacttggcctgccatggccccagcctgctgccctgccacagccaggagccatttcaaccgttttcaaatgtacaggcatctatttaaaatggcagtatctgtgcctgctcaggcaatcctgaaccttcttaacctgaactttttcctcctaaagcaatgaccactttaaaacagacagtgttagcttttgattgctattgtaagaaattacaaatttagtggcttaaaataacacaaatttgttctcttaccattctagagatctgaagttggaatggatctcaatgggctaacatcactgtgttgtcagggctgttatttcaggagactctcggggagaacctgtctccttctccccttttccagcttctccaactgcccacatccatggctcagggcccatttccccatcttcaaaggcagttccatcagattaagtcctcactgtgcccctcatctggttctccctcttccgtctgcctcttcctctataaagatcctgtgattacattggaaccccagggaaatccagaaaatcaccccgtttccggggcagatgatgagcaacctcaactccatctgtagccttcactcccttttccatataacccagtggggggttccagggattcacaccggcatcctctgggattggcgggagtgggtgggggtggcaggtgattattctttgcaaaacacatgccatataatttatgtatatatcatttttataccacaaagatgggggaagaagcagagcaatattggagcagagattttgcatcctgttaaaattaagttggttttaatatgatctaggttgtggtaaattaagatattaattggaatcccctgaaatgactaacaaaataacttttttaaataaaaaatgaaaaagagacaataaaggaagtaaaatgatgcagtagaaaatatctgtttaacacaaaacaaagcaatagtggtggaaaagatgaagaaaatgacatagtgcatatggaaaactaagaaaaaggtggcagacgtaaattctgttccaccttagcagtaattcccttacatgtcaaagtgataaacattcaaaagaaaaagcaaagattctcagaatgcatttaaaaaatgatctaaagatacaatgtagatcccaagatacaagtagtttaaaagtagacatatggaaaagataaaacacatccatagtaaacaaagacaactgaaattgctattaataatatcaggcagaatcatctttaagacaaacaattttataaacattctaagaaccaatcaacgaaagggaaactcacaaggaaaattagaaaatactttgagatgaatggaaacaaatacacagcatactatgatttataagaagcagataaagcagcacttaaaggaaaacttactgctgtaaatgccagtatactgagaaagaacaggacaaagaaaggattatgtcaaattaataacttgatatttcactttaagaaactcaaagagcaaagcgacctaagccccaaataacaaatggaaggaaataaaaattggagtgtaaataaatgaaataaagaatagaaaaacattggcaaactcaataaaaccaaaagttggttctttgaaaagatcaaccaaattgtcaaaccttaacctagaatgactaggtaaatggtggagggataaaactcaaatgactaataccaggaatgaaagaagaaacatccctaccaactttacagaaacaaaaaggattataagggaatactatgtacaaccgtatgtcaatgaattcaagaacctggatgaaatgaacatctttcttttccatttattttccagttattattgagccacttttgattgtatcctcccttctctaccagaaaggacaaaggttgatcaccaaagacaatttcagactcttgtcaggcctagggacagcagcagaggcaccacaagcttctctgatgccatagattggccttcccatgatctgccacttctctagacgtttattgttttctgttgaagatgctggagctctaagccagcactttaaggattacttgttttctccaggtgtttcctgtgtatatacaagagacgatagatagatagatagatagatagatagatagatagatagatagatagatagatagatagataataaactcctgtttgtttgtttttttcatgaaaatcatttttcctccccgccgtacaaaggcttgtcaaaggcacactaatgagcagctgattgggctcctccaaccgatgaactctgtgtttggctctgtttggaaacacactgaggagtccagcctctttggctgccacaggatacatttccagaaacacctgttaggcgtctgtggatgaggaaggcatcaggccttcctacctgaagccttattgactcctgcaagtgctaaagaaacccctggggacaggctaggctgcctgttcctactggattttaggcctggagacttctggtgggggcagcccaggcagggaaatcaggagctgtggacagggagtggaggagatcaggaggggatggcaagacccccagcctgaccccagtccccagtgccctctagcagcagaaataggaaaaggaggttgagggcaggcaatactgcaacctcctgtgctgagcatacagataggtccagcctggtggccccgcacctgcagattcaaggcagccctgccctgcactaaccctgcacctcccaggcccactgctctcccactgtgaccccatccggagactggtctatctaaagaccaggacattgaccagcagcccagtgctctgctccacggcctctgtcaggcaggacggagctggakcccaggcagagataaggacaggggaagatggcccttgtcagccagggatgttctgtcctgctgggcatgcggcctctctcacagagaacctacgtgatcttgcttcccccactttcttatctcataggccctacatatttgccagaaacacctgcattcctaactctttgccagatgtcaggggccagccgccaggggaactgcgtggcagagcccctgtgccaatggccagagaaattcaggagttcccagaaaacagagggtgctggaaatccaggtgggagagctgctccttgtgccaagattttcctcagaggctccttctccggtgccctgagcagggccaagcctggcgaatattagaatttctgctgggctgagaaaaaacagcaaaaggagaagcagtctggggggtgacttggaggtggaaactgggtgcggtcagaaaagtgagtggagcctggaggccaatgagcaccccaccctggcaagtcacagcaggacagggcaggggaccaggcatagaattgggccagttgtaacctgcacaacctggaaaaggatttgtatttgtatttcatgtacccattgggtaaggtggcatttatctccagcttccttgaggtgagctcagtttaggaagtttcttttcgactgaactgtgtcaggaatctcgccaatgcctgatgctgcccaccacatctcttttgctgctgctgtggctggaacctgcctgggaggcaccggctgtgaaggctggagacccagggaggctgccctgacacctctccttgttccctgagccagggggcccatctgagccccttcacccctggggagctgttttctgtgccttgtatgaggtttttgtcttcacagaaatggcattctagtaagagatagaaattttaaatggatagatatgtaaattatatggtatgtgtgttgggcagaagaattccctctccaatcctcaggatggcagatccagtccctggaacctctgtgttggggtacatggaaagggcggtgaaagctgtggatggagctgaggtggctaatcagctgccctgggaaaaccagccatggaggggtagtgttctcatgtaaaccaggactcagcctggtggagctgcctttgaagatgaggaaatggggtcctgagccatggacgtgggcagttgagcagctggaaaaggcaaggaggagacaggttctccccgagagcctcccaaaggaacacagccctgacagcacagtgatgatagctccgtgagactattcagacttctgagctccagaatggtaaaagaatgaatgtatgttgttttaaggcactaaatttgcagtaatttgttgcaaccacaattaaaagttaataaggtttgtttgattgtttgtttatagggatagagtctcattctgttgcccaggctgcaaagcagtggcgtgatctcggctcactgcaacctccgcctcctggcttcaagtgattctcctgactcaataagctgagtagatgggattacaggcactggccaccacacccggctaattctcttatttttagtagagacagggtttcaacatgttggccaggctggtctcaaactcaacctcaggtgatccagcctccctgacctcccaaaatgctgggattacaggtgtaagccactgtgcgcggcttactaaggtatgttttaaagtggtcattgctttaggggaacaagttcaggtgaagaaggtccaggatggcctgggcaggcagaggtctcccattatgaaatagaggcctttacatttaacagtggttaagatgaaaaatcacgttacatgaatcataccacaattttaaaaaaagaaagaaagaaagaaatacaagggttccaaatgcgaggggcagggagaaccaggcgtggaagggtgtgccacctgggagcaggagtgggagtgagccgggcagatgcctgaagggcagtccatgctgaagggagggcaatgcaaagtcccaaggcacggggacatctgcagggctctgaagaccagcaaggaggccgagggtggaggtcggaactgagcgagtgagggggcataatggacagctggccagactgtgcagggctctctaggcatctgtagtgactttggttttactgagagaaaaagggcacttttggagaattggagcagaggggggcgtgagtgatgaggttctgaagatcactctggctgcgctgtagccatttgggaggtggggacaggcacggagaaccaagtagggcagcactgcaatcaccctggccaggaggacggtggcctagaaccagggtcgagtactagatgacagtgtggtcaaatcatagatattttatttctagtccaaagaagagataagaaagaggtcgagcaaataggtgattttttttttaaattattcacagccttataacataacctctaaatcttcagtaaagttggctacattcacaagtagctggtgtcactttggtgggggctttgtaaggaagtgggcagggtgtcttttaaggaagactcaggagaagtgctggtcttccagttgcagaggggaatggagttgcaagaagaaaacagcgaggttcagtgacacacagtgcgaacacgagctcagggggcaggagctccaggtctcaagagggcaggacgataatgcagtgtttgcacagaaaccaagcaatagagggagccagcacccaccagaaatgaggtagggccgctgtcacagctatgccaggacctgcagaagcctaaaccctgaaaaaaggtgggggcccccacctacatatcaaggaaaacatatgtatgccatcacatgctggtctccaacaactgctaaaattacattaaatcctttctagaatttcgtggctgggacttgagtctggtcttggtccttctactgatggtgaatccagtactgaattggatccaattctggacgagttaccctgtcctagaatcactcacacgtgacagttgacaggtggccccaccbggtttgcatggtggacgggtgttctgctaggccggcctctccacrcccagagagactgaactggtttctgctcctcagagagtttgcacagagactctgaggaagcagtcacctcaggcctctccatcctagagacrgcagaaggacaaacatctcctgctggcacaaggtagggggtgggggatggctggtgttccaaacaccmgtgcagagggaacgtgtgcatgtttgggagtgaaggaggaaagcaggggctcgagtggtgagagaaccaggggcagataatgaagtaaaagtggggttgggggagatgctgggggtgtggcggcggggacgctggataaggcagggaggacggggtggctctgcgggtcctctgcctccacaccaagcactcagggatccgtgcctccttccagtctggagtcccaatcgcccytctctccaatttgggggacagggatttctccttgttctcctgccctaactccttctttccgacttctcttgtcccattctccctcagatcctcccttccgcttatgccaaggcttccacagcctcgctctgcckggccttggcattcctagcctgagtgttgaaaccattggccgggacctcaaggcagctggggcagggagaggacggttagaagcccagggcacactgccacaaaaaggctgtgactcattttcagggattgaaaactgcagtccaattcattttaaaattttcgtctctctttggacttcaggctgaaagttctttatagcaacgggcttccagggactatgtgaaattattggtttcactttccttatcacccgcttcttacttcaattaaaattccatttcagccgggtgtggtggctcactcctgtaatcccaacactttgggaggctgaggggggaggattgtttgagcccaggagttcgagatcagcctgggcaacgtgatgagaccccatctccacaccaaaaatttaaaaattagctgggtgtggtggctcatgcctgtagtgccagctattctggaggctgaagtggaaggactgattgagcctgggagttcaaggctgcagtgagccgtgctcatgccactgcactccacctggatgacagagcaagacctggtctcaaaaaacaaaacaaacaaaaatctacttcatatgtaaccattacttcagttttgaaaccattgcctgaagctgacattttgcagttggaaaatggctattccttcccatcttcaggttggctcaggccaagctgagattcaggaccacagagggcaacaaaggtggaagggcccctttcccctttctgtatatttttcccagcctgtctgcagctctttctttttcttcagtgttaggttggcatcccagatgtcaggacccaagtataggcctggtgtgctccttcctgtgagtcatcagacttgtagaaaatattggccctgctaaggagctactcagtggtcatatcacacatatgcacgcacacacacacaarcacccatgcacacacacacacacacacacaaacacacacatacactctgttcttggcccacccccgctggtgtccccacagcagcagtattggcagggcggtagcagtgagttcctctctgtgtactctcagggcctggatgtgtacagaacaggctccactcaggacagatttgagaccccttctccagaccaagaggtggaagtgcaccctcaaaattgaggttctttaaccttagcagacagagaaccacataggggacatgtaaaaaatgtgcattcctcggctccttcaaacgcttgacccactgtcctctgagcagacaaccccttatcccccagccccagagatagagccctgccgatagtccatggttactttctttgaagtctgttccatctagttaagaaaggacagtggtaaagacccacttaccttaccaggcatcataagggccctagcatctgagtcacaggatgtcaccctctgggtctgacatgcacttgaattaactggcatactgcccggcacacagagggaacctagatgtggaacggatatgggtggtgttacaggccgcatgtttgcctgccttccaaattcatatgcagaaatcctaattctcaaggtgatgctatttaggaagtcataactcatgtgagtggagccatgtgggattaagaagtgataggagagcttgctgtctgtctctgctctccactgtgtgaggatacaacaggaagacagccatctggtgaggaagagagggccctcgccagataccggacctgctgacaccttgatcttggacttcccatcttccaggaaggtaagaaataaatgcttggtgtttcagccaccttgtctattctgttgtagcagcctgaactggctaaggtagcagggtctgatgatcaaatgggacagctgtaaaagtgaggtgggaagggggtctacagatactaagttttatgaggaaaacttgtgctttatttgaaaatgacacaaaattttgttctaagaaaaattttcagaattcaaaacttagagccctaagacttttcccaatgatagacttggctttccttgaggtcttggccccagtaggactgctggagtctattayaaaactcatctggaaggacctctgccgttgctgaggcttgaggaaatggttttaaggtcacagtgtaaacaaaactgctgggaagttggaactgggcggagcccactgcagctcagcaaggctgctatggccagactgccagatttctcctctctggtcagggcatgttggtaaacarggcagcagccccaatcaggggcttatagcagacttaaatgtccccgcctgatggctctgaagagggcagcagacctcccagcacagcattcgagctctgctaagggtcagactgcctcctcaagtgggtgcctgacacccacgtatactgactgggagacacctcccagtaggggccgacagacacctcatacaggagagctctggctggcatctggcaggtgccccactgggtcaaagcttccagaggaaggaacaggcagcaatcttagctgctctgcagcctccgctggtgatacccaggtaaacagggttgggagtggaccaccggcaaactccagcagactggcagcagaggggcctgatggttagaaggaaaagaaacaaacagaaaggattagcacgtcccctcaaagaccccatctgaaggtcaccaacattaaagaccaaaggtggataaatccacaaagataggaaaaaaccagtgcgcaaagcctgaaaattccaaaaacaagaacgcctctcctcctccaaatgatcacaactcctcgccagcaatggaacaaaactggacagaaaatgagtttcacgaactaacagaagtagccttcagaaggtgaataataacaaacaactccaagctaaaggagcatgttctaacaaatgctaggaagataagaaccttgaaaaaaggttagtcgaattgctaattagaataaccaatgtagagaggaacataaatgacctgatggagctaaaaaacagcatgagaactttgtgaagaatactcaagtatcaatagccaaatcaatcaagcggaagaaaggatatcagtgattgaagatcaacttaatgaaataaagagagaagacaagattagagaaaaaagaataaaaaggaatgaacaaagcctccaagaaatgtggtactatgtgaaaagaccaaatctacatttgattggtgtacctgaaagtgacagtgagaatagaaccaagttggaaaacactcttcaggttattatccaggaaaacttccccaacctagcaaggcaggccaacattcaaattcaggaaatacagagaacatcacaaagatactcctcaagaagaggagttctgaaactattccaaacaatagaaaaagagggaatcctccctaactcattttatgaggccagcatcatcctgataccaaaacctggcagagacacaayaaaaaaataaaatttcaggccaatatccctaatgaacattgatgcaaaaatcctggcaaaccgaacccagcattacatcaaaaagcttatccaccacgatcaagttggcttcatacctgggatgcaaggctggttcaacatacacaagtcaataaacgtaatccatcacataaacagaaccgatgacaaaaaccacatgattatctcaatagatgcagaaaagaactttgataaaattcaacaccacttcatgctaaaaactctcaataaactaggtattgatggaacatatccgaaaataatgagagctatttatgacaaacccacagccaatatcatactgaatgggcaaaaactggaagcgttccctttgaaaatcagcacaagacaaggatgccctctctcaccactcctattcaacatagtattggaacttctggccagggcaatcaggcaagagaaagcaataaagtacattcaaacaagagragaggaagtcaaattgtctctrtttgcagatgacatgattgtatatttagaaaactccatcatctcagcccaaaatctccttaagctgacaagcaacttcagcaaagtctcaggatacaaaatcaatgtgcaaaaatcacaagcattcctatgcaacaataacagacaaacagacagccaaatcatgagtgaagtmccattcamaattgctacaaagagaataaaatacctaggaatacaacttacaagggatgtaaaggacctcttcaaggagatctacaaaccactgctcaaggaaataagagaggacataaacaaatggaaaaacattccatgctcatggataggaagcactaatatcgtgaaaatggccatactgcccaaagtaatttatagattcaatgctatccccattaagctaccactgactttcttcacagaactggaaaaaactactttaaacttcatatggaaccaaaaaggaggctgcatatccaagacaatcctgggcaagaagagcaaagctggaggcaccgtgctacctgacttcaagctatactacaagtctacagtaaccaaaatagcatggtgctggtaccaaatatatagaccaatggaacagaatggaggcctcagaaataacaccacacagctacaaccatctgatctttgacaaacctgacacacacaagcaatggggaaaagatcccctgtttaataaatggtgttgggaaaactggctagccatatgcagaaaactgaaactggaccccttccttacaccttatacaaaaatcaactcaagatggatcaaagacttaaacataagacataggaccataaaaatcctagaagaaaacccgggcaataccattcgggatataggcatgggcaaagacttcctttctaaaacaccaaaagcactggcaacaaaagccaaaattggcaaatgggatctaattaaactaaagagcttctgcacagcaaaagaaactatcatcagagtgaacaggccacctacagaatgggagaagatttttgcaatctatccatctgacaaggggctaatatccagaatctacaaagaacttaaacaaatttactagaaaaaaaacaaccccatcaaaaaatgggcaaagtatatgaacagacccttctccaaagaagatatttatgcagccaacagacatatgaaaaaatgctcatcatcactggtcgttagagaaatgcaaatcaaaaccacaatgagataccatctcacgccagttagaatgacgttcattaaaaagtcaggaaataacagwtgytggagaggttgtggaaaaatagaaacrcttttacactgttggtgggagtgtagattagttcaaacattgtggaagacagtgtggcaattccttacggatctagaacgagaaataccatttgactcagtgatcccattactgggtatatacccaaaggattataaatcatgctgctataaagacacaygcacacgtatgtttattgtggcactattcacaatagcaaaacttgtccatcaatgatagattaagaaaatgtggcacgtatacaccatggaacactatgcagccataaaaagggatgagtttatgccctttgcagggacgtggataaagctggaaaccaacattctcagcaagctatcacaagatcagaaaaccaaataccacatgttctcactcataggtgagagttgaccaatgagaacacatggacacagggaggggaacatcacacaccagggcctgtcacggggtggggggctaggagaggggtaacattaggagaaatacctaatgtaggtgatgggttgatgggtgcagcaaactaccagggcacgtatatacctatgtaacaaaactacacgttctgcacatgtaacccaaaacttaaagtataataaaaaaaawtttttttttgtagagatggagtcttactatgttgcccaggctggtcttgaactcccggcctcaagtgatcctcctgcctcatcctcccaaagtgctgggattataggcatgagccactgtgagggcctggccatttcagtttcgttaattagcatctatgatagtgcctgatacatgtagtagacactctgtgtttattgagtgactcaatatgttttattacaattacacacacacacacacacacaaaacccatctgtcatggtagaccasttgctgcctgtttgcagctagtttaattaatactggggtgtgcttggtgagagaaaatctcaaccatttaagaggaaagagtttgaacgggttagggacagtgggagaggggagaatggcgatgggagaaaatacaggaatgggcagggggtaccaggaagaaagggaaaagcaaaagaggcagggaggagaagggaagaggaaactggaggaaaggagaaggagctcacataacctccaaccatcctgctcacaccagagggggktttttttgcaggggcagcagggacaggagaggagagagagtttattcaaagttaattttgtttttaaatgtcttcttttatttttcaataaatgattatattctgaatacttggaaaacactctcktcacaaaattgttctttaattgggtctctacaggcctgacctcagttgttccarggtaaagaatttgggcagtgcccacacccaygctgttggataacatttcttcaccataccagtgagggtgaatgtgtacacgcccagcttcctgcctgttactctccacagtatgygaagaatatccctgacttctagccctgtgcrccttcttttgtttctgctgttgctactaatagccttggagatcatggttggtgagtgtcctgagcacaagaactggctgaggacaaggaggagrgagaaaggtagggggtaggcgaatggggcttcatgcaggcttcagacaagtgggtgcctgctcttaaggatgacgtgaggragaggatccctgggatgttacacccagttcatgggagaccacagcctgaggccctaggcaaggcactggctcacagagggcagttctacaatgctaccccccrccttctactccaggtcactttcctgaacatctgggaccccrcaggaattcagcgtgtgtcctgtgataaatgcctctttttcctttctattgaatgtcatgtgtgttcagctagagtttaagtctcaggaggtcatacactggcttgtctgttttgtgcctcagaacttggtagatgttgctaaaagtacttgtgacatgaatcctcctgttaacaccattaacactaagtgcaccccaggggtccctggtaccatcaagtatctcatcccagacagtcagggagagatgggaacagggatccagaaggttgagggagtctgggatggagctgccccgcctctgctagcctggcccagtccagggagtcttgggtcacagaagcgcaggttctaatgggcctcttcccctgtcctggacctcacctgcatctttgtctcacaggtggtcactctctttgcttcaacttcactataaaatcattgtccagacctggacagccctggtgtgaagcgcaggtcttcttgaataaaaatcttttccttcagtacaacagtgacaacaacatggtcaaacctctgggcctcctggggaagaaggtawatgccaccagcacttggggagarttgacccaaacgctgggagaagtggggcragacctcaggatgctcctttgtgacatcaaaccccagataaagaccagtggtaagtgtggaatggggtgggsaaacrgaggcaggcagtaagagaggggagggaagaacacagatggggaggggctttaggtatatctgtgtattgatcattggcccaaccatagaggcacatgggacccaatgggcaggaaagggcaagtctgggcagaaagaatacagacccctaaatgtgcagagaaacacttgacctattggaggatgatggacytctcaaagagtggaggatgatggctttgtgtttggattgcagatccttccactctgcaagtcgagatgttttgtcaacrtgaagcagaacggtgcactggtgcatcctggcagttcrccaycaatggagagaaatccctcctctttgacgcaatgaacatgacctggacagtaattaatcatgaagccagtaagatcaaggagacatggaagaaagacagagggctggaaaagtatttcaggaagctctcaaagggagactgcgatcactggctcagggaattcttagggcactgggaggcaatgccagaaccgacaggtaactgagctgggtgggagaatgtggcagctccctttaaaggtcaaaagccttccctgtgtgggtgtcagtgtgtgtgtgcgatagaaaatttgattgacttctccgtgggcttcctgtctggagagtcagtgatggcyataaggatttcccaccatcctccctttcccatcccacctcccactgtttcttcctcagtgtagaaaccccttcccattaaccaatgatccagtcacaatgacccactgctaaatggtcccaagtctatctgtgtcattgcaaacatccaggccttctcttcctctattataattacccttccaccagctctaatgccacttcttaggaagccttccccaccttccccacacagaattaagcaccacccattgtgtcatcctccaaacagttctaaccacagtaatcgtgaaactgtgtggtaatcagatggatatttgctacctctctcagtagaaatctgagctccataaggacaaggcacaacccctattcatcttcatggcccagggcctggtagagtggctgtcacatgagccagtgattatgtggggcaccatgtgttcctggggaaagcaggggctaaggaaagcatatttttatgctttttttttttatgtgacagggcttgtgctttttyttctttttttttttttttttttagtgtcaccagtaaatgcttcagatatccactggtcttcttctagtctaccagatagatggatcatcctgggggcattcatcctgttasttttaatgggaattgttctcatctgtgtctggtggcaaaatggtgagtggcaggctggtctctggcccttgaggacgtcttagtctggtaaggactcaagagaggtgaatcatgggtctcatccaagcccccgctccctgatccatctctctccacagaaatggtgcactgccttagtcttgagcccccacactacacagcagggctggcagcacaatgtgcagtgagaggagggatgaagcaatcatctcctctcgaggaggggcaaggtcaaagatctggaaygcctgcctggggtgttgtctccttgccatccggcccaggtttcatccagctctttgacggaaagtttgtttgctgtctgcgtttaccgtgatttagctcagcaggtcccatccccttttcccgttcaccctgagaagacttgctggtggcgcttgtggctgcagcatttactcccagataacatacaagatgtggtataagaaatcctttcaccaccctctaaacattacagtgccgaactacatcctacatttttagtagagatggggtttctccatgttggtcaggctcgtcttgaactcccgacctcaggtgatgctcccgcctcggcctcccaaagcgctgggattacagggggagccaacacacctggctgagagaactattatatgccagacacattgccagacatcttctgctctttggtcctgtttctccgccactgctctgacatgaagaattcatttctttcttccattgctgtctttgtcctcatagtgtcttctctaaattgacccaggcagacctcaacattttcaagtacagcaatttggaaaagttaagtagagctctagggttcaagtcacagttcctggggctctctctgtggagttcaaagttaggattccctctaatgagaaaaataggctactccatctgactcactgaggatcaatgtttctgatgtaagaaatgattctacccttttcattgcttaaacgaataccatgactcagatatgtgtctgttttgcaggggccctgacatgaaaagtgagttygccaagatcggtgtcacaacaggcttggcaagatatggcttgagtcagataagggccactggtccagaaggggctcgtgtggtgggtggtgtgatggcagcaggaacccagggagtgaatatgctgagataggaaggggtcccacccacagagctgcaggcaaaggggtcccaccttaatccctggtggaaggtgactgagaaggacttaactgccccaaccaagcaggctgggacttcagtgccattgacaatagtgaaggggattggtgagtaggaagggaggcaaaagaacagttttagaagctgggtctgaacagtagggatttaaaggaggtgggacctccatagacacctgggagttcctggcctctagcytcatcctggyaaccgagtcggctgctgaagggcttcctgtctgggcaggagcaggcagggatcaagcgccggtggaggtcagtgcccacagctgagctgaacagaagtgggaggcagagtgggcctggggaaaggtgtrttacaattcaaggggaaaaaaatrtatctgccaccctttggggagggcctccccactgtgtcgcatggatttctctgtcacggggaagagcagcacccagggaaaaagagytttgtgtgcccatgacacattcctattttgttgtctctggcatttctgggcattgtttctgmtgaagtgacagaagagagaaaaagctgatcaaagctaaatgacagagcaaaggggttgacagggagtgtcttttcaaatacacagggacattcaccaagaagggccatttttggatcataaaataaatctcatctgggcgtgatagctcactcctgtaatcccagcactttgggaggccaagttgggtggatcatttgaggtcaggagttcgagaccagcctggccaacatggcgaaaccctgtctctactaaaaatacaaaaattagccgggtgtggtggcatgggcctgtaatcccagctactcgggaggctgagacaggagaatcgcttgaactcaggaggcggagtttgcagtgagctgatattgcgccattgcactccagcctgggtgacagagtgagattccatctcaataaataaataaataaataaatctcaacatatgtaaagggttaaaatcatgcgaagcatcttgtccaagcacaatggaaataaactagaaatcaacagcaggaagctatctggaaaaatcctcaaatgtttggatatcaaataatatgcttccaaataactatatatcaaattaaaaagtacaaggaaaactagaaagtattttgaaatgaatgaaaatgataatacaaaatatcaaaatctatcagacacagataagaaaatgtctagaggcatccacactgaactttttgatctctgaatcaccgtgcatcattgctgccaaattttttgctcatgctcatctctgcctggaattttctttcttacctgaccgaattccagacagctatccaagtccagtttaactgtcacctcctctaagaagtcaccattcttcctggatagaattaactacccccactcgtagctcagaaactctgaccacagaaaaattatcacattgttttatgattgggtgtatgtcagtaaattgatgcgcttacttgaggacattacttttgtaacctgagaatctatcatggctgctatatagtagacgctcaggacatgtgaggacttgagtggcagcggaggtaagggtcatctcctgggtatggagcttggacaagaacctgcactcttctgttccatttcacctcaaccatccatgtccccaaccacatctccaccatcctacctgtaccaagtgctaatcctttgaatcatgtcagtgactatcttcagctcaatcccaatcacaggtcaggagggagggcatcaggtatactgtgagcaaaacagagtatgagatggggccaactggcctctggattaggggcagggcttgtcctgtatgaggacagggagaaatgaggttgctaagtctccccaagacccctgccaaatctcaccatagacataagatgaggtgaatttcatttatcgcctgggcattcacgacctgagaggcttagctctgggtcaagttgagccctctctgtccctggccaacaggagaaaggcaaaggctgaatgagtctcggggactgtctctgctttgcaagtgggccctgaggtgaacagggacctttccaaattaatgcatccacagcggtttggcaaagtcrggctttaaaccagggtcactctccaggggttgcctatgtgatgggtggtctgatggacagaaacacagagggtgggcaagacacaattttgggtggggcagcagcttgatgatctgaccatctgaccatgggaaagtatatcacatgccaaaggttgaggggtctctaggtttaattcctaggaggacataatgaagaaggctgcctgggctccaacaaagcaggctggaggcagggccacacagaccgtgggagaggggattgtgagcagaagggaaggctgaaagtgaaccctagacactctgtgaggacagcaaggactagaaggtgggattcctttgacacctgggtttctggttcacccctgacacaggaatcctggcaaatggcgtcgtgccaagccccaccctcagtgctctggacctgccgcagggatacccttgcccacagctggaagactcttgcccccgctgtgggccttcccactgtgttcccactgatactttgccttccttggctctgaacccctaaaatctctgctggggtctgggtctaactaatgatgaagtaacggaaagtgaacaatcataaactagatgacagagaggcagaatgtgaacaatagcggctgatctctccctgagagagaggtgggatctgagtcctgagagatcacggaggggtcaatcctgagctgatctgacccagggttctgcactcttttgtctccttcctaaaggcagaagatccacctagaggtgataccacggcggcgcagagttgttcacctgtggtcctcgatcgctgacagccttggctcccactgctgtgtgttccctgagtcaagtggaggcggagcctgcaatgagcggagatcgcgcctctgcattccagtcttggcaacagagcaagactccgtctcaaaaaaaaaaaattttttttcagtacatattttttaaaagatagggctgggcacagcagctcacatctataatcccaacactttgggaggcctaggcaggaggatcacttgagcccaggaatctgaagctgcagtgagcctttgctcgtgagattgtggacctatgatcctaccaccagcccacctggttctaacaccccctcctctatgtgtgagagggagagaagaaaagtgagggagaaaagagagataagcaaagaacagagaggaaaaatggaaaataagaggaaattgggggaattaaacagaggggagggcatggatccccgggagttagaagagtagcagcttgtggattactacgcagtggaggaagaagagttgttggaaattatttgagaggtagtataatcatttgtgaggcagttttctgcattcaccatttctcacagactaagttactcataagcaaacgtgcaattcacattacactgaaattcttccctaatacatcatttgcattggaataaagtacggttttcaaacaacctgatatagcagaactgactgtataaattatgtgagcacagtgcaagtaattctttgtttgtttgtttgtttktttgagacagagtctcactctatctcccaggctggagtgtagtggtgcgatcccggctcactgcaacctcgatctcccaggctcaagcgattcccctgcctcagcctcctgagtagctgggattacaggcatgagccaccacgcccggctaatttttgtatttttagtagagacggggtttcaccctgttggccaggctggtctcgaactacggacctcaggtgatctgcccccctcagcctctcaaagtgctgggattatagcatgagccactgagcccagacacaagtagttctttctgataaacactttaacactgaatgcaaaaaaaaaaaaaaaattgtgtgtgtactttttttaattttactttaaaatagacacaccaaacatgtttctaaataaatgtaatatggaaatctttctttttctcctccattctcagtgatgatatggttgtaaattcttatcatctgataatttttatcagatctttacaaattataaacttatttgcaactctgttttcagactatcccttctattatgatcatgaaactgaattaaataggtagctatttttttgacttttactcctttatttttattttcatagttttacaagaatataatatatgtaatctgtcttccattttaaacctaaagtcttcctaatctcttcttcatagtttcaacaaacataaaggtaacaattcaaagcacctgtcgcttcgacaagaagatattttacatatttaaaaaaacagataacaattttaaaatacttgctataagaataaaattgtatttaataagtagaactaaaattttgactgatgttgcaatagatttggtgggggctttttttgtgggtctttttttttttgagtcagggtcttgctctgttgtccaggctggagtacagaggtgtgaacgcagcccactacagccttgaactcctaagctgaaacgatcctcctgcttcagcctcccatactgctgggaccacaggcatgagccatcccacccagctaattttcagattttttttatagatatgggcgtttcactatgttgcctaggctggtctcaaacacctgggctcaggtgatcccctgcctcagcctcccaaatcgctaggattacaggcataagcctctgtgcctggcctctttattatcattattattttatattttcaaactaggaaaaaagctatgcagtaacagaaaattctagttatatttaaaacaggattgtaagagaaacatgttaatgtaattttggttttctcttttttataattttaacattttagattcagggagtacatgtgcagttttgttacatggatatattgtgtgacactgaggtttgagatatgaatgatctcatgtagtgagcagcagcacagtactcaatggcagtttttagtcctcgcccctccatctctcccctcctcatagtccccagtgtctactcttcccatctttatgtccatgtgtacccaaagcttagctcccacttaagaatgagaacatgcagtatttggttttctgttcctatattaattcacttaggataatggcctccagttgcatccatgttgatccaaaggacacaattttgttcttttttatggctgcatggtattccatggtgtatatgtgccacatttcccttatccaatccacaattgatgggcacctaggttgattctacgtctgctgttgtgaatagtgctgcaatgaacatgtgagcatgtgtgtcttttcgctagaatgatttcttttcctttgggtatatgcccagtagtgaaattgctggtcaaatggcagttctgttttaagttctttgagaaacctctgaactgctttctgcagtggctaaactatttcacattttcaccagcagtgtaaagtgttcccttttctctatagcctcatcacccatatgctatttttttactttttccccccaaagtctcaagttttatttaaatagcctccagtgagaacagagtgggccagtgactaccccttccttgtaaagtctattaaccaaaccaaggagagtaagcacaccctgcagccagcctgccagccagtcatgtgataggcggggtgcctctcaatgggggcggccacgaccacggccccagctagctgctgggggagcatccacagtcaatcggattcttgatggtttcatccacagacacaatcaggcacacagcctaagaggccactgccagggcattgatccataccaaagctggctcccacacgaaggcctcaaagttgtcagcaatgtcctcgttgttgatgtccacctcatatcacgtgcccctgggaatgccatgcctgcagcttgttgagaatctctgtggccccaaagccagcattattgtacagctggaatgagacaatctccaaggccttggcatatgccccaatcaacagctgttgttttcctggaatagtctttgaggaatcctggaggtacttggagaactccctctcaatggccctgccaccagccaccactgactcattcccgatggccctcctgatgatcatgatggcatcacacagggaccgctctgtctcctcaataaactgctcactaccaccatggaggatgaaggtgcctgtcttggctttgaggcagccagtaaaaaagttgtacctctcacctttaatcagggtctcttcaaacacctggcgtcgacccagcacatctgctaagaaagcattcgtactggtctggattgagcctccacaggccatcattgtcctcttcagaktctcctcaggtacttggccagcacagaacatgttcctgtcagcaaagtactgggcggccacatctccagtggggagttcagacaagacaactttggctccaaaatgatagatcctctctaacttgtcatagagaatgttccactcggcatcaacaatcgcctgataatcctcaaccgtgtggacttttatctaagcattatctttctcagctttcaactcgagctcaacattcaaaagggcaatctagggattttggtatttttgggagggttgcattttaaacccagcataagagaaagtcttcttaaatgcaacaccagctgggctccatcctgtaccttcttgattccaatcattttaagctgcagcaaatcatcacacgtcatcactgcatccaccaccatcttagcaaagaaagctttctgctgtgagatcagttggagctcagagtggtcctggcacactactccagcagcttcctctactccactttatctgccttcttcacagtcacagcaatctctttgatcgtgttaactaccaactgggtggctgtgcagacagctcgaatgttgagctgagggtgtaaaccatccttcacctgcagtttcacctgcttcagaaactctgcagccagcaaggtcactgagatggtgccatcaccgacctcagtgtcttgggatttggcaatgtctactaacgtctttgctgcaagatggacaacatgaagaagtttcagaattgtggccacatcgttagatattgttgctttgcctccgccatccacaataagcttgtccatgccacaggcacccagggtggctcttacagccttggcaatcacctggcaggtactgaggttattcacaagctgggggatgccttgggagctatcagtcccctctttcaacaggataactagtgtgggcatcattttggaagcttattcagtggcccgcgactctcctctcttctccgtgacgggtccgcccagcaatccacctaatttttgactttttaataatcaccattcaggctggtgtgagatggtatctcactgtagttttgttttgcatttctctgatgattagtgatgctgagaattttttcatgtttgttggacacttagtatgtcttcttttgagaagtgtctgttcctgttctttgcccactttttcatggggttatttggtttttgcttgttgaattgtttaagtttcttacagattctggatattagacctttgttggctgcatagtttgcaaatattttctcccattctgtaggctgcctgtttactctgttgatagtttttttttttttttttttttttcccctgcagaagctctttagtttaattaggtctcacttttcaacttttggttttgtcgcaattgcttttgaggacttgttataaattgtttcccaaggccaatgtccagaatggtatttctgaaaatttcttttaggattcttatagtttgaggtcatatatttaaatcttcaatctggctgggtgtggtgaccctcaactgcaatcccagtactttaggaggctgaggcaggtggatcccctgaggtcaggtgttcgagaccagcctgggcaacatggtgaaacccagtctctactaaaaatacaaaaattagttgggtgtggtggcaggtaactgtaatcccagctactcgagagactgaggcaggagaatcgcttgaacccaggaggcagaggttgcagtgagctgagatcatgccactgcactccagcctgggtgacaagagcgagactccttctcaaaaaataaaaaataaataaatattcaatccatcttgagttgatttttgtatatagtgaaagttaagggtccagtttcatttttctgcatataaatagccagctatcccagcaccatttattgaatagggaataccttttcccattgcttatttgtgtcagttttgtcaaagatcagatggctgcagatgtgcagctttatttctgggttttctgttccagccattatcctaagtgaattatgcaggaacagaaaaccaaatacttcatgttctcactatgtactagtaccatgttgttttggttactgtagccttataggatagcttgaagtcaggtgatgtgattgaagtcaggtgatgtgatgcctctcccttttttttttttttttttttttttggcttaggattgctttggctaatggggctgtttttcagttccatatgaattttagaatagttttttctaattgtgtgaaaaataacattggaagtttgataggaatagcattgaatctgtagattgcttcgggcagtatggccattttaatggtactgattcttccaacctgtgagcatggaacgttcttccatttgcttgtgtcatctatgatttctttcagcaggattttgtagttatccctgtagagatctttcatctccttggttagatatacttctaggggtgtgtgtgtgcgtgtgtctgtgtgtgtgtgttgtaaatgggactgcattcttgatttggctctcagcttggacattattggtgtatggaataactaatttgtatacattgattttgtatcctgaaactttactgaaatcatttaccagttctaggagcctcgtggcagagtctttaaggttttctagttactatcatgtcgacagtgaagagtgacagcttgacttcttttcctatttggatgtcttttctttgtttctcttgcctgactgctgtggctgggactgccagtactatgttgaatagaagtggtgagagtgggcatccttgtcttgttgctgttcttaaggggaatgtttccagcttttgcccattcagtatgatgttggctgtgggtttgtcacagacagctcttattattttgaggtatgttccttcagtgactagtttgttgagagtttttgccatgaaggtatgttggattttattgaaagctttttctgcatctactgagatgatcatatggtttttgctttcaattctgctgatgtggtgaatcatatttattactttgcatatgttaaaccaccttgcatcccaggaataaagaaaataggcagctattgtcaggcagtggacaacagacagtgcaagactgctatccttgagagaggggacattcccatggtgagccctacaactgtctgccggggacagttccccatggtgctatgagctgaagtccaaacacagcacaggggcctcactagcatagaaggcagagatcagagattggggcagctaaagtgactggaatttgcaggacaggtcaccaaagaggggattgccaagtggagaggaggggcagaagtctgtggggggagtccttggccgagtagtgcttgctcagagtgagacctcctgaagtttgccagagaaccactgctatggggttgaaacagagatagtagaggcagagacatgttgcaggacattgggggccagcccagccagagaggagagatgttgttaatactttattaac

SEQ ID NO: 12316 - DNA, 23242 bp, Homo sapiens
atctctaaaaatagtaataataataataaattaattaattaaatttaaaaaaagaatctccaggccaggcatggtggctcactcctgtaatcccagcactttgggagtccaaggcaagaagattatttgagcccgggagtttgagattacagtcagctatgatcatgccattgtactccagcctgggggacagagcgagaccctatctcagaaaacaaaaaaagaaagaaaaaacccagcttgaagttagtgtaaacaactaaagcacaaaactatgatcttatcccactggacattttactatctgaattcactcacagtacttggtccctaagtctgtgtaaccattgctggctgcctttgacttaagggctcagttggttaaagcccaaagctgaggctcaagtcatgggtccagtctcattaatggccagttattttgctctgttcttattctatatcccggaccccactttctgtgttgcatatttatgacgttggtcacgagggtggcttgaccagagagggaacagaggaaggcaaatccatcaccacagctactagcaaaacaagcacaaatcctgtgaatggaggataagatatgttttctcctataaaaagcaaagtgtttcaaaataaaaaaaaaaaacaagaatgaggcactcaaagctagtgaatggtgctgtttggaaatactgcacttcagactactgagtatactggtgaccatcacaagctggaacatacaacaggacagttagtctggctatgagtcatttgaaatcatgggacactagccgggtgcggtggctcacgcctgtaatcccagcactttgggaggcggaggcaggcggatcacgaggtcaggagattgagaccatcctggctaacacggtgaaaccccatctctactgaaaatacaaaaaaattagccaggcatggtggcgggtgcctgttgtcccagctactcaggaggctgaggcaggagaatggcgtgaacccggcaggcggagcttgcagtgaggccaagatcgtgccactgtgctccagcctgggctacacagcaagactccgtctccaaaaaaaaaaaaaaaaaatcatgggacactaaacagacgccttatatgctaaaatggataatatttttctcatggtaagttgtcatggcctaacacttgcttattatgttctgatggtaacatattttcaaatttaaatgtaatgtaagaatgttccctctgctcattacctatatgagtcattcataaacattataacaacaaaaaagataatcacaaaattttaaatggaaaaataatggagtattttatttattgatagagataacaaaactttttgtaataatcctgaatagaatttaatgaaatgtaaatccaaacacaaacagcaagaatctgttctggcaattggagatgattagtgaagcagagaatcctgaatggtggatattcatctaagtactattggaccacggggtggagaaggagggagtcgaggatggtgaagaggtattactgactctcaaaccaaccaaccaaccaaccatatgtgtctctacctctctctcacacacacaattggatgtttgacagtgagcaagcctcttgacctctctagacctcagaggcaaaatgagaagtgtcctccagctagaaagcatcacaaattaaatgttttgctttaggttttcttccccaaacactccatattccttatgtaaaaatagagccattactacattcctatgatcgtattttaaattattgggtaagaagtatctctttataaaccaaattttcatcttaatctttgccacttctgcctcctaccccaaattaaaataaaaataaattctactaaattgcaggagatagttataatgtaatgcttaagtgcttgggctctcagctagatttttgggttccacttaaattaggcaagtcactgactcgttcagtgcctcagttcctttgtaagaataatgatacctgtttcacaggatgggtaggaggatgaaataatacatttagcacaaggcctggccatagtcaatgctgagtaattattttttatttttattttttgagacagagtcttgtactgttgcccaggctggagtgcagtggtgcgatctctgctgactgcaacatctgcctcccaggttcaagcgattctcctgccttagtctcctgaatagctgggattacaggtgcctgccaccacgcccagcttattttttgtatttttagtagagacagggtttcactatgttggccaggctggtcttgaactcctgacctcatgatccacatgcctcagcctcccaaggtgctgggattacaggtgtcagccaccatgccgagcaagtaattgttatttttaaactatttccatttctccatttgcattctccatttctccatcttcaatatatgtatatgtgtgtatacatatatatgacagaggttatatatgtatatgttataatcatataacctcagacacagggtttcacagctagaaggaatttctacatcaagtacaaaactcttgttacatctgtgtcctttctgtcagattcagagggttagagtgatttggttagtgacggaaatgatacttaaacatgagattcctggcttgaggctgcatcgtttttacttttcttccatttacttttatcttatttaaataacttcctatagaacaatttcctttaaatatgaaatgttccataggtttttggttctcagtaaattatgatattacaataatgcggtttattctcctgattgctgatctcttcataaattaggacgtgtattcacttaaagcagtctatttgataatgaaaacccagtgatttctaaataggcagtcagaagaatctgctttatgaaacagacaaacccctaacattgggcctttaaaatgttcggatatcaagaccacgaatatattatctaaattagagcccctgagcaaggactcaagctctattttatgccccatccctgactcacagtaagatcctgggcaagtcacttgaccttyttatatttcagagtgtcaaactgtgaaaagcatgtccataaaactgtgcaagcatgacctcattataaacccgatgaacttgaaagcaaagatgtgctttgatacattaaagaattaccaaaatagaactctagtttgtaaaatatgaagaatcaggaaaataaattttactatactaagtaaaaggattctgaaatgtacagtttttagcaagtaaagtcataaaaagtttcaaaatgttatatttaggtgaaataaggttaatgacagaggaaaaatattattttagagaatgcttggctttcaaaaccatagattgtagcaacttaaccaaaataatcacaaggaatggaagactatcagaaacgagtagatccttaataattaaacacatttctaggccattatttccccctacttatacaatgcatatcatgttttaaaatgtatttcactggctgggagcggtggctcacacctgtaatcccagcactttgggaggccgaggcaggtggatcacttgaagtcaggagttcgagaccagcctggccaacatggtgaaaccccatctctactaaaaatacaaaaattagccaggcgtggaggcaggcacctgtacctgtaatcccagctactcagggggctgaggcaggagaatcgcttgaacccacaaggcgaaggttgcagtgagctgagattgcaccactgcactccagcctgggcaacagagtgaggctctgtctcaaaaaaaaaagaaaaaatgtatttcactaactactatatgaaaagccccagagaaagaataccaatacccttaggaaagaagcagttttagtattattattattattggatggagtctcgctctgtcaccaggctggaatgcgatggcgctatcttggctcactgcaacctccgatgccctggttcaagggattctcctgcctcagcctactgaaagtagctgagattacaggcacgcgccaccacacccagctaatttttgtatttttagtagagacaaggtttcactatgttggccaggatggtctcgatctcctgacctcgtgatccgcctgcttcggcctccccaagtgctgggattacaggtgtgagccaccgcgcccggccaagatgcagttttaataaggagtttggccatttaggcttgtaactgactggattattgcatattctttaaaattaatttgtattagtcccttttcttctatttccttatctccaactctcgcattagtatgcacgctttattcctactcaggttttcccctatgagcccaggagtattattattatttttttgcagggattaggatcaggtttgtgaagtgaatagtgtctttctaatctgcagagggaaggcagcatcccctggcttgctgctgcagcctctctttaaattaaacagcaggttcactctttctgcggcattccagaaggaacatcagtaggaacagctccacagatgctgacgtcttgtctaaggttatcccaagaagtcctgtggcatttgcaatgtgcctgtacatttttccttttttaaaaaacatattcctgcagactttgttgaaaccagaaacaaacacaagcaagcaaagccctttctagcacagcatgttaatcacacactttgccatattctgtgaaacagtaagcaaatgataacctccaactgttgcccgggccctgtaaaacagaagatcaaattctgtgttctgccttggcaagaaaagaaactgcagcattttgtctagatttttacaagtcctggggttcacattactggctgaaattgttctttctctactttacagaaaaatggaaaacactagtaaacttaaagatttaaatattattttaaaaggaatataataaaaaatggaaaacactagtatatttaaagatttaaatagtcttttaaaaggaatataatcaaaactgtagtttaaaatacaatctagctccataagagaggcaattggctgtgtgttccacttgtaatgcagaggatttgaagcatctattttttcccttgtttctatggatttatgaataaagactctgacccttctcaggatcaggaaaattacgaaaaatttaaagcctgggtttaaggtctgtagaagctgcacaggtacactaattttagtaagacgggcgccaggaaaaagaacaaaatagtaggggagaaatattcaggcatcctaaaaaatattcagtggaaacgtaaaaacattaaagactgattaaacatcgcagcatgacacagatttagcaactgagcataaataatttgactcggatactgctccaaaatccgaagaggaccaatttcttccaggaggacaactacctcgtcctctgcagacccctctcctcggcagctgaaggagtgtggccaatctgcctccacctccccgcggaccccctactctcaggacctcctgcagcaccccaaactggaagtggccgctgcagacccaaggacgaggggcacgcgggagccggcagccctagtggagcggttggagatgttgaggtgggagggtcacccaggtggggtgaggctggggtaggtagcggagtgaacggcttccgaagctctgggccgcccccaggttggactaagcaggcgctctgtcttcgcccccgcccagggtgggcgtctcctgaggactccccgccacacctgacccgagaccgcgcgcccagcctagaacgcttccccgacccagcgtagggccgccgcgactggcgcgcagggggcggcgggaggcctggcgaacccgggggcgggaccaggcgggcaaggcccggctgccgcagcgccgctctgcgcgaggcggctccgccgcggcggagggatacggcgcaccatatatatatcgcggggcgcagactcgcgctccggcagtggtgctgggagtgtcgtggacgccgtgcygttactcgtagtcaggcggcggcgcaggcggcggcggcggcatakcgcacagcgcgccttagcagcagcagcagcagcagcrgcatcggaggtacccccgccgtcgcagcccccgcgctggtgcagccaccctcgytccctctgctcttcctcccttcgctcgcaccatggtaggtcgggagtggcaaatgccggcgtagcagctgcccgagatttcttcccagatttctagttgttttgtttgttttttgtttgtttttggttcttggaggtttttcttttctgagtgttacgcagcagctgcgcttaaaggaggttgcattttggatttgcatctcggcgacctctgccagggagcttcatttattggttccccttggagctggacttggtcgtaggccgtccacgggcaggggctccggccgcaactgcagcgggggtttctgcatccaatccccctgccccccgcccagccccgcacccactgcatccactagcgccgcacccgggctgcctgcagcgcagcgtttcggcctgggagccgggcggggccgggcactagacccccccccccggcccgcccctccccaccccgcttctccgccggcgcgaaggtggcaggtcgggcgggcagtggagaatgaatgggctggagctggccggtggcgcacattgttccggccgggtgttgaggggcgcagtcagcgcccgccacctccccactttggccggccctgctgggcgccctccctcggtcgctctcccctccttcttcccggggggcgcggcgcgggcgtgggctgggaaggaaggagccggggaagggtggggttgggggcaggaaggcgaggggttgggggcggagagggcggaagcggcggccgggccgccctgcgcccgggcggggccctgcggtgtggccgtggcttgttcctgccgctttcgcaccctgcggccccccacccagtgcagcagtgcgggcgggcgtgagcctcggtgcaccaggaggcacttcccgcgggaggcgctgggctcgcgctaattggggcggggggggggggcggcgggggaggagggaactggcgcgcggcttggtttccattagagacgcaaagtttctgctccgggaggaggcggcgrcgccgcgggctcgtcgcctgggggagcagaagcgggtgggaggtgcgggtggccttggcckcagccctggtgcgcgggggccgggggtggtgaccctcctggccgaggaggggcggcgtccagacgcccgctcgggggccgccttcccccccacgcctgcccccgggcacgcgccctgcccggtccctcgccccgcgccacttccagtccgcagagagatgccctccacgtttctgctttctctgcagcctctagattgccagatgcgactgtgcgcctcgctgggtgtgttttccacagmcccttcctcctcggcgtgcagggctgacatcaccgactgcgtttctggtttggcgggtggggagatggttccccgcagggttctggtacacctttgcccccagggctagcgccatttgggggaggaggttttcgttgtcgagaaagttggatgctcctggtaacccctctaacaagagagttctgtagcgaggtgggactgttctccccataaggtgacagtttctcttgcgaggtgtggcagcgcttcctgttgtacaagacagatgttgccttggcgttacgtaaatcatcgtgtctccgtcatttaaagaaagccaatttttagtgattgaggtagaaagaaagatccgtttataatttgtaaaaacaaattttcacccagaatcaatatattggaacaccattcctactgttaaagttttcacttaagagyataaacttcatcagctttctattaggacttattttgtaattggcttcttaggcatccttctttaaaagagaaatccacgttagctctccttgaggtctcgagttccctcggctggaggcacaggttcagtggagaccaaataatgcaggtgaattaccttcgtggccattactgcctcsaacgaagtgtgtttattaagaacagttcttatgtcattcttaaggtaggtagggttaatactctccagcaaatttagtagatactstttgccagaaaagagaggagtatatatagtttgataattattgtgtagttttctgtgtacttaatttttgcagttttgtaacacttcatttgtaagatggtaccattttttcctggcttctgaatcataggatagtttgacccagggcattagccattgtaatggtagscttttaacaaataactgcctaatttaaaggattggaaagcatttgttacatggaaatgaagttggtggcgtacccagttgctgtatctttattttttstacttaattatttctcataaaatggatataaaagcctgttaatccaacccaatgccattatgtaacgccagtttggagatttcgagggcctggagcagtgcgcaaggtgcgctgaaagcctgcccctggatgagatccttatcctggctgtgatggcagtggcagtgggctgggtcccttgttgagtggaaagggggactgcggtgtccatggtgcagtaggtggcgctcttctgtcttagagcctgccgccactgcagctggtgccaaggggccttctgccactagaggtgccatttttcacatgatgaacttagcctagttagatcgcagagcaagctgtaagccatgggcccagaaaagaaaacttgaagtgagcagatgttgtcacttccttgtaatcctttgttaaaatagcataaggagttttctttattctatttactttcattaaatgaccgtgctrcaggtttcaaaggattttaagattgatttttgaaagatcacaatattaaaagtataactggaaaayctatgttgaaatcaaccaaacatgtcgtggactgaatgataaccttttctttcttcatataggctgatcagctgaccgaagaacagattgctggtaagttgacaactccaaggagtccccaraaggccagaactaggcactgactcagttttggtgactcctctgttcctccccgctacagtctgggcagttttctaagaatttatttaaataagaacagtaagcagaaacactgaggtcagatgttattcttgccagtactttatagatgaggtgaaaggaagtaaaactaaggatgcccacatgttaaactctggagaatttgaccatgtttcacaatgtgcaaagtttgcrtatgattaattgtactgagcctgctactcagcggtttagtttacaattcttatgccatgggtctttcagtaatctgccacgaaagcttgtgctcgctatcctaaaataaatggaaatgggtgaatatgagtgttaggaccactgtagtaattgggaagaaagttacattagttaaactctgttgcccaggctggtctctaactcctgggctcaagcaatcctcctgcctcagcctcctgagtagctgggactacaggcatgtgccaccacgtctggcagattttagctttttaatattcctggaggacttgttttgagactgtttctcgttaggaaaccaggaatgcttctgaaatattctaaaagtcatgtggagagagtttacctgggaatgtacatttctagtaaccattttatttgttatgaaacaagggattcttatggctttagaaatgtaacaggaagggatttgaagggggcacatggaccaatcttgtcagattggatttagtcccttgaacctgggaggcaggggttgtagtgagctgagattgcaccactgcactccaatctcggtgacagagcgagactccattgtttaaaaaaaaaaaaagattggatttaggactaatttaagcatgttccagcttagccgccttgaaacctttgggaatattgtggtgtgtggcactgtttattgggagcagtgtttgctttatgggctgctgtatgaaggccagtccaacaggactattgtggtcattatttcagtagataaagaccagacttctgatacgttgcacaacttgaatggctggctttggcaagcccccggcaagtgtgtattgtgactgggttggataaagacattgattctaacgggtcaacttttgttttcagaattcaaggaagccttctccctatttgataaagatggcgatggcaccatcacaacaaaggaacttggaactgtcatgaggtcactgggtcagaacccaacagaagctgaattgcaggatatgatcaatgaagtggatgctgatggtaagagctttaaaaccatgaatgagggccattgttgtgtaattcaagttcagacatgttacaggattgtctttcaggtccccagagcaaagcaaatgtgcaaagatcctttctgtggttgccccagggccattgacaattaaaatagaagatgatgggccttgcgtccatcctgcttagtgtctagaatgttttctgcatgggatcactattgttttcttcctgcttggtgcgacctagagctcaaatctatttttttttttttttttggagacggagtctcgccctgtcgcccaggctggagtggcactggcgcgatctcggctcactgcaacctctgcctcttgggttccagcgattctcctgcgtcagccttctgagtagctggaattacaggcgtgtgtcgccacgcccagttagtgttttgtatctttagtagagatggggtttcaccatgttggccaggctggtctcaaactcctgacctcgtgatccgccctccccggcctcccaaagtgctgggattacaggcgtgaaccactgctcctggccgagctcaaagcttttatcaactggcccatgagtctgcactgagtcttgaggggggaggtgaaattaaatagccatagaaagtgctttttaacaaacttactgtgtttaaagaggaggaggaacccccagatgaagtaggtgacragcactcttagaagttaccataaaagtgagtacagtgtgagctgtagatgtgtttgctgcagaggagcatgtgaggtttggaggcggatgtgtggtgactccaggggatagatttgcagaacctaacggaaagggaagctgtaaggtgcagggccagagggaaccagcagtaaccctgatagcggtctgtcatctgttcctctcgactctacagcagcggacaacagaactttgattgctgatttccatcagtaagcaggctttgaagcacacttccccacccctaaaaaaaaaccacgtattttggtaaatcctatatatattctaatgtactgtatgacagtatagaacatgatttttaaaagatgagttgggaggagaaaaggataaaagaaaaaataaaagaagcattaagaataaacaattcggatctagattttactttctagatgattgactcgagggtggtgtagtaaaatcgcttgtctggtcacaaacatttggcagcagagcttttgattaggttctttgacaaagccttcagcacgttagagtggttttcactaatagtgttttggaaagaaaaggttgtccatagttctctagtttgctaagatgatcagctacccaggaacgtggagtaacttcctcttgtttgtgggagcccygggaatctgtgcctggggaggggagaagtctgttaggctcttggattgtgtggaagaaggagaagttgtgccaggctacagaatcctgtgtttgcactgagaaaacaggatggtacctgaccttctctgcatggctgtgagatagcttaaaataatttcttttgtttttgatgaatatgaacaatatcttaaaatttttgaggctaaaaaagtcttgaagggatccctgaggtattttctttgaaaggtactggtgaaaatgagtaacttaacctaagggtttttctttctaattttatttccatttagttcaatgacactgttagtctggagtgcttgtctttgggggtattcatctcttagttttaaagaggagttgtttggagtactggccgtagaacagattgttctgacagttccctaagtgttactagtctgagctgtgagaatgctcctgagcttttcccttaatgggaaataaagatactgagttggaagaaaacaggtggctaaccatcatagcgtggccaagaaatgatcctggagaagacttggtaagacttcatggcccatgcatggcataacagaatcaatgttcctctctcataatcttttctcctctgaaacactttatacacttaacctgcagctcagttctaggccttttttgtgttactgctgtcactaaccaaggcagagtgagacctgagtgatttccctaactcagggatggcagtcgggggcgctttcttccctcggagtggaaagattcagcctgcggagtggtgtatgctatttttctyttgaactgtacagcccttcatgacccttccatgggcttgaatccagatgtgcagtttcctttgtataattaaatactatcctgggcactgatgatgagtttgaaattatgtgaaattgccctgtgaagtgtttgaacgttttagacctgcagatgattgaacctagtaagatagtctgccccttygtcctagtacatgtttaccgttccgtacagtggttctgaaatgattactgcagagcagcgttaatggagtgcttactttacatgagctttttgttttttaattcgaggtaatggcaccattgacttccccgaatttttgactatgatggctagaaaaatgaaagatacagatagtgaagaagaaatccgtgaggcattccgagtctttgacaaggtaatccagcatctacatagcagatggtacttaagtatggcttcttccgctttcacttctaaaagctataataatgttatagacagaagacttaaatctaactgcctgagcctctgatctcactttcaaaaatcctccttatggtaaccgtatcaggggagggtaggcataataaataggaattttggaccatgtttcttgactgttactttgaattgttgtgagcttttgcaaatcctgttttctgcattagctgtttgcatgtatttagtaggttagaggtgggaactagagatcagagaattgtttatggcagcagagttagcagtaacttgagagggcatagctaagtcaaagacctacttccccacactacatcattagcaataacaattgctgaatgttcacaggatggcaatggttatatcagtgcagcagaactacgtcacgtcatgacaaacttaggagaaaaactaacagatgaagaagtagatgaaatgatcagagaagcagatattgatggagacggacaagtcaactatgaaggtaaaactaaattctctgagctcagtgtttcatagtcttacctttagatctgtaagcaagccaactgcttcactagacagcctttgactttattttatgtacagtaaagatgttgtgttcattaaagctgttttcaaagataaccaaaagttactattatatttgtcttttcagaattcgtacagatgatgactgcaaaatgaagacctactttcaactcctttttcccccctctagaagaatcaaattgaatcttttacttacctcttgcaaaaaaaagaaaaaagaaaaaagttcatttattcattctgtttctatatagcaaaactgaatgtcaaaagtaccttctgtccacacacacaaaatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgattgagcacagtcaggcctttgtattaaaaatgaaaaatgaaaaaacaaattcaaaacctattcaaatgggttctagttcaatttgtytagtataaattgtcatagctggtttactgaaaacaaacacatttaaaattggtttacctcaggatgacgtgcagaaaaatgggtgaaggataaaccgttgagacgtggccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatctttggactctctgtttttaaaaccttytgaaccatgacttggagccggcagagtaggctgtggctgtggacttcagcacaaccatcaacattgctgttcaaagaaattacagtttacgtccattccaagttgtaaatgctagtcttttttttttttttttccaataaaaagaccattaacttaaagtggtgttaaatgctttgtaaagctgagatctaaatggggacaaggcaggtggaggggaggccagtgtacatgtaaatgcccacagcccagcattgggtttccctcccaaggccccagcaccaacctctgagcccaagaccttgcctgaaaacaagcagataccgattgcttcatcctatttatggacrtgtaggtctagttgcattttcactggggggaggggggaaggtgaattatggtaacttttaatgatctattcaggcagtagagctcttaaggaaaaaaaaaacccactttctctcaagcatgtatttaggggttgttctcaattgtgctgctgattacctgtcttatgtaactacttgagaccatctgcaagagacatgatttagtgtgtctgtaattcaatcttcgctgtgtgtggtagaagcagtagtcacttttgtaagccagtctcttcatgcctaaaagacactaccagtcacctttgattcgcgacttttaatttatgattatacttagcctcctcctcctttttttttttttcccaagttgacttgactttgcttttttccccccaagtagaactaatgctagcttccagcttgaaagtaaaactccagtgtggagtgaattttgtgtctaattataaacctgtaaccaaaactcagacatctggtactggtctttgcattgagattggtccctgtaaaaccccctttaaaagcatattgcatttagtacagagctcttttttgaaatgaaggctggagatgtgcatttttcacggtgttaactggttrtatcttattagcaaggagattggggttttgagtgtttgcgtgggtggtttcaatttgccagggaacagtggcaggctgctagcaaggcagtgagaagctcttggcagccaaatgggtgcattcagggctgatttatagagacccttggcttctccttctcctactccctgtytttctggcattttgtagcttgttagattttctgccagaggggtgggtcagagcagtggaggggagacatcgcccatgtgctkctgctactggtccttgggctgggtggttggtagaggagatgttgacactatgagctaagggttggcttttgtaattacctgaatctgaaaggaatgcctaaggttaccttggggtttctcttctggtgagatagggttcctggtttgagtaagttaatgtcctggatatttcttgtggcagggggtggtcaaagagcctgattgctgacccagtctcaggcctgtggtcgatgacctctcggtagtttcaaagggggctggagggggatatttgacttgttttttcgaaatgtagccttctaaccctcaagtctttagaagctgggtggactcttagtggtcctgcagcgtatcctaaaagactacctttgaaacaggattcttgtatggccaggatcstgtctgggaaccagaaaccctacaccctccccctccagggaatgctgagttccagttttgagcagaggtgaggcagaatccactgtagccttccgccctggtatttggggggatgaccagcccaggcgttgggtgttagtctgcatgagtttgtgagaggaaatagctgggtgtcctggcagtgcccttgaagttggttaggaccttcctgtaaactcttgcccctacttctaactactctataaatatatacatatatttatatataaagtgattagttgaactggcatcctgctttagcctgagacttgccataagaaactgctgagtacttggcaaaccctttcatagttttgttctccatctgtttggggtaggtgttgagygaggcaaatggatctcgatatttcagatgggcttttgatgcactgttgccaaggaaggctttttctgattttttgacaaatgaatttttgcacactttcattggtgtctttcggcaacttacacacattgaaaatgagctattgtacatatttttatattctctttataaatgcatgtctgattgtacttgtaacaatattgtaatgaacggctgtgcagtaggcccagcgctgctgtgtctcgtcagaggaatagcttaccacgaacccctcagcatactgggaatctcttcctgaacaacgaatgtaaatttggtcaagtctactcttccgttcattcaattattttaagcatttgaattatttattgtatatcctaaatatatttctcctttggcagtgactagatttccactaatgtgtcttaatctatccctccagctggcagttactgtttttttaatcccctgaagttgtcctgtaggagacagaaattctttgctgtctgtatcccttggagtaagaaggtagtggcatgggtggagtgtgtgttctttctccaaatctattatgatgtttattaaacacttctgtagcaaagatggtggtagttcttttgttactgaagttgcccttcaccatggctatttgaaaaggagatgtacttggacgtttctgtaaatcttgagataaactgtttggagatttaaccacctctctgatggrggaccaactctatggaaattgtaaatacgttttatttataaacctggcactgtattcaataaacatttctgcagcctttcatctctaactgcgaactgtgtaggtttctagcttgcatagctttcaattccttttgctctcaacaagatagacctgccctcagatgtaatttcactgggtctctagtactgtgagagtgaggggccagaaataaccgtagacacatcccacaaccgtcttaccctagttttaagtagtttgagtgttaatagctgacattttaacctattctcttagcctattaacttgtccatgcttgctttttatgcggaaaatttacaccataaggattagtttccttttaaccccaatccaagcctctttaggacttgtataaagaaatacatttttttcaataagatgggaattttagatgacaaccaagatgataccttggttcatgtcaagagcgggacagctgaggaaagtggggtgggatgcaagtacaatttargaccttggcattgaagccttccccttagtcaacactggcccagaccctggttcttagatgtagcaggagaggctgcctgcttctgccccctttgcttccagaaaggccttttccagctgcctcgtgtgtttcccactctgcccagaaggagtgagagggctgaaaagcggggcgggataaggccctgctttcgacagaaggcttgagacacatctccagaaagcatttaaagagcccctcctgcacataggagctgggactataaggacatggtcatcaccgtggagacggccctctgctctgaggctttagacctggcttctggatttggttctgtccctccagcctcaggcaggttctttacctttcccaggccttggtatcctccttggtaagatcatattggacttggtaccttctgcctgtggctttctaggattatgaccgacctggtttggcatcactttgtgtttagatagatgaaattgcagcctaaaggatgggaggcaaaattgtgtaggagtgctgtgtcctttgagatgacaaatgggatttaaaaattctcaccagcttcatgttggaggtggagtggaggttaagcttgctattaagacgtgatgtaatattggaacctgggtcagagaaactgattgttaagtgacttccattctcccaggacggaaataggaggctaccactgggcctgtaagggattcagtccaagtgacatcatctggttttcagcagctccggtttagaaaaacacacacacatttccgattcaagctgaactttcccgggcactggggggctggagcacccaatgactcaggatgccttagaaggaaataaaacataaagctttttatagcttggtgcttctctcccactgccctcaactctctgccaaggagtgggaggagttagctcatggaccagaactcccattaaagcccctgaactctgattaaatcaagtggcagttttcctcatgagaattatgttctttgtgtcaggaaccttaggaatgagtgtgaattgacacattcagattgtggggttttttttttctcttttgaggtggggtctcattctcactcaggctggagtgcagtggcacaatcacagctcactgcagcctccacctcccaggttcaaatgatcctcccacctcagcccccccagtagctgggactacagggatgtgctgctgtgctcagctaatttttaaatttttttatgcagacgcggtttcacatgttgcttaggctggtctcaaactcctgggctcaacaaatcctcccaccttggcctcccaaagtgttgggattacaagtgtgagccactgtgccttggctcagataattttttttttttttttttttgagacagagtcttgctctgtcactcaggctggagtgcagtggtgtgatcttggctcactgcaaccttcgcctcctgggttcaagcaattctcctgcctcagcctcctgagtagctgggactacaggcgcacaccaccacgtctggctaatttttgtatttttagtagagacggagtttcactatgttggcgaggctggttttgaactcctgacctcaggtcatctgtccgccttggcctcccaaagtgctgggattataggcatgagtcactgtacccagccccagatagtcttttcaatatcatatcttagttttattttcagttttacaaaggctaaaaggaaaatccagagtttcctctagcaatataattatttgaacattttgttacaacatgatctttagatcctggctgtatgtaagcatgtttgcttttaaactgatttttcattttgagtctttgtatacccttcaagttgtgattttttttaagttactgcattttttagcaaaagatagattttttcctgcatagacatatcagaatcaagatttgagatagattgttttaaaaatggaaaataagtaaaaaagtaattataaaatcatatcttagttaaaaggaacaggtcatataggtaaaacttcctctgagtgcaggtatccatatctggtgattctcaaacttggaatacttctaacactggacatctaatcctgtttccacaaggcagaacttgggctttctccctttcaatgacaagaagttaattaacagcccattcccatttttatttttatttttttgagatggagtcttgctctgtcgctcaggctggagtgcagtggcctgatctccactcactgcaagctccgcctcccaggttcacaccattctcctgcctcagcctcccgagtagctgggactacaggcgctcaccaccacaccctgctaattttttgtatttttagtagagacggggtttcaccgtgttagccaggatggtctcaatctcctgaccttgtgatccacccgcctcagcctccccaagtgctgagattacaggcatcagccaccgtgcctggccaacccattcccatttttacaaaagcatttttctgaatttaatagaaatgctgttgattatttaaaatttgtgatgtcaaatgacccataacctataaactatagctgagactctgtatttccttttggaatttttttctcaccatatggatgcagagatagggtttacaacatggggtcccactgtatgtgtaagttttttttttaataagcatactattctttagtatgtacaattacatgttgtatatatacgaatatattacaatcttcttactccttataactttttctcctcacgatataayttatgtaccataaaattcaccttttaaaaatacacaatttggtggtttttagtatattgacagggttgtacaaccatcaccactatataattttagaacactttcatcaccctgaaaaaccctgtacccattggcagtgattcccatcttcctttctgcctccttccccccatcccctaatccccggaaactactatattttctgtctccatggatatgcctattctagacccatataagtgaaatcatgtattcatactttttaaatcctctttttcccttttttttttttttttttttttctgagacggagtctctctctgttacccaggctagagtgcagtagcccaatcttggctcactgcaacctccccctccccggttcaagcgattctcctgcctcagcctcccaagtagctgggattacaggtgcacaccaccacacccggctaatttttgtatttttagtagagatggggttttgccatgttagccaggctggtcttgaactcttacctcaggtgatccacctgtctcggtctcccaaagtgctgggattacaggcacgagccactgcacccagcttcttttttactttttctactgaacatttctccatcgctttacattcttgaatataatttttaagatctggctgtattaatacagcatcatttagctaaccaataccctaataaaggccatttggcacattcccattattcttttcttatttctccaagaaacattccattttaagctgctttaactgtgagcacattcttactaggctggaatctgcttccttttaaccccacccattggtgctattgcagcttgtggagctaactctagacatctaatcctgtttccacaaggcagaccttggtcttcctcactgtcatggacccctcccgacttgtcaggcttaacattttgctccttttttattttttattttattttaattaattaattaattaattaattagagacagagtctcactctgtcgcccaggttggagtgcagtggcgcaatcgccactcactgcaacctctgcctcctgggttcaagtgattctcctgcctcagcctcctgagtagctgggattacaagcgcccgccaccacgcctggctaattttttgtatttttagtagagatggggtttcactatgttggccaggctggtcttgaactcctgacctcaggtgatccgcctgccttggcctcccaaagtgctgggattacaggcgtgagccactgcgcctggctggttgtgttttcgttaagtgcactggttttgagttggttgctccttcttttttaaaaccactctttgagagaaatcaacaagatgtagtgaaatttacccaggctgtgtattcaaacatctgtgttcaaatcctggaattactggcatgtgccaccacacccagctaatttttgtatttttagtagagatggggttttgccatgttggccgggctggtctcgaactcctggcctcaagtgatctgcctgcctctgccttccaaagtgttgggattacaggtatgagccaccatgcctggcctacaacatataccaactttaatatgtaagaactgatgcaggcatagcatgaaaatgcatcaagtaagaattaacaatggtaagaataagaaatccattattatagagattttaatatacttctggtaattgagaaatcaaccagacaatagaagatttgaaccacagaattaacaagtttgatctcttgtatatacatagaacattagacccagcaagtagagaatgcacatttgaaatattaaatattaatcagcactattattaatcacaaattaataaacaatataactatgtggttataatatataattgtaaatacaaatatataattatataaacaacaaattaatgatattagtgtaataaagttactaacaaatatcaattaagaagatattaattaaatagataattaggattgactacctgttagatcatagggtaaatctcaacaactactttaaaaatcctatcatattgacctagaaaataattccaaaaatacaactttaaaaataactgtttagaaaattaaaatccacttctaataacacatgggtaagaagaaatcataacgaaaatctagaaaatatttaggattgaatgaaagaaaattctacatttcaaaatgaggtacaacttaagcagtacttagaaatgtatagccttggccgggtgtggcggctcatgcctgtaatcccagcactttgggaggccaaggtgggtggatcacctgaggtcaggagttcgagaccagcctggccaacaaggtgaaaccttgtttctactcaaaacacaaaaattagctgggtgtggtggcaggcacctgtagtcccagctactcaggaggctgaggcatgagaatcgcttgaacctgggcagtggaggttgcagtgatctgagattgtgccgctgctctccagcctgggcaacagagcaagactccatctaaaaaaaaaaatttatagccttaaaatgcttataatggaaaagtagaaaggctaaaaataaataagctaagcatccaacttaggctagcaaaagaatagaataagctcaaagaaagtagaaggaaagtatcaaggataaccacagaaattaatgagaaacaaaacaaagaagatcgacacagacaaaaagtgggctcttttacaaaaagcatggcagtttgtcaaaaaaattaaacatggaattaccatatgatccagcaattcc

SEQ ID NO: 12317 - DNA, 645179 bp, Homo sapiens
catgtttatttaaacagatgcagaaaaagcatttaccaaaatttaatattattttgtcacagaaactctcaacaaaagaagagaattccctccactttgtactgagcatctattgaaaacctggagccatcatcataacggtgaacgaatgttttttccctctgataagaaattaggcaaaaatgtccactcttaccatttctattcaactttttaactggaagtcacagccagaaccaaatagcaagaaaaagtgtaaaaagcatacagattggaaagatagaaataaaactgcctttatttttggatagcataatcctatatataataatcctaaagaatcaacatataaactacttacaagtgatttcaacaactttttaggatccgatgtatataacctatatcacttatattactatgaaactaaatttatgaaaaattaaattgaaaaatatttacaatagcactcaaaaacttgaaacacaagttaaattttagaaattatgttgacatgtacatgaatgggaagccaagttgggaggattgcttgagcccaggagtttgagactggccttggcaacatagtaagaccttgtctctcaaaaaaaaaaaaaaaaaaaattaattagctgggtatggtggcatatgcctatagttacagatactcagaaggctgaagtgggaggattgattgaacccaggaggttgacgctgcagtgagccatgactgtgccactgcactagagtctgggtcatatagcgagactcatctcaagaagaagcgcggtggctcacatctgtaatcccagcactttgggagaccgaggtgggtggatcacttgaggtcagaagttcaagaccagcctggccaacatgctgaaaacctgtctctactaaaaatacaaaaattaggtaagcctggtggcacacatttgtaatcccagctacttgggaggctgagacaagaggatagcttgaacctaggccagagtgagactctgtctcaaaaaaaaaaaaaaaaaaaaaaaagaaacccaaaagacatgtacattcaaaactataaggcactgcttagaatattaaacatgtaaataaatgaagacgggctatatttgtgaatggaagtctaaatattgctaagatatcaattatcccacaatttatctgtaggtccaacctcattacaatcatgttccctactctccttttttgggtagaaattaataagctgatatttaaaattatatggacttaagaaaactaaacatattcttaccatatgatccaggcaattgtgcttctgggtatttactcaaaggagttggaaacttgtgtccacacaaaaaccttcacatgtgaaatatgagaatagttataatctatagtgacaaaattagatcagcagttgcctttttctgggaatggaggttggrggatttattgcaaaaggtcagatgctgatagcagttgtatcaataattgtcaaaacttggaaccaaccaaggtgtttttcattagatgaatggatgagtaaactgtggtacttcaagataacgaaatattttttcagtgctaaaaagaaatgagctatcaagccatgaaaagaggaaacttaaatgcatattactaagtgaaagaaacttatctgaaaggctatatattgtatgattccaaatatatgaccttttggaaaaggtaaaactaaggggacagtaaaaagatcagtggttgccagtgtttggaggtggggacagggaggaggcatgaatacgtggagcacagaggaatctcagggcagtaaaattactctatatgatagtgtaatgttggatacatgtcattataaatttaatgtaattataaattacattaaaacctaatgtaaactatgaaatcggagtgataatgatatgtcaatgtaggttttcagttgtgacaaatatatcactctgatggggcatgttgataaagggggaggctatgaatgtgttgggtcagaggtatatggaaaatctctgtaccttctgctcaactttgttgtgaatctaaaacagctctaaacaatagtctattaaaattaaaaaataaaatattcaacttcaccaatgaatagatttttacctaaatattacataatatgtgaagaacctaaaatagtaaagataattttgttttgtaaaacaacattataggatttaccttacctaactttgaggctcactgtaaagctacagtaatagagactgtgatagtggaataaggagatatatatatatatatatatatatatatgccattttatatatatatatatgccattatatatatatatatgccattatatatatatatgccattttatatatatatatatatatatatatatatgccaatgaaaagagagtccaaaaatagacccacacgtggtcaattgacttttgaaaaaagatccaaggtaattagacgaggaaattatatctttctcaacaaatgatgatgaagtgaatggatatctacatggaaaaagaaagcccttacctaagcctctacttcacagcaaacaccaaaatttgctggaaataaatcatagacccaactgtagaagctaagactataaaatctctagaaaaaaaataaagaagataatgttcacaactttggtgtaggcaatgatttctgaaagggacaaaaaatattaagcataatgaatgatttaataaattgtatttaatcagaattaaacacttctgctctttgaaagcactccaaatgcaaagtcaagccacagattgagaacaatacatattatagtaaatgtacttgacaaaggtcttttctctagaatatgtatttaaatcttattaataatctggcaaacaaagcaaaatgagcaaagatttcaagaagaatttcacaaaataagatatacaaatgacgattaagcacatgaaaatatgttcagcatcatcaaagaagtgcaaatgacaccaccaatgaggtatcaccacacaagcactagaatggctaaaatgtaacaatattagatgttaataaagccatagagcatctggaactcctatatattgctgtgggaggaatgtaaaattataaaacaacattggaaaagaggttcacagttttgtatagcgctaattacatacctgataatataactcctaagacttgataggaatagagaaatataaacatgtccatgcgaacactgtgtttaaataatcatagcaattttattcttcatagccccaaactggaacaacccaaatgtactttaatagttgaatgtattaaaaaattgtgatatatccatacgatatagaatgatagatactattagaatgatagaatattattcagagatgaaaaggaatgtattactgatataagcaacatgactatacctccaaaacatgttgcaaagtgaaagaagccagacacaaaagattactattttattattgtatttacatgaaatatgagaatagttataatctatagtgacaaaattagatcagcagttgcctttttctgggaatggaggttgggggatttattgcaaaaggtcagaaagaaaactttttgagattatagaaatagactatgtattgggtactttgtcagatgagtatttacatctaaaaaatgtttcaaatgagcatatttattgtgtgtaaattgtaccttatttaggtttatttggaaaaaatatagctctaaatatactggttcattttaatttgggttaaatatttaagaattttttccatgtgctgaatcaaacaagtagagttgacagtggagatcatagtcttattctcaaggcattttcatgtaaaataggaactcaggtaactgcagtaactgcagaaaagcaggtacaaatattgattataaaatcctgggaaaatgtaaagaggaaggggatagagggaacatggtatattttcattccacaattagagttagcagctgcatcattctgattttcctttttataaatattttttattatttattagattaactaatttgagttgaggccacaacatggttgagtaaaaataatcattttcctttttataaatattcaataaaacttttcctttttataaatattttttattatttattagattaactaatttgagttgaggccacaacgtggttgagtaaaaataatcattctgagaatagcaataggtttagaaggttaatttagggtgcctctctgctattagatgtacctgaaaaacacttctaggcaaaattagaccaaattaaaaacactggggcttcaattataataaactctcaaatataagttttattattgtttattataataataaataatgtataagtgtgcagacatgggcagactacattttgcaaatttccacagtaaggtaaaaggattacaaagctttctggtataatattaacagaactaaaagacatgaataatattaaagaatgggctttggctagtgattttcaatcaattctcttcaaagcaatactctcttaattttactgaaagaaaattcaactttaatataatatttagataaatcaatacatcttaactataaaaaagaaaactatctatataagacaatatgtatttcaacatataaatgcttgggtaaaacttccttaggaggcaaaataaaataaaagtttgcacctattcttagatgaccccagtgtaatcgatgggatgttgatattgtgctggtgactcaagtaccatgggcaaggttgttatcagtgatgtgcttctctgaaagtacatctttacacccattgacaaatgggtgtaaaatccaaaaacacaaagtaaattatcttctcaatgtatatagtagatgcatcctagaaaaaarcaaacaaacaaacaaaaaacacacacaaaaatttgatgtggaaacaaacttaaattaggtttcaaatataaggcaaggttttgttgttttgtttgtttgtttactcactacataaatgaccagtggcccattcagaagtctaaggacaaaatatgttgtaggactgtcctgaccactgagggacagctcacaccctgacccaacagtacactaatgcctgcagtacccaccgttcccggagtaaaccaaaagacatcctgcgactcacaaaatccattatggagttgttttaaaccttatgagaaccactgacctaggccataaaaaacaaatgaaaaaacaacaaaaactaggaatggcagtagttctgttgagttaaagaggagaaagaggagaaaccaggactggaagagatgaaattgtgagtctggaaggaaactattgcaaaggcctttattacctttaagtaaatgtctcctaactgaactgaaagccttcattctaaccattagtttggtcaggaacatttcagggacgccagggtggctgttttattttgcacttcctttactgccctcccagcagcctacctagcagtaagttccccagcctgcagtgtccccagagggcaccttccctcggctagtaacttctcagacactctggccttggggatgtcttggatcttctaggtacacagtggctgcacacagttttgccaggcctttctcaagaggtaaaagttcctagctgtttgcatttcccagaaataatgttttccatgtgtagggattttacagatttcaaagtgctttcatgtcaattactttctttaatttaaaagaagttcagataccaggtcaagctaggaatgatccggtctcagagggaaggagcgctctaggaaaggaggatcctttaatagagggccgtcctggggccgcgtgcccatggaaggcgagagtggaggagtgtcctctttctcccccaccctcaggcggcggcccggccaaagccagagggggctgtctcctcctcttccccagcagctgctgctcgctcagctcacaagccaaggccaggggacagggcggcagcgactcctctggctcccgagaagtggatccggtcgcggccactacgaygccgggagccgccggggtcctcctccttctgctgctctccggaggcctcgggggcgtacaggcgcagcggccgcagcagcagcggcagtcacaggcacatcagcaaagaggtacagtcgaggcatgggcttgggttgcatcctttgccgggaccgagattcctcacttcttccactcttccgagagttgctgtctgtggactgccgtcttgcttcgccttcagagagtgcgctctggggcaagaggaacttgaagcaagttcaagttcaatgccatgagagcrtagtgtagggggaattacctaagtcctgcaaaaggaacggggagtgcttttcattgttctttagtttcgaagaggtcttgctatcacgatacatcccgtaaattgatttctgaaatctttccaagaggaaaactttttccaattggaaaaaaaagaatttcttcaaatcagagcccatcctgcagagaaaggcttcccaagctgtgtggttcatcctgggactttatggagggtagctgatgcatcaaaaaaaaattatatatatatatatacacacacacacacacacacacacacacacayacatatatatatatataaagttttacagaactttgttttcaacttttaaaacaggatttctaaagaagttatgtggttttttttctttcatggcaatggcgcctccagcctcacctttttcaaacccacatcttatcttcatatcctattttattgtagtgaaatcgtgaaatttctccttttgcttaaatacagaggagacttctatgtcatgtgtactttaaggccacagtgactagatatacactttggaggactttggaagatggctgtatttaatgtaacttaaataacttattctcctcagagmctcttagtgtttatgtatatatagctctcatttctgaaactttggggagtctttgaagagttattttattatcatgaattttacaggaagcacatgtgcagcattgtaagacatactttgtaacacattatttcagcaaacaattctttaagttggaaaacctgtatcaaagtaaaaaaaaaagaaatatttattattcggttttaaatatgaaaatgtttaacctaagagtacaaaatctgtaggttagaagcttttaaaagttttaatgaggctgaatctgcttaagttttgaagtatacttatccttcttccagttaacttctagccaagtcaatagttctgatatttgttcttataatctagcatttttagcagtactattttttaaggagtaaagagatatcccaagctctttctataataataactccctgattaaaattcttggaataaaaatgaccttgcattcactatataacttttttccttctatttttgcttttgcttctctgagaggtaaaatggggccaatatgacttaattaatataatttacgagagtgattttaagagtatctctggccacttatttttaaaaattctacttttaactattaaactttgctcaattacaaggtgtgtttaaacaagacataatactttaataatgttaggcagctgggagaaatgaggggccaggggcaccaatccttatgtccacttggaatggggcagaaactcaaagcatgcagagtaaggatcaagtaaattgttgctaagaattatcctgaacacacacaggatttctcttttttcctctcccttcttatttactctcttttcaaataaggtaatattaactctgatttctatgacccaggcacaagatgaagtgaattcaggaggaagggtttatactaccattctgtcaagataccacttaaatgctacatacaataaggaattttattcaaaatagctacaacatacaatctactataggctgctataatctgcattctagtatatattattgtctttgtcatagaccatttacaatatatctggaggttggctcaaggataaatgacttaaacctgttaatgttgaaagtatgtaaaattcatgaaactttaaaattggatagtgatttatgatttaaaaatgccttatgtacacgatctttattcaccttcagatattattattctcaaaggacaaatttagaacttaggcttccagtagttgtaatttaagtttacataataataactttatttcaacaactaaaacacttccggtattgtttgtgctgaattcccttttttatggttccaaggtttctttccattaattgtttaggccatgttttctttttagtgttgttccattgaagcaagccctctgtgaaaatcacgggatatgagtttgactggagaagggttttcctggctatgatcaacttttctgttttcgattatactagcactgacctttctaggcaagcgctaattgtgtagaagttctatttccccttataattcgataccactttattaagaatttttgacatgaatcaaccatttttagatgttgcagttgagttagaaacataaccagactttttgttttttactttttctttgaaatcttatgtggtttctatagcatactcgattgtagtatgaatagcattgattcagcaagaatgatattccaaggaaattctttagctatatttaaaattgacgaaatagaatgatgcaatcaaaatgattctgcatttcagcaaggcagtgtctaaaatgttttctgatattcttgtgaataatatgtggaaactgaagcataatggyaggtaaattgcaactgattgaaaaatagttcacaaagaatattgcatagtggattaaggtcaatccggaaagaagtctctagcagtgcaacagaggttttcttatactcaactatcttggtaatggcttgatggaaaatgtaaaatccaagcttatcagaactgcatgtggtccaaaattgatagaggtggctaagctggttactaacaagttcagaaattttaaaggtctctatagccttgaccatgaatggcacctacatgaagttgcttttattattcatatccacatgttaaaaaaaaaaagtccatttgtgctcttctggaaattagttacattgtttatatgtttaggaatgaatatgaagacaggaagagaaaggccactctgaattgcagcaagttcgatatgaacatatagtgtaatatggtgacaaaaaaggttggctcacttttacacaaaactcatagaagcacataggtctgttgcttaacacacatttgggtatttcattgacaaatgggtgtagatgcagagaagggagagcagaatggttaagagtctgagaagattttcagaagaggaatgtcccaagtaaaatctttccatctgaacaaggaaagatttagggaaggcaatcataaggactgtcctcaaattttcagaagagtcgttatgttaaagagggactattctaaaggctgaaggtggatccayagaagaacatgacaaacaaccaggtttgaattttataatatggagaaaatagctcctctcctcacttcctccccatgccattttgagttgytcagaaatagctgaattgtgtttgagcaacttgcttctggaaatgaccatgcagtgatcagatgtacagttagtgagggatgctttatgagggaatgcctctactgagaggaagttaagactcatcaactgtctagccatttgtcagttctaagattctaatattatagtctattgcttttagagtgcatacttgyatttaaatttctgaattcttaaaatgtcaagaaaatgttaaatatataaaaatgtgtttttaaatcccttctgggatttaaaataaaaacatgtttgagacaatcctcacacatttttggcaagaatacttagatatttagcatggattttccacatcatcgtcaattgcacagttctaaaacatcttgtgttataacacgcaagaatactttataaattacctgagaaattttcaggggattcatagtggccataaacctggaattaatttttttaaatatttttctttgctgcatatgttaactttttggcttgtttgccatatactgacctaatcatttagtaaaaatgattcataacagataaaatgcatggcatttcaacatattcaaaatatttatatgaacatattcaacactgaatattatagatgtgatagaattaataaaatttatataaattttatattatgttatatttcacatatcaatgtgtacagatttctggtctatcttaagatttttctaccctaggatttcatgcaaactaatgaactgaatctatatcaagggatgctgggggctgggcaaggtggctcactcctgtaatcgcagcactttgggaggcctaggtgggtggatcaccttaggtcaggagttcaagaccagcctgaccaacataacggaaaccgtgtctctactaaaaatacaaaaattagccaggcgtggtggcatgtgcctgtaatcccagctactcaggaggctgaggcaggagaatcacttgaaccctggaggcagaggttgcagtgagccgagatcgtgtcattgcactccagcctgggcaacagagggagactctatctcaaacaaaacaaaacaaaacaaaacaaaaatttaaaaagatttgcaacttatcatctatccagtttgcagtagggccttatttagcatctagaaaccatgtgaaaaagatcaggaagaaattattgtaaataattattgtaaatggttgcacaagtggtttaacttctaatctagaagattcgggtttaggatttgtttacagttgcaacttgagcctcgatagctaaacaggaatttaggcagaagctccgtttcagtaaatgagaaaacaagacagagtttagagaaagataaaagtagattttccaggcttagtatataccaagcagatagaaataaaactaattctaggctttccccattggtaagactgaatttagaggtcagaagttgtgaaggaaattggtggggttgggcctatatgcattggaatgtggtaaatgaatgaatgtttacagtgagtaaagaagataaaaaaattcctgctcttgtggaactaatatttagttgggrtggagatgagcagacaggactatgatgaatatatgatgaagcaacaaaagaacacctatattgtataaaatgtagttgatgaaaaatgtcctggacaaacaaatacaacggggtaaggacagtcaggagttctaggaatggagggaggttgatggctattttgttggtaaaggttggtaaaggttgacctctttgagaggatctcactttggcaaacacttgaagatgacgtgggagtgatttgtgcagttatcagggggaagagtactctctgtacagggagcaggcytatgaggatctaagcttggagcatggtgagaaggctcagaggagaaatgggaaactggaacacatagcattgttgaccttaattttaaagattttgcctttttgtctgagtgagatgaggaggcatcggtgagttttaacagagttaaataaatgaataaaatcacaggtttttttgtctcaaatacgcactaatccatgggactagaccaacagtccaagcatagaattattttagatttatctcttgtcccaaacactccactgatagaacacatttaagtgattctacattcaagagcattccacttcaaccatcttatcatggtgaagctcagatgtgtctttgtaacactcttttcttccctttggcaactcagtgctattccattattcaaaatatatcagtacctcagaaacaatttgtgtgcagggaacttccgcagcttttaaaaattttgctccagtgtagttagaaatatgacagatttttaagggtaattttaaatagtatgcactttaaaacaaaaatgaattattcacaatcccacatggacatataggtactttggagttcccttttttattatctatttcaatctcagacgctaaagtttagacacaattgttgaaaatgacatagtgatgtattgatctgatgatttcttttatgatatgaaatttgaaatgctacctgttttacattcagaaacttattctatgttctgtttccatttttgttactgttttaagaatcacttgtaagctttaacaataacgttttggactatagtaatgcaattttggcctaatttaattctgtcatttagaacaaaaaaggtaaaaaaattggatagcttttccttctctctccctctcttctctttctcccttcctttcttccttcctccctttctttattttccttttcccttagtattcttcctgtgaataaaataaggtaattaaaatagataattctaacaaatataacatttaggaagatagtaaggcaaaactttacttaaatcttccttattaaaagccacaggtaattactatctaaagatagtttgagacatattttcagggtgagttaaagctaaagacatttgcttgtcaaagatgtataatatgggtttaaaaatgtttttctcctaagtaatcttgagtgtggatcttaatatgggaactttatgctatttggattttatttggacacgtgacatttacaaaagatcattgaggattgcctattaatgggttattattcataatatcggcctctgtgacatgcctaatctagttcaaacaacaagttaatctatgcaaattcctgatgatgaaaacctcaggagctatttagtgcctggcacttaggaaatgtaccttgtgcaatgttaagtatgtctctgtatgtgtagtccactcaactgacccccgaactgtgtacctccccaaggctcttcatttagctgcgtcttgagtgccagatggtttagattggtataataatatgtagtgcattgtgagcattaacacatttacttacgtagcagagctgtttagtagattaatataattatcctcagtttgtagaaggaaaatatgcccagcaacttgtcaaggacaaacaaaaattccartgcttattttagaattagaaattaaattacggtcctgctcttgactttgtagatgctaactatcacctcttttggacttttatatatttatctttcataaaataccctgaggaaaaaaaaatccatttctaagttatgttagtctatcatatccagagattcatttggtattatggaagaacaaaaaataaaatgtgtagtcttgaagggtctttttcatttaaatacacacacacacacacacacacacacatgctgcttattactatgtagacatatacacacatgtattacttaaaactatgcattaattcaaatgcattcatcaaattttagtgtttacattcttggaactttgattactggacactaggctataagaaaatattaattgattctttattggcttttctgaagtaactttacagaagttacttcagcaagctagaaacaacggtatttattatactgtataatgaaccctttaagaatagtcaatgtgtaaatgtcagtgaatgaaaagaacaagaaccaaacagatatacctaagaatcagagcaagattaatctcaaaattccttctgaaaagatgaaaaaccttgacatcttcataaaaacatttaaagactttcatttgaagttgaactcagttaagacaaaagtcttccaatctcccagattttgagagggtgtatttgtgtatgtatgtgattgcagcaccagtgcacatgtaccatttacagcctagcactcacaggacctaatttgtatatttagtatgttttctgtttgatttttgttgtcttaaggtattagattttgtttatcaaaatctttgaataagaaaatctaaaaattgaatttctagaaaactctagttgccttgacaaatgattatggaccaaagaataaattataaatgagacaattataatattccatccagtagctatactgttaaaattccaaggtataatccctttcgagttgcttgtaacttagaaggtcctattctatagaagaaatagagttagtagagtttgctgcatcaaatatattttttcaaatgcctacatattatagttgacacaatttcctggctttattgccttctgtgcaattttcaattattggatgaggctgaaagtttgaaagagaatatgaagcagtgcaattgtcatttcagtgagctacctcatctcattggtttgtcgtggtacatatgtaaaacactgaatataaaacatgaaacatctagtaaggcctcaataaatgttcattttcaaaatgcctcaaaaaatgaattaaacctaacaacctaacatgacwttctctggctgaaagaaacactcttctccaacatcatgtggtataccaaattcagttgagactgtttgtgaaggaaggaatttgcttatatacttaaacacacaagtatttgaattctaattagaatttgtgctgcagtatttctttattctcaactttatagcttagcctacaataaaaactcttatcaatacgtacctctttatacctttagtttccacatacagtactcttctttggaggtaactgaatcgtagaaaacgtatggacttaggagaaggctagactcggatccatagccaagtcaccactttactaagatcaaaagcctgagtcaacggagttaaattttctattcgtaagataggtttaggttagataataaatgtgaaaatacttgccagctaatcagtaaatactagytcttttcttctttattttatgagcataaaactaaaaaaaaagatttgctttgcatatagcatatcctttttgcttaagaacagcaaaatattctaaaaatttctttgaggagaccctaagagactatagatggcaaactatttatctcattgccaagagattgaataattctgtcgaggttacacagcaagtcagtaacagagataagaagaaacacaagttcctataattagctaacagttatgttagtagctctgtgtgagaagtgatttaaaacaggcaacatgatggaaatttttgcaataatttgtagttattcatacttcaaatgtggtacaataaacgttttttctaggaatctcattgttgaatatgtatttattttgttgataaactattttttaaaaacttctttaatacttataatatgtttagataaatatatggcatatagtaagcacttcataaaggttagttattattcttagtctatgaagtatatgttttcattgacatctgcttgggtagagatgacaatgtggcgtgtttgacacacaatgtaagttaatttcagcatggccttcagtggaaagtctaattggattgcagaaaatctctcaatatagattgtctttatttggactctccctaattactatagtaaaaaaaattcttggaatacattatttaatacaactctggatagggaggattcttagtgtgtctacttgtgtattaaatttttagtgtgtctattttgtattaaatctactattaaaaaaaccaccaaaaaacaaaaccaaaaaacctacttcagaaaatcatatagtactctaacaaatctctagagaaaactgcttttctaaacttgggaacgctggattttgaaaatatttcagacaaaacacttcttaaaggcccgtttaccatcaaaaagtttcaatcttgcctaacacataatgtgcaaatattcattttttcattctgatacattagaaaagtcactggatttgtaattggaattccaaaatataaattttccctctagctcttcctaaagagattaccttaaacatggataagtcacttaactattctgaaattcaattttccatctaaaaaatgacaatgtaatgttcgaatctatttcatggggttgttataagggttaaataaggcagaccatacaaataccattattaatactatttgttattataataaatgacagagttggtcttaggcatcattggttatgaagttttgctccaccccctttctttgttttttttccccagtggctcctaaccatttgttattaattaataatgttatgtattaatatacatatatgtattaataatgttgttaataatgttatgtattaatatacttagttctcctgttttcaaggacccatgacacatagctttcaaacatggcacaaattatttgtttagtaaacatatacatactactgcataagaagaaaatatggtatctgaaagtgtacatcagcttcctacaaacaagtagcaaagagtaagtattcagtgaaattataaaactatcataaaaatagcctaagggctctgaaacattctatgtcaagattcctttttatcctcttaaaaataattgaaactttgatttatggtatatctactatttgattgtattaaaattaaaattgggaaatttaaaaatgtttactaattaatttaaaataccagtaataaaacaattacatgttgacaaaaagaacataactttatgaaaaataattttatatccaaaataaaactcttcaatgtctggcttaatagaagagaactggattctcatttctgcctctgcgttcaaattattacatgttattttagtttaaattattttggtttaagcatattaagaaatatataacaacaaacatagataagctattggaaaaaagaggagtctgtcagtgccttttaagatagctgtaaatattctttgattctataccaaaactcagtaagtggtagttttcaaaagattggctgcagtgtggtatctgaaactgcatcaacgatatttttgtacgcttttatattaaaatctacggatctatcttrcacctggaaagaattttacccatgtgtgatgttatagtatcattcatagatcatttggaagatactgatttactagttatgcagatcagccacaacttgacagattttcttataaaatattttaattacattttttatgactattgatctcaccagaaaagtccctaaatattagaagctgttaatctcacaatggtagagacaaatttttcagaatttttattttcatttgtaagttyctgtagttattgacaaattttgttatttttcttgaaatagttactttattcattcttaagaaaatgtttatcaaacaaatgagtcttaaaaaccatagttagatcctttttgtagtacatagggtattccacraaaaaagtggctagtttagcttgcagctgaaaacaactgtacaaatgcttttcctcaaatcaaccatcatgcttcagtatacagttgatgttaaaaagatgtacccaagatttaataaatttaatcattgttactacttcatcaagtacattcatctgtgaaactagttgtttttttcttctgggagtgtgtggtggtgaaaactaaactgaccactagcatggtttagtacccctgccttgatttgtgctaatgtaccatcagtgtttcccaccactattgcttttgcaccatcagtgcacatgtcaacacaatgaaaaggcagataataattaaatcttgttactaaaaggatttttgaacttgtgtacctatggataatgtattgtggactcccagggattcacagatctttctttgagctctacagggttggactacagttaagttcctcactgcctgcctcttcaccaattctacaaaatctatagccatatgaaggtaaattttgcwatcagaaaaagccaaaaccacttcagtttttacctcaggtctagtctaggagagtgataccatttctttttaagggggaagaaatccagaaaagcttcttctgtggaaaaagcaggaagtgttaaaaccagccagacatacatatagaaatcaaaatctctgccatatcatctgcccttcttaatttcctttcacttgcccaaactatagtagagatagtgtacttacccacagttggacatatgatgttattcctaatagacttaaaaagtgaactcatggcggggcgcggtggctcacgcctgtaatcccagcactttgggaggccggggcgggtggatcacgaggtcaggagatcgagaccatcctggctaacatggtgaaaccctgtctctactaaaaaaaaaaaaaaaaaaaaaagcaaaaattagccgggcgtggtggcgggcgcttgtagtgccaggtactctggaggctgaggcaggagaatggcgtgaatccgggaggaggagcttgcagtgagccgagattgcgccactgcactccagcttgggcaacagagcgagactccgtgaactcatgagcaaggtttagtacaaaggaaacatactaatatctgtaattctgaatattagcagaagagatttttattccttgctgagctcctgaactcacatcaggaggggtcctttgttcttttcatagaaagaattcctgttggaagcactggatatcgtatttctcaaaatatggaatttccttcatttatttctagcctttgaagttttgtgatttctaaagcatttaaaaggttttgtaatgttgagaacctaaaacgtgattcttttctctgtgcccatctcataccattgtatgtgtgtcatatgatggatctggtttctttttcttatttgttgggagatgtccagagactcaaggatstatcctttgaccaaatttttcactcttcaagggcctcatactgctctgatttcagatgtatagatatattgcttatcaaacactgatgggtctgarcatgagtggtagtaagatatttccagattaagtagacaaattgtgcagaaytttttagtatcactatttaaatgactaaatttttgaggtttatgtgtatccagcccaatatgtcctctccttatctagtataatttatctttaaaaattagactggcttggcatatgtcagattttgtatttaacagactttttatatatttctttgttaggaggtgttcaatgttagacaaagtgaacagattactttggaatccatgtcctggtcctgctgaataacatgtcctcaccctccttccatttttttttttttctgccatacacattccagtaacactgaaagagttaattgatgtgtcccatctttattgcttttgtaaatagctatagatacactttatatgtagataatggtatgttttaaaattctgcaaaaatagcttttcaattctctttattctctttctcaagctttgataaaatatttttcattcaacttttagggactgattttctccatagagttcctgatgtggtgctactggagtgatgctgagaaaacattattctaaatgttttttagaaacattttttagaaaacatcattcacccagaatctgaaattttatctttatttatttattcctttggataaaacattgccctcacaggctattcttttctaaaatgtttgctgtgctgttattattcactttaatggaaattaatttatctgctgacctcctttttgacagtttaggactgtattaagttttcagatctgctcggtgagaaatagtgaaataaaactagttaacatctatggaatacctaactatgggccagcactgctgtaagcatgtctcatgccttaatttatcaaaggtagatgctattaatctcatttaacagaagagaaaactgaaatgcaaaatgttaagtaactttccaaaagtaaaacaaccagtgaactggtagagaccaagatttggacctaggtagttctactttgtggcccattcacctacccatggcagcgtgtgacctcaaccctgaaagagtacaaattagtaagtaaagggcttcctttagtgacatacttcagaggtgattttatttcccttttttgtgagatttcctatgaaaagattaacaatttaaacaatatttgccatttagattcagcactatgtcctgatatatcagaagagtctatgaactttttttttttaaagactccttggagatagcaatgaatgaattcttaactgtgtcaggcatgcctgaattttttgagtcatataagagtttgtagcactcctagaattgttaacttaattggtaagaatgtgctttttttctctttgttgttgtatgaagtgttaaaccaaaaataatcaaggcccagggcttttcctggtccattaatggatatatgacaagtgatggcaaaaggatagttacagttattaacttaatcattaattggctcagggtatccccaaaaccgyagttggaactgaagtgctacaaaaatgaccattttgttgttatagcttttcttcacataaggaaataaataagcaaaaagagggagtgtcttatctatttgttgatcaaagatcttgtaattctgcttatggtaactcccagagtagagaatatcatccagttggccccctttatgaacttggattgcaatggaagtcctatcggccagtttactagttaacaggagctgtagtactagagctatgactgcatcagaagtccagcagtgtgggcacaaagcagcrcagcacttttgaagttagacatcgagagtttgagtcctagattcacaccttgctggctgagtgctgttgcaatagtgctgttgagtgagttatttaacttctttaaacctgatcatcctcacctttaagagaatgaaaatagtagtgcctttttaaggattaaatggaattaagtatttaatttgtattcagaagaggatggaatcatcattcaaagactttacaatcagtggtgttttcagcatggacaactggagctttaacttaaaagatctagaaactgggcttgttggccacagttttagtgtgattagaggtggtcataggktagtcaargttgccactatcctggttatggatggtaatagaactgcctatttatttgatgtcttcacttagttgtctcctaggtccttcacagcgaacatttgccaggattgaacataggtactctgcatttcctcaactcttttcccatcagcttttcccaactcagaaaatggtaccatcattcaccccttgaatcaaatttgacatctagaagttactattaacttctctctttccttcacctcccagattgaaataatcagcatgtctgtcatccacaccaccagagtttattccataaatatccacatctttttgtccctattgccttctagaccacagcactctttttttgcctatgcaacttcagcagcctcccagctgctctcccttcttttctcttttccattttacaatcaattttccatgcaataggcaaagtgaactctgaaaatagtaaatcagattagatctttcctctgcttaaaacctttcaatgcatttctattataagaataaattctaaattcattagattttaagtctattcatgacagctcttgtatttttctctgatttcaaattattctctttttctgttatttaccagcaacagtaaagactttttttccgtctcaaggcctttgtccttgctgttcctctgtccagagcattgttccattagatccctgatggctgtctccttctcaatattccaatctcatgtcaaatgtcacctcttacagaggcctttccagaggaccactttaaattagcttctgtcaggcactcatctccctgttgtaatttctttgaacaattaaatgtttatcttgaatacccttgtttatttacttttcttctttgttgtttgtctccccagactgttggaatataaattttgttataaaatggccttcatctccagagctgaggagatacataaatattttttattttgaattaacacatggctgtgttcaggctcttctgaatgtaattccatggaggaggtcaaaattggattcctgtatgtagtgaatctgtcccgtttatgattttcagttatataattagttagaagaccaatccaatcatatttcagataaacctcaagagcaattgctatggcagagaactagaagggtatttaatcaactagttccttttccaagatctttagctctttaacagttataaattaataaagtatgttatataatgctaggactttttgtctttcattgtttctgttgctttatctccagcttctagtctgacatatggtaggcactcaaaaattggatgaagaagcagctctttttggacagaccaagagtgttgccttttaaaacattttatgtgtactttttccccctgatccttttatagtatgaatgaatgtttgtataagacataaatttctacaaatactgaaacacagtatggacagatatgagttattattattaatatcacctagataatagataaaatattttagaaagtgaggctaccttaaattatcttgcttcttgagttttttttttcccctctaaggatattccagtaagagttgagcagtatttaagctttggataaggaatgcatatttcttggcttagtcagaacttttctggatggaaggtctttttggatgagaattatactacataagattaaaatgcccatttaagatgtaaattatagggataaaatatagataactcacatggggtgatttgattggcatctgttttcatttttctttgtttctttttagataccaccaaagtccttcctatttcaggcaaaaagatatgttttaaaaaccactcacaaggcctctacaatatgtcagataatgcatgtgcgtgaatgtccttggatgtgtatggtctcttgcttgaagttatcagccagcaaaatggtgaaatacttagaattaatcaaacatctggaggtcaagaaacrcagtacctatattcttctccttactttaagaatgaaactaataaaaaataaggcggagctggcccttcagcaaaggagggatttttattatatgagtgaatttgagagaaagggggacaagaaaagacctttgagatcagggcccaggtctgttttgttactactgtatccttactgcatagcacagtgcctggcacctagcatggtcacagtaaagattgaatgatagaaaaatagaaaaggaagagctaacttttaggaaggaacacttacttcccacttacagttattgaaaaaactatgaagatggttaacatcatgatactgtcggatgtaggcagttacaatttctactcaacgatagaaaaaagaactaaagagaatttaccaggacatgaaagaaaggtgtaagatcatggattcctgaaacaggatgttccaattaaatatttaaatttaagtgaggattgtaggagtttaacagctatttaaaatacgccctgctgctttccttcctaggttctccacaccttcaaagctcatcacttggayaagattgcctctttactttttccaaatcaatctggttcatccattttttgcaaaaatgaaaactcccctctttcactaaggtatttgagccatcaagaacaccctcctgtctaggcatggtggctcacagctataatcccagctctttggaaggccaaggcaggaggatggcttgaggccaggagttcaagaccagcttaggcaaaatagtgagatccctgcctcyacaaaaataaaatgaaaaaattagctgcgtgtggtggcacatgccagtggtcccagctactcaggaggctgagatgggaagattacttgaacccgggaggtcgaggctgcagtgacccatgatcacaccactgcactttagcctgggcaacagagcaagaccytatctaggaacaataaaaaattcattattcattatttgatccaaaacaaaaacatgttatagactatctatagattcaattttcaaaaatcctatgcttctcatctctaaatattgttataatactgcaattttcaaattagctttcacctttaagaaatgctactttccatattggaatgaataattaatatagaaccaaaatgcatgtctgggatttagaaaatcttgggattctgtttccatccttgcttattttttattaagctaagtcattcattttaagaaatgatcccctttaccccaactatagaggtatatactaccttatatactaccatacttaaaaggttagtgaagaggcatagaaagagtagtgaaacagtgaaaccttctagatgccagatgctatacaaatgtgaagcatatgacaccagcatggtgaaaaaggaagctaattaagaccatcagatagtatttgattttatctctccatagaaatcatgataactatgttacatagttactgaaatttagacattaagtttgtggaatctctctgacagttatattagctaatcactaaacagaaattttaaaagaagtatttaatattaattctcaagtcttaggagaatatttagctaataattctacagttgactgsagagtttattcattatttaattcataatgtcttttcaatcactttactgtttcttgattcatgaagaatacatgccaagtgtattagtctgttctcacactgctgtaaagaactggccaagactgggcaatttacaaagaggtttaattgactcagttccacctggctggggaggcctcaggaaacttacaatcatgacagaagggaaagcaaacacattcttcttcatgatgtcaggaaggagaagtgcagagcgaagtgggggaaaagccccttataaaaccatcagacctcatgagactactcactatcctgagaacagcatgggggaatcactctcatgatctaatcaccttccaggaggtccctcccccaacacatggggattacaatttggattacaattcaagatgagattttgtgaggacactgagccagaccatatcactaagagaataaaaatggacacagaatgccactttcctattccctttaaatatttccasttgaaagtatttccatgacctagtgagttcttagagaattcaatcactattgatgtcccaactggtataataaaagaagaaaacacataattttgagacaaattccacctttctcacactctcagcatataaacacataatcgaagcaagaaaaatgagaaaaaatcaaatatataatatgatgaagaattttacactattcattatgacatgtggggccaaagtgacaaaagtaattggacaaaggtagactcagcaatgaggacttggaagaaatgagctttcagtcccattttaaagtagaagagaaggtagggtatcaaaagtagggtgcgctacgcaaagtggagggtgtttttgttgttgttgtttttagagacagggtctccctctgtcacccatctttgcccactgcagccttgaactactgggctcaagtgatcctcctgcctcagtctccctcagtgctgggattacaaatgtgagctacccaacacccaatgttttcttgattgtaaaagaaaattgatggtttctcatgttcaccagagggaaacatccattcattttatcaatgtgtttaaaataattcttactccttctttcactttaaagtgtttaactcatttttgcattctattcataaatatgaccagtcacaacttagaatatgtatactgtattatttcatattaacacacacattttgttcttctataatagatttgtgtatggtttcatatattagagtgttaaatattgaatttattgtaatttacttagtgaaatactgatgttaacatctagtatgtttatttgagggatataggaggcttacagtgaaatcatcctttcaccaagatttctttgtaagacactgttactggaattgtgctttgtgcattacatttcattgacgtaattttaaacttccattctacttcactacaaatggaatttcattatatctgactccacaataagtgggttccagaatcgttgacatttagtagaattacagatcttagtgtctttgtacattctgtattaaaatgcattatgtgtgctttcaattctgttttaaagaaattgccattgatttacatggttgtatggaagagttttgtttaaatgccattgcctgatttcctggtggcttttattttccttctgaaatcayttacaaatatttcttagggtattggctactgttggtttgaaatgagatamaacttatggattataaatatgtttgtgcaaattttctctagcagtaattctaaaacctttgtggacattaagctgtaattgtagctttctcttgcaagcttytttatcctctgctttattattcccttgtaggaaattaagtattttatataataatgcttagaacatctttctcttttaaagagggaaattaagataaagagcttggcaaatataggatctttcctggattgtatgtttctgagatttggtgacagagcgtctgctgtggaggatggggaaggacggatctgggctgaagaagtagacagagacagtggactttggttttaagaggcctgctgctgggatcttctcacccatccctagcagagctcagaagtaggcatccagctgcaggtaattgtgttttgggctcaaaggagcccttagagtgccagacctaaagaggcaactcccgataagagtttcaatagttttatccattctagaaccgccatttccttaagagtctgaggcccagggaccaacgcccaggacatatatacactttgataggaggaacatttcaaattcatccaggtcaagatcactcactaggtcttgtgcacctcctccgcctcttttctgtctggagttagtaaccacctcaaaagacagctttctgactcgtcattataccacctacagtcttacttttagcttggtttgagggtgtcctgttcattacttacagaaacagatttggagtgtgaatgcccttaacaccagttttaataagcatttttaattctacaataatgtgattcagagaatttttttttcctttgtctctatctccctagatagaaatatgtggaggttggatttcctgctgagtttctttatttttttcctttcttttttttttttttttttttaagatggagtctcmccctgttgcccaggctggagtgcaatggcgtgatcttggctcactgcaacctccgcctcccgggttcaagtgattctcctgcctcagcctcctgagtagctgggattacaggcgagcgccaccatgcctggctaatttattcttgtatttttagtagagatggggtttcactatgttggccaggctggtctcgaactcatgaccttgtgatctgcctgccttggcctcccaaagttctgggattacaggtgtgaaccacagtgcccagccttcctgctgagtttcttagcattattgccaggtcggaacttaggcatagtaacatgaaacatgttctgcatctgaaggccagaatataataagcattgttaatttagttaaaggaaaaggctgctgttgaaggttagacttcttgtgtatgtgtgggagataacagaataaygtctcttttccaagatgcatatggttttcttttgcttatgtgccaattttaatcaatggagaaattaatatgttaaatgaaataattaaccattttataattttagtcggatattggttgaccagtacttatatgatggtataaagttctagaaactggataactttaaaaatctttccatataatgcattatattctgggtcatagtttcctatattataactgctaaacaacataaaccaattttattttcaaaatcaatctttggggtaacttctacttagagccctgacctaataaatgatgtacgtgtttatttctgacacgtattttgataatcatttagattagtcttatttatgtggatatgtgtaataaaatttctttggaaaatatggtttattgagtttaaacctcttacctccatttcactttcctaaattttaactatttttttctgttccattgcaggcatagtaccaattctgtgtcaggcattttattcactttgtttcaactgttcttgagatcccggaggattaggactattgcagttataagtctataactgaggaaaggaagcttatctggacaggaagatatttagagtatgatataaagacagtctctttttaaaaacagcattttaaaggtataatttcttttttgtttgtttttttcgtttttttattttttatttttatttttttcttttattattatactttaagttttagggtacrtgtgcacattgtgcaggttagttacatatgtatacatgtgccatgctggtgcgctgcacccactaactcgtcatctagcattaggtatatctcccaatgctatccctccccactccccccaccccacaacagtccccagagtgtgatgttccccttcctgtgtccatgtgatctcattgttcaattcccacctatgattgagaacatgcggtgtttggttttttattcttgtgatagtttgctgagaatgatgatttccaatttcatccatgtccctacaaaggacatgaactcatcattttttatggctgcatagtattccatggtgtatatgtgccacattttcttaatccagtctatcgttgttggacatttgggttggttccaagtctttgctattgtgaatagtgccgcaataaacatatgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgactgccattctractggtgtgagatggtatctcattgtggttttgatttgcatttctctgatggccagtgatgatgagcattttttcatstgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgcacagaagctctttagtttaattagatcccatttgtccattttggcttttgttgccattgcttttggtgttttagacatgaagtccttacccatgcctatgtcctgaatggtactgcctaggttttcttctagggtttttatggttttaggtctaacgtttaagtctttaatccatcttgaattgatttttgtataaggtgtaaggaagggatccagtttcagctttctacatatggctagccagtttccccagcaccatttattaaatagggaatcctttccccattgcttgtttttctcaggtttgtcaaagatcagatagttgtagatatgcagtgttatttctgagggctctgttctgttccattgatctatatctctgttttggtaccagtaccatgctgttttggttactgtagacttgtagtatagtttgaagtcaggtagtgtgatgcctccagctttgttcttttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctgtttgtctgttgttggtgtataagaatgcttgtgatttttgcacattgattttgtatcctgagactttgctgaagttgcttatcagcttaaggagattttggactgagacaatggggttttctagatatacaatcatgtcgtctgcaaagagggacaatttgacttcctcttttcctaattgaataccctttatttccttctcctgcctaattgccctggccagaacttccaacactatattgaataggagtggtgagagagggcatccctgtcttgtgccagttttcaaagggaatgcttccagtttttgccaattcagtatgatattygctgtgggtttgtcatagatagctcttattattttgaaatatgtcccatcaatacctaatttattgagagtttttagcatgaagtgtggttgaattttgtcaacggccttttctgcatctattgagataatcatgtggtttttgtctttggccctgtttatatgctggattacatttactgatttgcgtatattgaaccagccttgcatcccagggatgaagcccacttgatcatggtggataagctttttgatgtgctgctggatttgttttgccagtattttattgakgatttttgcatcaatgttcatcaaggatattggtctaaaattctcttttttggttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgtcacaatttcagatcctgttatttmtctattcagagattcaacttcttcctggtttagtcttgggagagtgtatgtgtcgaggaatttatccatttcttctagattttctagtttatttgygtagaggtgtttatagtattctctgatggtagtttgtatttctgtgggatcggtggtgatatcccctttatcattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtrtttgctcttgcttttctagttcttttaattgtgatgttagggtgtcaattttggatctttcctgctgtctcttgtgggcatttagtgctataaatttccctctacacactgctttgaatgtgtcccagagattctggtatgttgtgtctttgttcttgtyggtttcaaagaacatctttatttctgccttcatttcgttatgtacccagtagtcattcaggagcaggttgttcagtttccatgtagttgagcagttttgagtgagattcttaatcctgagttctagtttgattgcactgtggtctgagagatagtttgttataatttctgttcttttacatttgctgaggagagctttacttccawgtatgtggtcaattttggaataggtgtggtgtggtgctgaaaaaaatgtrtattctgttgatttggggtggagagttctgtagatgtctatcaggtccgcttggtgcmgagctgagttcaattcctgggtatccttgttgactttctgtctcgttgatctgtctagtgttgacagtggggtattaaagtctcccattattaatgtgtgggagtctaagtctctttgtaggtcactcaggacttgctttatgaatctgggtgctcctgtgttgggtgcgtatatatttaggwtagttagctcttcttgttgaattgatccctttaccattatgtaatggccttctttgtctcttttgatctttgttggtttaaaatctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcatgatgatgttagctggttattttgctcgttagttgatgcagtttcttcctagtctcgatggtctttacattttggcatgattttgcagtggcttgtactggttgttcctttccrtgtttagtgcttccttcaggagctcttttagggcaggcctggtggtgacaaaatctctcagcatttgcttgtctgtaaagtattttatttctccttcgcttatgaagcttagtttggctggatatgaaattctgggttgaaaattcttttctttaagaatgttgaatattggcccccactctcttctggcttgtagggtttctgccgagagatctgctgttagtctgatgggcttcccttccagggtaacccgtgctttctctctggctgcccttaacattttttccttcatttcaactttrgtgaatctgacaattatgtgtcttggagttgcttttctcgagaagtatctttgtggcsttctctgtatttcctgaatctgaacgttggcctgccttgctagattggggaagttctcctggataatatcctgcmrwgtgttttccaacttggtttcattctccccgtcactttcaggtacaccaatcagacgtggatttggtcttttcacatagtcccatatttcttggaggctttgctcatttctttttattcttttttctctaaacttcccttcttgcttcatttcattcatttcgtcttccattgctgataccctttcttccagttgatcgcatcggctcctgaggcttctgcattcttcacgtagttctcgagccttggttttcagctccatcagctcctttaagcatttctctgtattggttattctagttatacattcttctaaatttttttcaaagttttcaacttctttgcctttggtttgaatgtcctcccgtagctcagagtaatttgatcatctgaagccttcttctctcagctcgtcaaagtcgttctccgtctagcttcgttctgttgttggtgaggaactgcgttcctttggaggaggagaggcgctctgctttttagagtttccagtttttctgttctgttttttccccatctttgtggttttatctacttttggtctttgatgatggtgatgtacagatgggttcttggtgtggatgtcctttctgtttattagttttccttctaacagacaggaccctcaactgcaggtctgttggagtaccctgccatgtgaggtgtcagtgtgcccctgctggggggtgcctcccagttaggctgctcgggggtcaggggtcagggacccacttgaggaggcagtctgcccgttcttagatctccagctgcgtactgggagaaccactgctctcttcaaagctgtcagacagggacatttaagtctgcagaggttactgctgtctttttgtttgtctgtgccctgcccccagaggtggagcctacaaaggcaggcaggcctccttgagctgtggtgggctacacccagttcgagcttcccggctgctttgtttacctaatcaagcctgggcaatggcagacgcccctcccccagcctcgctgccgccttgcagtttgatctcagactgctgtgctagcaatcagtgagactccgtgggcgtagtaccttcccagccaggtgcaggatataatctcgtggttcgccgttttttaagcccgtcggaaaggcgcagtattcgggtgggagtgaccagattttccaggtgccgcccatcacccctttctttgactaggaaagggaactccctgaccccttgcgcttcccgagtgaggcaatgcctcaccctgcttcggctcacgcacggtgcgtgcacccactgacctgcgcccactgtctggcattccttagtgagatgaacccggtacctcagatggaaaagcagaaatcacctgtcttctgcgtcgctcacgctgggagctgtagaccggagctgttcctattcggccatcttggctcctcccctaaaggtataatttctataaaataaagtttttttacacataagaaatgtatgtgacatttgacaaatatatatatacccatataaccgtcagcccaacaacaacaaaaaatagaacatttctcctttcccagaaggccctcactgtttttttgctgtcttcttccacagccctgaaactcttatctgattagtttcatctgtcttagaatttcctttatatgaaacaccaactaagtacttttttctgtctgccttctttcacccagtctactgtctgtaaaaatcattcatgtttttgcatccatcaatattttgctccttttaatcgctaacattttccgttgaatgaatgtacctccatttttattttattggcctgttgatgacattaagactgtttccagtttttaattatcatgaataaagttgctatatacaagtcatgtacaagcttttttatggacatatgttttcatttgtcatgtttatctgggagtaaaattcctgggttgcatggaaaaaatgttcgtttaattttataatagacaaattgttttctaaatgaaggcatgatcttagtctagtaatgtttatttacttctatcaacatatgtgtttggtaagttaattttttggataatgaatgataccgtaatggatatttttttctcactacttcttcctttctccctctttttacacaattaaaaaactaaagataaaagttggctctatagggaaagrttttattttttacrtttctggcaaatttgagatttctataaaattcttcataggtatataaaacagagtaagtatattttgtttaacttttaaagcagggtattattcatttgttagttgtttaaaatctactataattatgggtaaggcagtgatacaaaaggaagaaaagaaaaatcccaatttattcattaaataagaatgtgtcaatgcattttgaatgagaagtcattttaaactccaaatacaaagatgagcaagacgattttttaacctcaggaatggcatagtagggaaaaaagtaagtgtatgtatatcattagattcatacagtcaggctgaatgtggaaagggctttaagaaagttattaaaattgtttttacattctggggaagtagaaacatttccatctaacaggaacagggcagtttcacagaggagttggaatttggactgagttttgaacagaagagaatttcgatgggcagatcaggaaaagagcagttcaggaggagggaatggtggactgtggagcatgggcgaccagaaaggcagattaagttaaaacagggttgacaaattgggagaacacaggattaagggactggaatttaagtttagatttgctttaataaagaaaaatgttactttgtgatgagagaaaataagctaaaaattaaaaatttaaaaaccaatccactctgagagattaattaaagtgaagatggggtctgctaatgtgttactgaagtgaactgcagagtacagtcactggcattgatgagtctagatgctgtgagaaagatcattagcgcattgacaattctaagtagctggagaccttttaaactttcaacttccatatttttagtaatttttcaaatgtgattaatttagcccatgaaaacacaccccatcattgatataaccaatcattataattatttattcgactggtgtactttgtctctaaatgacacatttctatgaaaaaaagatcagtttcactaactcctcaggcttctggctgtgacttttcataaatgtctgtatgaacgtaagctataactttgcttcattgttgtttagatgacattaataattggttttacttactgactatgggcattttaatacaagattccattttaaaagtgtgtacttgtagcttattgcaacacagtgaccaaagacaccatattcttacttctggaatcaatttgtgggcattgttaacagtatcttcacaactgcactagtcaagcaatcagagctaagctttcaaagcagattagaggaagcttattagcaataaaatatagtcaaaatataccaggcataatcatatttttatgtagtggaattacctcagcacatggagaatctaaattaaatgagtttataattgaggtttgtgtgcaagggaaaagaaaattcgtctgttatggaaacgctctatattttttacattatagccaaagtcttagttaccttttgagggtatctgtaggtgccattaaattcagctatcctcttctgctgtgggtataagcacatggcaaacccaggcaaaaattagaaaaataaaaaggattgtagagaaatggagatataaaaaattaataagagaagaggcaagctaactcccttatccatttttttcctcaaggttattaacagaaattatttccaacataaatgtccataaataattttgaaaatctagaaagaaattgcatttctactttaaaaatagctttctatggctgaaggtttgcttcagttgttttactgtcacaactcccaaaaaccagctggttctgggatgtcgtaacaatttgatacttcaaaccaatggtttgtgctcattggctccctggtgcaaacagggagataaatgctacttaaatagtaggtgaatgtaattttgcactttagaaaatgtctgcatgtttattagagaagtgaatgctgaaatcagcgaacaaaatgtaaagtgagcaactaagaaatacttataagrgctcacttgtattatttaactgtgtaatcctctatctcatatatatgtaatactttcttcaagttcattatagctcccgggcccagtacatcctagtccagttccaaccatgtctaattttaaaatagctatgctcacttcaaacgaagatgttgctatagctttattttattttataggcttcaattttaaagttgtatcacctatagataacaaagacagctttcatggacacctcaatttagaagagtcttataggcactttgtgagataaactgtaagtgtatgtgctaatcagataattcttttactagagactttaggtgaagatagcaaatcttctaaaacagactgataattaaactgggttgatcattattgggttcattattatcaaattgaaatatgctttattttgtaatgtttaaaatgtgttcttaaattcagtagaatattaatattatattatacttttccatttttaaatcatattaaaaatagcaaaaatattacttcttcaaaaatgctttatacttcatgtatattactgattttaagtaaaagtacaattaagacaattagccagwcctatttatgagtagctctaattggagcagcttgttgctggaccctattcagtggtagagataaggttgagatggctgaatagttcatctaatttgaaatactttggtgtcacatggaccttttcctgaataccatggctatgtactcactatttggccaaatgctgaaaatgaacatatatttgcctccgtcaaaatgttttgtaaatgttcactcagacattgacataaacaaggcagaaaggttaatggataaaaaattctttttctttaaaaaaatacatacacatacgaattttctctcttttagttgctaacctgctttttagattagtccatggttatcttggaagaggtgtgggagaacaaggtgagagctaaggaaggaattctatgcaaagcgtttctgattctcttagtattttgtggaacagcatgagacatgtcttccagttgtgtaggataagtacagcccactgaacactgcttaccagcagtttaccacaagccagttataacatcaaaaacatcggaaccctttcttttcttctatatttgaataatgataaatgccttcatgctgtgtgagcactattgaagtgtgtttctctgcaggtaaacttggcagtgtcttatataactacactcgatgggagtattacttaaacagtgtgaaatacattgtctgataaaaattgtatcacaatttggaatgacgtttatgcaagtggatagtctgccagttattttatagtctaaaaaaatgaacctgtaaggctacagtataaaatccaagtctttatagttgtatatttgtagtgaaaacaaccgtgggggaataatataagcttaatcatttggtgattagtctaccaactattaatgatgagagataacctatctgttctttatttctaaaataagatgtgtaatacagctaattagtcactattttaaaaggaatttaaatatagttttcattgaaattcaaatatttaattgcatgtgtacctaatgcctaattatttacatgttggctgatgttctctattatctaactgctgtgctgttcttaattgctgctagttcatctccgcccatctcccttggtgatgatagtcctgcatttcatggcaattttcaatagcagtttaatggtcttaagtgggtagcataatagccaggtgaacaacaaaaaaaacaaaaacaaaamcaaaaaaactatttggcaaattgggatatgagaattgaggccaaaacttttagtccttgccaattttttttaaaacttcaattatcttgattcatattcccatttgttgggttggtaggcactccaaaataaatataataatcagagagaacaccaactgtaggtactagttttagcaactgaaacaactggcgttaaaatcactgagcttctgttacatgaatacctgagtattatgtggctacttctgaaatggagtatgcagtgctcttataattgggcatttcagttgaacactgcttcagtaaagtaactggcatttcaagtcttccttctgtagtgattgctttgtctttattcaatgattgcttttttaagttagaatctggttgcatagtgctccatggttctttcctatgcagtggtgtttctcagtgttgatgtggagaagccaggagacatcctacaactctgagaagcatttgatgttggcagcagtggctgtgaggttagcccatgaacttagggctagaggtgagtcttaaccttccaattcagcatcttttccatctgaacattcaagtcaaatgggaaacctgttggccctccagctggatctttccactgttttaactggaatgaattggataagttataaggcagatggtaagattggatctgatgggatggagtttggtgaagtggaaacttttaagcattaggtttgagatagctagggagtgttgacctctctttccccctgacattatcctcacatttgtttttattccaccatatctaccttgatccacctgattcttttcatttttttctttcattctctttgtgctggctttctttccttttttaaaatcccatggtatctcatcatctcttcttgtcctcccattctacaaatagaacatgaaattgaagccttttttwaaaaaaaaaaaactaattacagaattaatatatgtttactatgtacttactacaattagaaactatatataaacaaaaaagagagcttgcccatcaatccacatgcaaaattggttgagtaccttgaagatttgtaatagtatatagagaagaacattatttttcttaactatttaaaagtgtattctgcattctcaattaaaagtcattttatcttttactttttcttttattcctttttaagcaacaaatgaattaaatttcctttgttttatatatgrcctattaacctcaatggagaaagaggctccctttgtttgcttcaggacttacatattgttacagttagtccttaggtaaatgaaatgagaagagcttcacatcagcactagttcttccccatggaattttagtttctccacaaccactttactgaatgtgtataattataagaattatttcattttcttacaactttttctctttattttatactctcaccctattatctgtcctttttcttttttttttctttctttctttctttctttctttctttctttttttttttttttttgagacaggctcttactccgttgcccaggctgaagtgcagtggcaggatcatggcttattgtgcccttgacatctcagtttcaagtgatmctcccacttcagcctcttcactagctgggactacaggctcttgccaccccacctggctaatttttctattttttttgtaaagatggtaytttgccatgttgctcagactgaactcctgggctcaaacaatcctccccacctcggcctcccatagtgctaggattataggcatgagccactgcacctggyttttatattcttaatatttcttgtttcttctatttattttctttactttaaactcgttgttataaagtggtatgggttaatcaagagtgatggaaagattagctctgtttttctgtgtgtgagtgaaagatttagaagtaagaaaatataattattcttcttcccaaagtaatgatgtttaccaaaacactggtaacattactttaaatttcctaaatttataattcaatttagtaaagtaggacttctgaaatggatttttagatatattggggaaaaacaattcaggatctaaggtaaactttttaggatgtatatatatttgcatgccattcatggttgtgtttatctgaaaacctaatacatttttatcataaaaatctacataattctaaatcatctcaagtgaaattagaattaatataaagaaataaacaaatattggaagttaaaattttcagatttattaggtgttaaactgaatttttcgtcttctactcctatcctcccgtaaacactatctagaaaattgtcacccaacctattgtagaactaaaaacctagtggtcttcctcatcttcattgtcttcattatytccactacacgaaacattcccttgtaacaaatataatattcacagcattgtgcaaaaaatgtacattttaaatttctagtataaaatttgatttgtgactctgagcccccagtttccttagggcaaacaatatgggtgctttcagttaattttagtccaatccagtaatttttcagttacttttccatttaaaacaagtagttcgaggttcagccttctgatcattttcctgatatggaatctgggagcagcagggaacataagtaatgtcacggtgtcaggattgggaggtgtgcattttggatcctgattaaatgtatcaacgtaggtaatatattgtgattgtttcaaatagtggagatcaggaatccttcctggtacaaattcagttccccacagtaacctcaaaattgacttcaaacctactgacttcaaatctgactcatgatgtttctcctctcccatcacttttcactgtgttctgctgatctccatactgtttcctcaatgatgggcccaaaaaatgctggaagktttcttctatttctctctttgagaatcatgaggcactcattgggattgtggttcttggattgtttccctctttgtatgtatttatgtatgagccatatacaatcaactgttctctcaatatcaagaggtagcaattttaaatgttctgtgttttaaactttaatgtataacttacgtcagtcaatcctgataataccactattctyactagtcatcaacatcattatcatcattgtcatcatcatgtaacaattatataatggttaatattggccacaaatcaatcctagttccttaaaatctattagttgagccttatgaaactgccctttttgtcggttcaaatggtgagtagaagcaatttcatatggttcaacttattattacttcaatttccttacaggcttacagccaacacagtgattcaggccaccatcatctcacaactagaaatcatcactgtggccttctaatggatattcttgcttgcaatttagccctcccccatttgtttgttgtacttcagctaggttaagctttataaaacacaatagtattgagctattcctctctctaaaatgctgtcatggcatctgattgaccttagtataaaatccaagctctgttaatgtgatttataagtcatgtagccgtacatcccagttagtctctgacagccctggtttacaactgctgccccagcctaattaatagtggtgttccctttattctcagaagtggactggtttagatgatgaattacatgaccaccttatttataatgtacctcatgctctgccctgtgcagttctctccagcctcatctctcaccactttttaaatcataaaaatgagctgtatccattctgaattcctttggatttatggaatatatcactgtctctttcagttcaaagcctgtgcccataatgttgtcactgcctaaaatatctctctgttaacctgactaatgcataccaattttcatgctcatttttcttttcttttttttttttttgacggagtcctgctctgtcacccaggctggagtgcagtgctgcgatctcagctcactgcaacctccacctcccgggttcaagcgattctccttcctcagcctctagagtagctgggactacaggcgtgtgccaccacgcccagctaatttttgtatttttagtagagacaggatttcaccatgttggccatgttggtctcgatctctcgacctcgcaattcgcccgcctcrggctcccaaagtgctgggattacaggcgtgagccaccgtgccggtccctcatgctccatttttatagtttctccaagaagcactttctgacctctagactagtttgaattttcctatttctgtacccatattggctctattcttcccctaatcaaacccttttcccaattaaccatgtttatatcctagtttatgtgcttccttttagcatgtaccattgtttctctagggccttataagtatttgttatacagacattacatatatatatatattatatatacatgtgtgtatatatatgcatatatatgcacacatgtatatgagagtatgtgtgtgcacatgttgaacaaattcatgagacaaaatacaactttaggttgcttttggactttgacatctgctcttgactttttatgttgagaaagggatgttgagagtatgaagcactatagcaagggagaagaaaagaaagagagaccagaaaagggctgattattgaatatcaagaaaggaacacatagaaaacaagtaagaggctttgaactgacaatttggatggacaactacattccatttctgatcatcgatcctgtctttgcactattgcttgcacttatcttagcaggggcacttaaaaagcctgaaacgcgtatcttgcctgcaatgtacaaacttatcagaacatctcatatagtaacataattttcagtataagtatagataggaattacgtttaaatttgagtaagtattggactaagattatctctccttttttaaaagttggtaagttatgttaaacaaaaacaaaacaatttctaaaatgatgactaaaagtaagggttgtttaaatccattttataagatttacttccagaagatgaaagtgggaagctgaagtggcatatcatttctaagctatttttgtaggttgaattgcatccttcaaaaagaaatgttgaagtcttaaccccaggtaactatgaatgtgaccttatttgcaaatagggtctttgcaaatataattaagttaaggtgatgtcatactggtttagggtggaccctgatccaatatgactggtatcatagaagaggggaggagatacagaaatacagggagaaagctgtgtaaagatggaggcagagatgggagtggtgcatccacaagccaagcaatgccaaggaaagaagcatggacattttttcttactgtgtctagaaggaaccaactaggctgacattttggtttcagagttacagcctcctgaactgtgaaatgaatgtctgttttttttttttttttattattattatactttaagttttagggtacatgtgcacaatgtgccgattagttacatatgtatacatgtgtcatgcttgtgcgctgcacccactaactcgtcatctagcattaggtatatctcccaatgctatcccttccccctccccccaccccacaacagtccccagagtgtgatgttccccttcctgtgtccatgtgttctcattgttcaattcccacctatgagtgagaatatgcggtgtttggttttttgtccttgtgatagtttactgagaatgatgatttccagtttcatccatggccctacaaagcacatgaactcatcattttttatggctgcatagtattccatggtgtatatgtgccacattttcttaatctagtctatctttgttggacatttgggttggttccaagtctttgctattgtgaaaaatgccacaataaacatacgtgtgtatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcccctgttgtttcctgactttttaatgattgccattctaactggtgtgagatggtatctcattgtggttttgatttgcatttctctgatggccagtgatggtgagcattttttcatgtgtcttttggctgcataaatgtcttcttttgagaagtgtctgttcatgtccttcgcccacttkttgatggggttgtttgtttttttcttgtaaatttgtttgagttcattgtagattctggatattagccctttgtcagatgagcaggttgcgaaaattttctcccattttgtcggttgcctgttcactctgatggtagtttcttttgctgtgcagaagctctttagtttaattagatcccatttgtccattttggcttttgttgccattgcttttggtgttttagacatgaagtctttgcccatgcctatgtcctgaatggtaatgcctaggttttcttctagtgtttttatggttttaggtctaacgtttaattctttaatccatcttgaattgatttttgtataaggtgtaaggaagggatccagttttagctttctacatatggctagccagttttcccagcaccatttattaaatagggaatcctttccgcattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaactctgtgaagaaagtcattggtagcttgatgggaatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttagaatgtctgttgttttaagtcacctagtttgtggtcatttattatggcagtcctagaaaactaagatacctaaattaggaaacaaatataactatattaaaaggggatagtatatccaatatatttaatacagaaaggatgaagatatagatagtagaatgatcagaggaataataatttttttcccactgttctcaatatcactgctaattcctataagaacacaattactcaatcactaatctgctgtagtagtctgattgatgctaagccatgctgcaggaatgaataaacccccaaatcttaaaatcttagcattatagaggtttatttctcaatgatgcaatgacaaatacaggtccatctggtgactcagggtcccagttgtcctycgcttatgatgtttccaactcaggaaatgccttttatggttgctatggcagaggaagagaggagtggggagctggcacctaggtcttcagtgcttcagctaggaagtcatagtcatgactctgctccacatttttacaatctaagaatagtcagatgcccctcttaactgcaaggggctgagaagtgtagggaacacaagaatattttttgagagctmctatctctgcttacatataatggcagaagaaatatcctcctaaatctattaaaatcatactatgctctcaaagattctagctgctcccttaatttgatattttatccctgctataatttttacaagcttcttttcatatatatatacacacacacacatatgtatttatgtgtgatgtatgtatacatagctattacccaagtctttccattaacatggtgttatatttgtccttaccagaactactgactgctaacaacataaaactcttttccatccaaaatcattcctatttaaacatttattagtgttcaattctaataccattcaactgctcataaaggagaaagaggaagagaaggaagaggaggagaaattttccaggtaagtttatagagtaaaggaaacaacctgccattttgattgttttgagtatcaattaaattatcagttaataattcaagaaaatatatcccaggaaaaaaaaatcccctgtataataaactaaagcttttttaacatccttcttaatccctcatatgaaaaatttatactcccctcttagatattaataaaagctcaatgtacaggtagctagggtgccccccgtcttccctgctggatttgtaggtcctgctcatgcagaggggttatttcccagcatgtggatgctctatttgactccactgtaggccaaccaccccttctcatcaatcatgttgcaattattttttacacaattacgtcttcttttagagaagagaattatttaaccagaaataacatcaacaagccttttacagaatatacatgcttaagtttcacaccatattgttgagatattttaagtgtttaaaaaatagtatgtgaatatatttcggttgtaaaaaattcaaaggaagctttatacccattaggatggctgccataattttaaaaatggaaggtagaaattggtgaggatgtgaaggaattagaagccttatgcattgttgatgggaatataaaatggtgtgacaatcatggaaaacagtatggagggtcctcaaaacattacaaatagaattacaataggatccaacaattccacttctgggaatatgccccaaataattaaaagcagggtcctgaaaagatatttatacatctctgtcatagtagcattatttacaatggccaaaaggtgggagaaacctggctgttgacagacgaatagataaataaaatgttgtgcatgtatacgatggaacattattccgtctgtaaaagagaggaaattctgacacatgctaccatatgaatggaccttgaggacattctgctaagtgaaatataccagtcacaaaaagacaaatgctgttatgattctacttacctagagtagtcagaatcatagagacagaaagtataatggtgattactagcggctgcagggagagaggaatagggagttattatttaatgagtaccgagtttcagttttgcaagatgaaaagcattctggatgtgaatggtgttgatggttgcacaacaatgtgaaggtactaatactactgaactgtatacttaaaaatggttacaatgatgaattttatgttatgtgtattttacaatactttaaaataattcaaaagtaacatcctcactcccagtgctctatacagagaaaaccaatgtctttattctttagttctgcgtttacatagacacaaattctcacatagcaatatatggtttattctttgattcatttttttttcacataaatgctatcttaatgcatatcttgttctgcatgttcaacaatgtctcagtcttgccatgagaaacggagcagggaaacttcctgggcctaaactgaataggccattttattctcttctctgccacattctttgtggttctgtctccactggactgggactctccattggtcctttaccaatgagccattctattctcatgaaatattcatgagaatgtttcaccagatctaggatttctacatattacttctaacatttccatatttctttgcctaaaattttccattctatttgaaagttgtgtgccttttttctttttctttttatcacctacatggggaggtagagtgttggctttcaaaggtgaaattgcatctttccacaactctgagttttctgagttttgagtctgttcttgacttcttttaaaaaaaaactctttggtcatggtggcaatagaggttagagtatgaataccaactcctctcgtttaggcctctgttctttagatatggtcattttaccgcttcaaggatcagaacatatcatatcccaaatttataatccccagaggtaactcagatatgtataattctttaataacaatctgatttgttctcaatatttaaagtgaacccaagatgaagagttggaaaggaaatttttaaaactctaatgctttagtaggctctcaaactgctgacagctcaagtgttctgtctctttggcaacatataaaaatccagaataacagttaaatattccacagctaactattatttaatactaatattatgtcttggttaatggaagacaccatagaccacattttgaatatttgtgctyctttttaatattggtaatcctccttctgagataaattcaggaaatctgacctttctcctcagcccttttgaaataaagaccacttttccaattaggaatatctaatgtagtgttaaagctcagagttgaaaagatgttttagtattcatcagatataacgttgtagtattattggtaacattgtgaaacaaattccagtacacttcagctctgctaacaaagatgaaatagagaataaagtaggtgtatgctgaatcttattaaggttgacatccagtttgaatacattcatcctctaaggtatagttttgggtataaaccatygagcaagcacaaaacagtgaagctgagagctgcagaacatagagatctggtggattctaaaggactgagaatgatcgatggctactgaaatgaagtgtgaaatggtatccatagctgatatttgtctttaactgataaaatggctaaagcatttcctggtcaacacaccactctccctcctctcttctcattcctctagaacagtggccttcaaactcttttcttgataacaaatgcacttaaattggagaatatctctctttctaacacacacataacaaaaatgtcatgagatgtcttaaatacttagacattttacattcagtgtactccaatatttctattttatattcttttttaaatactggttttgacctattaaatggacttcaagaaatttttcagtctcatctaggcacacagatttaaatattacttctatgttagtgacctcttctgtgagtaagctccgtctctaactttctatctcctttggatatccttattcgcatattccttccagaacgtacaacttaacgtggcttaaacttaacagctaaacattctccctctgaagtatcccattctttccacagtcctcacccacctccatcaagttattttcctcctgtttccaaatttctgctgagggtcccatcagtcttccaggtgtaaaccattagattcctactagatccctatctttcttcccgttactatatcagtgagcaaggtcttgattctatttcrttttttgtcacaattaattattattaatagaaaataaacacttattccagtttcaaagttgttataattgaagttgctaattttaaaaaatgaattttaaataatcacttaataatccttctttgactaagacaatgaaatgtggctttaaaaaaagtaatcagcaccatttgcttataggtctttcagaatttgttcttaaagtttctggaactttcctctctgtaaagtacaggaaatactgagctacactggaaagcctctctgggacaggcaatggggagttaagcagtcatcataaaggaatcaatgtacattcagcatagtgacttggactacacaacaattccttctcctctacggtagctcaagagagacatgcttctaagcacagaggtatgagaagtctcagactgttatttgctgttagaattggtctccccatctaataacagtaaatctctggcacagatgctattggtccttaatgtcctgtgattttaggaaatagtttggatttagtttaatttattcagaaatcaaacatgtttaattaggttcactgctctggcagagtaagggtatgctggtttagtatctttataatatatatataatgagtaggtaaatcatagtcttaaatcatacttagaatactatattatttaaaccaatatctatttcaacaaaatgtttataaataaaaacagctgatgaaactaaatccaaaggtatgacaaagacgactcagctctatgttgcttaaagaactttaaaaagcatgtgcccataaagccgttcaaggagagggaaggaggtccccttctccttattcttacgatagaattcctattggggctgtgccagaaatgagcacttctaagtatttcagagaagtccaaagtgttaaaaagtcttttatgcaaaagaacgtctttctgaatcagtgaatagtaatgctcatcagaattttctaataacacaaaaacaaagccaagtccatacatttgatcagttgtcaaagtaatgggaggtggactattatgtcaaccttagtcagagctcctgctggcttctttgtatacactgttcaccaatttgagtaaagtggactttgtgagagaatagtgtttgatggccaggacctcttttgggcatttcttcctaagtggaatacacaacagataagggagtagaggaggtaatacagggaagctactcattccagctcagaaggagcagaaggagttagatgaagcccatatatgcattcaagaagccaatggtatcctctagctgtggatagtggctaatgtggtcatccagaatccacactgtggaccgcagcagcgttttcccgtacagatccaaaaactctggatagggatttacaggatccaatggccggtagataaaatgaatggggatagttacagaggcaagagctcccacccagcgccttctgagcttcttcctctgattgatgtactgtaagagaccgtcaatggctaagttcccgtcaytgatgcggatccctgcccacatgtcccacagctcactctcacagagccaagtacacggcccaaagactggggtgagacctcgagagaatacaaagaagttcatcagtcatgtgaggatgagtgatagcacacctccatctttgagtagcttttggagaaggagtggacggtgagtctcaggaaagatacctccatttgacagacagactctttatggtatgccgaccagatcgattctgcttgtacctgtagagaaactcctgagcgacaattatctccatagtcatgagacttgatcctgcagttctggagccccagatgccgcaaaagcgcttccacgatgctgacctgctcaaatatggaatagtgatgcggtctcggtttgtcactgaagccaacgccaagaaatcaagggcaatcacccgatgaaacctcaaggtcagaccttcccaattcttgtaccaatcgtagctggatattggaaaacgtgtaaaaccacaactgtctcctgacttccaaccacacccacagagtcttggtagaagatacgcagtcccttgtaagtgaaaaacttgcctgaagacttccacgagtgaagatcaggtgacagctgagtgtatgggatgtgcaggtacgcagcaagcaggagcgcggcccacagccccacctggacccaccactccctcatcctgcggaggcgatctttgcgcacggcggcgttatcccacgctgccagcctcggcgttgcagagcacggggcgccgtggcgcccgcagccctgcagggccggccggcagcggggtctcaatcagcagcccacagcccgcacagggcggcgccgcgcccggcagctacagccactctgacgtgcacggcggcactgcgtttgctaggcgcgactgccacaagggaagtgcccgggtgtgctggttgccgtggcctctatttctaaagtatttcttatattttcctatttcttttcattcctactgcttacaccctcattgactgaactattgcaaccgcctcttgaggtgactgaaatattcatagatattgcagttattctccttttgggcatatagtaggattacatttgctcacccctgaaattaggcatagacaccgtcaatgaaatgtgaacagaactgacwtgctttactcttagattgaatacgagttttacaagccagtgcataattcgccatgctatagagacagatgatcttccagatggatgcctgagtgtagaatatatagatcagttccccccacccttcacacatgggcccaaaatgtacacggagcaggagcaagaaatacacgtccttgctatctttgttagtttaatccacagagactttggagtctgcagttatacagcatcctagcctgtcctgactgatatgatcccttaactgatttttctactcaaagtctcttctccctccgattattctacatcactatcatattaatctttctgaaatagaactctaattatataaattccttatgaaaatctttgaatatttccctgttatcttcactggctttcaagaccatcacagtgtgcatctcaacttccttttaaaacacccacggtttccctacgtgtacacacacactttctaacacgttcgcttttctgttcctatgattctaagatgctctctgctagtcctgtctaagtgctacctattcttaagtaacagttcaaatgccagtatctctatgaggctttttctggatctctgcaaaaaaaaagggacaagaaacaccttcctcccaaaggaacaaagaatggcaattacttataagtaagccagattttagcaattggaccatttttgtcttaaatataactaacctgtctctatagcttacaaggtattcataaattcttcaaacaaaagaaatttatcataaaggatacaggtaaaagttctgtgaaattgtttaaaaaataactaaataaatgaattcccaaatgattttgagtctttattgtagttcttatcactctttgcagtggccatttctagcacttttcaggcaataaatggtcttctttcacttccatattattgaaaattcttttgcataatgcctagcaaatatcttaatgttgaatatctgaatgaatgaatgaatgaatgaacgaatgaaattaaggttgcattttattttaaaactaccgtttttttcttcagaaatcacaacgaggcaaatgttgccaataaaatagttattaagttaaaaaacataaatatctgagaaatgaactgagaaaaggagaaatccttacaggacatgaatggtacaggagaatagtacatatcaaagggtgaactctgggtcacagcttgtgggatcaggcaagaacatgtctagtcatagtctttcaaataatcttattaaaaattattttttctaagatccacttttactcttttctctgactaattttatttagctttcaagcatttctttgtggcttcagttttgacttcagtttttaaacaatttaaacaaataaaaattacattacagrattgttacttttaaactcttactttccacggggactgttattgtaaaatctgttcttattcttttaatttaactccattattttgttttaaatgtaatgattgttcattatatttttytccaactgctttaaaagcaccaatccttctttgctgtatatgtatcaaagtccataaatattctttgacattatcctagccttgaataataaaaggaaaaaaacctctcacaactttttattctacaaaataatattaaaatatgcccctatttttactgtaaatgtaatcttcacagcaacagtcaagagaacaagactgagtcattcttcatcacacattgcaagggctatgtctcctctgttgtgaggagaatattgccctgcagcaatattctcacaagtggagctctgggtcattgactgcacttttgctaataagaaatcttcagtaggagtgactgggccttgtgcaaatctctccagtagtttcttccactagtgacgcattagagcctcagaatcaatcactcaacaagtgtttactgaaagcttactgatacccagaccttaaactgttaccaaacagaatgccagatatgggatataattccagcctgaagagtttatgctcaagacaagacttacatatattacagagaagcgtaacagagcaaatgattaagttctaartttcactgtacaccctaaaaaaaaggagaaattgatatggaacatgartagtataggaaaatggtccttaggaaggccagacatgagagggtgagctctaggtgaccacctgtaggatcaggaaagaacatatctagtcctggagttaagatttctattttttctagatttatagaggtataattgacaattaaaaattgtgtatattctagatatgcatgaygatttaatatacatatacattgtgaaatgattaccacaaccaaattaattartatgtgtatcacctcacatagttatcactttgtgtgtgcgtgtttgtttatgcatggaggacatttaagatctgtgtttggaaaattccaaataaacagtacaatattattaactatagttactattctgtacattagatccctagaacttattcatcttataactgaaactgtgtaccctttgacccaaacctctcatttaccccaattcctggcaaccaccattcattccaccattctactctctgcttctatgagttcaactttttagattccacatgtgagtgagatcatactgtrtttgtttttctatgtgtggcttatctcacctagcacaatgcccttcaggcttatccatgtcattgcaaatagcaggatttccttctcttttatggctgaataatattcctctatctccctctctccctctctttctgtgtgtgtgtgtgtgtgtgtgtgtgtgtgtgtgkctgtgtgtctgtgtatgtgtgtatactatatttactttatccattcattcactgatggatacttaggccatttatttatcttgactgttgtgaatgatgctgctatgaacatgtggatgcagatatctccttgagatactgatatcaccttttaaaatatatagctagaaatgggattgctgggtcatattgtagtactattttcatttttkgaagaatctctatgcttaatgctgttttccatagyggctatgcctatttacattcccaccaaaagtgtagaagggtttctttttctctgtttcctcaccaacatgtgttatcttttgtcttttatataatagccatgctaataggtatgaggtgatatctcactgtggttttgatttgtatttccctgatgattaatgatgttgaacactttttaatatacctgttggccatttgtatgtctctttttggaaacatgtctattttttagatatgtttaggtcctttgtccattttgaaattggcttattttgtgttttcttgctattgagttgtatgaattccttatatattttgaatattaactcctgatcatatatatggtttgccaatatattatcccataccacaacttgcctttttattttgttgattgtatcctctgctgtagaagtttttagtttgctgcagttacacttctttgtttttgctttcattgcctgtgcttcgggtgtcgtaccccaaaaatcatgaccaagactgatggcaaggagccttttctttatatttattttagaagctttatggtttcaggtcatacatttcagtcttgaatccattttcagttgatttttgtatatggaataagataaacatccaaaatcattcttttgcatgtggatatctagtttccccaatacagtttattgaaaagactatttgttccccattgtgtagttttaatggcctagtcaaagattagttggccatatatttgtgggtttatttctgggctattccgtttcattggtctatatgtctgtttttatagcactatcacactgttttgattaccatggctttgtatatagtttgaaatcaggacccatggtgcttctggctttgtccttctttcttaagattgctttggatattttgggtcatttgtgatttcatatgaattttaattattaaaattctyattcttttttttagaactgttttttctacattttctttctttttttctttcttttttttctgaggtggaatttccctcttttcgctcaaggtggagtgcaatggtgcaatctcagctcactgcaacctccgtctcctgggttcaagtgattctcctgcctcagcctcctgagtagctgagattacaggtgcacaccaccatgcccagccaattttattttttgtatttcttagtagagatggggttttgctatgttggacaggctggtctcaaactcctgacctcaggtaatctgcccacctcagcctcccaaagtgctgggattacaggcataagccactacacccggccattttttctacattttctaaaaaattgccattgaaatgttgagtgactgcattgactctgtagatcattttgggtaatgtggacattttaacaatattagttcttccaattcatgaacacagaaagtctttccatttatttgtgttgtcttccatttctttcttcaatgtcttatagttttcagtgtacagatctttcacctccttggttaaatttattcgtatatatttcattatttttgacgctattgctttggtttcttattattattatactttgagttctagggtacttgtgcacaatgtgcaggtttgttacataggtatacatgtgccatgttggtttgccgcacccgtcaactcatcatttacattaggtatttatcctaatgctatccctcccccagccccacaccccccccaacagaccccaatgtgtaatgttcccctccctgtgtccatgtgttctcattgttcaactcccacttatgagtgagaacacacactgtttggttttctgtccttgtgatattttgctgagaatgttggtttccagcttcatccatgtccctgcaaaggacataaactcatcttttttatgactctgtagtattccatggtgtatatgtgccacattttctttatccagtctattattgatggacatttgggttggttccaagtctttgctattgtgaatagtgctgcagtaaacatacatgtacatgtgtctttatagtagcatgatttataatcctttgggtacttaattcttttttggataatttgttgttaatatagatgcacgactgattttcatatgttgatttcatatcctgcaactttattgaatttctttattagcttctaatagcactttagatggagtttagggtttccttcatataagatcatgtcatctgcaaacagagacaatttaccttcttcctttccaatttagatgaatgttatatctttttcttgccgaattgctctgactaggactcatagtactatgttgattgggagtggtaagactgggcacctgataaggttaggctttatgtccccacccaaatctcatcttcagttgtaaccctcatcatccccataatccccaaatgtcaaaggaaaccagatgaaggtaattgaatcatggaggccagtttccccgatgcttttcttgtgatagtgagtgagttctcatgagctctgatagttttataaggggctcttcccccttcgcttggcacttcttcttcctgctgccttgtgargaaggtaccttgcttccccttggccttctgccacggttgtaagcttcctgaggtctccscagccgtgctgaactgtgattcaattaaaactttttcctttataaatcacccagtttcgggcagttctttatagccttgtgaaaacgactaatacagcacccttatcttattcctaatctcagaaaagctttcaacttttcactattcagtatgacatcagctgtagacttgtcatatatgtcctttattatgttcagatacatttttctatacctaatttgttgggagcttttatcatgacaggatgttgaattttttcaaatgctttttctacatctgagatgataatatgatttttattctttattctgtgaaagtggtatacagtagtccccctttatgcatgggggatacattccaggacccccagagtatgtctgaaactgcagattgtactgacacctacatatagtatgctttttattctatgtatatacctatgaaaaagtttartttatgttaggcacagcaagagwttaacaacaatagagcaattataacaatwtactataataagagttatgtgaatgttgtctctctcactccccctcaaaatatcttattgtattatactcatctttctccttgtgatgatgtgagatgataaaaggccaccatgattagatgaaatatggtgaacgacataggcattgtaacataaagttaggttattattgattttctgatgatgcatcagaaggaagaccatctgctttgagcgacccttgattattgagctatgacaatgttgatggttggatgccaggtgcatatgatatcaatgtccaacaggtcggttgtgatacagtttggataccctagaaaaaggaatggttcatctcctgggtgggaggaaacaggacagtgtaagatttaatcctgctactcaaaatgcacaattcaaaacttatgaattgtttttctgaaattttccacttaatattttcagaccatgattgagtacaggtaactgaaaccatggaaagtgaaacaaagcataagtgagaatactatatcacatttatcgactcatgtatgttgaattatccatttattccaaggataaatccctcttaatcatggtgaatgttccttttgatatgccgttgaatttgatttgctagtatttttttgaggatttttatatctgtgttcttcagagatattggcctgtaattttctttatttgtagtgtccttatctgggttagcattgtataatagttacctcatataatgagattggaagtgttccctccaagtgtctggtcttgaacttttctttattgggagatttttttttctgatttattctccttactcattatcaggtactcattacccaaatttgttcagattttctatttcttcatcattcagtcttggtcgattctatgtgtctagcctttatcaacttcttgtaggttattgtatttattggtgtataattgttcatagcagtstctatgatccttttttatttctgttgcaatgtctcctctttartttataattttatttagttgaatcctcattccttttttcttagtttggctgaaggtttgtcaattttgtttatctttaaaaaaacaattcttacttatattgatcttttctattctctttctagtcacaatttcatttatttatgctctaatatgtattattcccttcccttttctatctttgtcttagttttttttttcctatttccttgaggtataaagttaagttgttcattttagatctttttttttaatataggcatttatcaatgtaaacttctctcttagaacgtcttttgctgcatcccagaagttttggtgtgttgtattgttattttcatttgtctcaagatacttttgatttctctttggatttcttctttgacccattggtcattttggagtgtgttgcttactttccatatatctgtgctgggattaatatttctgactttttagccaggctgcctgtattctaattacaacttcaccacttacaaggtatttagctttaggtaagccatttaaactctcagtgcctcagtccccttatctgtaaaaatgagtaatacagtgatattaataataataatgagagtatctacctccctgactgattgtgaagatgaaatgaaatagtcagtagaaagtagttagaatagttcacagcatacagtatttattatttttatgattaactaatgttttatgaggtccttagagtgctagacactgtttgcatgaattattttatatgayctcaccacaaccttataaaaaagtttttattgtccgatgttttagacrgcgtagttataggagttagtttcagccaccagttgtatatagagaagctgctaggcaaacataagatttttttaaatctagcacaaggacctgaactttaccacatctgtctcccctgttgactatcaattcaatgcctaggtcccatgagggaagggtcaaagcatttgatgttaaaatgtacttctcagaggatgtccttcggagaagtattctttctcttacttatgttttgttaatttttgcttggttttgattgtagacatcagtttgtaatcagaaatgaagggaaggtcctgggagtaccaacatttaagagtgaccaaaagaatggaagccagcaaaagggatagaattctatcatcttgactcccaaacctactccatgttgatagtcttaatcttagttaatgatccctgctgcttgatccaaaaacctaacaatgacttcactcatttccctccttctgcactgttgttacctcttcagggacaaaatttcaatactttccacttagactttcactactgacttctaactcatctttttgctttctcttatttggaacagttattcagcttaccctaagtccagagtgaatttccaaaaaatcaaaggttctscaacttttcatttctcttcaattccaactcagkttcacacgtttatcacctagtgtagaagggctttcctccacagttttgcttggcaaactccttttcatccttcaagactcaacaaaattgttgccttttcatgaaaaaggatactcttccatccttctgatattaataattttttgttcttgtgtccatgatagactttgtcataatgtattacagtttatcctggaggaaagcaccacaagaccaagagtttcctttttttttttcatcccaatgcttgatacatagtagccatttgataagtacatgttgaatgaaagcatgaatttataacatatataccttcacytgacttggagtttcataaggaatgcaacagcttccaattcatttactttctttttgcttaacaaagtatctgacacrtagtacaaaagttaaatattataaataaaagattaattgcacagatatttttaaaggagacagaaaagatttgaatatccaggaattccacccaacgatgaaagacctataggcggttacaagtaggtaagcagagtccaaaatgtagggtcattttcaatggcagagaggaataggagagtcaataagaagcaaatgctcaaggagcttgagtagagackggaataggcatctctttattatcttattggctgatttatacttcttgtaaaataattagcttaagctaattatctaagaaacaagaatctctcctaggcagattcagttgcctttcctggttctccctgagtgctctgagtaagccccaccattgccttctagaaaaactttctttcttctttcttgcccactcccatctgatcccttcacggcatccagaatgatgatccaaaagtttgggtccaaatgtgatgcaaaagtttacagtggtctaccatggttcctttacaaaaaaagaccaaaaatgttctgccattcttgctcatcatgattttgcctcagtttttcaagttatgttttgttcataatggatttttttttgtttgttttctgaatgtgttctgttccttctactgccttaaaaagccctcatcactgagtcttcctactacttccctcacctccacttaccctactgaattttcaaactgcaagtcaaatattacttccttaggggaatctcatcagactgtctccctagaccaccacaccccacccaacaactagatcacatccctttattaggggtactatgttttcagtataattgcaattataattattgacccattgaatgagttgattcatgtcccttccttctttattataagctttaagagggcaaaaactatttctgtttttcttaccatctttccctctttagtgcttccacattgtctggtacattgcagacatctaataaatatttgtcggaaggaataaatattagtgagagaataaatgggtaatgcattcatgagtgaataaagattatatcatatttttgtggtaaatattttgtttaccttcaatgactgaaacaaagagttccatatcctgaaatatgacctgaaagccatggaatgaaaggtttgataaagctggacgtggtagctcacacctgtgatcccagcatttctagagaccagggtgagagaatcgcttgagctcagaagttcaaggccagcctgggtagcacaataccttgtctctacaaaaaaagaaacaaaattagttgagcatggtagtacacacctgtagtcccacctactccaaaggctgaagtgggaggattgcatgagcccaggagttccaggctgcagcgtgctgagatcatgccactgtgctccaggctgggtgacagagcaagagcctgtcccccccaaaatttttttaaataagaaagttttaataagcagaatattagtttaattatgaatgagaagagatgtatagcatttgtaggggtacagaaccatgyattccataaaggaagaagttaagagcaatgatgtggaataagcatggggcttttaagaacttgtctgaaaagaggatattctttggtcaatagttgaaaaaataaaataaggcttgctggagtggagcaagtcaatggaaagccttcacagttaggtggagcatttacactaaatgactttatttcgaacattcaacaaacactgactgattgtctattggttacccgccatataatgttaggtgctggggaaatagaagtaagtagaatgaggtgggggaggttcactgtggctcttggaaaggaaaatacataatcaaagtttgtgttagaagggtcaatctgaaggcttttgaaaaatggatctgggatagggaggatgtttgttgaatgaatgaatcaatcaatccaattaattcaataaactaatcatgattttagtgagtattctatgaaccctcacttagtttgattaccttgactgtgacatttaactttgtatttcactacttctttgcttctcttacattcagttaaaaatatttttaaaatacaattttcaaggttcagaaacaaaaaaaataaatgacattctggaaaaaatagatgtgctcagaactaaaaaataaaaataatggagatggtaaatatataagtgagaaatatgatgatgattttcattaacaagatacaccattaaatatattctcacgtgatccaaagtaatttcgttctctgtgcccagcgagttggtatctactgatggtggtttttcaaatgcaccgtgcagttagacgtcatcactgagacctcaataatagacctccatcactgagaagttcagaggtagaagatgcagggggacaatgttggcctgcattaatcttagcttgaaaagaggatctttagataacactatctaaatttagctgtgttcaaaatgctccaccacagaagagcagcaaaaagcaatctcattaaaacaagctcagaaaacaattccaagatatatgagtaaaagcaaactaaacaacggaagcacaaatagtatgaccttctcttgacttctacttgcacagctctacttattcaagctctgtttcggacattaagcttttttcatagccataactttcgtgttttttccatcatcctgtctattatatttccccttttatcttttattgagttcttttaggagaaacttgaaaaaaaaatctctataaatggaggttttttactcaagagcttttaaaataacagtacatcaccagatcatttttaaaaagtgttctattgtagttaagtgaatatttattgaaatttttctcgtcttcccattgaagactacagaaatctctttcttccagttgagctcaaaaggaaaagcaaaaaaagatggacagaagccagaaatgctgaataaattagtatcctttttatttactttttaaaaactatgaattggctcatttaaatagattctaaaagtatttgtatgtgggtctgaacactgttgtcatggagattaaaacatttttgttgttgttgtgtacagtggagatggcagttttcttctagttgatgcttctgtagaataaaaaaaaaagtttagctgagaaaggtaggtcttaatggaattgttaatatgtagtcttattttggatgacattttaaaatcacttacgtatttaatctgtggattgtagagcatgctgggaagttatcaattccattggtacctgcctcagttgcagttcagccttaagtacttaccaaagggagctcatttggggtggcaggggtaaccgaaaagtgtgggagctgaggtattgtttgagagcctgtgggcagtgtgactgctccaatcgtagtytcagtgaggaagagcaccatctgtgcaagattttctcagatgtcctctataagactttcattgtcatcagttctatgtgctctcaaatcattgctttttcttctttattttgcacataagctataagctattttttaagacatataggttttatttctgtgtgatcaaaaactatgtctcgggcaacttctactttttggaattaacaattattttctttgtggtcttgtgtgtgtgtgtatatatataaacacatacgcacaagaagactgtctctctgtttgtatatatacatacacgcacatataaatacacagagagagtgtgtgtgtatatatacacmgagagagagagagagagagagagagagagtcagtcttgctctgttaaccagctggggtgctgtggtgcaattatggctcactggagcctccacctcccagactcaagcaattctcatgcctcagccttctgagtggctgggactcccagcattcaccaccacacccagttagttattgtactttttttttttttgaagagacagggttttgctgtgttgcccaagctgatcttgaactcctggacctccagcaattctcctggcttggcttctcaatatgctgaaattataggcgtaagccaccttgcctgaccatcgtccatatatttttgaaaatgacctaggaacaatgagactttttgaagttttttccgtttgctaacttatcagagaaaactagtggaaataatatcaaaaagaaatcatcaaatgctacccatggataatgtacaagaaaactcagcaaaattatttggcacagatgaagaagacaagaaaaatgtctgctttgtgagaataccatagtaggtccttcagacaggaggtactttattaagaaggagcaattctcattaataaagatttagagagatcacttataagatgtatttatggcagcaagctcatttggtacatgtatgtatgagggaatcaagatctgaaaagattttcatcggttagagtgatacgtctgttatgatrcaattaattgtgatatactgtctactggagatttgttctccaaaacctgacaatctartactttgtaggaactaatgtgtataatcttagggggcttagtggacagaaagttcattagccrttggtactgtgataggggaaaaagcaaatgggaccttaaacaatatgaatagacatggtttctcaaagaatagtctatggttcacctgagcacacatcacaaaggatgctgacaatgcacagttaaggtaccccacctagattaaatgaattaattttggacttgggtttagatatttacatttttatcaggacttcttatgttcaccccaaagtttgcaaaatgctcatctaaaataagaaagatgataggcctgatccatcttctgtttactaggttaaatctggaaaatataaacctcaggtgccagacttcagaggsatatagaaaaacaattactttttgcattagtccattcttgcattgctaaaatcctaaagactggataatttctaaagaaaagatgattaaggcgggatgcagtggctcacgcctgtaatcccaggattttgggaggccgaggtgagcagaccacgatgtcaggagttcaagaccagcctggccaacatggtgaaacctcgtctctgctaaaagtagaaaaaaaaaaaaaagaagaaagaaagaaaagacgattaagtggttctagattctacaggctgtacaggaagcacaacagcatctgcctctggggaggcctcaggaagcttccaatcatggcagaaggttaaggaggagcaggcatgccacactgcataaacaggagcaagagagagtgggaaggtgctacatactttaaaatgacctcatgagaactcactgtcatgaggacagttccaagggggatggtgctaaaccacttatgagaaatcagcccctattctccaatcatctcccaccaggcccytcccctaacattggagattacatttcaatacgagatttgggtaggatcacacatcctatatcacttttggagaaagartggaggtagctctgaaggtttgttacatcacagcatttgaggaatggctggggtgatggcaaatatcatacagaagagcaggcgtagacaagatataccagttgttttcaaatatctgagaaaatatcagtaagaagaagtatagtcatgagtgtgcctcacttgcctaaacattttgattaaaaatgcattttagtagatttaattatgcctttttcctctggtgaccatctgttaaaaatttttaaaaccttgacctatgaaaaaatttgtcagtaagatgcatttgttgtaccaaacttctcagttctggactttttaatcagtgtagttgccatcggactcacccaccagcttgcctgctaatccatctgatctgtgtcactcaaatacagcaggcagtgaagaacagctgctttttcttatttcattctccttctatctgtcataaaatccaggtaccaataactagggataagtgttttaccaagagcagttatttcaatagcttgaacttaaataccagattaattttcacagaataaaaataatgtttagtataagttttaataatggcatgtagatgaaatatttggacttggtgacttttaagttgtggttgctttttaaatgacttctctgtttgaggactttgtgtatacacatttcctatcacatttgtggtaggaagattctaagatgaccctcaagattcacaacctctggggtacacatcctatatgatcccctcctgttgagtgtgattggagcctgtgaatatgatgggacatcattcccatgattaggtaacattttacaacaaagtagaagatataattcggatataactcaggtggctaaattagttttcttcaagctactcaaaaggaagattattctgagggcacccaacttaatcaagtgaactcctaaaagagtgtctagttctcagagagcttttcctgctcttgaagaagcaaataatcatgtgagaaggccacacagcaagaggcttaggaggcctctagaagctgagagcagcactggattgataatcagcaagaaagcacagctgagctaacatggagactgcagcctctctaggtcgacaggaactkattatcaatgaatgttgttttaagtcactacgtttgtgataatttattatacagtaataaaaaccaaatacaaaagattaaaaagaaatctaagttgaagatatcttaaaccgaattgcatttaatacacctaacctactgaacatcatagtttagcctagcctacctttaacatactcagaacactcacattagcccacagttggacaaaattacctggcaacacagtacactgtggaatattgttggttcaccctcatgaacatgtggtggactgggatcctcagcttgctgcccctgcccagcatcacagagagaaatgtgcttcatatcactagcctggaaaaatatcaaaattcaaaatttgaagtatgatttatattgactatgtattgctttggcactatcacaaaatcgaaaaatacsaagttcaaccrtcataaattgatgactatctgtaccaccaaatagcccattactcaaatcctcaactttttctcttcaatgtatgtgacctctatttatatagtcaatacttcttgatttgaaaaaggattggatgataatagaagtgaaaagtttgaatgattatactcatttttctttttctttatctataaaccagcgcccagttggaacatttccatattttagttctaaggttgtaaattgctgaaagtttaggttttcttattgatgattctctgctaacatttgataagtaggtcccattgaatatcacaattaatctatttaagaaggttgagagatatactgttaaaccaaagggaaaatggtaaatgaaattacaatttatatttttcccctaattcatgggcattgaatattaacttagtggtctgcacttgtagcttgttaattgtttgacatctagctgaaaagtaaagtgttatatcacagatagcttttctaattgcaaacacatcaccctgtttattcattggttcactaagccttaattaggtatctatcctgtaccaaatggtatgccaggggtgaggatacaaagatagaatagaactttttagtacaatgtgaagaaagaaacataaagaaataagactgctgragtattttaactaccaggtttgcacgttgacttctttatgcttcatttggattttctgaggctttaacgttttccgtttttaagactaagctcaagggtcaactcttycatgaaaattaattgctatttatgtttccatctataagaagagtgaaataaacaatgaaatctaatgacactgaaaagtgctttcaatgtactgttgagtgggaaaagccacatttttaacttgtatattcagtgtgatcccaattttataattttactctcaatccatatatgtgaatataatacataggaaagaggttggaagtaattcaatcatgaggttaacaagttttatctcagatgagattgtgtgtgatttttaaaaattatatttattctacctaataagcatttattacttttataacctgagagataaacattattgaaaaagaagakcatggatttaaagcgaggatgtgagactgtggctgttacatatttttttggtttggaccttggttaagaaggcaaagagggatagagattgtgggacatagagggagacgcaggcctgaggacagttacagtgttataaagggagaggcttaagtatcattataatatgagcagaaattgcaaagagtgagaagctaaaatggaagggagacgataaatagctcagcaaggtttttagggaagcagaaatgactcagatttgaaatataggtgacagaattagccytaaggaggagaaagaaaagatcttttgagactataagaaaggaggtgagagttgatgtagccataaaaaatacagagatgaaagggtggggagttaaaagagcctgtgtatgtagcctaaattcttgctatgaactagaaagccaggtcattagccgaaattgacaatgggataggggtggtcttggggaggttaaggctagaaaaatccaagcaaagcaggtaacaagaggacttgattccagactgtgaacagatttgaggcagggtcagaaagccaccctgaaatttcagtgctataaamctgtagtgggaactctataggaatactaatttctcccttcatcaacaaagatattatactggtcctgtgaagaggcttagtcacttcccagtttatgtatttcaagattatattcctaaaacacagaagtttttcagtttgttccctaacctgaccccagtctacctgtttccatccaagactatcactaccacttctaaaccacctccagccacacaaaaaacacacactatgcttgagtcattccaaattacacaccttcctctaaayattagtgtgaaattaggacatttgggaaatgtgattgatatgatttgcatgtttgcccccttcaaatcgcatgttgaaatggtattcccagtattggacgtggggactggtgggaggtgattggatcatggggacagatccctcatgaatggtgtagcaccatycccttggtgataagtgagttctcccttagttcccatgagatctggttgtttaaaagaaattgggatctccccctgctctctcttgctcccactccctccatgtgacatgtgtgctccagctttatcttctgccatgactggaagcttcctgaggccctcaccagaatcagatgtctgcaccatggttcctgtacagcctgcagaacagagaaccaattaaatatcttttctttataaattacccagcctcagatgtttcttaaaarcagtgcaaaaaatggcttaacactgtgatatttggtattttctagtccattagtgcacatccccccgatgtaggataaatatggtatgaatatttgaatatttttatgagtaataattaagcttattgaattatcacaactccagtgagataagtctaattttaatatcattagaaaggtgaagaagacaagaccagcgagggctactaatttctcaaggacacgctcatcctcatgtgagagctggaactcaaaaccagaccttgactttgtcaaaatgcacttttggttcccaatctgatattaggtgcagattcttctcttctttaaccaagggccaaataatacagccacccaccccaccctgccccagctctccttttagaaccaaactgttgctctctcactttagtgaggtggaaggaagactatttcaaattgactgatgaattaaccctatcgaaggtcagaaaaatgttagataacttaagggggaaaaaaagaaaataaatatcaaaatgtggaaatgtttgaaaaagaaagacaagaaggataggggaaaatagagaagaatagagagagaaaggaagaaagaaaggaggagagaagggaaggaaggagaatgtttgatgagcttatgaaggatgtctctttgcaactgagtgtgaatttagatgggattacataacatgaaacaaaatgaaaagaagaaaaaacagatacattcagtgatttaaaaatggggtaattctttctgtttttatttcacaagtcttttgtaacttattttagagttttaaaactttgtakacatatttaaaatgttcaattttcactaaaacaatcacatttttaaacataagggcatatatttggtgtgacaacctaacatttgccaccaagtgttaaagatgaaccagttttaattttaactagacgatttgaaacttttttgatatacttgagaatttgggactaccaaaaaacccctaaatatgatcctttatattttttattacttctaaaatattttgattctaaacaaatatatgtaaatactatgtggagaatttagatactaaaaatttaagtcaaatattgtttaagtacttacaatatgcccgggactgtacatgatgctaaaagtagccagatgcaatggttactgacttcgagtggcatctttttgaaacagagggcagaaatgaataaatctgagataacatgatgtgagcttgttccatactggagaatggggcactcagagaaaagagtgtgtgcaactgcaggtggggagaagctttgggtttggcactccaggaagatatgttcaaagcagaagggtaaagggcactgattgttcaagaaaagtgagtagtctggaaagggtcattatttcagaagcaacataccaagaaggaggcaggaaaagagaagacaaaacagcagcatggaagatgggtgaggagccaggccacgtgggtagaacttgagtatcataatatttctccatctaaattctactaggactagaagtcttatggacattttatttactctacaaagtgcccacgtcagtgacagataaagagtcaacatctgggagtagcttaggtgggttccacatggcccaggattgaacctctttctctcccttcttagctgtttgacctcagtcaagttatgtcacctctcatgcctctgttttcttgtctgtaaattgggaataataaggtaataataagtattgtgaggattatatatacatgtatataataatacatcatatataacattaatatttattaacacacatatataatctgcacatatgtttattatgtatgcccatatatatattacattatatattcatgtatacatatacatgtaaggtgcttaacagagtccctggtaccaaataagcactgaatcaacattaactattattatttggtttatctgaaacattcaaatggtatagcactaaggccatgtaaaaatatcatgtatttcaattattgaaactttttcacatttttgggtatccaggatagagaaggggaggaaggatctagtcacataatatttgagagtcagcaaattctttcaacaataatgtgattgtatttgtctgtgtgaggtttctatgatggtcattttcatggagccagtcaagcattgactttgaaattaggcagatatgaatttgaaaagtagttttccctccactagccgtttgaccttgtacaagtgactttaactcattttttattattaaaaaaatagggattttttctttgtaagatttttcaagaggattcaatgtggtaacaggtataagtgcctgttagagggcctgtcatagataaatcctcaatgaagggtaactgttactaaaaggaagatataaggagagatatgacactacttccaaataaaaaccctggttcaatattggagcatggggaccccctttaagagaagcatcctcccagcataatgtccaaaatgaaaatatttcatttgtaagcataagaaaggggtcattttaagtgaaatgaccgacttatcaagccagtccactgaactgtagcttggagtctgagttacaaagtaatctatagtgatctgagggagtaatacaaactccaagttaatgactgtagaataaattctactgatatttgcagtctagtgtcatcaaggctaattctcctttaaagaggcaaaagcttcttattgtccccaaaactgttgatatagtatgtaactcagcatgtcacagaaatgttgtttatccactttggctattttgtttaaaaaaaacttttctaccctttttatttatttatttttaaatttctatatttcataagtaaaccaagcctcaacactcggcatttcaggccaggtatggtggctcacacaggtgtgtggtaatcacagcactttgggaggcttgtgcaggaggatcgcttgaggccaggagttcgaggctaacctgtgcaacatggggagaccctgcctctagagaaaatgaaaaataattaggcaggcatagtggcacatgtctgtagtccctgatactcgagaggctgaggtgggagaattgcttgagtccaggagtttgaggctgcagtgagccatgatcttgccactgtgctccagcctgggcaatggagcaagaccctgtcttgaaaaaagaaaacaaaaacaaaccatttcaaattcaaacatatttttctgaattaaaaaagaaaaaatactctctttaagtatatgaaaaagcaaatatctttcctagagtatattacattttaacagctcttgaaaattcagttaagtggtctagtgcttgtggtaatctggatgttagctaacaagaataaaaattaattccatacgttatcaacagcaaagaattttggagcagctaccataaataagaaactgctttagatgctggagatctaaatttggtaagatataatttcagccctcaaggatctagtttgttaagaaacataggcatcataacaaataaatgttcttgaattcaaaaaaaattaaagcttgattgttcagaaagcaatttcatctayatttaggagatgtttacaggtgttatattttataatgcagatctgagttcactttttgtacaagtagaagagtcacacttttatattaatagtgataatattattaacactgttggatttcttccatgtactgtcctagatattttacttattcctagaattttatagaataggtcattttgcttatgttagccttcagttgcaggtgatagaaatccaaattgagcatctattgacacctctattgatctgtccagggaagtacagaggagacctgccttagccatctgttgaccagaggaccaatcacatcaacaggactctcccctctctcttctaagctttcctctttgttgtctttattttcactagggttttctctgtaaggtgcctaaaatggctactagtagctacaggtttaggacctggtcyttagcagtttaaatcggaggaggaaaaatacctcctgttcttaaagtccctattaatctctgttggccttgcatgggtgatgggcccaaccatgtaggaacacagggcagcttaggtcacatttccataaatatcagagaagtggtattgcctgatatgtatttcatagctagcaaatgacaactggaattgaagtccatgcttcttccgagtgatcactgtccctctaattgagtacctttcaattgaacctgtttcctggcgttactttaattttgtgtgaaaaactatcttcttgattttaagtaaaagcaatgaaaaaaggccctctaacattttctgctcacaaaaaaattagctttacagatagtagacttcatcagtagatacagtctttaaggaagaaaaacatagtttgtataaaatattactataccctttactatgtaatgtctcctggattctataataattggtgggctgtgtggtctgcttgccatcttccaagatgtgccccttattgaaaaaacaaaaacaaaacctatgtctgtagtatgtatatttgtgcatttaaatgtttgtgcccatggacttgtgtgtgtgtgtgtgtgtgtgtgtgtkaatgtatgtctatatatatatgtatggtgtttgtgtgagaggcaaagagaagagaaaaaagaatgacgttagcttatcaatatattataataaaattgtgttgactagtttctttatcgttctcttccaaactgataaaaggacaatttttggtgtgcggtttaaaagaaatgaacttttccccctatactgagggcaattttaaaagaaggtagtttctcaggtgtttctagtcaaaatgacaaacctacaaagtacatttgcattattttatgtatactttaytgatagwgtcctttaaatgttgagttcaagctaatttttcttaatcttcaaaaagtttagggatcaaattgtatcctgcagatttttgttatgctaaatttcatttcatctcttcttctttagttctacagagaagttaggtcaagattgtttgaaagtagacttgagtccagaaacttgtctcttcgaccagtggattatctaccaatttgaaaaaatatagcatgcatgtggaagaaaatgttacttttgcatgtcagcatgttgtcattattattagaagaacacatctttcaaagaaaggaaacataaactccataatgctgtctgatattattcttgaagatggctatcattttagctgttataaaacaggaaggaacatcatggagcattagattataatatctatagtcccactagcacaccattaaataaagtgaaggtatgaatatttaaattagaatttgttttttatactatattatgtcaggaagaaattgcaagctctggaaattctttgtgtcttaggaaaatgagattctattttttatagctctttaaaaaaaatacctgcatcagcagacaattggtaacagtcatcatatttggtgttatttagcatttctcaaaaacatggcagttgtttttatgtgggtgtggcatgttggcatttttacattatcgattccttgattcaatttctactctgtgctgacctgtcatatgggataaatctaactacagcaaagctctgttattcttcagtatagtacaacagataagtaagccagatataatacatttgggtgaaaaaactacaaaatcatagagggggatctttttaagagcttttaaaacaatcttttggtttaaggcagagaagtattctacaatgaaacactagattgcataagataagcctgtgcctgttccaacttaattttctttgttactctaagaactccccatatatatgtaaatttcagcagtgttaatgggctttctttggtatgtcagaagaagaatgtaatttgtgaactagataaatctataaggcacaggtgtgagcaaaaaaaaaaataataagaatcactcctcacaaggaaatactaaataacaattattattgagatgtttcatgcattttttttatccatagtagtaagtactactatctctataaagaggaaaaattcaatccaacagtcattaaagttgttctattaaatgtagtgataaatcttcagtttgtatttttaatataagatctgagggataatcaaagcaaaggcttatgtggatagggcatttattacataccaggaaatgtcctgaactctttacacatgattcattaattttctgaattacacttgtagataggaactattgttatcctcattttatagacaaagacacagagatagaggttaagtatctttactggggccacacagctaggaattggcagaaccaggatttaggcactaaaatctgtttatttaaccactagcctacatggccattggaaatgaattatacagagatgaaaagttttcgttatagattccctcgttgaaactcaaaaacagaaggcaaaatatgtaaaagaactcaaaactgagaatatttttaaaaatagaataaaatgtcatagaaaaaaatcacatttaagagtttctttcttctattacttttaccattgcagttatgggcgtttggatacagtttgggtttaataaaacccccaagtttggtttttattaaaataagtcaatctatcattggtcaatacatcacatttatctctcttttctagtagtgtcaaatctgaggagcaaatatatagctactatacaaaaatcaaagatttaaaagttttagcattgcattgagctattaatcattgtaaaaacattttaaatgcctccattttttagatgatagctacacattaaagatggggtgtaggtagggtggttgatcagtgtatctaaatagactatagtatgcaaaaacattcagtaaaaaatgttccttgagcaagaagaaaaaataaagacagctgatcaaaacacatgaatttatatgactcagtaattcttacattatcataaatttcgctaccacttttatgaaagcaattcacacaattcacaatgtgaggagcaattaccatcaaagatacataataatatgccatgtggtatatggagccacaggatgaagatggcaggttttcttgggccatcaattttactcaagggcattttaaaataatattttaatattaaaggaagcatatgatactgtagaataaaatttatttgaatttttaaaatctccaacctgactcttctgtgaaatttcagagctgtggctgttaaattggaactatgccaccagaccctggggtatgtctatttattcttctctgcctttagggaatttttttaaaaagttcaagaagccgtgagataatgcagccttcatagttattctgtttgtagattggtagtaaatttttgatacttattatgaatccaagagtggaggtgaaacatagcactggatatttttatatgtgttggtctatgtcaatcaaataggagagataaaatgatagtcttgttagtgaaagaaaatagggacaattaatgtataataaacttaaagttacatgatatgacagcatagaattaaaaatatgtctgtctagtaatttttttctccttcgcaattattgctttcttcataggcttttcctattgttctctgtcaagacactgcagtctgttttaatcattatcatctactgcttctattttacttgttatgtcatacaaattcatgtttggttctccactaatactgtttcaagaggtcacgaagaaggtattttttttttaaaggaacaccaaaatcgaatgatggtatgatggattttatgtgtgactgagcttgtgtggagtgaagaaaaattcaaaataaattcctctctgagacacactgcatggaaatatcaaagcagtgcaattctttcataaattaaaggttatactctcattctgttttgggtccatccagaagatgataatgtttcgagagcagcagtttctcaggacactcttctgtgtttcactatggtaccaagaaatttgccagggaaagaaatgatttgcctttattctgtcaatattatcaaattaagaatgtttttccaaaaattcttttaaattattgagtgtttattatgagtatttatgatgtgcaaggtgctaggctaattgctggttgtatataaaggtatttggactccagtactattctatttttattttgtagtctgtgtgaatttataaaccactaaatcttacaggtttaatactcaaaactcctcttgtcttcaatatacctaccatagactgtaagggattatttcgagtagtcagttggggtttgatatggtgttaattctttatgcatttacatcattctatcaatttcaagtgtgttcttttattctttttcttttttctttaatttttccaggctgaaatagttatcttttaaagtctgttctacagcagctgctccaccccagtcattgcctttagctttctctagattgccattaggccttcttgaagtcgtgcttattacagatatgtgaggagtgctttttttagggggggaaggggagaaacagatgtagaataatccttttttgttgttgtttttaacacccttttctatgatggccagtgtttcactgatcttgttggctgtctccgtggctggatgagttgtctcgaagagcagtttacactcagtagtgaccaggtccttgagagctcttagctcatcatcctttaagtatagtttggagtattcttcccaggctgtactacttcatgcatttttttttttttttttttttttgcctattgtatttagagtttttcctgaaatgaatttctcactatgtatttgactatcaagaagagttgtatcatctgcaagtttgaggtttcacttgaaaatcctattagcccatacagggaataattcattccagtaggttcttaatagcccttccctgttccctgtttctaatccatttattgctctttaaagattaccatgtactcctttttcttattataaaatattgcatattcatattaaaatctggaaaattcatagaagcagmaataagtaatctaatgaatcaaaaacaatgtcaagtagtgtttcttaatcattacaattatttatgaattttggttttaatttttcaacatttggtctacttgatgtgtggcacacattgttctatgaaatccaaacagtgttattgtaaagtctctgggcttcttagagcaaaagttttaaaaccatcatttatatgtttaatatatttttatctatttctagatttrttttaaaggcagtaaaataatmtaacaggctcctgggtacccatggtgtttattatattatgaagaaataaaatattactcatacagtcgaaaccctacaattaaattcctttccctcccttcagagggaacctattataatgtgtgatttgtgatcatgaatgatttcaactagtttttctgatatttatatttattctgcaccttcaccctcatcatcatccttacaataggctttatcttttggaaatacatataatattgatgtgctctggttttaatcatcacctgcctcttgcctcagcaagctctaggttrtattttaaaggagattaaatatattttcactgaatttaattgtatctaagtaatacctttcgaagagtcaaatratacagaaaagctcataacaaaaagttgcaattcttccatccctccttcactctcagagacatgactgatctatctcagctgtttcttctagcatttacccccggatttaaaaataatatatttaaacaactataacttaatttaaacattttagacattatctcttcctttcctagtatggaagacaaagattgagcactctcatctraccctcacacatttctgcctacatcctgcaacatatacttaaaataaatatwtaatgctaacattgttaaaaccatataaatattactcacagctgagctctgtggtgcactgtgtctctcttttcttttttgtacatcgttgcctggcattaataattgctttgttttgaaaaattagtcttagtttactacatacattttactaattttaaactacactttctgacagaattattaaactcccttcagtatgtttcatcacatttggaaatctattaattgatgatttttgttattatttgtgtttcattgttaagaaaaccatcctgatgcttttctctcccacatttttgtagcttccttagaaagagtgaagaaaaggtaaatgtttttaataaattatgtgtctgaagatgccttaattcccccctcttttagatatcagctggctctagaattctaggtagaaagcatctcttctcagaattttgaagatattgcttcatggctctcaattcttcactcaccttactctatgaaccccagggtctttacatcccttgaggactgaagtgtgtttccacttcaggtgctttgcactggctggtcttctatctggaatgcttctccccaagatatcttctggctaactctcttttcttcttagaaaactgctaagatttaccattcccaatgagccgcctcttgtccttttatttatttttgcaaactgcccctgcccactgccattcctggtctccctaaacaagtcttagtatttcttccctttctcttttcatgttgaaatacactatatagtttacttatgtattaggtaaactttttattgcctctctctgtactccccaagctacttcttgacccttgaaaaaatgtagattccatgatcgtataaaatttttattactttaaaaacttttctaaattaataaattataaaaaattaatatattcaaagcaactagatgtatgcctaaacacctagaaaagtgcctggcgcatgttagaaattagaaagtatttcttatgaacagttttatgatttttcacattgaagttgaagagtcttgccaatttcccctatcttatatatgtgatcagatttttgcctctgtaaacttttaggattttatcttgaccccaaatgttctgtagtttgatcacaatatgacctgtgctatgaattttttgacccgggaaattcatacacctaacttaaggattttaatttttcattattaattatttaacaatgtgttatttatctatggaactcttctttgttagatattgaatttcatggattaatcccctagctttttgtctttggtttattttgattactctttttttttttttccttttttttttttgagacaaagtctcgctcttgtcccccaggctggagtgcaatggcatgatcttggctcactgcagcctctgcctcccaggttccagcgattctccggccttggccccaccccscccccgccgacccccatgagtagctgggatttcaggtgcctgccaccaaacccggctaatttttgtatttttagtagagatggggtttcaccatgtgggccaggctggtctggaacgcctgacctcgggtgatccacccgcctggtcctcccaaagtgctgggattacaggcgtgagccaccacgcccagccgatttctcttttcttttatttccttttctttatattctattgtttcccctggggagacctcctcacctttatcttacaacattttaaatattaccataatttaataattcttttgtgctttgagtagtcttttaaaaattaatatctcatcctgttcttgttttgtgcatgccatatgttttgctagttctccgagaatattgactcatttttgaagtttttaatattatttttgcctttgtttcctctgttttgttttctttcatgggagatacaaaatttctgggaaaattttgctgtccaataatgtttagctgagacactaaaattgttaaatctctgtatgtcacgaaagcatgttaactcaaatatgaacaaggtatcatttcattggaagactcccaaatatcctctcggtaggctatttttatggacaggtattttccaatctttgtctgctagcatttttgttgagaacggagtatgagctaaggatgagaataatcacactctacaatatgtagattttcactttttcatttttagtatgaattcttatcctcacccctcatccttcactgcatggtaattggacactttcttattaaatttccctagagaattgtattagggttctgtagagggacagaactaatatgatatatatatatatatatatatatatatatatatatatatatatatatattagtttattaagtattaacttatacgactgcatatatatacatatatatatgtatatatcatgggagtttattaagtgttaacttactcgatcacaaggtcccacaataggctgtctgcaagctgaggagcaaggagagccagtctgggtcccaaaactgaagaacttggagtctgatgtttgaggacaggaagcatccagcaagggagaaagatgtagactgggaggctatgccagtctctccttttcacattttctgcctgctttatatttgctggcggctgattagattgtgcccaccagattaagggtgggtctgcctttcccagcccactgactcaaatgttaatttcctttggcaacaccctcacagatacacccacgatcaatactttgtattcttcaatccaatcaagttgacacttgtattaaccatcacaagaataaattcccagtggtctcttgccaggtcagcaatgggatagtaacgaggtttatagggttggcagggggatctggatacctaactaagattttgcagcctcaacacttactctagccttgtaaattatttggtacttaaaatttcagagacattctggggatcagcagctcaaataacacttcttgctgtggtttgctcctccccttggcagacacatcctatccccagcttcctctgctctgggctagtaccactcactccatccactttccttccatcctatattaatttgttgacacttcttttctgatgtcatcctctggaccatatatatatatatatatatatatatatatatatatatatatatatatatatacacacatacacacacacatacacatatttatgacttaactcttattttagaagatttgtaggttataatagcatttaagtgtgtgtgttcatggtcaggtttaaccaaagtcctaggcctgagtatttcaatgtgaagaacaaacagaatatgatattactttcatacctctatttttgatagtctgtgattctgagccctatctatgctttcagtcaaattaccaatggtatgaaactctttaattttgtgtgtctcacgtttagagggtrgcttaagaggttctttaactgcatgactattgtgaggaggatacttatgagttgttcttcatttccatggggacaaggacaatgaaaatacagtataatacattcagagtgttattagaagttaggtagtaccttttaattgttaaacaataaagtaataacattgctcattaggcatgtgcttatgaagacaaaaaggcctgatttactgatttagtgatttagtccaaggctttgacatccatatgatgtggacctctgggtactaaagaagtctataaatcccaatcacaactgtgattaattacaaatatcttatgcatgtatttctttagctaaagacagaggtagaatcaaataaaaattactccaagtttactggctctatttctcttcatttgaaaacagaattttctcaaaaggcaaaggaaaagtttgtcatccacatctcttattaatgaaagtgtaacaatcatatactcacatttctccttctgaataaaacaaactactgatgagagataaagataattatttttagtacctctgttgtcttttaaatattccttttttggaaaagcaaaacaagacatgattatattgggagaagaatggtgacccaagaactagatggccttcttctggtacggttctttcactatctggtgtatctctgaagtgtgatcaaaggtaactgatcataactagataatcgttaaagcccctatcctccctccctttctgtatttttacctttcttcccttattgatactaagaccttgatactaagttgttcacaactggcccacattctaggttgaaatgatggtgcatgttggagacaaatgtacaaataaataccatatggttatattactactgtgaaaatgtatgtagaaaatgctggggtaatatggactattttcttaataatctaatttcttacctagtagacagtcaacatttccaatcatggaaatgaactagtgtccacataactgaaatccttcacatctggctatctttaggccctaaattatgtgaaattcactgagtattttccacagabttgtttactgttgtaaaatcttaaatcaaaatgttacatcaaaggaagagttgcatcaaaagaacctcagcaaaacctcaaaacaaccaaacactccacttgtctgtttaaattattagcaaaagcagctctgttatcccagcttctaagctaaccagactcatcattttggcctttcatgtatgcttttcctatggccaaaacgtccacaaattactaataaatgctgrcaaggagagaggttaaaaccaggaagccatgccttttagctgacaaaacattcattgaaatgctatctgggtgaagcactgagaaattaatcrtctgaatagtctaaattatagtacatgaagaatgcaacttgctagggagacataccttcagcattattcgaggttaatttaaaccaacatgtaaatgtttgtatgcttcatgtgtggtatcccaaaaggttgtgttttctcttttgatctttgaatatgctgatcgcctttcatgaacagtggcattcaatgcactttgaaaaaaacacagtctttttctttgaaggtaagttgtaagaaagagaaatcattaaagcctggagtgcagaattgttgtcgactgaaatggtatcaagtgagttgaatgcctcatattttaaaaatgggcatgatctctattattactaacaaaaaaatctgcattttatgtgatatctgacatgggaaagggatgcttgatgagtagccaatgatgttgaactggctgtattttccgactgacttgtttttcttatgaaggcagcattttagtaaaattgtgtttgtctttctttctgataggctctaattgaagtttgaaggttcattacacaatgcctgggaatatgttgtcaaatacaattcacctctcccacagtgaatattggcatgattttataggacagggtactctagagctcagctgtcataatatttggctccaatttcattcataatggacagaatatctacaatgttttgaatccctactttcaaatgtcagcacactggaacawatattaaagaatgggtttgaatctaagtagatgagtatttccttgaagcaacatgttatagcctaaatgttgtttccttcaattatgtttaaacaatgtaaccttaaatgtttcacagatgtatcacttgaaatccaaaacacatactactcatcaaagtcatctttatttaagcttaggaagaaaaatagaaatctgaaatgtttgctcttagtccacacacacttctcatctggcaggacatttctgaatttatttgggaaattgaatatatgtcaggtaggtttgggttgctgggtaaatgagtgtacttcagtgtcaggactgtttttattaacagattttataaactggcttggtagtttccagttctgtggcaagaacaatctatcataataaacctgtaacataaaagtacagaatacattcctgtttcaagagtctgtaagaggagtcccctcatgaacagtttatatgagaggattataaaatgaagttcagcagtagcacaagcaactgcagtgaatggtgtgttgttaaggttctttaaatcatgaaaaaaatatactttcaaggatttattaatcttactccaaatatatatattttggtaaatagcaattggaaagaagggtttgtatttcttagaagcactgagctgaccaatatattggaaaactaagtaaagcaggccagtgatctctattctgagtgaaatattttgctctgtttgacatctgggtgcaatgatggctatgtcagtgtcactttatttttctcttgtgcaagtttgataaaactctttaaatactaatgtgtattttagaaaacacaaattctgttatattccaggaggaaggaaattgccttaggatatgaatcagatttgataacatgaactatcttatttaattattctaaattgaaaacatcatgaaagataattgggatttttccatttttattttmctcttgtttcttgcttatttgaatcattcgttttattcttctttctacttaggctaagctctcaaaaggaaaggagatgtaattcaatgtatgtaagtttctaagtgtaggtatttttcaacaaacacataaacaatcatcgatgacattattacttatgtcacataaaaactgtgtttaaacagattaaaaatattttctggagagttttatttattttacaatgtttacaagtgaattgtcaagatgtctcccaatattatttcctttccagacagcaatctttaaatcctgcttgagtcatcttttattccagttttcctttttttgagtgtaaaggcaataaattataacaataaaagacttatactctttgtcccatagtttctcttttctgttgaaatatagcttgctctttggaatattaacatgtaaaccagaggttttttttttttttttttttttgaacaatctgactattctaaaacactttttaggatatcactaattgtcaataaggaattgagatccacagataaacttatcaggaacagaaaattgttttgaatacatttttaatatttaaatagtcacagatcaaaactaaatttttttttaaagattctgttgaataggtaggacttcacattggattcaacctggtatttaaaatgcaaatactttttgatttctctttttgctaagtaatattctaagagattagccatacattttaaaatgttgtgactgtttttgtgtttcatgtttgtataaatgtagagattagacacttgtttaagatccttaaagatctgaggtaaattatttttgggaaatacaaatttctttctgtaatttctaccttctgtgaacaacttcttgaagactgttctgttgctcttggtttatacgcaggtcccttaaaataacaaaataaaaaataagaaacaatacataaggacaaagactggaaataaaagaaaaataatttaaactcaagggattttcttgggtaaggcctcagagaatgttccagctgttcttaagaaagacattgtatataaaggccacatttagctgaatagactgaaaaattcttattattttgagaaatgattcaattgttgtctcaatgctaaatattcataaaaactatccattcattaatcctttttaaactgaagtaattagaaaaagcaggtcaatgtgcaaagaaatgggcttttcttcatcaaatggttaattctttattaaatggttattctttaaaatgagcaaagatgagctcagcaaataaggtacttgtaataatgaaagtactatatgcaggaatactggctttttgtttttaatctgyaattrgttaattaaatttcattgtagatgtattgcataaaatacatttgaaaggcaccattcttcctcataatacagctagtgaaggtccaaatttcagtgactcaagtgtaggtgggaaaaagtcctcacaaactttacgcaaattgttagaaaagcttatgtaaacatgactactatgaatacagaccagggatgtgccccagagtcaatgagttcaattcacttgctgccacaatgctttcaggcctaggctctttgcagacagagagcagcatcagggaatgattattacctgtgcccagcagggtttgttcaactgctaatggtcaaggtagattcaagccctctatcattcccagagacatacaaaatcaaatactgacttaaagagaaatataaatgaaataagttctaaaaggaaaagaaaacaaagaaatgtcttttacaaggcactaaagaaagacacaagggaacattcatatagattattttattaaatatttattgagcaaaatatttgtgccaggcactgttagattggcctcatgagctttgcatgggcacccacttgctatacatcaggcttggaaacatactcctgaccagcatttatgctagacatgatttatgtctcatactgtgctaagggggtgactaaaatctatattgaccaatacttgatgagtatatttgacagatgtttaaaagttaaccctgctcaaaaatgtaacgggatctttrctaatcaggatcataggtttgcatgggttcctaggaggaaaagaatgagtgggaccagtttatacaccaagcatcaaaggactccattctcaccctagggaaacacggattttactgctcaggggatgatgaaaattggattccgacttttacacctcagattatttctattaattacayctcagattatttctattacacctcagattattatctcagattattatctattacacctcagattatttctattattcagtcttagccgaagattcccagccccaggtccatcgttgctcaagggtaagatcacagacctagtgcctgcattatttcccttctgtgcaaatcgtgagggccaattttgctctctaaaaatttgcattaaacagaccaatcactagattccttctacagatcaaaatgcatttattcaatcaaacaaaagggaatccatgtgaggcaactaaggaagggctttccctccagtctggtgagcagtggctgtggctctgctggctctattttgtgaggtctttataaatgaccacaattaagctgtagatgtactcatgccctagatgtaaccatccgttctggggaatatggcttgataaacccattggtgtctaacacttattcatgtcactcattcattcattcatttattcaaacaaatatttttgagctcttatgaggtgccaggcactgttctaagcaatgggaaaacaggagtaaacaagtccccattcttatgatgtttttattttagaggggataggaagaaggagaaaaagccaatgaataaggaaagaaataaatcaacaagataatttcatataatgctaaggatgggaagaaatgaaaacaggtgttggaatagatcatggggtgggagttaattgaaggggtagtcaagaaaggccctgctaaagaagtgttgggttggttagagcccagcaagggacttttcakctctggagatgcttgtagagaaatgcagaggtcctaatatgggaatgaacatctcatgtagggtatagcttctcatgtttgaggaacagaaacaaggccctaaaggctctaatattgtgagccaggataagggcagccagggtaagggcagatgacatctggagacaggtaggggccaggtaggaccttgtactgtgtacgtaggaccttgtacatgtaggagtcagatcacgtgggaccttgtgcttcgtttgaattttattctaaatgttgggaattgattagatgattttaaaaataatactttcttaatactgtgtcactctgcctactctctgagaaacagatcataaggagacaagggttggaggcaagcaatgcttctacagaagactttggtaggttcggtttctataatttccaagctctgcaggagaccactacagcttcctcctcagttactcttatttacttatgggcccaaacccctgagcagttaaaatctggcatcaataacactatcaattctggctaacaccttggccagtgagaagggttaatataacaggagggaagatgacagacggaaaaccatttcttttacctcttttttggtctccacaggttgacaataacatgttgtaataatcacatgtatgcaatttaccagaagttttgaaatcttagattaccactaacattccaatttctaaagacagtggacatgaattcctgcagctctctgagaatagattttagctgttaatattatattacaacttcctacatagttgtaaaaatttaggttaatgattcctgtgaatttatttttatttttttgaaatggggtctcactctgttgcccaggctggagtgtagtggtgtgatctcagctcattgcaactttgcctcccaggctcaagcgatcctcctgcctcagccacgagagtagctgggattacagattcacgccactacacccagcaaacttttgtatttttagtagatatgaggtttcaccatgttgtccaggctgttctcaaactcctgagctcaagtgatccacccacctagacctcccaaagtgctgggactacaggcatgagccacctgtgaatttaaagtaaattaatattatgtacacagaagttacaataaaaatgcttctatttggataaaacaaaaaaattaaaactactgtaaaagtgaaagatactacatactttaggaacaactggtatttgtatgcaagtgggcctaaatctaatgttgtgtgaagatcaaagccaagtacaattgtagctcatgttgcagttatttcgaggtctcaaaagggataacaacaaaaatctataatagaaaacagaatctgggttaaaatcagtggaaataatttttatttcagaattaaataaattgagtgaaatgaagtatctggctcttggaggaaaatatggtatcttattctttaaatgtctttaaatttataagtcataagctgcaagtcagtagcatcattatgttgatgaattacccagtttaattcttataaaaattgaaattatcttctgaactctaagtcatattttagccacaggtatttttttgttttgtttaatcaataattcctgaaagaatgaaacttattcgacttttattacgtgacaaggtttaaaaaaatttgcttgaataaaacattatggagtctgaattcaaagcataaaggcagaaagtaaagtatgaagatctttcaaacgtctgtcacttttaataattttgttctatgttatatgacctacgaatgttaagagtctgtaagagtttcttcagctgcatttgattttaccaacaccttgtgggtacagttaagaagatgacttatttgaggctttataactgaaattggatatggttcaaacgttcaacagatataaacatattttaattaagaataaatatttttataagattgctgaaatgacttctctcaaaaatttatgccggaacatcaacaaataaatttgcattacaaaatagaaaattcaattgtggaaaatcatattctaacttattctgatgaagtagttcccttgtcaggaagctttttcttaaagtgtgttttatgatttgtgatagaattaccatcactaagtcgatcattgcccattggttagtctacatgtactgccttttagtgacatgagttcaattctaattaagaatgagaatagcctataactatgaacacagatagctacatgtgtctctagtgagaggtactagtcctctttgacatttctcttaaagcggaatttatttggggtagtgatggttttactggtagccataggggaagataagaaaagggggccaagatattcatttctactgctggcatgtggaatgctcttttcctgctccatgccagtctctcacttgatttagaaagatttgtgcgtccttagctttgaccatcaagaagagtccatctcctttgccttcctgtgcctggtacctgaaagacctagtgaagactgaaagaaaagtttttattttcttacatagtgaaagcactttgaagcattttgttacacatatctataatttaacatgataattatattgatcatttacaattctacacattattttagcaagtaatgaacgttcttaagtgcctagtgttgtcataggtataaatcaagtaggatacctgccctcaagaaagtgtataattttatgcgtagagataagagatgagtactttcgcagaaacaaatgaataattatataccaacatggagaacttaagctcataggtgaatgtgrgaatatggaggagaatgaaaatcattgccaggtgagtgatcaaagagtgcattctagaaaaggtggtacctgtacaggggtttggaggatgcattggtattaaataagagagaaattagagggaagacacatcttccaggcagagtgtctagaagcagagccagcagcagattttagtgtaagcaatttattgaaaaagtcctctcagaagatatctatgagatggtaagaaaagctgaaaaaggtaggggagaaagtggacaaagatgtgatctctaaagttgagcctcagactgatacatggcatggtctggagggaaaattgcaccacagaaagaggtaccccttaaggaacaggatgccaggattttacccctcatatctgtcagttatcggctacaagtccaaggggcagggggaagtgcaagtgatgtatcttgctggaagtctcagggtcagraggctctcattcaaagaggcaggtctctggaatgatgcagctgcaagccattagcagccaacccttgcctcagctgagagatgggtaccaggatgaaaggcctggtaaagggttatggctgtgccaccagtggaatttcctacactgggaatatacatgctaggtgcatagaatgttaggtgtgagaggggagaccagcctgttggaaagtattcattaatgcatatttgtcaagaattctagctggtaacactttattaaacattagatattgctattttatgtgctttgaagcaattacactgtttgaaaaaccttattttgtaaaaaaaaatctgttctattcactgtctcacagatttaggacartttattaattaagaacactagatttcaagtyaaacagacctgaccttaaaccttgaccttgttctttgctgtataaatggttttgtatgagttacttaaccacactgagcctcaaattcccatcagttatatgtggattataatgtctgcctcatgcttrttgtgaacattcaatgtaatcattcatatgaagaagcaatgaacacagggtctggtgcacataaatgttcaacaaatgatagacattacttccttctggatgagcaaaaccttgatgctttcagtagaaggtatttggaactatggttgaatcttttctgggggtattgaygggactagagtcaggatgaggtggatgaaatgccaggtactttcatctgtatgacttgagagtgtatgcatcaaattttgcaccctcgagcacctctctcacctccacattgaaaaaaatacatgccagattaaaaaaaatgaaattggaaaggatggtttgtagaactgttagagcatccataaaactcattacaaagtaaaatatattagtaataaaatgattttagtaatacctcgggaaccactctaattccaaatcatctctctgtctcttgtaatggctttccaatattctttgaaaaatattgaggttattttagttatgatattggtactttgatttggtttaaatatccttttattcttgagatatacaatttcaactgaatggcaactatgacagagttgaaaatgtacagaaaaataaattatagattagacaacgtattaatttaaaagcagttgcaagcaagttactatattgcaatgaaaaaaaagttcctaaaattggtaattcaactattgctgtcctaatagctgaagtcatttttatgtatggcaatcctaaatcaaagccatcataagatgctgcagacctcttaatagcttggctccagtgataatgagcccaggacattagagctcatttgagagcaggattcataattttttttactgtgcaattttcctacctctggctttgtctcaaagacatagccacacatggagaaggacactgataataagagagtttgacattctttataatttttcttttgccaggatccttataatccttgaatcaaaatgattgaagcagttatttttaaaaatagaagctagatttaaaatgtattattttgtgcctcttttgacattattttgtttagagcacctttaaaaactctactggtgattaaaatattgaaactataacagtatttttggcatgatttttaaatacttctttcagctatatacttctctaacttattggcttattatttgatttaattgtccttaggcagtgttaattatgagagtttgccgagtttcttcttgggaatttgagaataaaggatgcgggaaagaggaggtgggtggaggatggatataaactgttttttcaatgtactgaaggcatttcagattaccagaagaatcacagagacaagggaccatttagccatagggttaaacctgtcactttacctaccccacaaataagtaactatggcaactcactgaaagtgcttagctaccatgggagtggatggagttcgtgctttgtggggacaatgctgtgggacctctatgcccccatccataagggaccctgggaattgccttctagcagagaggccaactcacatttcaaataagtatttttccctcctcaactgcttttctaagctttgcacattaacaytgacctagtgcaccatttaaaagtcctaaatatatcacacagtcgccagcccaatcaaggtgagtggtcagacaccagcatgctgtgcacagtatgctagttggccttagagtaatacagggtacaccatttatgtccagttaaccaggtgaccctctagttgctttattaagcacaggcttgactgtcaaacaggtcacaaggaggacaaaaagtgtccttgcatcgtatgaaaagagttgcttgaaatcacagaataccctctattaattgctaaaatccaatttccacctgaagacatgcctccatgactcgtgagaaaaatcaattatttaggtaaataggatctgcaactcaaacactcagacctattagagtatctagcagcatgccaggagatagactgagctgcaagataaatatggaaccatcttgtggaatataaatttcagttaaaggttttaaggagtatataataaggaaagcattgttttatattaaaatgtattcaattatattatgggatggaactgaaagttcacatgcagttttcagatgtgtcccccaaagttaatatatttcctgggtactcattcacactcttctgccaatagtattaatgctttgggaaatgtttgagaagtgttgttccagtggaaatgagcctgtgggttcactgattcatttatccattcattcatttattccttcatacagtatatagctttcaagccacttttatggactattttattaactttgaatatcaaaaccaataaaatagactttgtgtctgctttgtgacacaatttaatgagtaacaattttttttttttttttgagaaggagtctcactctgttgcccaggctggagtgcagtggcacgatcttggttcactgcaagctccgcctcacgggttcacgccattctcctgcctcggcctccggagtagctgggactacaggcgcccaccaccatgcccagctaatttttttgtatttttagtagagacgaggtttcactgtgttagccaggatggtcttgatctcctgacctcgtgatccgcctgcctctgcctcccaaagtgctgggattacaggcctgagccatcgcgcctggccatgagtaacaatttttaaaataaaaataaatagcaaatgatgagtaaagtacaacaataaatcaaacaaaatgctattaggaccatatggcagaaaaacaacagaatcttagaagagttagggaagacttcccaaaggaagtggcaattaacctgagatttttaaagatgagcaggagaatttcaggcaaataaaacttgcagtggggttgggagtaggtggatggaccatgatattccaggtgaataattgagcactttagcttgggaggagggccctaaatgagaaagtatatgacctatttcaggaactgaaagaaatttggaatgcttggaatataaagtgtggggcaaatgatggaggacaaagaggcagcagggataatatagtttggctgtgtctccacccagatctcatcttgaattgcagttcccacaattcccaagggtcatgggagggacctggagggaggcaattcaatcataggggcaggtctttcccatgcttttctcrtgatagtgaataagtctcacgagatctgatgattttataaaggagagttcccctgcacatgccctcttgcctgccaccatgtaagacgtgactttgctcttcaagtactttctgccatgattgtgaggcctccccagccatgtggaattgtgagtcaattaaacctctttcctttataaattaccctgtcttgggtatttctttattagcagcatgagaatggattaatacaaggcattagagggaaagagtggggagaggtaaagttgaaagacaagcaagaagcagatcatgaaacgctttgtgagccttgttagtgagtttcagggaaatccctctaactgcaatgtggaaaatgaattggaaaagtcagaagaggaaaattcattaaaaggatgtgaagtaattaaagggatttaggataatggcctgaactaagaaagtggcagtgggaatgaataatatgaatggactgacaggattttttttgtattttgactcagcaggtgttggtagcattagatatagagagtggggaggaagaaggctctaggcatgatgctcagattgctgatttggttaaaggaagcagagaaagatacatctggagaggaaacaagaatccccactttttgttttgttttttccagttcctgatagatagccatgctcaagtgtcccagtggcagttgagtatttagagtcaaagctcaggggagaactctagctggtgataatgatttgggaattttggcataaaaatactcatttgaacccagggaaatgggaggtaacatccaggataagcttgtagaaggaagagactgtgtagtaggaacacagggaaagatatcaacaccagagaggaagagatgctttgcttgagggtgtactctacatttaaatttttctctttgagagaagaatcatgacaataagaaatttgatttattccatatttcagattgttttgaaagtggtatgtcactaatgaaaggagtgtgaagtgaatactgttgacattcctgagaaatgtatctggggggccttaaaatctgtaaatatcataaatatcatacgaatcctaagaarttctgggatttaaggatgagtgggagacttaggttcttggttctgtgttgtaagtcattctccaagtgtagcaggaccatagcactgatgaaaatgatttatacagtagtcttatgatccaatgcccatgtatgaacaaaggttactgttcctgtcttctaaattggggttcccagtgtaatacaggaagactacygtgtgctagtaaacagaaagcacaatccacatttgaccatattttcctcgttggatgtgtttatggatatattttattctgcttttatctttctgagattaatgccttatctggccttttttcctatgagtacctttggttataaagaacttcgcattgctacattatcaattttcagcctctcttcttttttatttttaatttctttgccacctcttcttaatacataatgctctttcttccttcgttcctccccctctctstttcttccttcctcctttctttcttgctttcttctttcttttctttattctttctttttttttttttttcaaggtcttgacgtgttgcccaggctggagtgcagtagtgaaatcatggctcactgcagcctcaacctcctgggctcaagcaatccttccacctccgcacccccaagcagctgggactacaggcaagggccaccatgcccaactaatttatttttgtttttcatagagatgaggtctcactatgttgcccaggctgctctcaaactcctgggccaagtgatccttctgcctcagcctttcaaagtgctgggattacagacatgagccacctcacccaaacttttctttttttttgagagattcttaaactagattgtacttacgataaatgttgactgattcattaccttcaacagtgctttcagcctctgatggttcagagaaatgattgtgtatactttatatttcacctgaatcaggtttcggttgagacaataattttctgagtatgtctccacttcacaaaattaatttattttcaacttttctctagttttaccactcttttgataaataatcttacagtggaggaagacttattgaaacaatttcatcacttttttttctcttgtttgcctcagagtatggttgattcattctctccctaggttggagccattgcagaatcaatattttacttttaactgactccaaaatatatacattctagctaagtactttcagcactatgagttgtccttcttttaaagagaaatttttttaaaatgatatcattaaaaacaagccattccatgatttattgtataagagaagataagtacggagttgtaaacctgcaatagaataataccctggatatccaccttcactgatgagtttaactgactcattcttacctgttaaccaaatgcttttgagagtcaaaggcagggtctgagaggaattatcaatgaatatttgtaatgaatcattgaggtcgcttgtgaatagttgaaacttccaatattaaggctgtgtaggccaagaatctagttatcctttcagaaatttttttttctgaccacctactctgtgccttaagcaaaagtacctgcccttctttctttctttyttttttttttttttgagagcatggtgtggtctcggctcactgcaacattcgcctcccgggttcaagcgattcacttgcctcagcctcctgagtagctgggattacaggcgcctgccaccaagcygggctaatttttgtatttttagtagagacaaggtttcaccatgttggccagactggtcttgaactcttgacctcatgatctgcatgcctgagcctcccaaagtgctgggattacaagcgtgagccaccatgcccggtcagtacctgcccttctctaaaggcacttgcttgcagtctttggaggagataagctttgatcaactcatcaacctaatggcaagtatcatttgacttgagaaaagataagaaacagggttctcaatagtgtgatctacaagatagacagcagtcagtagacgcttgcttctctgaggaagtgactcttggaagaattagtaagagctaggtgggcaaattcgggtaagacagaaggttgagaaagatgttttcagagaaggctccacaggaacatagttcctctcctgctgtattatggagagaacatggagccttcagagatataaaaatgtcattgtggctggaatgcaaagatgaagggaaagagtttgaattgaggaagggatcagagcatgcaaggatttaaagattactttaagaatttggtgcattatactcattaaatgatgtttgccacttgggtcaacaaacattctgtaaaggcttagatagtaagtattataaatattgcaggtgatatggtctctgttgcaattactcaactctgctgttgtaagggagaagcagatataaacaatatgtatgtgtgagtagatgtttccataaagctttatttacagaaacaagccatgacagtatctggcatatctcctgatcagataaatcctcatgttgctgccttatttcccaatgtctccgtttgaactagtgcagggatattttggagactttagcaatgcctagtcagcaagcatcagtgtactttagacattgaaaatcgggttaggaaaaaaaaaatatggactgctttgattttcctttgaagtaatgtcacaagaagaaaacagcaagctggttcatttgccaaggaaggaagagcatgaaagacaaratgaaatgccagtaactaggtactagaggaaaggagtgctaagaaaatgttcaaaagggatcttgaaaagcaaagatcacttggtagatgaacttgttcaaagtgttcgctaactcacctcttgcaagaacaaactatcttgcaaggctctactgcaacatgtctgatacacagcacctgcagtcaacagactctgtagttgcaaagtattgagttttgtgctcaagctatagaagttaatggactgtcataacattgttcagatgaaacccagcaaagcttaacagactaaggtggattttgcctccccttttaatccagtgctaatttctttgagtaatctcagaaaacttttttatgctaaagtgattcatttataaagttcttgtcaaaacaaccagtgtatttaaaatattttggaattataatacaggacacaaatgaaagaagatatttatactaggcagatgggctaggttatgctgcaataatgaacaaccccaaaatcttagtggttgcaaacaacaaacttttttctcccactcacaatacaggttcatcatagtcagcagggggctccaggaatcataattgctgatatagccacctgacagatcagtaacctcagtgtagctggtggccatgagaaaaggcgataatcatctttcatatcaaatattagaacaatgcaagagaaatatggtgattttactctctatatcaatatcacacacactaacayttggtgtgcattttagaatatcttgctggttcccagtaaatatgtcaactttttgcactatatrccgcttgaaatgtcaatactgcacaaatacgcgtagtctgctgacagtaacctgccaggttctagacttccatattgattactgttagcaaaatgtgtaggtgaaatttttgtagggtaygcacgtgaccattcacagaaggcaagaggttctctttggaatttaattttctgtgtgaaaaataaatcacttttttgtgtgtgtggaacatttctcatggaataatgggtcatattaggttaagtttaggaaactgatgtttattgagctgtgcacatatctgctaaaggaatttcacatctataaataaataagcttatttttccatggtgtcagagagataatgagactttcatataaaactatttttgccagctgaaatatcatgattgttattctaatatttcctccacaaagacttagtgaactgcatgtccattttagaaagttggagtagatattttaattttttcttgcttcttgagaactactatcaacaataaaaaaagctttgattttaacgtgtatatcttaagatttcttttgatcaatactaatgaaaataaacctgaaamgcgaatcattggacaaatgtgagatttttcctttaatttatacattaattgatgtaagatagtatttagaaagtttcaatcctttccagttacaattgtaattgtcacttacctcaaactaaacaaacggactctttcccatatttttctacttggtgaaggacattctaatcatctagatgcctaagtcagaaacctaggcatcatcccttcattctttctgttcctcacagtcacacttaattaattgaacgattttcggtccctacatacttcctgatttcctcccctgtgccctactgcttctctccctaactcagataatgatttctcgactatcctattttaagatcaggctattttgtctccttgcaatgatctctctataacctagtaatatcaagccctaatgaaaagtctttggtcggcttctgtcacccaggataaacgtgaaactcctgagagttggatctacttcctttcagcatctcacccttgcctgcacttctagcctccactctcaaaactctttcacacaccatttgaacctgagacattaaaaatgccttccagggcttggtgcagtggcacacacctgtaatcccagcactttgggaggccaaggccagcagatcacttgagctcaggagttcgagaccagcctgggcaatatgcgaaaccccatctctaccaaaaaaaaaaaaaaaaaaaaattgctgggcttggtggttgagcctgtcgtcccagctactcaggaggctgaggtgggaggatcccttgagttcagaagttcaaggctgcagtgagcagagattgagccactgcactccagcataggtgacagagccagagcctgtctcaaaaagaaaataataataataatactgccttccagttcctccaaaataacatgtctttccttggtaaatactcttcttactgctttcagcagacattcaacccacaggtcccaggtcgttgactcattctcatctcttaattgctagccaggcctttgggaagccgttctctagttcctactcagttaggcacccaacctctctgctctcatagcacataggctgtccctctaacatagcatgagtcacacgctttccaaactggtgtttacctgcttgtcttctttactgcattgctccttgaggtagcaaggatgtcttctttattagcttttttatactgagaaaattttaaaatacaggaaaagaaacatgataaaatatatacccacattcctaactcatagaaataactgttgacattttgtcatgttttcttttcttactagagaaagaaaatgagataaaactaacctgcatttctatcctacttttctgcctgtcttagaggcaaacaccaacacaggtttgttgtcaatttccttcccattaaaaatacttttacatacctactgtgtatctatagccaacagatcttatatttatgtggtgtttgcgtttttccaattttagaaatggtttcctacctttcttaacctacgacttctgacaattttatttcaaaattatgccaatatgtatagatctcaaaaacataacattgagtgaatatgccaataggtagaatgtcatgtaaagtttaatttttgtcaattttatgagtgaaaattgtatatcactgttgtttttatttacctttttttaccagtttttttccagttttgttttattattattttattttattttattatactttaagttttagggtacatgtgcacaatgtgcaggttagttacatatgtatacatgtgcctgctggtgtgctgcacccattaactcgtcatttagcattaggtatatctcctaatgctatccctcccccctccccccaccccaccccacaacagtccccagagtgtgatgttccccttcttgtgtccatgtgttctcattgttcaattcccacctatgagtgagaacatgcggtgtttggttttttgtccttgtgatagtttactgagaatgatgatttccagtatcgtccatgtccctacaaaggacaggaactcatcattttttatggctgcatagtattccatggtgtatatgtgccacattttcttaatccagtctatcattgttgtacatttgggttggttccaagtctttgctattgtgaatagtgccgcaataaacatacgtgtgcatgtgtctttatagcagcatgatttatagtcctttgggtacatacccagtaatgggatggctgggtcaaagggtatttctagttctagatccctgaggaatcgccacactgacttccacaatggttgaactagtttacagtcccaccaacagtgtaaaagtgttcctatttctccatatcctctccagcccctgttgtttcctgactttttaatgattgccattctaactggtgtgagatggtatctcattgtggttttggtttgcatttctctgatggccagtgatggtgagcattttttcatgtgttttttggctgcataaatgtcttctttgatgaataatgagatttaactttttcccattgaccattcacatgttcccaactctgaatttctagtaaattcatgtttttccagagaatgaaagagtgaatggccactgtcttgaggaaatgggagtattctagatgcatagtcaggcagtgtgattagtatagtgcaagaatggtaggaaaggatggagaggacaatgggaaaacaccttgctaaaaagtttggattttgtcttctagtgatagaaatgtactgatggtccctgacatgggtaacagctgctttagagctgaatttcaagaatcagcttgtgaacaatgctttggagattaagacagtaggaaggagaagatttgaagcagtaaagtgatttagaaaactatttcaatggaccagacaagaaatggtaatggcctgaaatgagtggagggagtggaaatgaagtcacatggctgcagttgccatttattggagaaactgaatttcagggatttggatcaggtcaaggtatgttatgcacataaaccaaatattaatgrtatttatttagtgtgcaccagtgatatttgttttttccttcgctaaactgaagattaaggcaatcagaacctagtaaacattgctgaattcaccattgtatcccccagtgctaatacacaaaaagtatacaatgaattctactacctacctttcgcagtgtggctatccttgcaaatttcaccctttcccttcctttcagtcattcttgtttccccatgctccatagatcatttagccaccacatctttttgtgttattttgttttctgcaatgatgctggtataattcagaactactagcaaaatctcatctctagcttcatgtgatattttcctgcttataaactacccatattcttgctgtgctatagtcaatatgtgtaactcttctgaggcctcctcattcattgcagatgtttgcaaacttacctctcttcttaagggcccattcgtatgtacttaaataggaagatcatcagagacaagtatccacatgtgaactcccttagctactgttcttttctctaaatttctctttttctctgttcaaaaaatttccaactttcaactttgtggacacttctggaaaaaaagaaagtcgtgtcttaccaattttgcagaattgaattacaagtttctcatactaagacatttttctatggaagaaacaaggttcttttgtagagatgagaatttaaatgattttttttttttttgcaatgggaagagagatttctcactagtcttactggttttcatctgactttatagtttaaaattgatagccattttgatggcaacacacatggtttagttaaattttactccgtcctcagttttcctgagggagtatcagctactgtgttttctttacaaaacaacataaattccatgtatccaccctgggaatcacttcactgcgttgaatctggataggaaataaagattcatgaatatttcacaatttactaggaaccatcactttcttgctcttccgtgtggattttctactaattagttacttggtatgtctaagatacgttatttttattatacaaagactgtatcactttttattcctttgatataaatcataatacagtgtctgataagtacagctttttaaaaactcttttcatagactgtcttattctttttagatttatgcccatgatgtgcatggtcctgaatgtggaatgggtctctctgaagaaaagtgggtcagatggttgcttgtgcatattggaaagaaactgatagcttcctggtctcttttgaagggtgctgttgtaaaatacagattagtcaaggtttacagtgctgttactagcctgaacacttcaaaccaccatgcagtttaaaactattcagtgcttatggcaaaattcaggtcttttgatgttggggcaggagtagacattttattggaatgtaaggcaaaaatagagatgaaaacattgaatcatttttggtggggggattgacttaccttaataataattttttatacctttaaatccagaaatgtcaagaaaatgacacacaagaacaaaacaaaagaaaaattcagtttagagcctgcttaaaaatctgacattgatcttccaatgccttaaaaatgtttttattatgaaaaaatttgaacatataaaaaatggaagatatggtataaggaaccctcaagtacacattacttgcttcaataattatcacccatcaactaattttttttttcatctgtaaccctaccaactgttctcctttcccactggaatattttgaagcaaatcatcatatcatataatctgtaatctgcaaatatttaagtatgcatatctaaaagttagaattctttttaaaatcataatctcagtataatgacacactaaaaaatgaacaataattatttcatcccatcaaatattgacaagctattattcttttactatatattggctagaattttatgtaaagaaaagcttttcaccattgactcttatttacctacaggtagaattcaaacaggaaagcagatcaaatacttgattctttctttttatttcccagtttttagaaaaaatgagttggtttactagtatcctttaatgataaccagtttgctttttgtatctctatgaactcatagattttaaatatatttgatatgtttcgattcattgcagttatgattcttttcaataatcaaattgtctcatctttggttggtaagagtgtcttcaacttggctttctagtcctttaaactcagttttccttaatgattctcatgcttttcagtgttaagatgtggtaggattgttttgcatatttcctgtcctggttttagaaacagtcatttcttggaggagccctggttccttatagtgaaaaagggtatttcaagaccacaggtcggtagggctgttcactgttaatatgtaggttgtttctaggtcttttcagtggatcaggtgggaaatatatatttcaaatagagaaaatacattatagtttattctgacatgcccatttaggaatatgaggcttatagttaaattcattaatttcatatttgtatcttttttctcatccactgaaagttttgattcctaataacttatttgctctatcatagctctctatatatcatttcataataataatagaaatattatcatatacaacatagtggctgaaatgactttgaaagatttcttagccacgattttatatttataaagcatcccactaggcatctacaatcaaattacctttttttaaaaaaaaatcacttgaaaaaattattttatggttaagccaccaaacaacttcatttgcttcatttgactttttgcctgaaagtattttaaatatttgttttataatgatgtaaaaacttttacatagtttcaaggtcaaatttgcaaaataagttatattcagagactagactctctagatccattcatcctgttttcttcctcactaatgtgtaaccattttatttagggttatctttccatttgttagaaatattatatatataaatagtttgtttaaacagtccgcttaagaatatttttctagtcttttgctgctacaaataatcttgcaatcagttgttttgtgcacgtgtcttttgctttttgtcattgcatctttaggatagtttgtttttttttttttgttttttttttttttttgaggcagagtctctctctgtcacccaggctggagtgcagtggcaggatctcagctcactgtaaactcttgcttcccaggttcaagtgagtcttctgcttcagcctccctagtagctaagactacaggcgtgtgccccacacctggcttttctttttttcgcatttttggtagagacgggtttcaccattttggcgaggctggtctcaaagtcctgaccttgggatccaaccgcctcggcctcccaaactgctgggattacagttgtgagctaccgtgccctgccaggatagatttctaaaagtgtgattactcagtcaaaaggtaaaagtagataaatttattagatgttgtcaaattcttctttgggagtaatgccattttccaatcctaagatcagcatgtgagaatgtgttctgtttccataggttctccaacaaattatattgccaaactttatgttccaaagctttgtggggatatgtctggtagttgattggggcagagaaaatgagaaaaacttagtatgaagaaaagagtcttaggcttgaaattaagacacaggtttaattcttgaccattgctgatcacttgtttcaccttagacaagtcagccaacttttttcatctgctccacagatctgtggtaaggattaaatgagatgacatccatgaaacatatgacagaataccttgccatagtggctactcagcatgtaagttttttgtttgtttctttgagacagagtctccctctgtcrccaggctggagtgcagtggcgagatctctgctcactgcaacctctgcctgctggattcaagtgattctcctcccaaatagctgggattacaggcatccggcaccaggcccagctaattttttgtatttttagtagagacggggtttcaccatgttggccaggctggtctcgaactcctgacctcgggtaatctgctcgtcttggcctcccaaagtgctgggattataggcatgaaccactgtgcccggcctagcatgtagtttttaaaaggcaaagcaattgaaatttgtaaagcatttggatatctacaaaagttatttgacgagaacatacaaggggacatctcttatggactggtaattttaggattgtccacttgatgttaactaaatatccttcctaatgccaaaccaacacatggggtaagaataagtgatgctggactaaaaaaaaaatttgatttctctatcaaatgtacttttaggtaaaaaaaaatatgcaaagtataaaatatttgtatgggcaaatgttttactaagggtgtttgggttattttctattgaacaaaacctgctaaaccagcataagatgcactgaactaaagtgcagcagagatgctactgtcagcaagagaaggattcaaagagaggaagcccaatccgagcattacctggacaattaaacagtcagttattgggattttcacaattcttagcttttttaactttcacaattcttagcttttttaactttgagttttaaaaatcatgatggagagaaatttagttcttaacttttattttctgggcttgatgaagattgaatttcatcagagatgagctaaacaaattaaaactgaagcatttaatttagaaaactcaaatttcttcagcctaaaattgttcatttaaacaagtttgttagattctcaaattaataggatactgaataaatatgaaattattctttcctggaaagttaaatggaaaaacaggacagaatcgctattttataactaatacatattaagtcaagaaatagtaaaggattatttgtcttcaagaaaacatcctgtaaagaatggcaatgttggtggtatatagatgtaaaatgcttaaaaagaatgattatctagaagatgttatacatgttataattatctttaagtctgccttctctaattctgtaagttaaacacaaatattgatactttaatttttaaaatatttttaaaagtagctgaaaatggggctccatccttcaaagttctaacaatacaatttatagtaaagaatatgtatgagaaacatttgttcttagaagttcagaaaaatcaaatatataatatgaagatagaataatgtagagaagttaaagaggagaaaggggtgactgattctgaatcaagtgagttttagcttcttttaagtgaaatcatgcatgctcctcacatatgctaatgtataaaacatcaatttatagaatagtatttgaattacctgcctaggctttgcaagcctagacctttgaatttgcattcaaattcttgatgtacattttctagctgggggactagaaagcaagacactttcctttcagtaccttgggctccccatctattaagtggagatcattaaaatctgccttgcaccgctgtcctaaggatttgagataaagcatacaaagggcttggcacatagtaggtgctcctaaatggtaactttattcttcacatcaggctttgcttatacttataaaagccagttttgtagataatttgctgaatagaactaagaatagttataaatattgggttagtttatttgagctgctatgataacataccataaactggatggattataagcaaagataatttatttctcacagtctggaggctgggaagtccaagaccacagcagtggcaaattcagtgtccagtgagtacctgctttcctgtttatagacagcacgttttttttctgtagcctcgcatgatgaaagggagcaagagggacctctttcagacgctggtcacctccctaaagccccacctcctgatatcctcacattggagattaggtttcaacatatgaattttagggggacacaaacattcataacatagaaaatacatattattttaaaatgctttcttattctttattatgaccactattaaaaccaaacagaaaactgtagaactagccaaggtatcttacagagatatgtttcagaggagtgtttattagattctgttgtatacactatttgtttagctttttctgttttttaggtcctcggcctatgctattacagaaagaatattactctcttttgtatttactattggtttcctgagggaagcaattattttaattattgattatttatggtttaatggggaaccattgtattctaactcacaggaataaaacaataacaaataggatgcatgcaaaatatctcataaatgtgtacctaacaaataaaacatacatcttcaaatacgaatatgcatttagagcctggcttgctgtctgaggtcttaacttgttctgtgcttcaactccctattataatggatgctacacatggaagctcttgggtcaccattggaggtaatagcgccctatagagttttgtgtctgggaagaagtggactttgtagttaggcgattaaatatttaccagcttgccttaagccaagtacatgttaaaggactattttgtattattattttgtttttaaataggcccctttctctcatatttatcttgccttaattagggagtttattgtttattaaaaagctttaatctgaactactttcattgtgtgggtgtgtgtgtgtgctgtttgaaacaaatgaactaaaaatgtttttaattgagctgcaagtgaagacttgtcaatacataaattatacagtattatatatctctatatatgcataaagaggatattttaatcagcacatgtccctgtatttaaaagttaaaagaaccgctctacagagctaagaatacaggtattttaattttttaaatgattataacgggggaaattccactgttgtttctttagtgtttgatgagggattgtaatctaatcagtttaaacgactataaacacagcgatgatcatttaagttggatttttattcgaaaagtaagttcttggaatttagggtattgcacaatctgtcccatacaggggaaaaaaaaatcacctacttgtgatttttactaatttttttccgtgagaatagaatcctgctgggaagcttattttattctcttagatttgcttcctcctttttttccccctccggagaacgatgactggtttacaaatagcaatttatatcaactgacacagtcctttttccttatactgttgatctcagaactgttctgcagtcctgaagtatgaaacactattgccattttttggtacagccagtgctctaaaaaatgtraatggatgaaagcgattcaatctattatggaagcagaaacatcttcctatttgctttacaaatttttccgagtaaaatgcagtcaggtttgtaacattgcataaaaacttgttttagaattctttacactaaattaaagatgataaagcaatctgcttttcatactaaacagtgaagtgaaaagcattattttaaagaaatatttctgttttgttrgtgtacgaaattctgtaatagtggctaacttctttaggaacctttttaggtgaaacttatgattgactatgaaatctattctaggacaaaataaaatgagaatagaattatatgtctaattaaatgatatatctaggcaaactaaccattcaagttttaatttttatgaaaactttctatgtgcccctgacatctgtacatgtgtttaatttccagtgagctcaaaatacttcaagtgatctcatttgagtattaactagggaaatacattcacagtcyagcaattttcttttatgtctacattattttaaatcatagcatagattttccactgtgctttatgaccagaacacatttatttgcaaagtattttcacttaccttatattgtagtatgtagtataggacaattgatacggtcaactgtttaaaacgtcagatgcaatgatagagccttagcatttatagatgtagcattcacagttgcaactctttcagtttcagacatttgtgaggaatctcataggtgtgtaatatggtttgaaatttgtgaggacagcaattcgtgctctgactctagtcattggcggccagtgagcaagcgcaactgatcacccagtatcaacttcacaatgtggtttccactaatcggcaccttatattaatttttatgaaataataaaaaccttatttcatagcaggagcgggtacccaaaaagtagttaaatggctaatcctttatagtttttatgtttttggaaatttgtgatctcaagactatccctcaagaatgtcaaggttttgctgaagttaaagacatttgttattctgtggtcagattatttcagtagttgagatgtagtctcacattaagggagaaatctgcaaactagaaatggtttgcaaatggcaaggcaaagcattcaaataactgttacatgtgataaaaatctcttttgggtttcaggatgacaaggtacagggcccagggactggcatttaaagagaactcctatacacacacttaaattcaacaaaaaagtctgtattctataatatccaattaccttaattgtgtagtggggaaaatgaagagttgaatttctggttagctagactagggtaggaagacaccagctctttgtttgttttgtgctttgacatttcaattttcccgcttggctttgtccttctgtcttcccttgacattgatgattttgttgtaggtacgtcacctccttgaatctactgatatgaagagaaagctataactaaagttaagacaatgttaaagtaaggtccaattctcagttatctacagggctatccaaaagaaaaatggaaatttcatttaaaatagctgcatcttttaagtaggaatattttgggctattatatgccagactcatcactggtgctatttaatttctcctcccatcaatgagagctctccctgagacacattgtgagatctttctgaggatgaaatcacttaaccccagcaacgccactgattattttcagctacaacaaccacacttctatgcacacacatcaatcacgccaaaaaacattctgactaaaaagctcaaaagaaaataattaagcattctcttttccatatgaagatattactgaccagcagaaagtggaaaaatgtatacataatgtttatagatactgacttaacaatgagtgaacagttgcgtctcacaaatttcagcagcgttgtcttgacagtggatcatggtgcttctgtgttgctaggcaacccgaggggatggaaaatttaaactcaaatttacttatgtatgttagattttagacatattatattgagagtgtattacacatgtcattacaggctagttgtacatttctattctgtcttttatgtgagtttctcagtatatacatgaaagacactctgcctgtatccttgctcctctatttttgaaaattaacatagtcctaatatgcatttttatggtygacagtcgtggtatatgagagaaaatatgtagcctttgatgtaaraagattgtttttaaaaaaacataaactktacaatatatgcttgtgtgtgtcagtcagagggggaggtggagagaggcagtgtttctgaaacaagagatctatgaaagaagggaacagtctgttagttccacctggttcttctcatttaattactataattaatatatgcagaagaaaaattaatagggttcttaaatccagggagatattaaatgtcaaaaatgtggatatttgaattaaagactaatcaacttgaacaatacattataatgttaaagaactggtagcatattaatttcaagtgagagttttaaacttgataactgcagtggttttgtgaatccaattttaagagttaaatgttgtgtcaatgccatgaatcagagaatagatatttataacaaaagatctgtatgaaatgatgcataatagatggtgatggctgaagctgctgaaaattgatggtctaaatcaaaaggatggattaggaatctttgcggaattattacagacctgtagttttgtgagaaaagcagagaatgtcaaggtcttttacttcaaggaggatttgaagtatttgggggtatacattattgcattagcttagtcagtttacagctagctagacagtgcaaacttgtgaaggaggatgttttcagtatatcacactaggatcatggcaccagtcctgaagaaatagggggaacttttgatctccatcataccatatacacacctatgtgtgggaatgctaatgggatagaatctgatacagttagggtctgaaacactacgagttcttatggtactttgattcaatatttagttgagtaattcttgttcacttatttgtattatcctcattagattgaacctgtataggtttatctttgaaactaaagattaaattgaatttaagttctactgtattttttatcaagattatttttaaaatagcttgtatcacaggaatcctgagtacatacctaatactatcctctactgtatagaaatttagtaataatgaaaaagtatactcctggatttggttttctgggcagagaaaattaaaaactttaagcaggtatcatgtagaataacatactcaacagatattattttgtgggtgacaatttttatagacattatatgtcagatgaaatagctaattaacattaattctattatatttaacataacaccctatatacctcggtgaataaagaagatttctaaaggatgagtttaagaggtattgataaggaccagatatttagtaaagaaatcccatgattccctagatttgtgactcttcagtgacacatttaattagttaatgctttgtgaatcccagaattctttgtatatactgtgatataccatatttttgtcatagtaacaacaatttaattctgattctcctatagatgaatctctgcgttctatctttcatgctactttgaattcggtttttaaaactgaatttaaatatcacagtacttatcatatgatattcaacaacctgactgttttccattttattttattttatcaacttttattttagaatcagggagtacatgtgcaggtatatatcacacaagatatattgtgtgatgctgaggtttggagtacaaatgaatctgtcattcaggtagtgggtatagtacctgataggcagttttgttttgagacaaagtctcactctgtaacccaggctggagtgcagtggcacgatctcggctcactgcaacctccacctcctgggttcaagcacttctcctgcttcagcctccatagtagctgggattacaggtgcctgccaccacgcctggataacttttttgtatttttagtagagacagggtttcgccgtgttggccgggctggtcttgaactcctgacctcaggtgatccgcctgccttggccttccaaagtgctgggattacaggcatgaaccaccgcacctggccccagtaggtggtttaaaccctttctccttctctctctcccctctgttgtattgcccagtgtctgttgttcccacttttatgaccttatatttttcttctttaaatcagtaattttttatgttgttaaaatcaatttttgcagagattagaatgtatttggcctaatttctcattcttaagtaaaacaaaataaggacataatttatagacttgacatatactgattttttggtatagatcactaaataagtactgaacttttttctttaggacgtttagagtttttgacaggtatatagtcaagccctgctctcttttacttcctttttattctctctgatgatttgtatatgaattcattctttattgatagtatcaacatgacaaaacatacaaggcctttgtcctaatggatcttataaatctaatgcaggaggcagacagtaactaaacaatataattgtatatgcggtaagtgctatgaaggaattaaacaaggtgacacaacagaaagtagttgtgtcgggcaattttagataaaatggcgagtgaatgctgtgcatggaggtgacatcttgccagagacaggagaatgagaaagagtttggcatgtgaagatcggggaaatgagcacatggggcagagggagggaaatgtgaaaaggcatgatggtggggagtgtttgaggggtgagagaaactatcatcagagtaacaggcaacctacagaatgggagaaaatttttgcaatctatccatctgacaaagggctaatacccagaatctacaaggaacataaacaaattcacaagaaaaagcaaccccatcgaaaagtgggcaaaggatatgaacagacacttctcaaaagaagacatttatgtggccaacaaacatatgaaaaaaagctcaccatcactggtaattagagaaatgcaaatcaaaacgacaatgagataccaactcatgccagttagaatggcgatcattaaaatgtcaggaaacaacagatgctggagaggatgtggagaaataggaatgcttttacactgttagtgtgaatgtaaattagttcagacattctggaagacagtgtggtgattcctcaaggatctagaaccggaaataccatttgacccagccatcccattactgggtatttatccaaaggattataaatcattctactataaagacacatgcacacgtatgtttactgcagcactattcacaatagcaaagacttggaaccaacccaaatgcctatcaatgatagactggataaagaaaatgtggcacatatacaccatggaacactaggcagccgtgaaaaaggatgagttcatgtcctttgcagggacatggatgaagctggaaaccatcattctcagcaaactaacagaggaacagaaaaccaaacactgcatgttctcactcataagtgggtgttgaacagtgagaacatatggacggacacagggaggagaacatcacacactggggcctgttgggggaggggtgggaggcaaggggagggatagcattaggagaaatacctaatgtagatgatgggttgatggctgcagcaaaccaccatggcacatgtattcctatgtaacaaacctgcacattttgcacatgtatcccagaacttaaagtagaaagaaagaaagagaaaagaagaaagaaagaaacaaagagagagagagaaagaaagagaaagaaagaaagaaagaacgaaagaaagaaagaaagagagagagagaaaggaagagagggagggagggaggggatggccaatgtgactagagtgaagtaagagaggggaagaatagtattagtcaaagttgaaattgaagacacaaactggctattcaagactttatgcctgtgatgtggccaggcatggtggctcacacctgtaattccagcactttcggaggctgaggcaggtggatcacttgaggtcaggggttccagaccagcctggcaaacatggtgaaaccctgtctctaccaaaaatgcaaaaattggccaggcatggtggcacatgcctatactcccagctactcgggaggctgaggtaggagaatcacttgaacctggaaggcagaggctgcagtgagccaagattgcaccattgcactccagcctggccaacagagcgagactctgtctcaaaagaaaaaaaaagtttatacctgtaatgagatgagaagttcagattttccagtgtgtgttgtataaatgaaggacccaattttctcagacagaagataaaaggagttgaggttcgtaacgaggtgattttaaggatggatcatagaatcatcaagccaggaaggagagagtgaaatcaaggagaaggtgatggataggagaaaggaccctgagttattataacagagtccaagagtcagagagctgcacagatggkgtgggatatgccaggtcaaggaaagggccatgggagtgggtgcctgatgcggagaggaggaaaagaggtcagcgaggaggtaaagagcctgggcacagkcatgttggtagattttacagttacataaggagaggtaggaaggaagatggcgaaccagaaagtaagtcattaataatggctggaaggtggttttatgagggatgtggattttcagagagaaagagaaaactgattaagaagtagcatcaaagaggagcaaagttgatgcacaacctatctctagatcttgaaggtcttatagaatattgtttctaagtcagaagtatgatgacagggggaggagccaagatggccgaataggaacagctccgctctacagctcccagtgtgagcgacgcagaagacggtgatttctgcatttccatctgaggtaccgggttcatctcactagggagtgccagacagtgggcgcaggccagtgtgtgtgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaagaaacggcgcaccacgagactatatcccacacctggctcggagggtcctacgcccacggaatctcgctgattgctagcacagcagtctgagatcaaactgcaaggyggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacrgcagtaacctctgcagacttaagtgtccctgtctgacagctttgaagagagcagtggttctcccagtacgcagctggagatctgagaatgggcagactgcctcctcaagtgggtccctgactcctgacccccgagcagcctaactgggaggcaccccccagcaggggcacactgacayctcacacggcagggtattccaacagacctgcagctgagggtcctgtctgttagaaggaaaactaacaaccagaaaggacatmtacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatgaaaccaagttggaaaacactctgcaggatattatccaggagaacttccccaatctagcaaggcaggccaacgttcagattcaggaaatacagakaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgttgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaatgagcaaaatcaccagctaacatcatcatgacaggatcaaattcacacataacaatattaactttaaatataaatggactaaattctgcaattaaaagacacaaactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgacaaaacagactttaaaccaacaaagatcaaaagagacaaagaaggccattacataatggtaaagggatcaattcaacaagaggagctaactatcctaaatatttatgcacccaatacaggagcacccagattcataaagcaagtcctcagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagarattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacsacataccagaatctctgggacgcattcaaagcagtgtgtagagggaaatttatagcactaaatgcctacaagagaaagcaggaaagatccaaaattgacaccctaacwtcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatcgaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatrccctctctcaccgctcctattcaacatagtgttggaagttctggccagggcaatcaggcaggagaaggaaataaagggtattcaattaggaaaagaggaagtcaaattgtccctgtttgcagacgacatgattgtttatctaraaaaccccatcgtctcagcccaaaatctccttaagctgataagcaacttcagcaaagtctcaggatacaaaatcaatgtacaaaaatcacaaacattcttatacaccaacaacagacaaacagagagccaaatcatgggtgaactcccattcayaattgcttcaaagagaataaaatacctargaatccaacttacaagggatgtgaaggacctcttcaaggagaactacaaaccactgctcaaggaaataaaagaggagacaaataaatggaagaacattccatgctcatgggtaggaagaatcaatatcgtgaaaatggccatactgcccaaggtaatttacagattcaatgccatccccatcaagctaccaatgactttcttcacagaattggaaaaaactastttaaagttcatatggaaccaaaaaagagcctgcattgccaagtcaatcctaagccaaaagaacaaagctggaggcatcacactacctgacttcaaactatactacaaggctacagtaaccaaaacagcatggtactggtacaaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaatttttgcaacctactcatctgacaaagggctaatatccagaatctacaatgaactcaaacaaatttacaagaaaaaaacaaacaaccccatcaaaaagtgggcraaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgagtataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataataaaaaaaaaaaaaaaaaaaaagaagtatgatgacaaatggtcattttccttaaaataaaatcatatatcactacttactgacttgcacctatatgtacttctgggaaatttagccagcatgtatttccacaatacagggatagtttttgttctgtggactgctaaatgatcacagcctaatgtattgccttctcagtaaacacacgttgacttaaatcagttgggtaaattgtaaactcaattccttactttgactttagtttgcaaattaagaatagtgtacttttcttattttcaggccttatttataattcctaatgctatacactattatgttacagcttgcacttgtattttgacactttctaattattgtcaaattataaatactactaattaatatatccttgattcttcataatattctattaaccagcacttaacacctttttcataaaacacttttcaggatatatatatagttagggcttgttgacactatttcatcttgatttcaatttatgcaatccgaattttcaagtaaaacctcatggaattatcagattcatcactaactttcaaaacttttataacacatctgctgagttttcagacattcattctggaaagaaaaaacatgctggaaagaaaaattttacttactctaatgtgttttattttaaataaaaagtcctataggttatgattttactgtcctctttttttttctgaaaaacattaaggtttctttcccaaagcttattagttaattgtcagtttttatgtaagcccatgaggttagacctatataaggcagtaatttttaattctccctctcttcccacccttccttttcttccctatctcctttattttcttccttcttctttattagtttttaaatatgcatatctctttttataggagaaaggatggataatgattgcagcattctctgaccactctaatatctcaccctagaaattttaataaatgatttactaacattctcatcagggtttttattataaaataatatcaaagaaaacctgctttttaaaaaaatatcttgatacttgtattttaccaaattcatgggtatagataactttttgatttctcattactttcaagtatcttcttcatgtaaaattttaatcaaatttcagatcccatgcttaacacataaaaattaataaattgatgttgagggactatcacattattttatactgaaaagttgttcaattattctaaagttctatatattaatccaaagccgtctctacttgggggaaaaatgtgtgtgtgtgtgtgtatgtgtgtgtataattttttggatctatctatctatgaggatgactgccttattacaagtttcagtacaatttatatatatggattatatctacatatatattttttggttatatatatttttatatatataaacgcttggccattttgtctatttacctatctacctataaacttcagcattttttgtttgggtaattaatattttgaagttttctctcttgttttccttcttgtttggaatgatctgtttgagactgtgtttttaacaaaagtatatgtaagtttgatatacttaaccttatttttcgctaaacaacaacaagaaagaccccctaattttgaaaagtgtccatcaatatcactgtttggcagtttatcataaagattcaatcagtatacagtaaatctataattgaataaataatgttagaagcaaatatcacaggctaggatcagcttaagaaatctccaaaatgtgagcctacataattgagaccaagtgacatttcatttggtgttaacatatactatgtaaaaatggtattatattttcagtgttttaatggaaattttaacatgctttctgatagtttaatatcttttaacttgtgccaatagattgttttagcaagaaatgagtgataatcttaattttattttcttttacccgattcaaacattcttgccttgatcttagaggctggagaataggcagcatgacctctcatctcttccgttctttcctcagccttagtgaagggtgtcccattcacccatttatccacaccatgagccatactgtggatcatccactcagccaccaactcctgcaggtgctgcctctttccaattttacagccactgccttcattcagaatctaaatatttctgcccttgatttctgaactgcctctgcagttagtcttctgctgccctctcctcattcctttcatctgtcattcctgcttaatactctcctagggctctccatcgtgtccagtataaaatcgtactgaaacttgtaatcaggaagacatcccctttgtaatcagatctccatcaccagtccaacttggtctttgacctcttctcactgacattttatgctcctgtcatgctggactctgcagttgctgggcagtgtacccgcatgctttcctgcaggctatcccatctgactctcttctcctaaacctcaccatatttgcatgggtaacatgtcctcaccttttaagaatttcctgaagctctccctgacatcctgattcctgaacaaccacccctttgtgctcacaaaggtctttgtagttacattatttatcatacagtgtttccactgaaagtttaagtgcctgttccccatcgtggctcctgagtagctatgcagagggcgtaggggaagcaatctggtgaaactgggccaaggagacttgtctctaagctacattggcagagcaatgttttacttagattatatctatttaagatggatttagggaggctcagggagattattggagagaggggaaatatgagagaccctaagcacctcttggcagcactgctgtgtttcctctactgtggagtgagctcctggaaaacagggactctgtctgtcatctgtgtgtttcctgagcaccacatagtgtgtgccagatagattgtatgcctgctacatagtaggctcttaataaataagaagtgaattgaggattctagatgctattcatcttcccatattaaattgctttcaaaatgtaaatcctctgtggcactgaagtctatttaaaatatgctcttctgccaaataaaatgtctcctccaggtgatttgaggaagacatgtgggctcaaataagattaaaccaaaccattgtcatgtacatgtaaatattgcatgagtaactagtcttacattttcttcactaatggggatttattctaaggaacttttttgttcagtattttctgatgaaggaatagtcagaaatatcaaaatccttcttactccattttaggctgccatttttttcctaagagctgttatacattgagcatacctaaattgcctttctgaaatacaggaacacactgtattgtcagtaaaatggtctgtgttgattagtttgtctttggggtgtacttgattcatcagatgatggagatcctgctggcgtttcatgcaacctgctatggtatgtgggctttattggcttcccagcagcgacactgacacaaattgtcagattttatgggcagttttaaacctaatgaaatacatccttgagaagcttccttcaccattttagtagctgtacaatttgaaagaaaaaagtcaatgtacaccacacagggtagttcactattgaaatcatggaggacaatgacaacacgcttattttgctcttgaacatgctgtcattaactgcacaatgggatactgatgctgcctcagaggctggtattaatctttgtgccaaaccttgcagaaactctgtgtgcatttactgacgtaagcattgctctccatctctttgatcttaagattactcctttggggatagaaggtaatataaggctgctgaacttaaaaaaaaaatgctcaaagtgagtgaaggtaagagatgttcattttcttccagtactgaaaattaagagtacagacccacatgytattatacaagagaaagtagtcctatgactgctggataatttacatacattatctaatttatcataaccctgggagagtggaaatattgctattcttattttactagtgagagactaagtgatttgctggtttttgatcccgggtctacatgaatacaaagctacatctttaattagttctctatagggtctcaaagcagtcattttactaaatttttgatctttattaaacatagatgcaaaagtaataataatatttccacaaataaagggatgttaaccaaaattaaygttcaagaatcctttcagtgtttctctacctctttaaatattccagaaatggtgatacagtcaggagcaatatattgccaggaactttggcaggacgagagattactttttggatagaatcagttgcaggaattttccaaacgattcacacagcatcaacttaatcttctggaaaacattttagggaccacaaatacatattgtacccaggatgtagtgtacttactgcagygtggtctatgatttttcttggcatgcataattcaaagacccagatagaaatgactgattttagcacttctaacaataaaacaaaagctcttctacaagagaatatcttcattcatgttaaacatatcaatatctcaagtaagtatgatgaattttgagatagggatcatgccattggggtctcatctggtggtcatggggaaatggtcctctttcttggatatctttggagagtatactatttgactctttagtcaaactgaggatcagtattttaaaagtctataaaatacttaagccatcttgtagaaataaatagtcttcccacccagaccataatctcygaaataattattaggaattttctttttctttcaaacactttggaattataatttagattctttaaaaactgagttttatgactgttttttcaaaaaagcttcaaaattttggcaaatgttgcatttttttttccaattaggataagtaattcaaaaagtcacaacatgcttcagccaaaaatccattgtgaaaatagaaattagaaatgatctttcaaaaaattaagaaatcattttttgaaaaagtgtggagtcattaattaagtgtttgaccttttgtgccttctcaaatgtccattttcaaaaagacagatgcagttagaaggaaaagactatgaatgtaggttcagggccagaggacaaaaactgttgaaattgccttgatatagattcatagattgcaaatgagcactttttaaaatttaaacccttgaatatgrtatctcaggcacagagtgagttctttatatatacaaaatgtgattcttaccgcctaccagctgtcttccgatttcaccagatgaccttccctataagtttgacacgtaactcataaaatgcatggctctggagaacaattatcatgacgggagtatgctttcttgattatatggcaggatcctctttcccacctctgcttttgaaggatattaaaggtgagattaaaaatgctccagttgttctgcttgtctgattgtaacagtgaaggagacaaaattgattctagcttatggctcagtgtttcaatgttattctgcagcacttgtttgccagcagctgttagggattattgcaggtttctttgtcaggaacagtgtggcaacaataataaatcagatttagwctggctactgaaggggtttgtttaaaagatttaaaaatctcttcagagtcaaakatgttaattctacctggtgaaccagaatgatcctgcatatatcttgggacagacttatattttctaaatctgggtaatgatcatacatgcactgaaaagaagaccatcttctcccagaaatatacaacactgaaagattctctaccaaacatgcatgaaaagatagcaaaggtacaatatttctttaatttgtttctttcctctttcgtttaggtgaaatagaggatacagctctgatcattagaatttcatatggcaaacgctcacacacatagtggatttgaggaaatcaattttcactaatctagaaaattctctcctcaagagaaaagggatttaaaaactttcatgatgtatttaaattcaacatatcttttgcctactttaaatagggaaaaggtgactctaaggtcataacgtgaaattgactttacccttcctggtatagaatggcatttcacattgagaaaaactagggagaagcactgaagaattaatgggcagtggggagagaaatgtagttcattactttattatttgtcgtggtaacacatactttatacaatctatcactcctacttgtccaaatatgtgtttctcctgaggtaaaatttcaaaaattctagatgatgttttggaggttctgtagagaaggtgaatggtatagagctaaagcaaatcttgtatgatttttttatttaatatgtttacttcctatacctatgtctttactgtgtatacatatacacccatatccctatatattcgcgtgttcacttttgatttcaaattttatttgtgaaaaaagcagatttattyttttttttctttgagatggagtctcgctctgtcaccccctggctggagtgcagtggcttgatcttggctcactgcaacctcagcctcccaggttcaagtaattctcctgcctcagcctcccgagtagctgggactagatttattcttaatcccatttatccatgtggagaatatgtcaccctgctcatttcactttgcaaaccgacttactattctttgtacctctctccttctctttttgctctgtcactaatagagctttcagctactaagacacacaggagtsctttctagagagtaactgaaattaaccacatacatcattttggtggcaaacctcacagccaccagtcatttatagtaccaagtccctgctctttgggtaacagtggataagaaatgctacacaagctccttatgtggagaaaagactgttctcctatttggaagccttgtgcccatatccatgccctttgcacatttatcaaataaccgtgacttgtcctttatgttttttcaagcatttgtatcattaggcaaggctctgcctaatggaagagatttactcttactctgtgcccaggtggctcgtccatctctgggtattttcaagcattggaggtggcaatagtgtgcttagcctcaagactgagcaaagaaatgaactttccagagattactcttaaaatatcccattctgagagcacatgtttctcttagtactgtttactccggactttcagggtcagtaggcaagcttttcaacaaatttggtttcttttaaaaactatttttggtagttttgttaaatgtgtctggtaattcattttaagtggaaaagggatggagataaagggtaggtagaattgtaaatgtcctaagcctcttttatcatcctatgtttttgataagttttatctggtaacagacaaacattgtagaagcaagaaggggtttaatgttgttaaataaagaaaatgtattaaaagagaaaaacgaggcactgggctcttctactcttgtttatattcttcacccttgtgttccttctactcaggactccattgtaaatgctcaggattaatttttttgtcatttgatgcagttctatactgtaccttgtctttctgcaaagcaaagataatattgtagtttaaaacttggctatccaccaccatgagggaatatgcttctcttatttttctgcagaaacatttaaaatttcttcagctatattttgtacttacctgaattttaaaaatagaatatagataatacatttccctatttttgtgactcactcactgttattaatagttatttttctaatttgaatattatgctttgttaagttatttagaaccacttaccccatctgtaaataaccccgaactcctatactgtcatcacctttgtttcttctaacatgttgtaatgtaaaatcaaaattattaagttataattatttatgatataagaagtattctgtggataaagtatacatttattttggatatttagaataatttttgtttgtttttggcataattcctttttcttgactatttacaggaaatagctagttataggttttacctaagtctcattcaagctaatggattatgcaaataaagtttgctcactgaaggacaagaatattctgtatcttttttctggttcttcaaggtgatagttcataaagaatatgttccattgacaaagttagttatgttttttagcttattaaactaatttaaggacaaagaagagaaaataattttcaaacccactgtgcttggccctcactaattatgtttttgcctgtgagatacggattttggaggctgtatttgcaataagtgacacatacacaatttataaatgataaaatataaaatatttgtcttaaatagggagatgctgtaatgtctctttcccctcttcaacgtatcrtattacagtgattcctcaatgagcagctgaatttccacctgttcttgacgtattacctatcaccatcaggctatgttatgaaactcacttttagagataaagcaaattrtccaaatgtcaccaattattgaatctaaatgtgggcatacaggttttatttgaagcagtctttcagcttttctatatgattacatttttatttaaaaattttgaataggctgggtgtggtggctcacgcctgtaatcccagcactttgggaggctgaggcgggcggatcacgaggtcaggagatcgagaccatcctggctaccacggtgaaaccccgtctctactaaaaatccaaaaaaaattagcccggcgtggtggcgggcgcctgtagtcccagctactcgggaggctgaggcaggagaatggcgggaacccgggaggcggagcctgcagggagccgagatcgcgccactgcagtccggcctgggcgaaagagagagactccatctcaaaaaaaaaaaaattttttttgaataaatagaataatgtgatagcaaatggctagacagctattaaggtggtcaaggaaaacccactaaaagaaaccagcatagtattttgtatgagcatagaaggtgtgggttagagaaatccaatgtctctattttagaaagaaatgtcatcaaggtggacagggaccagaacatgtagcactttgtaagccacgaaaggcattttcattttattcttgtagattttaagtagagatgcagctttcttctcacatattttagaaatatttatttggttaccatatagagccagttctcatatagagaatttattctctatatgagaatagagaataaatttggtgcaagaaataaatatcgggtgcaagatctaaaataggaagacaggttatgaggctgttggatccccattataatggcagcttggatgagataggtttcatgaaaatgggaaaaagcagacatgtgtgggatgttttaggcagctggaatcaatagtacttattaatggcccagaggtctgggtagtaaaggaaagaggagaaactttagataaggcagttagagaaggaaaatcaaggatagattctagatttttgtcttgagcaactgcatggatggtgatgtcattgaatgtgatggaatagatcgggargggtgcaagatttttcatggagggaaggccagagaagaaacagttctgctatagccatactgaattttaggcaccttttagacatctaaatagaactattgatttaatatttggatatgtaagtctcatctgtatgccatctgttctggctatcttacattcggatcctgtgtattttttacactggcctggaaaagctggcaaaacctagaactgcatttgtcccctctgcgtttataccatttcagttgacaggtctaattttaagttccaccttttcataattgattattcatttgtacacaagtatttgttgagtaccagaaatagcatttagtyatttcaagctttagtttttcatcatcctattctccagatttcagcagcatcagaagccatataaacactgccttcggatggcccttagatggccaccaagatcccctagttacattttctgtgtacaaagcagaagaaagatgtccttcattctgtacacagtgtgctacactgtggtttagtttattattaaagagcataattaaaagaaaaaatatgctatttaggtttggattactaattttaagtttaaatgcctttatatcatatttctttgaagctagacatgtattcaaacctcagctcccccaataattagatatttgaacatggtggaaatagtgaacctatcatctttaaaacaaaggatataaaatctaatagagtggataacatgattataataaagatataaagattataaaatattaaaagttcaatattgtcattagactctaatcaataatgagtatatcacgtattatattttgacatgaagaactatctagccttagagctttgaaatataactaagaaatctattaaaataaattaaatagaatatattccaaagtaactaatgttttcccatattaactcagaataactttgtctgaaattaaactgaatatatatcatttataaatacaagcatagagtttaaattcaggtaatcttatttggatgtacaaaccgtgaatagagacattaaggaaaagtagtcataattaattatatcgaatcttcagagttcacaccattcctcttcctaaaaacacatacaggtttaggctgatcaagatatcaatgtctgctctgagatcatcaaagtaatgcgtccattctaagaagcactagtggcatatatgatcacggtagaagagcaagaaaaggagccctcacttagaaccccataagacaggaaagatacagcatcaacctgtcctctccagtttatctgtgttatggattgtaagagtgttttgaaataatattttacttagtaaagtaatatccacaagcatttcaccatgaaaaacattaaacattttaagtatataatatgaaatataccatctctgatgattatttttattgaccatattcttgccaactctaaggtactctaacactagaattttaaacttgttatatttgttactttggtacgaatgtcaaagaaaggtattacctgtaagtattagagcattcctcattgttcctaaacaaagaatttctttttatgtagtctgcactaggaattggaaatgatgcacataaaatacagctttttaatctgtgagattgtttatgcatcttaggtttgcttagttttgcaaatgcgtgcatttaaaatcaccatttgtattttgaactcttctggcttttaactgtagtggaaatttggattgaagacaatggaaaccgtgaggtacaatatataaacttgcatccaaccgagaaaaaccactactcttatctgcacttcaatcagcaggaggttctttttcagtttgtttagaaaaagtagggcctgtcatctgcatggcatacaatctttacaaagaaattttcttttgccctttgtgttttaactactgagtgctgcagaaacttctgtctaactgcaaaacagtttaaggtatcatctatgacaatgttaaaagtaaaacccaatcaaagtttatattatcatgcataatagaccaagcaccattatctgaataccaaacggggccaaataattctctatgattcagatgagacataaaagtgctttaaaaacaagtatgtggtaaaaatcactttggaaaacctttggcattatctaatgaaattaatatgtgcctactctatgatgttgcaattcaacttgtaagcatatactcaagagaaataggtgcacatgtgtacaaagacatattcaagaatgctcataacagcactattaataatatctaaagctggaaataaccaaatgacatcgctattggcatgaataaatatttcatagtatcataataataggaatactataaagcagtaaaaatgaacaaacaactgttatacccaacagcacgggtgaacccttaaacataatcttaaggaaaagaaattagacataaaagagtatacagtgcctgattccattcatataacattcaaaaatagatgcaattcaactttcatgctagatagaagtcaggatactagttatctttggaaagggtagagatagggaggattcttagtatgggcaatattctctttagatctatatgatggttacataggtttttatatgtaggttattaaaataatatactgataatatgatcatacattgaggtttttatttattacaataagttgagattattcaaaggtacatttgttcatttttctatacatatatacattatatattacatatacatatatataccaatttttaaaatgttctaagagaaagaaaagctcaataaataaaaacaccccatttccttgtcactagagatgaattactattatgttcaaatcgtatatacagcatattttttatatatgtatctaaaatatgctgaataagcaaatcaacaactacatctagacttctgcatcgcaaaccagaactacatttaaatgcattttatctcacacttaaagaattaaaataaaactcttttctgaacaatcttccaatatattgaccataagtaaatgtaatatgagtcaattattttaaccgttttgtaactcaatgtctgttggatttatcttgatttttataaagttcagcaattcaatttccacattttcttttgtttctatttttgtgaggcactatagtttttatgtaataaatgttactgatatggcctcctacttagaaaatgttattcatgagagtatattgattttagcaaaatttacatatttacatatgtacatccacaggtttgcatatgtaaaaatatagattatttacttactattgaaaaagtgtattatggaagataaaaggttttcatctctgtcatacgacaggtgaactttggtaacataaggcctagcaaagttttattgatcttacatatatatatatataaaatggtttttcataatttcatgggatgcatcatccaagagaatgatcacagtgatactaattactgccattgactagccacctgccacatgccagacacatggtgacatggctgatgataacatgtgataggtgtttcccaagagagtccctttaaacaaggtttttttcctgtcttcatattgatgaagtgttttttctaaagccattatttcatttattctatgaaagacaaaattggcattttaaaagtagaacacrgtcttttgatacctgtcatctgagatacctaaaggattttttttttaagttagcatcaagggtaaataataacaaatgaagttattttatgttagatcttgtaggtctaaatatatgcacagcaatatttaacatcctgaaatcagaaattttgtttctgatggcatctctttccattatgtgatttgaaacattttagggatattttcctgtctactttgcatggaaaaaactacagactttgtcaaatctagttgccttggaagaagaatgaataagaggagatgtgttaaacaatacaaaatatttttgctatttcaagtttgaattgattttgaaataatagtttcaggctaaataataaactgtctttttaggaaacaaaagaagtattttagaaaaagacattaaaaagactttattaaaatagaggacatgatgatcttgtttgttgctttaagcagtttatgtagtaactttaaggtggtagaaagtgtcaggaaatcaatttgaaggcaaatcttcacatatgaaaagaatcagaaatgttaactcaggtcttaaataaaaaggaagaattaatatgatatattaaaagtgatacgaaagtcaaaggaaagattgatgagacttattaatatgaaatgaggtttcttcaataaatatgtaagtacaaaaaagttaaattgtattaagaaacttgagatttaaaaaaaaaaaaaagcgaagtatttaaactacccctcttgagctcccagccacattcctcttagttgtctaataataacacttcttggctatttcactggatatttctaaatgatagggtcctattcatatatctcaacttgtcaatttttaatatcatcaattgacattccttttttagaaatcatgacttagctacttatactccatcttcagtgcttatccttctaatgtaatactatcataattttatttaaatactatatgtcttttatgacgtaaatattgtctaatactaaaacatctactattccatgtttctgtgttttatcttaagaggttaattttatttgtttatttttcctgggtctttagcttttcttgtattcttgtcctatttgccattattatattattttcccactaacatttcaaaatattagttattctaaatagtctgacttttctttagagttcttcactcaaagtcctctatgttctgcctgaattaggattgattattccctatgcccactgtactgtttttctacattggatctaccttgtcagggatccacaccttcctctttcttggtttactttctcattttgctggagcacatcctcaaatggcttcttaagaaatattacatgggcagtgaattttctgagtccttccagtttaactcattgcaatatacaaaatggcaggcccattcaatttatatacttattccttcaagttttggtaatttatctgcattattattaaataatatattaatatattacttaaaatataaattaaaacataaattccttctaatttctccagtctacttttttgaaactcccatgagtcaaatttttaccttgttgtattggtgattgatattatcatttctctcatattttcagtatttttttgtttctcttttgtgggtgatgccttcaacttttttgtccaagagtcatattaaaactttattttaaaagatttgtatttttccctttttaatattattctatttttcttcttgaatctcttcaaaaatattaattagcagtttgcttttaaaaatattatcagttttttaaataagcatttgtcctccagattttttcccctgtttaatgttgattcttcttttccatgagggactatttacgcaacaatctacataatctttattccctactaacatttaactgtgatatcctaaaatggcctgattgaggaactgattgagatgattaagagctctgtagcagggcgcagtggctcacgcctgtaatcctagcacttctgtgaggctgaggcaggcagatcacctgaggtcaggagttcgagaccagcctggccaacatggcgaaaccctggtctctactaaaagtaccaaaatcagccaggtgtggtggcaggcacctgtaatcccagctactcaggaggctgaggcaggagaattgctaaaaacttgggaggcaagagttgcagtgagctgagatcgcaccactgcactccagcctgggcgacaagagcaagactccatctcaaaaagaaaaaaaaagaaaaaaaaaaaaaaagaagtctgtgtatagggcaggacgaaaggtgatttggtagaaagctagctgttttgccaggcagcattaaatgtaagaatgtgcagattttttcctctgggatcctgtcatttctccagaatggtaatctccatacttattcctggaggagaggtggttacaagtattctggggccacaactattcttggccttttgtctacccctgaagtttccatcactggaataaactggacagttagacagattaacatgagaaaaggcatacacattcattacacgcacatgtacctggaaggcaacaaagtatgagacttaaagaggggccagatggttgaaatttagatagcatctggagatacggaaggaaggaaataaggacttaaagtctcttagtaggtggtggcaacaagctgtgggagtgtgaggagaggaactgcatggcaagcaaaggttgtcatatcatgaagataaagtctctaaggtagcaatcctcagaagaacacgtgaaaaggtgtcccaggcgtggtgtcccgggagtttcctctcctgagataggatttaatcttctctagttcatgtagattccagggaaggggttcatgacaattacattccttctggaggaacttcccttagataagggggaacttcagagaaagcctctccctgtgcttgaggagaggcagaggggcgagagatgggagtggaaggcaagtcagagagaacttggttctaaggcggcttctttagtccaaagtgctcagctcctcaaagcgccatactttggagtactattttctgagccctaacagccacaaatggaagaagtattcccctgtacagaaaagtttgcattacttttgtcagattatgtctcttaatataatcacattttatgaataagttttatttcacttaacagatttatttattttttaaaaccacaactttaattcccaagtaactcttagaagtttctccyttttggattttcattttgatgtttagtaggcttaaattccagtgtttaacacaacccccagcttttgagtcacagtttatttcattatagtagacccctgattgccaaattacaatatcttatgaaccgggcaaaatgttgacttatttaggacattatgttacctatttattccaaaatatttcatttgaaaatcagctacattcccatgtagacttttctttatacaaaaattaaaataattacagaaaggtaaattattctgatgctaaaattagcctttcattgatttcaagtagattgtaattggctaggatcaaatacatgctttatgtaatacagtttatttcttaaactgatacagaaagtgcacataattctggaagtaaaaatgttcaaaagctaagaagctctcatgttatttttcttcaatttgctacaaacatatatagagtgtagttattttctagccataagaattagcagaagctttggagagaaaaggtaggagactgaatgccctgagcatccctttgaatagctcaggcaagaagaggtgctattatcccaggaggagactgtaagtgacgtttgtgtaattcaagtatgtcctgcctggataaggacttgtgggtaaggaaacagagtagtaaatagccaaagggaagaaagtcagaaaagcttgctgtgttcctccacttaaatatatgttatttctttagggactgcaggttttacaaagagatgaagactaattcggaatgctacttacctctgtttccaaaagaaaaagactcctccagaatgtggttttaagtaggccatggaccaaaagtaggccacaaggcatggcaggcagctttatgaacttcaaggttctaggaaatttcatccattggagagttctccagtgctttaaacaatattagaaagaaaacagcggtacaaatcaaccatgctagtaaaaatctctcctgcaagacattactgagtggtgaagactaagtggttttgccattgttgttgtattgttggttggatggtttgccttggatatttgcttgcttcttttttgttgatttttagcatataaataaaatttataagcccaacaaaagaaaagaaagcaatctttcaagaggctttaagataacatcatacattttcgaggtttttaaggctgagattctattttgttttacttaaaaggaatgttacaatgctgttaacgtttttgcttattctacatttttgcttattcatgaaactcgggagaaattctgtctattggcaggctctcattgtgtattcatcaccacactaaccactcatttactccgaaattaagtgctcagtgatatgcatgttataaattcattctcagttgcaaaattttcttggtgcttaagaaattgtactttaatcgcttttagccaaaaagtttagcaaaaatagtactttgacatagtactgacagcctgtgcttagattttgataaatgtggacaaaatcaatagatagatgcataaggagtgcccagataaaatcatcatacttcaaaagctttttctaacataactcacagctgtagacttttcctttcaataataagcaaaaacaattttcatagctacaaaccgccgacacaactttctattyaaagaggacttctttgcaggaggcagaataataactcaacaaaataaatagaatctctaatttcaaaatactattatccccaaaagtaatgggaattttaaaaattatttagtgtytccagtttagatatttaagaacaccactcacatctacatgccaaataaattgactccaccctccacccgttatatcagggccccactccatccattgtcttttttcttagttatatcttgatatgtcaccctattagttttttccttgcagcatttcacttgcttcttgcyttttttaaacaaaaatttatgcactaccctccctgcatccatgttcctgctgcctcatattcattcattcttcagctggtggcaatcagcattcagtttctctccataaaactgttattaaatccaataagcctttcatttctgaatcaagtgaagatttttctctatctttgctgaattctttatggcatttaacatgtcttttcactccatctttctttggggactctcttccatgacttctaagacaacactttttaattctcttccaccattttaggtttgtctttgtaggtaacctttatagattcttctgtgtaatccttacataccaatgttctgaattccattctgctcctctttttccattccatagagtctgattgtgtacttgcaaacacttccatggtatctatttcaagtgtattttgaaaagtctaacatctaggctttcaacttgatctgttgtactttctrtattctatacctgagtgtcagcaaagacgcctgggagctgtctttgagtcttccttctctcttacctccatatttaatggattaccattctcattgattttaccttcttaatttctcttaaattgattttctttctctatacctaatgttagtacctttcygccatgtttctatctggtttacattgctggaacagcacctgatttgctatcttgttcttagtcttgccatcccaacttagtccattcctctgatgtcttttcctttatacagttatcataccatttatcaatttgcattatatatctgattttatttacttataagtcatgttctttgttagctcattaggtaccaattttatatcaatattatttttctgtttgtcattcagtccatttttgttgttgttgttttgttttggttttagagacgaggcaggtgaataggtatagactgaatgctcctaagctagatgataatgaccaaatgattactgagacagggatgagcgatggtcagtgaaattgaaaggatattttagcagctgctttaacaagtatctgggaaaagtccggtctcttccttgcatttctgaacgttaatttgtattaaaagcagcatgactcagaaattttatataaaactcaaataaaccttagaattggatcttatcgagtattgtgttatacagagaatatggagaatatgtgggataaatgagtcaaatggtatgttaaaaaaaaaagtaggaagcatgatagactcaattcttaattcctagaggaaacagagttatgtccaaggaacatattcaacccaatcactgtacagctgtagctttttcttttctttcttttttttttttttttttgagacagtctcagtccattgcccaggctggtgtgcaatggcatgatctcagctcactgcaacctctgcctcccaggttaaaacaattctcctgcctcagcctcccaagtagctgggattacaggcacctgccaccatgccagctaatttttattttatttttttgtatttttagtagagacgggacttcaccatgttggccagcctggtctcaaacccctgacctcaggtgatcctcccaccttggcctcccaaagtgctgggattacaggcatgagccaccgtgcctggccaatttttctaaataaattaatatgatgatgataatggtatatccaaatagctacccagtttttgattaggcagaagtatgcttatggtcagtcagagtaaaaagtgagaccagcatggtggcatgcacatgtaatcccagctacttgggaggcggagacaggaggaccctttgagcttaggagtctgaggttatagcacactatgcttatgcctatgaatagccactgcactccagcctgggcagtgtagcaagaccctatctctgaaaaaagaatcaaaggccttaagaaatattttatttttacctcagaaaatttaaaaattaacttagagctaaatagtttgggtttcattatgtgtagaaatgaatcttgcaacagtaacagtttcccattacacattataagtgtctgttttgagtaaatttgttgaggagtctaatttagtttgaatcactgggaaaagacacaattgaggttttataaaatgtaaaaaatcaaatgaactctgtactttcacttttttacataaagtacatcttccacttctagttacaaaaaattttttttttctcacttgagtcgtttatctgtagtaagtaaatttgggaaaagtgcaagtattcatatacattgttttgcatttaaaagaaaagtgataatgttcaaacccatgctatttacaaaaatcaaaagctcaaatcatgaattctgtttgtgttaaggatttaaaaaaatagtggcgtgagaatggttattgctcttcaataaagatagagataccacgttttgctttaacatatctagaggcacctttttcatcgatagctttattagtaggtcaaggagaaatcatacctaagtagaaaggtccgtggagaaaagagacaaaccatatcagagttaaaattaaattgaaaaaatttaaatcaaggaaaccattttcacttctttcgatatgatgtgcaaaatcatgcattttaaatgggaaatgggaaatttcatagcttcttagcaatgatgtgagctctgtggtttgggtggatgcagggcatgtgggtgcttttgctcatttaaggaaattgcatttgaaacattctcaatacattatgtagccacaagaaaatttatagtgatttctttttggtggaacaaagtatatgctcttttccagctcaggatccttttccagtcttcctacacttaacagccagtacaaacttagtccatagaacgtatttgttgtgcacagacctgcacaaacacacacacatgcaaggttgcacgaatcaggtatgtattttgtgtatgtgtcaaacttagccatcaactggaatttgtgttttagtttggatgctgatttacctcatcagtaaaatgcccttcacttactctccctagacatagactattttccgtaaaatatgttagtgatttcatatttaatgtgatatggaatagaatgagaggttgtgtgaaattaaaatcatgatatcaattatctttctgtcatgcagaataaaataagtgttttgacagatataaaaaatatttatggtaattaagtacattcatactgtatcagctaaatttgtagaatattgatttctgtattaaattatgtaacattttaattaaaataaatatattgtcgagttgtgagcagcacagtggtaagaatattttgcatgaagatggttacataaatatgcactaaaattgagtctaactgcaaaaaaatgaatgcagtagctacacatttagaaagaagttctaagaataaagcagtttacaaacaaatagtatatatacatgtatatgctttgttagaagaaagagaatttattgtgagtgggatactttaaatctttcagatgttaaggattctatttcccaaataacttcattcatgtaagaagtatacttcatgtgagtcaggttttattctctaggtgttttctaatgtgggaaagtgaaatacaagggtttgaaatggttctggggatgcagtctttcctgtcagattccagcagatgctgatataatttaatattcgtggaagacagggcaaatatagaatagcatcaaattgattttgcagagttttcaagccagatgtcccttggcatttacatggaagaagtctactgtgtaccaagttgcatatttttgtgtgtaagttctcagccatggtatgtagtcattggtgttttgacagccatctgctcagacctttatttctctgttcagccataactaaaattgaacatttttcaaatgttccaggtagtttcaattttaagataacagaaaactagtattcaatggttaaaaagaaaaaaagcaatacctatctttggcttagtaataacccctaaattgaaagttaatttcttataaatagcagtgcaaaatgaacaaactttgagaacagaggcctcaccttattatcaaatgagtttgttttaatcatgtggaaggctctcagctagacactgaggaagttatagaaatgggtaattccaaggtgaatgttccaaggatagctatgtcttatacataacaagcacttcatcattatttgctgaatgaatgcatatgttagaatccatatgtaatagcttgtccatttgcacatattttcaccccactgatagtttttaatatgtggaggtacacatacatatctctgtgttttttgtgggtgagatatgtaggctaacatgtcgtaagtgaatgaaactgtgtttgataagaactgtcaagtgttgactatgcacctattggtgtgctagacattctgaagattcagaagaagtatacaacattatttctaatgttatgattacatctacagacaaagaatcaaacaatgattctttttaatggtaacttgtgttttttaatgttaaagatatgggccaaatgataaagaacaggaaaagatgagtttttttctctatcagaaggatagattttgagctaatcttgaaagaaatactaaatttagacttatggagaataatttaggaaagcaattgaacactacccaggggaggtgggaagtgagatgctgtgttcagagtgagataaggaaataatttgaccagagcatgggattttaattgagaatattaagagataaaattataataaatgtagggaaggtgtatcagagtgagattatgrtatactatacttgaaatatctaaatgaagtatttatgtttactctaaaagtcaagtgagagagattctggagtgagacaagaatgtgaggaatggggacttctgtggagtttaatctatagtaatgcacatgaatctgataaattattataatctttgcttttagtagaaatggggatttagagtayatcagtacaggtggcgaaaaatgtgaatttaaaacatattttgaaaaacaaggataagaattagtgtttaaaagctaaaagagaagaatttgtgtcagctgcaaaataaagtaaatacacatacacatacactacatacatgctcataatttaaattatgaactattttatcacactctgctgtgtaagtttttctaactcatattgtatatcagccatgttgtattcttgcattaattaatgtattcattaaatatgtcttcagtactttttttgggtccagcattacattaggcagatatattattcagcaagttttcaayttagttcagggaaagagggatgataaatattattatgagtgtttagaaatattaagaacccgaatccatttatcagtttcataacaatgattttcaagcttgtttcatttctcacagggtagacaaagacaaaatatatatctcataaaagtaataatctaccagkcatgtttgttgtagccaagcaaatatatagaattctaaaaatattgtttatagctcttgtttcaacatgcttgggacaagttaatgtttacagttttgtgagtgaatgaatctatatactgaaaacatttcattcaataagttgaccttcttgaggtttgaataaattttggagcctgagggaatcaatatggtttttaagttgatctcctaggtatgtctaagtttaagttcttaatataattatcaaccctttattattttaatatttcattacattaattatcttttggaatattttcactgatcagtaacttctagtcataagccgttctggtaccaatcatcaaatttcatatttgtaagaaaaaatgactagcctttggctgtcttgacatgcccaaatccaccaagtatatatctcacttccaaaatagtctcaggatatgttttctagatatgatcttagatgatggagtgtattgttaaattaacaagtagtataaaaatagacaaaatattattaaaaatacaaggagaaaggaatatgttagaaacaagtaagaagttccatatggaaaactgataagcaattttttagaagcaaaaatctcatgacgctaaaacaagatgatgaagaaattactctgtgtgcaagtgtggagaaaaatagcttgtgataccatagtgatcttagagctcattatacatcagcaatgaagagctttaacwaccatgcaattaaaatactagagagtataaataagattgtaccatgtgtatgtggcagcatataaaaactcagaagtggaaggaattttagtcaagtgttactcttgaaaaagcaaacggattaggaatatttaattggagaacaacatagacaccttctgtaatattattcaagtaagaatgtctcattttggacatcttacttatagtcagattgattctcaaaacactttttaaatgtctagaaatatttacaatggtatttatcctgagaaatgctaaaaaaaattagaaaatgtaaaggtgactgaagttaggaaataacataaaattggtaatgatgagcaattttcttaatggctgttcataactggaaaaaaacagatatgctccgaaatatatgaattgtgagataaactgcagtaaaagaccccaagaaattgagggaaactatggaaatgattgtagcaagtggtagcaagctatttttgtttgcattttgaaagcagtttttagaaatttctaattttgaaaatcttaaattgatttttaggaattctggggctacttttttctcagacctctagggcaaccaattgtagagacttcccccttctgttaattgactcagatctgcttacatattaaaggccacctctggttctcagctggaaaaaagagttcctcccttttgaaacagttgactcagaatcagttccttcctttcagatccttatctttaattactttgtcttctaacctggggtcctaatctttgcctaggaatttaaagtaaagrttggccgaatcttatttctcttgacttgtatctacctttactttagctcaccctctgggcgtggcctctagccagtctcactttgagtatctttgaaactctctccttattgtcaaccccttactttgattattttttttaatttaatgtttccaatgtagaaatacatctcaaaaattatgcagaagttctatcatataatgttcttgcatgggtctgaagctctttgaaggcaagggtccttgactrtgttgttcattgttgtgtaattactgcctagatgagtacttggaaaggtggagtgattcaatgaatatgtgttgcatatagtttaagaagaactgggactggaattagaaacacatgttccgtctttagcaaatcacccatcattactaatcttccattattttatctatgatattgagcaagtaatgcctatcccatctatattatagctttgttggaagactcaagggataaagtgaaaatgctttgtagagttcagtgctacacatttattatggtcaatgaactgcattacccaaaccaacattaattgtacataacatgtgacaaagaaaggcttatggttttggagtttgtttattttagaagaccagataaactagaacaaatattttccatgaagaagttttttttcgtgttagaactcatgtgattaaattgattcacaaaatttgaggtcatttattaattttatgaatattttactgagcacctatatgatgtcagtgactctaattgtctctgaaaataaaaagattaataaatcatggcttctgccttcaaggaacttagagtttagtggttatagaatgttggtttaaaaaaaatggcaaaaataaaattctgacaaaaactcataatatctgagagtttatatgtgcttgctaaatgaaaagaattattagcaatactatgctgaatgactgtaaaatgctgactttttacttgaaatatttacaagaggaaacagaatatttgtgggtttccctgcatatttatgtgtgtgttcaaacagctgctagagaacaaagtgttttgctataaacactgtcaaatctcactgtgaaaaaaatttgtctataaaacaagtattttcatagatacactaaagctgcatagaatttgcttttatagcataaaacagaattagatgcttgagtcagctatgaaatactttttcatgcaacactcattctaattctttacactatgcattaggctgaggcctggtgtaatttgaaagtgataatgcaatagagaaattccagaagctgggggtggggggaatagactggatattgcaaaatgcatcagttagtcaatcaaactcctaatttatcaaccaaaccaacctaatcccatagagaattcaaagtgactcacgaaaagacacacaaaagaagaaatgttttgtttattttccaagatggaaaatgtaaactatccagaggacagtggtatgggtttagaaagacaattcacacaataaattttaaggaaataatggttttagtctttgatgctaacattatttctgggcttccaagtcactaaaacaatacatacatctttttaaaatgttatttttgttgtgttgtttggttttgtgttttagtctttttattttctgacaaaagaaagtttgccatgtctccagaacaggcacacaatttatgtactaaatcctgatatgaatttcttttcttttcttttcttttctttttttttgaaatggagtcttactctgttgcccaggctggagtacagtggcacgatctctgcaacctctacctcctgggttcaaaatgattctcctgccttatcctcccgagtagctgggattacaggcatacactaccatgcctggccaatttttgtatttttagtagagacagggtttggccatgttggccaggctggtcttgaactcctactcaggtgatcctcctgcctcggcctcccaaagtgctgggattacaggcatgagccaccaggcccatcctctgatatgaatttcttattggagaatccctttatgtgtccagccctgtggtaggctctgagaatatagtaatgaacaaggtaaacaaaacatacatagtctctcccatcatgaagcttacgttccagcaaggaagctagaccttcaatagataattatcatttaaaattataccttgtaatcagtgctatgcaagaaaaataaggcagaattaggggctgtaatgaaggacctgtttacaaagcattaggaaagccctcatggaggaaataagacaaggaagaaacacttgtgaacaataggaaggtatgtgaagtgaaggagcgttaaggaacagagatttctagacaagccctaagcaaggaaaaagcagagctttattctagaatcggactaaaggcagtattctttgaatgtgatcagaggacattgtaagccaggataatcattttgaattttaacctaggtacaattatgatctatttttaagaagactgacttgatcagatttgaatcttaagaaaactcattatgtaaaaaaagggctaaagaaaggataagggtagtcagcaggccattcaggaggctattgcagatgtccagatgttacaaatgcttgtgacttggccccaagtattggcaatgaccctggagagaagcagatggatctgatatttatttcggagttagcataatatgaaatgatgcaatggcatcaataacgactcccggttttctctatgagacactgggtgggtaaactaagatgtgttgagcttgagagaattcaggagtagctaaatctgggtgtcccttcgggtggggattagaacgctgaaaaccacgaactctactttggagagtaatattaaatttgtgatgttcctgagacgtctaaaaaaatggagatttaaccaggcatttggatatatagctctatactttcagaaagatacctggtctggagatataacttgggagttattgactctacagatggtgtgtaaatgggttggaagtgggtaagatttggggaagagaagaatgaaataagaaaatgatccaggattaagccctgaggaacgataatagttactgataaaaaaaaaaaaagaaaagaatgaagtaaatgaatgtgacttttctgtttcattttgtctaagtcttttaagccagagaaaacataatgtgraacagtgtttttatgtgtgttttatcactagagataagaaattgtcaagctgtccttaaggaccagggagggcccatggggaacagcatctttcctgatgctgttgtattcatcaaagcatagatgagtctcttctgatatttttgtttgaggaacatgaatataagctcatgctcctagcatagcaattagtttagagatttatcattgttttatttttattttttgaattattaactgcagacaaagccctaaattttttttgttttctatatcacaagtacctttttttggtttaaggttctaaatttcattttccgtgacttgaaactgttttgcacttcctctccttgctttatattttgagtttacacactaacctgccaaagagacatctagtttataggcttgattttggaagaaagacagaagagagcagatactgaacatatgttccgctgatattgatgaagtgaggttggaagaagcttggaagcagtctatttctctccaactgccaccccctctatgaatattttgggtacccttatgctggaacattccaaataagtgccccagctatgggttttttttttttttctcataatgattctgaaagcctttgggatgatttaggattgttctacaagtggaacataaaccaaaacaaagcagttcgtggactctaattttaaatgggtgatggatgagatttcaatgcaaattgtaaagactgaaaatgatgtgaccagagaagggacccctagatagtaagtactcaataaatgacagaagcagagtatagtatgaacctgtttcttgggaaaatagacttgaagttagacaagaatctatttaatcaaactctagatatgatgttttgctaacttttgttttttgttgctttggttttttggagtttttttgcacttcaagaagtctttttgatctgaggtagggtagtcaactctaatttattaagcatgaagtgattggttacaggtattttaacaagtatttggaggagtttggggaagttgaagtacgaacacattatttgaagtcactgttacagaggtgcactattttgtccttcctgatgtagccattagtgttcctacaagaaatctggattatcatgacagtttttttttcttttttcctttttctttttttaattttagatttaggggatacatgtgtgggtttgtgacatgggtatattgtgtaatggtgaggtttgggcttctactgaacccatcacccaaatggtgaacattgtattcagtcagtaatttttcagtcctcattcctctcccagcctcttcccttttgtattcctgggtgtctattatttccatctttgtttccatgtgtatccattgtttagctcccacttagaagtgaaaatgtcatattcaattttctgcttctgagttatttcacttaggataatggcctccagctccatccatgttgctgcaaaggacatgatttcattattttttatggctgcacagtattccatggtgttcatataccacaccacattttctttgtccaaccaacacatagattgttgagcacatagattgagtccatgactttgctattgtgaatagtgctgcaacaaacacacaaatgtaggtgtctttttgatatagttagttcttttcctttgggtagatacccagtaatgggattgctatatcaaatagtagttctcttttttgttctttaagaactctccatattgatttccataggggttgaactaatttacattcccaccagcagcgtataagcattcccttttctctgcaacctcaccgatatctaatattttttgactttttaatactagctattctaatttgtatgacttggtatctcattgtggttttaatttgcatctccctgatgattagtgatactgagcattttttcatttgctttttggccacttrtatgtctttttcttttcttttcttttcttttttttttttttagaagtgtctgttaatttcctttgcccacttttaatggagctatttgtttttttcttgttgatttaagtttcttatagtttctggatattagtcatttgtcagatgcacagttagcaaatattttctgtcattctgcagttgtctgtttattttgttaattgtttattttgctgtgcaaacgccgtttagtttaattaagtcccatttgttcatttttttttttttttttgcatttgcttttgcaattagtcttagtcattaattctttacctaggccaatgtcgagaataatttttcctaggttttctttttatggtttcaggtcttgcatttaagtctttaattgatcttgagttaatttttgtatatggtgacacatagggtccagtttcattcttccgctagccagttattaaatagggtgtcctttccccattgcttatttttattgactttgtcgaagattagttgtaggaatatggatttatttttgcattctctattttgtctcattgccttatgtgccatttttataccattaccatgctgttttagttactatagcctcatagtctcagagcatagtgtgaagtcaggtgatgtgatgcccccagcgttgatctttttgcttagaattgctttggttatttgggctcctttttgtttccatattaattttagaattgttttttctaattctgtgaaaaatgacattggtaatttgatagggattgcactgaatctgtagattgttttgggtagcatagtcattttaatgatattgattctttctatccatgagcatggaatgtttttccatttgtccatgtcatttatgatttctttcctcagtgttttgaagaaatcataatcaattcctggtagagatcttttacctccttggttaaatgtattcctaggtatttcacttttaatagttattttcttatgtatgtctaaattttaatcacagcaaatttatggtgtaatcctatcttaattagatggatgatgtcctttgttgggaatttaataaaatctaatactgcttagctggaccaagtggataagatgacatttgaatccatagtggaccttgtagcccttcttttatttgggtatctactatatagagaaaacattggtattctataaacatgcctaagatccattggagtatgtatggttagctctgtttattttctttttggttacaataaaaatacttaacattttcactgtaacctgtttggaaggaagagagtaagcaattttaaaaattaattcaacagagaaacatgtactactttttctgattaaaaaaaaaaagaagaagaagaaaagagcccacagcagctcagaagcctccaaaaatactcttttattttagaagctgaaaagggcagatctaactaatggtacaagacaaattgaaagtcctataaacaggaatagaatacttactctctttggttttgtttgcttctgaacaactggattcaaccttctttctttccccccagctcttaggcattgttgtgtcaggacagctatggttcaaattgggctgattttccagttctattaaacccttcatctgcatcgtggatcaaatacattaactagctgtctgcagtgcacagctggaaatcattctcttccacattttgctttgtgccatttttgttttataccaatatgctctgacacacccacatagctcaggatttcagcagtcaattatctccttttcttccttgataggtcttagaacattttaaattggtgtattctcttttgtcttttaaatattgaatcacttgcaaacatctctgcttgcatgaatatttttcaaaatgctccatagacctagaagctgaaatggaaagttagaatcattcaaacacaaattttgattttattcctttgagagatggtaggtgattggcatgaaatagcaggataaatattgtctaccaaaagtaagatgagagagagaggaagacagagagacagagacagaaaggataaggatcagccatgtattattgtaaacagtatatgatatcttagagattattttaaaatgaatatattgaagtgaattgttgcattgactgaatggcttttccatagaaagactccagctatcatcagttatcaattacattattggtggtctttacaaacttgactataaatgttgagacatttttcgagaaatacatacacatgtgtgtgtatgtgtgtgtataagtatctattggtatctccgyatgttagttaaaaatataataatatgccaagtacggacaatgaagacagctactccacaatattcatttaatttaatttttttttttttttttgagacggagtctcgctctgtcgcccaggctggatggagtgcagtggcgcgatctctgctcactgcaagctccgcctcccaggttcaygccattctcccgcctcagcctcccgagtagctgcaactacaggtgcttgccaccacacctggctaattttttgtatttttagtagagacagggtttcaccgtgttagccaggatggtcttgatctcctgacctcgtgatctgcccaccttggcctcccaaagtgtagtttaatatttaagctgataaaacaagaaaatatatttaaaaaatttttgctagactacattagaaagattttctttaaagatgtgagctagatagaggtcattttaaaatgatgatttatcaaattttacacagttaaagatagtgaaaataaagagcacattaaaaaataactagatggaaattttcactgtgaaacagaatttctgaagtgacactgtgttcacttctgatcatggtcattgtacaaccattgagtctttgtataattgctgtgagtagtgtcactaccattttcccttcactttttttctatagatatttaaatgaagcaactgtatacatatttattcattttgtcagttataatcaagttattctatcctaatctttctatcttcactctgtgtgtgagtctgtgtgtacataacatgtgatatttatatccatcttccttcttgatcatgagcaacaggaaccaccaatactattttacttaagctgaaatacatttgaaatataccatataacttgcagagttgatgggaaaatttgaaaaccagggtgagaagatggcaggcatcaaggtcatccctaggttttgatacctgtacagaatagtcattgcttactgctgccgccatcactactttctctttcattcctctgatatgactatctctactcctatcattatctgattttccttatctctctagtctgtgcttcacatgcttaatattcaaattcctaggccaaagtcacatgtacatgccctaactgctatagggtagggagaagaaaggtctcctctatttacatttccttggcaggaggtaggacactgcataccctcaatagtagacacaatgccaattactcaagaaaagaaatggaggatgaatgttggacagccaagaaatgatgaaggtctgccacatttttcatataggttggctttttctttgaatgttttcacttagctagtgtaccaaaacagttctacatttccaccaaattaaaggtctgattagtttaatgyccttcatttgccatatttttctcaagaaagattatacagtgcatgaactcattcttattcagtaaatttaaatttgagtggcattatattccaactagtgctatccatgccctcagtaattttatagacttgagagccaccgtaaaaaatactaaagttacagtatgatgagggttctactaaatatcaactaagtaatatacggacaccaagaaagaaacagaaaattctgtgtggcaaagtcagaaaacactttcacagagcagggaatatttgagctatgaaagatgaacatgcaacaaaaagggagaacattctttgttgaagggacaagataatgtcatcacaaagcattttcaaaatgcctgctatatttgtaaataggaagagatcagttcactagatgtataagaaggcatgaaggaggatagcaacagwtgagttcagacaggtagaaagcaggcctgattataaatgtttagatcaccaaggagtttgtctacgacactacaggtgacaggcaactcacaaaagtctttaaaaaagaaagtgagttttagggaagataatttcaacaacaatggggaagattaatgggagtagagtcacgcaggaagactaggaagggcwgtggtgctcaacctgtttggcaccagggaccagttttgtggaagacaatttttccattgacagggataggggtggatggtttcaggatgaaactgttccacctcagatcatcagccattagattcttataagtagctcacaacctagatccctcgcatgcacagttcacaatatggttcacattcctgtgagagtctaatgctgttgcttatctgacaggaggcagagctcaggtggtaatgcttgtttgccagccactcacttcctgctgtgcagccctgttcctaacaggccacaggctggtactggtctgcagccctggggttggggaccccgggttaggatgctactgtaataaatgtaaagtaaggttaggatatctgaatataaatgttgatgtgtktgtgtggcggggagcggtgtgtgtagctgaatttgagrtagagacaaaaagtaattaaactggaagcagaaatcttagaatggggaaaagtmagrcatatttgttcacaaagtatcttttaacattttctggtttctgtggagtcacattttattaatgctggttgacatttatctacctagaaaaaaatgacagaaatttcaggaacaaaggtgactatgaattaggtaccaatatttttgtggatgatcttcatgaagtcagccaataatggagatgagtatgtggaaaggatggattatttggactttttgaaaagaagttattgggtgaacatgatggctcatgcctgtaatctcaacagtttgggaggttgaggtgggaggatcacttgaggccaggagtttgagatmaacttgggcaacagagcaagatccatctttacaataattaaaaaaaaaatagaaattagctgtatgtgatggcttgcacctgtagttctagctactcaggatgctcaggcaagaggatcacttgagcctaggaggcagaggcttcagtgtgccatgatcatgccactgcactccagcctgggcaacaagagtgagaccctgtcttaaaaaaattaaacaaattaaaaagaaatgaagttattgagtgacagttaaagaaactgatttgcaagtggccttcaggaggcagaagraggctacttgtctttccccagtgattttatgaatccattgaggagatctgcagaagtgttgtcactgctggagaaaaccaaggcttcacttgcaaaaaggagtactttcttayaaytgagaaatttggaaatatatcataggacttgtaaagctatgatggaagttagcccatgagtgtgtttacagaaggcagagctagatggcataagactcagggatgatgcaggaggtgataaatrtttttgtttagagtagtgagaagagtgaaacacagtagatctttaataataaaattttcactcatttggaattatgaaaattgtgtttgaaaaccagctgtgccatttaaattctgggtatatgtttcttcatttgtaaaattcaagtttgaactaggcttctttgaactaaattcttcttgccaccagacaacaaccttcttcttcatcacctagaggaacattgcctgaagcctaaggaagcagccttccctgtgccacacagaagaccccttaattgttcaatgaatttctcattgacttgtgtagtgcttcaaaagaaaacacttacacatcaaacatgattctaagtcaaagttcttcatttatatgagattaaagaactggaaaactgtacaagagaaatagtcacctgctgattgcaggcctgtgggtttcttggaaaaactcagcaattttgcttatccaggactatctttttgcccagttcctctgattctgaaggaagttgaaaagatagttttcctttgctgtatccaacatccttttctacatttgatttaagaaatgtcaatttaactttttattgatactgatattgaaaatacataaaatccaaagaatgagataaatcttacatatgtgtcatatttctatagatttttttgaccaacattttattttgaaaattttcatgcacttggtaaggttgaaagaatcatacagtgaacactatgtactcgaaatctagattctaaaattaggccaagcatagtggctgatgcctgtaatcccagggatttgggaggctgaggtgggagcattgcctgagggcaggattttaagaccagcatgggcaacatagtgagaccatgtctctaccaaaaaaaagtaaggccagcacggtgctgcatgcctgtagttacagctactcaggaagctgaggcaggaggattgcttgagcccaggagttcaaggttacagtgaagtattataatcatgctattgcactccaacctgggcaacagaatgagaccctgtctcaaaaaaaaaaaaaaatagttaatgccaggcgtggtgactcatgcctgtaatcctaacactttcagaggctgaggcaggtggatcagttgaggtcaggagttcaaaaccagcctggctgatatggcaaaaccccgtctctactaaaaatacaaaaattagctgggcgtggtggcaggctcctgtaatcccagctactcgggaggctgaggcaggagaatcacttgaacctgagaggcggaggttgcagtgagttgggatcatactactgcactccatcctgggcaacagagcgagactccatgtcaataatagtaataataataatgataaattaatttaacatgtttgagtagggaggagatatgtgctttatcacatatctatccatctgaacatatctacccataaatccattttatcttttaatatactgcaaacctcattcctatacacatgatcatgaatatcattaactggagttaaatactgctaatttttttcaagctcaaatttatctacattgaaatgcataaattatcaccccgtgtaacattcactcactgaatgtaatatttaattaacaaatacatacaccattataatacaaactgctatcaagaatattatcatcatcccagaaattttctttatgcctcttcccagtcagtctctgcccccaagctcccaaaggcaaccatttttcctgttttattttcctaaaagattaggtatgtttaaaaagatcatataaatgaataatagagtatccactctttggtgtaaacttatattatgtggcataatcctttttggagtcatcagcattgttgtgtgtatcagtaatttgttccatttttatgttgaatagtatttcattgtttaaatacaccacagtttttgtatcatttcccccattcatggaaacctaaggtgtttccaggtttggctattatgataaaaacttctatgaacatttttgtttaggtctttttaaggacatgtaatgtcatttatcttggatatgtacctaacaggggaaaatttgaaggacttttatatttattaaaaactacctgttttctaaaagggttgtgctaatttacattcccaacagcaatgcagcagacttttgattgttttacaaactttttaatatttgatgttgtcaatctttttaatataatgccatttaatctaaaacatgagaactttgtcaatatataggtccagttactgtgatctctcacccaccatttctttattatagttgtcatatatattctatttacaaacatatgcaatgatgtgattttttgccttaaatattaatatgcatttaaaagaatttaacagggaaaaagtctattgacatcaaatgtacttatactgtcttttatcatctccaattttctattaatcacatgtagtggatttttttttcattctagatactgtgttacatttttcagtcacagaatttatattcaatattttttgttgttaccatttcttttttgctacaagaattttcgtatgtgtgtatgtccttgagtatagtttaaaagctgcttgaagatgcttgtttgcttattccaacatctggttgatctcagtacaatctccgttgattgctttttctcataagtatgagttactttttattgcttccttgtatgtctagtatttttttttaattgcaacctggatgtcatgaataatagcacattgtagaaactctgggttttgttatgttcctctgaagagcactcacccattcttttttgttgtcgcatcagttggttaacttgactgggctcaaagtcccaacttttttctttcctgtagagtgcagaacctaaaatctctgttcagtttttcagccctagctgggctacttggaatctgactagggcaggtgtaggtctggcatcagtgagcaatttggacagagtttatgcacagattgaggctccctttctgtggacctctctttacacctgctgtggctatttttagttttgttcactagttcttcaagccagtaaaactgtgggtttctatttgagttttagccattctggagctcatccagtgccttttccttctaagtattcatagtcttcctggcttacctgttcttaggtgcactccagatatctggtgtttgctgtgtgtatatatatatatatacacacacatatacatacacacaccaaatatatacacagaatttatagctgttatctctgggagctttgctccaataaaagctacttcacaattattaaaaatagaacctccataagtagattttaaaatgtttctgccatttgaaaccaaaaagtgggattttgagaatgtagatcatcaaaatcatgccaacatgtgtgaacatactacattatttgagaaagcaaatatggtataaacacatccaaataaaaacagtggaagttaggtgatttttttcaaatgtttgccatattgtagcagaatttcagtttttcaaattttcacatgatatacacttagcctttttctagatatcctattaccatatatatatatatacactatagaacagaatatattattctatatataatatgaatattctaatctctaataaaatacatagtataaacagaatattgtttgatttttgttcagacattgttccttataaccagaactccaactaaacttatttagtctagtgctattcagaaaaaaaatgtcaatcatagttgtatggataatgatcactggcttttatgtcattaacattacaggaccttaagttgagttaagaagatgtaagtcaatactctctaaaggttcatcagctatttatagttaatttacactcctaatgtttacataatcttaaccaagtaacacatattgaatatggaaataaatattgccctggtgcttttgaatgggaataagtaggcacagcataatagatttaacatataatgaaaatgggttgcaatctataataagacatgctgaagattcaataaaagctcagatattgattcattcttcaaattggtcattcattagcaactaattggagacctttgctgaccaatatgcttaacygatttttaaaaataaacagcaaaatagcaatgaaatttcatawagcaactattccctgaccataaaacaaggcaattaaattgtgcaaaggttaattttgagcacataatcagtaactgtaatagaaacaaatcaaagaaaagaattgaaagatcctaaatgtaaattttattagtgtctttagttttatggttagaaaactctatgaagcaacaatggcatggtgagggataagttatttgttttattaaagatttaaataagctttaccaaggaccagattttggttctactttaggccctgacaagaagtcttgtaagctttttaaagagctcacttcaaatcatagttatcaatcttactaattcataactttgtacatatcatttatcttctctgagctgcacttccttcatttttataaagtggaaagaattaataaaatttatacaatgggttatatgggaattaaataatatgaagaatatagaatagcttcagaatcaatgtttcttgtactctgtaatccctttgtagctgtatgcttttgctctctttatttatttaattatgtgggataattggtacataatccaattctatattttctgaacatacaacataaagaaaatactttatccctsgtctcttttcttggcttcctcccatgattgctgaggcctgggaaagtacaggcctggcctgctccaatcaggtctttcagggcagaccaaagcagggcacagggagtcttacccatacctgcaaaacaggaatgaggccatggtcagggtcagaactagtcagtgctgagggaggaggcaaaaatccgagagaaaaagtgacaatgccctggtgaagttttagaaatgttagcacctgcctgagatggcttttgtgtaagtaagctggctgtctttgaagggggcagatggagctagactgcttaaactcatcatataagcgagcaagagaagtataattttgctctcctttaaacagaattcccagcatgtctctttgttcttactacttatttttctatactgtaaattaaatttttaaagaactggagaaaagtccactaaaacaaattactaacagtgacaaataagcagtgctttatgttaatatgtaagtgcaccattgtattagtccattctcatgctactaataaagacatacccaagactggataatttatagagaaaaataggtttaatagactcacagttccacatggctggggaggtctcacaatcatggtggaaggcaaagaagtaacaaaggcaggtcttacatggtggcaggcaagagagcatgtgcaggggaactgcactttataaaatcgccagatattatgagacttatttactatcacgagaacagcatgagaaaaacctgccctcatgattcaaatacctcccaacgtgtccctcccacaacacatggggattacaggcgctacaattcaagatgagatttgggtagggacacagccaaaccatatccaccattatgtttattcaatgtgtaacctatatgtatctgtatctatagccacatctatatccagacaattacataatcttatatgttgaaacaattacagattcaagtactctgactcactcatcatttacataagctttcagcagagagaccatacttatatgccattccctctgcctgatacgtttgttttttctttcttcattttccctaacagataaacttctatttctccttgaaaattcagcwcaagattacttcccatgataagcccatcttagtaatatttttattctcagatcctttactgtctggcataatatgtgctcaaaacatatttgatgaaggaatagttgtaccrttaaatgcaaaatggtgatgaatgacaaaatagaaagatatacagacaaactttatttaatcgcatatcatttattaacctagaaaataaaatgtctaagatagataatggcgtggagaccatctaattatttttaaatttgtaacctgacaaacgtcacaaaattgttaggaagttttcactaaggcttatatcatggaaaagataaaaaaaaataaggtaaaaacttttaaatggtactctactttttataaaacattacattttctaatgaaataaataatactttatgaatgtttaatatttctctaaccaacaattacattagctttccttatgtcacattgacagaatgtctcattgtgttggggccagagagcacagagatgaggggggaataaatgtatcaggaacaataaatgagatagtgattaagtgaaaaagtaagtaccattggcaaatcaggaaaaattgggaacctcaactttcagctgaagaaaaacacaaggcaggaggccagatgagagttgggggtcactattttggaggaacaggattaagggatttttaaagacatatgtataaggagggagaaaagaaagaaaagattctttgggggcagctctttgggagatcttaagaatgactgagacaagaactgagttgtcacttgatcttttgaattcatttacctgtggaattttttggagtgattacaacaaagatttaaactatttataattgcaatttttactgtactattatctttttttaacagaaaagaaaacttaatagtcaatacatactctaataatcaaatattataaaaatcttcctaatttactttcttttttaattttttgtttctttcaatgcaattctaaggccaaccaggtccgcaaggtagcactagatctatgctggtttcataaaacattgtagatgccattcagtagagtgattaagaggatagactctggagccagattgctttggttcaaatcatagctctgctacttgctagctgtaatcaggrgcgagttacttaacacctctctgccttcttaataaaatagagataatagtggtatgaagctcrtgtggatgttttgtgtagcaaatcattgtaggaacagtgtctgacaatagtgcttggcacattgcaaacattcaacgatgctggctattatgattataattattattattatatgcagatgatacagacaaacatttatgagtccaatatttataatctaattattcgtttattttacaaatacattgagtgcctactctgtccctactatgtgccaagctttgaggataaggcagaaaatacaaattcaagatctagagatcttggtaaaaaaggcagaaaacacaaactcaagatctagggatctcagtaaaatatcaagccatgagatttagtcaggaaggtttcttttttcttttctttctttctttctttctttctttctttctttctttctttctttctttccttccttccttccttccttccttccttccttccttcctttctttctttctctctctctctctctttctttctccttccttctttgcttccttccttcctttctctctctctctctctctctctttcttgacagagtcttcctctgtctcccaggctggagtgcagtgatgtgatctcagctcactgcaacctccacctcccgggctcaagcaattctcctgcctcaggtttccaagtagctgggattacagatgcccaccaccacgccctgctaatttttgtatttttagtagagacagggtttcaccatgttggccagactggtcttgaactcctgacctcaagtgatccgcccacctcagcctcccaaagtgctgggattacaggcgtgagtcaccacacccggcgaggaatgactttctatcagaagttgaattgatatagacctacttggcacatatatagagctgaaacaacctagatggtcggcatattttctccataaatagagtcaaattatctgtaatttcaaatgtactttctccaagaacagatttttcagttaaagagtggcttttgatgagtgactttgctatactgttattgaaaaagggtctataatatgcaaatgctagacatgtatgaagcacaattgacattaacttacaggaagaaaagagactgaatttggttctcagagggaataaaaaaatctccccagccctacacttagatggacctctgagatcgtatctatgaaagttaaaaacttctattatatctaagacataattactggtgtatgatcatggaccactataatggcttgtttctggcaatatattgctttattatattgctggatggcatggaaagcagtaaaaattggtattccaaagtaaacattatctatcttctctagtctgggataaagaagttttaataattatttacactgaaggataattagagcatgaaatgaccatgaaaaaatatatttgcatagttgtgcagaaacattaacatgcaattatgtcttgatactagatacaaaatatctgaaatggaagatggaagatttagtgggatcttttaccaataacttcaacagaagatttgtgttttagaatgtgtcctagagacaggaccttcttcctagctaaatattagagataaaaaattaaaaagaggcttaaagtccatacttaagacccagaaagaaaaatagtattcttttgataacacatagtatttatgtagtatactgaattgtcaggtatttatcattaattatctcatgttgggttactttaatgctccgaaraatattttatctcaattgcttttaaaatgtatcaaaatcctaactttgtttctggtctacacaccttcatttgtccatctttttcaggtttattccctgctgtcctgaatcttgcttctaatgctcttatyacgaccaatgcaacatgtggagaaaaaggacctgaaatgtactgcaaattggtagaacatgtccctgggcagcctgtgaggaacccgcagtgtcgaatctgcaatcaaaacagcagcaatccaaaccgtatgtattttagtgtgtaggtgtgtggcgctgggtaggatctataattgtgagatgttgaggccaagttgcattaaattcaagggtttgtaatactaagaattcctagaattctttttaccattaagagcttcttcctggcccctctctgtcattcagcaaacattattggagttcctgctatgtgctaagtacagtgattggagatgattcgccagctgaaggcctgtggcagtcattgggtttactaactccagataccaaagtggtttctgagggtgtggttattaactcaggctatcatcattcattggtaatttatgtgccagatattgtgcctgagatccaggaggaataaggtaggatatcgtctttgagctactgatatatagtgtggtaagtacaaaggaaagaatgagcacagcgttctgcagaagagagaggatggccacaaaggcttggtgtaagtaaaggcttgccagaaggagcgatatccaagctgatgaccaaggacatgagctaaacaagggtatgagataaacaggtaaagaggtgagggaggggaagaggagaagtcatgccaggaagagaaatcagaattagacagaaaatcctagttactcggggagctacaagtaggaatgactagaactgamagtgccaaagggcagagagtagagatgagactagagcaaaaggctggagccagattatgaaggcatttaacaaccacaggagaagtgatttagggagaggcaccatgtaaagccctctttccagcctctatgaaccacagtgatacctcagactcattgatgtatttattcaacaggcctttgaacacctcctactagcaaagcattgtattggagcataatgttaaattacacataacccctgattcagaggacctagaggggaaatagaggcaaaagaaaagtaaattcagtgctaaaataacatgaatgctccatgtagatgctaaagtcatctaaagatttctggctaagaaatctttatatctatatatctctatctgtatctatctttctgacatgccttcttctcttctcctcgcttacctctctctctctgtatatatataatatatatataaaatatatatagcaggtagatatatacttatatgtaatctacataaaggtaaaaatatatattatttatatttatttatattatttttaatgaacagatatattattttatttttattttgtttttgaggcagaatctcactctgtcacccaggctggagtgcagtggtgcgatctcagctcactgcaaccgccatctcccgggttcaagcrattctcctgcctcagcctcccgagtagctgggattacaggcacgtgacaccatgcctggctattttttgtatttcaagtagaaatggggttttaccatgttggccaggctggtctcaaactcctgacctcaagtgatccacccgcttcagcctcccaatagatatattttttgttaatattatttcatatataatatattaaaaggtagatatatattatatgtagagagakatattttacatatctatagatcgatctatagatatctatatctatagatcgatctatagatatctatatctatagatagatatatagaggccagaaagtaaatgaattgatggattattagtttcaggttcattaggcaagatgataaagcctgatggagggaaaccaccattggttcagagactggtggccttgaaaatttcatgaagaatatgagaaagcccaggggcatgaacggagttgtggggaggaggtgcgagtgtgtagatgtgtgtttaggatgggctgtgcagacggggagaattagagagataaaatatgtaaaaccataagtgtgtgtatatgtatacaggtatatatatatatgtagagagagagagagaaaggaggtaataacgtgaatacttaatgccaagtgaggtgaactatgatgggggtaaagcttcacaattatattattttaaaatttgcttagtatttcttctcctttttttttttttttttttaggcagagtttcgctctgtcgcccaggctgcagtgcagtggcgcgatctcggctcactgcaagctccgcctcccgggttcacgccattctcttgcctcagcctccccagcagctgggactgcaggcgcacgttgccacgcccggctaattcttttttttttttttttgtatttttagttgagacggggtttcaccgtgttagctagcacggtctcaatctcctgatctcgtgatatgcccgcctcggcctcccaaagtgctgggattacaggcgtgagccaccgcgcccggccttttctctgtctttttaaatagaccttatttttagagcagtttgaggttcacagcaaaattaagaggaaagtacagaaattccccatatttcccccrccccaacacatgcgtggacttctccattaccaaaatccccctccagagtgctacatttgttacagtccatgaacctacattgacaacagcatcacccaaacttcatagactgcattagggtttacttttggtggtgtaccttttatgggtttggacaaacttataatgatatatatctaccattagagtatcacgcaaagtagtttcattgctcttttttttttaaattataaaatgtataaaatgagagctttttctcacaatttacattttttatcccaaaaagaaaattgaaaggcgttgtgccttttttcttggagctggttaaagagaggcatgcatagtcccctcattatataatttaggaatgcagaaaacattagtatatttcagcaattgacacttgtttgattaaaattagtggtcgtgtgtatcacagaatatcagaaaacatgttaagacaccaaagaaggcaaccaccagaaacctttcctattaatgactctggttaatttctttcttttttgttttgttttgttttgttttattttgagacggagttttgctcttgttgcccaggctggagtgcaatggcacgacctcggctcaccgcaacctccgcctcccgggttcaagagattcttctgcctcagcctcctgagaggcatgcgccaccatgcccggctaattttgtatttttagtagagacgaggtttctccatgttggttaggctggtcccgaactccagacctcagttgatccaactgcctcggcctcccaragtgctgggattacagacatgagccactgcgcccggccgactctggtgaatttctcggatgtaagttgttatggtatgtgtgtaggagtggggagtatagttgcatacccatgtgtttgctagctcttgtatagaatgtaagaggaaaggacatatgtcagagccctttgcttttatgtaaaagccaagggagttcaggtaaatggagtcaagrcaataaagggaaacagatttcaagggaaaaaaatcaggaaaatgaggcattaggtatgtgatgaaggaaagaatttttaggaagaaaaagtaacagttttaaatgcttcgaagataattgagtaagaaaagcataaaataggtttcccttgcttttgacaacatggccatccattgaacacctttstaaagtactcagcagattcatagtggcaagaggcacactgaagaggtaataaatgartgatgaagaagaagaggggactatagaaatattctgtcaagtatccttgatgtgaaagagaatgaaggacagaggaggttgtggagttgcaaaggttttcaaagayaagagacatttgagttggtttagatgcttgkggggaaaggcagggaagttgaagaccaagtggtggtgggcatggtgtctctctagaagtaaaaacatatgggtcattaagcataggcaaaaaccttatattagaagatacatacttttaactcaccaaatcagaaagaagaaagaatgaatagcagcagtcagcagaaagtgttgggagaaatttcttatttgatgatcttgatttcttcattaagatgtaaatctgggttacctgctgaggaaagaagcaaacatttagattatgagcctctcaggggaataggaggggatcactgagccgtaatcagaataaagyggcaattccatatggagtaaaataaagaatcaaacgtgtggactgatactcttggagcattacagggaaagtagaatggaaagagaagatggcaagaaaattgaagaaaaggtcagaaagtaaatgaattgatggattattagtttcaggttcattaggcaagatgacaaagcctgatggagggaaactaccattggttcagggactggtggccttgaaaatttcatagagaatgtgagaaagcccaggggcatgaacggagttgtggggaggaggtgcgagtgtgtagacgtgtatttaggatggactgtgcagacagggagaattagagagataaaatatgtaaaaccataagtgtgtgtatatgtatgcaggtatatacatatacttatgtatttattaaatatttaaattaaacatgaaatatatgatatgtaatataatatacttatataatattaaataaatttatataaataatatacacatataagtataaatattatgtatatataataatatgtacctatgtgtatataatatttacactagaaaggcaagaaataagaaaatgtatccaatcataaaaatgggatggaggaatgatacaaagattggggtagaaaataatttagttctccactcaattatttttattcttggctggaaaaatggatgagatgcattgtcagattgagtccaaaagctattctgtctttcaccctcttgaaagttctacattcagagtatcttttgtctcgtggaagataaatatattcagccaatactatccatgttttcacattgaaaccaaaaatgaatcaattatttcagtaaagcaaggtgtatataagttatgatttgtatttccccatttttatttacctgtagtgttttctaaaccagtcacagtctggatttactttacattattattatttattattatttwttattattattattattattattattatttgagatggagtctcactctgtcacccgggctggagtgcagtggcacaatcttggctcactgcaaccttcgcctcccaggttcaagcgattctcaagcctcagcctcctgagtagctgggactacacgcgtgtgccactgcgtctggctaatttttttgtatttttagtagagatggagtttcaccgtgttggccaggctggtcttgaactctcgacttcacatgatctacctgccttggcctcccaaagtgctgggattacaggtgtgagccaccgcgcctggcctgcatgattatttttaaatgaccagattcattccacatttccagattatgctttgatactagaaatttagaaagaataaaaccccacaagaataaaaatctagcaatcaactgcatgaatatattttagtaaaagttggagcaacagatgataaaattccacaaattcagtgaactctgagaataaatatggaaggtccgcagttaattaycctgcaaagaaaacgaaccttgaactttctgttaatagactttgcttcccaattaaaagctagcagtttgaaaggtttacctcatcagcgattccctatccagttttcagatgcagttagcccttggattgacttgcatatttatccctgttgaggatgttatacgtttctatctccttttaaataagggaactttgccaacaattcgtcagtatttgcaaattaattatgattaaactttcataatagggattatggttaattgttgattcatctcccagtcctcctttttgtgactaattctcttatcagtttgacctgaggtggcagataccacaatttcctattagacaacttctctcacaattacytaagagccatgaatttgatttagaaatggggttgtatgtgtgtktttttctatcacatattaaacgcacaatctgtaaaaaagattcaggaggatgtttgggaaatgttttctgtgatatttatttttcttcagaagaagtgccaacaatatttcatttatggttttgattccccatatgccaatttcagcaccctcttatttcaccagggtcatttatttggtatttagttatgcttctgatatttgctgtcatcataaagacctgacatcttccctagcttcaaaagaacaatttgactaatgctaacatttaaatatattcagaaattttacttttcattaatgagacaggaagcctcatctctatggactgctaacatgatgatttggtggaaaataaagtccagccagctgttaagttgaattaaaaaatttaccaataataatggaatatttttgccctgtcttgtacagtcatattaagatttgcaatatgaatatccatatctggaataggactataataccataaatagcttaaaacatagtcttcatgttttcagtaaatgttatgacagtgtattatatattaattataaattaatatgtaatacaaatcttcacaaatctgaaaatgccaaatttagtgaatattcagctttttaaattttgaaatggagtctcactctgtcacctaggctggagtgcaatggcgtgatcttggctcactgcaacctctacctcctgggttcaagtgattctcctgcctcagcctcccaagtagctgggaatacaggcaccygccaccatgcctgtgctattttttttttttttcatagagatggggtttcactgtgttggccaggctggtcttgaactcctgacctcaggtgatctgcccacctcagcctcccaaagtgctgggattacaggtgtgagccactgcacctggccaatattcagcttttaataaaatttttcttttaaagatgattttactttctatcagattcctattgcattgaggacttagttttgctttatttttattgktttttcaaatgttttaccaagtacaacttgtctctaagattcaaaacagtgtacattttgaatagatgtatcatttattttatgtatatgcataataatggttagaatgctcacagttatactgttcatcagtaaccctgtgaatacagggttcacatccaagatgttctcactggtccgtggcaaagtaagaaaatgagaacaactttccacatttttcataaaaatagaaaggatacaatttaaataattgtcckccawtttgatattatgggttttaaaaactaatgatggtttttaaatgccctttgtttcatgaaataataatgatgctttattaaatgatagaaatatattggaggttattattacttggaaaaactaagagctagaactcctatatcaatttcacaaatcgatcacacatttatttttaatttcatattttttctctgaaaattatgaatctggaaaccactgctgtgagcggaattttgttattcctagatcagagatgacacataatgttgaatgatttgtctgtggtcagttacgtactaagtggtggagccaggaggaatatcagctacccgtgtgccagcacctcatggtccccctctcatcaccattattattagaatacatggctagattgcaatattaggtaggcaaattgagagtccatgtttgttcctcatagcaatgtgatttgttcmttatgtgaggtattccttcaaatttaaaaaggattgtgttctaatctaaaaggtcattcataagccactcattcgaaacatcttcccagatacttagttttatgaaattctcaagactgacaccccaaagcatccttaatctataataaacacmggagtacagggaagctcacctccactttgtttacatttctatgggcaaatgtgccgwctttctagtgagatgtgaggaatttaagtgcccttactgcagccttgggaatagaaacaggatcatcaacagcctccactcctgccatcctcacccatgcatgagcaaggcctgtttagagagggagaaagaaaaagaccttatattacttggaaaatgagaagcaaagattttagacaagaaccaatgactgggaaccaaaatgcaatgagggcttggcagcccaggagtagtggctgctgttgtgagacacatggagctaaaatgggagagatgagaaactgtgagctttgaggattgtaagaaggaagggagctgcaacaaaggtcacaggtctgtggggttgccacgcctcctattttctatctctaatctcccttttgattttcacaattggtcctgttcttatatgtctgggtgaaagtaagggaagatctgtggtttttggtaggatagagtttcatgtgccatcatctccttccttgccattattgtaaagattcctccactagagttagtgatgatggcaacagacaaatgccggatgagaggtttgggttatctctcatattattaaatagtgatagaaaattggcaagttaaagactggccgcaaaaagcttctgtaagggccaagggaaaacttctcttttgccctctgaaggtttgctgaaaaatcaactgaaaaaagttagcttggtaggtgaaaggcatacaaaatgtattttaacatgcatagcatggaagaatcacaggaggatgattacccaataacccaataggagcatagatgtagatatacccttcttcaygggggagggaagatggggaaaatatggcaatttggaaaatagtaaatgattttttaggggaattcaagaacctacaatggcctgggacaaagtctgttgggcccacagagcagatagtggtttgtaacaaaagtctgttcaggtgtgccgacagacttcagtctctcttcatgtgaaatgagttaaattaatgaaaacttaagcaagagggccagaggaaacttttcctcctggtgggatcagactgtaagtagatacgggagtatcagagtaaaacttatttcagcatttgctggtctccaagagcctttaatttaaaataatcagcataccagcatgctatattttcgggtattggtttctgagcctcaatatctcatagaatgaatttaacagcattttatgttaaaaccagatatatattggactccctacgtcttaataataatgaatgtgtcagaagggcaagtgttcaagtgtatttcaaccacaagtcaggattttatgtttctgttaacaaggttgatggcatactagagctgtctcaatagttagttgttgcttttttgaatgattgacaagtcaattagattttaacattatatctttacacttaatttctgtagttacctttaaaattgcccattttggttaatggccagagtgctgaccagctcattcccctgcagcctaagcatttaaacatttcctgctaccttgtatggtgctatgagacagctgtcattgaagaaattctgttgagaatctgaattactctccttytgtattattttaatgtttgatattcacatgatggttgttttaaccrtttttttttactttaaagaaaaagctataaactagttatatgatcttttcttcttcctttcatatgatgctgctaactcaatagagagmcacccgattacaaatgctattgatggaaagaacacttggtggcagagtcccagtattaagaatggaatcgaataccattatgtgacaattacmctggatttacagcaggtatagttcctctttttttgtcatttccacttttgaaattgcattttacatttgctatttgtttagttagtggtttgtgggtgaaaggatactctttcttatcactctccattgttttcttgataagatgaacaaagggtcctattcatatagcgtattgttatttacgagtattcagcatttaattataaagcacaattcaaatggaagcacgtgaagagcttagaaatgaattaggtgctaactctgttttagctagctggacttaatgatgaaaatatggatcaataaaattttacataacaaaaatataatagtatcatttttaacttttaaaataatacattgctcccactgtgctgatggtgtgtgcacttaaaggttcttggataacaaggctcttgagcaaattgcctctcattactgagagctgagaaagttttgacagttgctttcaagttaaacttgggtgactaaatgaagtaacaagctttgtagttatacaaaattgatgccggaagttgttcaagtttgtcttgcataggcctgggtgccttctatgcttaatctctttcttccttctcttcacaatattcaggtcaggctgaagttattaatcaggaatcgccagcacctcaaattatttaggcttgcaattaggatggaaagtggacaaatgccacattccatcctatttgtatgcctaaataatgtgcaggggtgatggtcaggatagttaatgacagacacyatacactgtaaaggtcatggtttttataagttatcactgtgtggggaagcccccagccagtgggccagatcagcacaagacattttcctaatggatgccatttgccaccagcatgagtacaatctccctcctccagtgtctaggttcattttggtgagggctgcatatattcaagagccacagaaagctggctggagcaaacaagctggyggattgcacggtagacctgccttccacccatatgggcctcctcgggatatgaggaactggtggcggcaggggctcagtgctgcagcttatatcaccaaatggcatggacttatttctaccctcactaatatacagcagctgaatgtcagtcctgagttaataatatttctcaggaagtctcagagcactatcagagaatggcagggcaagctaccacactgatcaatcatgctttaggaaaattaatcctgtgcatgaatcccctggggatcttagcctcaaaatggactgcataccactcctgataaagacaactttgtcctttattggtcacaagagttctcccccttcatgtgatcattgaaagtctagtctcccaatcaagagtgagtctgctgtgcattgactcaggtcatctccagggacaggcaatcaataaataatgatgctttattgttctggtttattctccatttattcttttagattgcacatagaacaatggggtcaattattaatataatttgcacaaatcacttatagtactctttgagctgaacagcaatattatttacctgttatcaaacatggcagcaattttcccctcctaatttacaactggatggcgcaaccacaagtttttactaaatcatttctaacttgcctgtttttatcaattcagcaagtcaaagagtttacctgaaagcctatttttcagtgatgtcattgatattttcctaaatttactttgcatactcactcatccattcccacacagtatcttaagaattatgtggatttgtcgttctgttttctcttcctcccatttagtttaatggaggtaagatgagtgaatatgccaagacatattttatgcttcattcatcataacaaagtgccagaattctgtatataacccaggtctacctgactccaaagtctgaaattcaccaagtggaattggtacagagcatatgtgttcaaattgtcccatattccaggatggtgtccatccatatccttatttattccagctttctatttcctgaaaatcaacctactgtgtgtgtagaagaaggggaattcaagtaatctctaaaaatgtaataaatccttatttctacttgactcaagattttaatttagtcagttatttagtgatgtgaaaagttaaacaggttttgtaatcaagtttcgtgatggaacttctcagacaagaaagagcttcagacttccaatttggcctcaggctttggaataacaaactgtgagacatgtttataatacttattcagctatggatggtatattgtactgcactggcaacagagaaaatgtggacattcttattatgtaactcctcacaataatcctgaataaaccagctaatattaatattcctattgcatagttgaagaacactgtgctttagaaaagttcagtgacttggccttctttctaaagcttattatgggcagggctggggcaacatgaatagtctgaatccagacccaaatacactatcttttctaatgggtatctgaagacataatcctagggagctcaggataatttttattatatattttcaagggctccaaatgtagttcaggttcaagaaatattgcactatcttctcctggcttctatgggataatatagccaacaacctgtttcgttataaagcaggggactagaaccctcattttctagtatactctagtgtgcctctaaaatggcaaagcttctgtcttttctacctaccgcatgaaggattaataggttattcaaaataagatgagctattatccaactgggattaaaaggcagtaaaattataatgaataggtaaatatcactaaatgtttgtttgtcatttattcagcaagagacttgaccatttattagttcttcttttgtataaatttcaacaagtgccagtattgttgttgataaatgcttggctcctctgtgacacattttcataaattagtatcttaaacataacagaaacgattgcatttatttgattaaatcactatagattacagtgggtttttttttttttttttttacattttaacattcaagataagcactagaaaaaataccaatttgtttggaagaaagtagctacttattttataagtagattgttcttagatacgtattactaagggattattaacttttctcattctatttactcatagcatattttgagcaagtgatttaatcatgctgtgcctcaacttctagattagcagactaaatattacaatatcttggcaagaaaattaaagtaatgataatggcaatatagcaactaaattccatctcacaattacagctattaaaaggatcyagagtcagcatgaacttaaagaaaagcttaactgttccagtgacgtgtatataaaaactcaatataattgcgaacaaaaatatacaacaatttaaaggagacagtaatagggactcaaacgttaataagatgtctaaaacattctattttagtctttttcctaccagatttcaccagaatatgtcattatgtctgattttatttatttcttttaaaatctagccattatctccgtcatgccctttgatttgtttcagaagaaagctgattggcaggcggggtaaaacagagggrggcagcttttcagtagacttttcaaacacatattgaggtgatactcactcctggctaatccaggaatgccattaattagttaagctcatgtcttaactaggagtcttctcctcaataagcaattcacttctcttcctggtctatccctcaaaactaagaatgcgtttaccaaacaagattatcttacagctacagagatcacactccacatattcttaacctaaatattttattcactgatcttgcagagaaaaatttgtttggacaagttaacagttttaactggaatttatgttttaggaggaggataaactactatttctatgcaaatattactatacttttagaatccatgtgaatagtataaaatgatttttctctaaagcctagaatcattaatgtaatggttaaacatttctgcaataataaaacataaaatacgtggaaatactttatatattcaagttttaacaatcatttaaacatattaaaggtgatccaattttcagtcttgaaggaaggtcattattctttcatgtcaattctttcctcatgctcttcttactgattcctgattactgattaaaggatgtgttgtacaaggagggaattttggaaaattcacaaatacatggaaattaaacaacatactcccaaacaaccaatggataaagaaaaaattaaaagagaaatttaaaaataacttgagacaaatgagaatggacacactaacactgataagaagaagcaaaagcagttctaagaagaaaggctatagtaataaatacctacgtcaaaaagaagaaagatctaaaattaacaacctaaggttacatttcaagaaagcaaaaaaaaaaaaaatgaagaaaagataaaagaaagaacaaactaggcctagaagtagcagaaagaaggaaataataaaggtctgggtagaaataaatgaaatagagactagggaaacaatggaagagattagcaaaactgtcacttgggttttggaaaatataagctaaattgacaaaagtttagctaaactttctaagaaaaaagatcagaattgaaagaggagacattactactgatacttcagaaatacaaaggatcataagtgactactctcaacaattatatgccaacaaactggataacctagaaaaaatggaaaaattcctagacctactaacactgaatcatgaagaaatagataacatgagcagatcaatgaagagtaaggagattgaatcaggaataagaaataccctatcaaagaaaagcccagaacctgatggttttactgctgaattctaccaaacatttaaggaactaataccaatccttctcaaaatcctccaaataactgaagatgagggagtacttccaaacttattttatgaggccagccattagcctgataccaaagccaaagrcactgcaagaaaagtacattacagatcaatatttttgatgaacatagatgcaaaactcctcaagaaaatactaacaaaccaaattcagcagcacattaaaaggatcattcactgtgatcaagtgggatcactaccagggatgccatggtttaacctttgcaaatctataaatgtgataccttacattagtagaatgaaggacaaaaatcatatgatcatctcaatagatgcagaaaaagcatttgacaaaattcaacattgtttaatgataaaagctgtcaacaaattagctatagaaggaatgtacgtcaacataataaagactgtatatgacacatcctcagctaacatcatactcaatagtgaaaagctgaaaggtttttctctaagatcaggaataagacaaggatacccacttgcaccacttctatttggcataatactggaagacctagccagagaaatcaggcaaaaaaagaaataaaattgtcatcaaaattgaaaaagaaaaaggtaaagtgtctctttttgcagatgacataatcttacatatagaaaaccctgactccaccaaaataactgttagaactaataaacaaattctgtaaattagcaggatacaaaatcaatatactaaaattagcaacatttccataaactaacgaggaactatctttaaaaaaatcaataaaataatcccattcaccatagctaaaagaaaaataaaaaatttggtaataaatttaaccaagaggattgctatgatttggctctgtgtccccacccaaatttcatcttgaattgtactccaataattcccatgtgttgtgggagggacctggtgggagatggttgaatcatgggagtgttttcccccatgctgttgtcgtggtagtgaaaagtctcatgagatctggtagttttatcaggggtttccgcttttgcattttcctcattctctccttgcctgctgccatccatgtaagacaggactcctccttaccttccaccatgattgtgaggcttccccagccacatggaactataagtccaattaaacctctttcttttgtaaattgcccagtctcaggtatgtctttttttttttttttttttttcttttttttttttttttgagacgcagtctcgctctgtcgcccaggctggagtgcagtggcgggatctcggctcactgcaagctccgcctcccaggttcatgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcacccggcctcaggtatgtctttatcagcagtgtaaaaacagactaatacagagatgaaagactggtacactgaaaactgtaaaacagtgatgaaataaattgaagacacaaataaatgggaaaacatcctgtgttttgtggaataactaatattattaaaatgtccatactactcaatgtgatccacagattcagtgcaattcttgtcaaaattccaatgacgtttttcacagaaataaaaataaatcctaaatattttatggaaccacaaaaggtgctgaatagctaaagcaatcttgagcaaaaagaacaaagctggaagcatcacactatctgactttaaaatatactacaaagctgtagtaatcaaaacagtatgctgctaacttaaaaacagatacgtagaccaacagaatagaataggagcccagaaataaatctaagcatttatggtcaattgatttttgacaaagatgccaagaacacacaatgggattgaactgtctgtccagtgaagggtgtttggagcagtagatgtccacatgcagaagaatgagtatagacccttatctcaygccatataaaaaatccattcaaattctaaatgaattaaagactgaaactgtaaaactactgaaagaaaacacaggggaaaagttccatgacattggtctgggcaatgattttttaaagatataaaccccaaagcacaggaaacacaataaaacatagacaaatgagattacattaaactgaaacacatctggataaccagggaaacaatcaacatggctgctcttcaaatcactgaatttattttgttggtactatttgggtcactgctaaattggtgaataccaaactaacacagaagagattataatatacatgttccaaatgtagattataccttacctgagtataccttgtttaagtacaacagaatatagttaaaatcacagttctttacctgytttagttgtatataratttttaagatcatttgttcagtatcacaagtagaatctgtggttaattagaaaatatattttccctttaaawgaatttgtgctgacttttaaaattattaataaaggtgacagctagctttggtgtctatattgaagaaaatgttcatcctaattggtttccgtttgtctaccctttggtctgctttcaacacagcagtcacagcaatctcattagtacagatcacataacactttccactaaaagtggaaatcttattagtacagatcacacaacactttccactaaaagtctctactggttttccatcacattcagtgggaaaagcacaatgacccacaaggccttaaggaccttttcctcacctcttttcatctctggcctcatctgatctctcttcctcagttgcccagctggtcatcccgctatgtcttgaacactcacacctgcctcagggcctttgcacttgatatttcttatgtctagaattattttcttcaatttcaatgtagcttgtttcctcacctccttttggtttttattcaagtgttaccttctcaacaagggcctccttgacaactctatttaaaattgcagctcccagcctgtccacttcctaaaccactttcctgctttatttttctccataaaatatatcaccatctaacttactatgtacatgttactgttcagttgaatatttatctttctaaatgcaatttttttgtgcgtggagctatttgttgttgtaatcattgctttctaagcacttagaatagtgcmcaacatataggaagcattcaatgygtttgtattaagttaataaatgactgaatgaataactagtacaaaccaccaatccataatttaagaatcttattgaatctgagaattaaaggattaagtgatttcactgtgcttcttatgataaaacacactgcactttttctaattatgaaatttcctttaaggttgaatggcattgttttagtctatttgggctattataacaaagtaccagatgaggtggcttataaactgcagcaatttatttctcatagttctggaggcttgacgtccaagatcaaagcactggcagattcaatgtctggtgagggtctgcttcctggttcatagatggccttcttcttgctgtagcctcacatggcagaaggggcaaataagctttctggggtttcatttataagggtactaattccattcttgggggctctgtcctcatgacctaattacctccccaatccccatcacctaataccatcacattaggggttaggatttcaacatatgaattttaggggaacagaaacattcagtctatagaaagcgtgaagtaaattttcttccagttcctatgcatgttcttactctgcttttaagcgtattctaaatttcagttgtatctgtcactatgtgactttaccacacttacagctttatttaggaaaagagatgttaattattttaactcttcttttgtaacagagaagtctgggactgtcattttttgttttttgcttgacattgtattttttcctcatagaacaaaagttagtataaaagaaagggaaaaaaggccatacaatgatgctgtttaaacaagagtgtaaatgtaggatatgtattttgatctaaaatgttgataaaccaaattctagcaatatcatgaaaatgtaaacattttggagacccagatcctatttcaaatagagtcaagatgactgccctagaaaatgcttcttgaagtcatggaataaattakatgattgtttatttaaaaaaaaagaacaataatacataggagatctgttaaaaaatctgtgaggaaagagctgttaaaatgttgaaaccacatgaattctgttatggaaagtctgaacaagactttctaaaatagattgaatgtgggcagttttcacagctgcctgatgacttccacacacaaaacatccacatttcatccttttggtggaatactgtgtattttccaattttattcttagagtttaattttttacttacatattatgcttatgtatatcatatttgttatatatattatatataactaatatacaattatattatttatttaaaaataaggaattaaaaacaattatattatttgtttttaaataaggaattacaaaataatgaagagaccgtatttattatagatcttgaaactgtgactaaaaaccccatgcacagagaaaattcttgagtcaaatggcttcattgatgaatagaagttagaatactggttattgttacaaggagagggaagataatgactgggagagggtatgtggaaagtttcatttcttatttttgattatataattgtacaataataatgtgttagtacatagaactaatataattgtaaataagtgtgtttatatataataaaatatacaaaatatagataatatattgtataatgtataattatatacaatataataaaaatgtgataaataatattgtataatatataattatatacaattatattatatgtactaatgtattagctatatgtatttatatgtacctatatataagactttttctagaaattgactacatatttgaattgtgagacagcatgtatgttttgattcatagataagatatgtttccaatattacccatatctctaaaatacaaacatggcaaaaaaaggctggagtgagactaaggagaaaggaggagctataagtgtgcccagattccatttctttacctatgacttatgcgttggtacatttaccttaggtaacttgtcccacttttatgctcttcaatttggtctagtgtaaaatggagcaaataggcccacttccttattacgaagcatattataaggataaagtgatgtgttataggcaaagagcatagcacactgctgcactttaggtgatactcagaaaatattacttttggtcttccacattgaaaataatggtgaatggagaataaatgggctaagttgtaatgtgaaaaatggaaaataacaaaacaaaagctcaaaaatgctttaattactggatattgaaatgatacctatgaggttcactttgtatatcacctaagaatattattttactcaatatatttttagcactttatggacattaatatttctatggagaaagcttaaaaagtgtcacttgtgcattgaaactcttttgtaacagcttctttactcttctgttgttgtyatgatatcctccagattacttaaatttttaaccaagaagtaaccttacttattactagtatgctctttccttaaaagcttttctgatttatgttattttaattatatcaatcttgttattatktacagtttttaattattttaataatttcaacctttctgcaactttccattttagatatgtctcattaatggcatatagtgaagttttgacgttttgtctagtttggcagtgttggtcttttaatgaaacatgcattttcagtggatctgtgtgtatctaagtgaagcatgtacacagaaaaggtgacaaataaaagtctgagagaatttttgctaaatgaaccttcccaagtaactactactgagacaaaaataaccagcaacccagaaacttccctcatgccttttccaatcactatcttgccttctcccctaatagtaaccagtattctaacttgtattcaccagtgaagccatttgatctaggagttttctctgtgcatgggttttagtcacagattccatatctataataaatgtgggactcactggagttttcatttcttatattttcagtttagttgagttgggcttttcaagaaattgatccacttacctaatttttcaaatatatcgacatgagttgttagtgatattatcatcttttaatttacaatgatctgtagtgatgccctttttttattccagatattgttgtgtaacctttgtttttcctttacagctttaataggtcttcataatttcattagtctttttcaaatagccagttttgggcttgattgattttctctatcgtgaaattgttatattgtattgaatcctgctcttatatgtcttgttttttacttctcgttattttttattttagtttactacattttcttagcttcttgaaatsgatacctatgttattaatatttcagttcttttttcctaatatatttattaacgcctacaatttgcctctacatagggctttagttgcctcctacaagtttgatatattgtatttttcattatcatttattttaaaatatattctaattttcatagtaaatttttctgtggcctctgagttatatagaagtgaartgcttaatttctgaacaattgagtatttttctaatcgttttgtttttgttgttattcctttcctcactaattccactatggtcagtgtattttcaattctttgagactaaactttttgagacttgtttttatccaacatatggcagtgacttgaaaacaatgtggaccagttgccctggctcactcctgtaatcccagcactttgggaggccaaggcaggcggatggcttgagcccagaagttcaagaccagtgtgggcaacgtggtgaaacctcatctctaccaaacaaaacaaaacaaaacaaaacaaaaccccaaaacaaattagctgggtgtgtgcctgtagtcccagctattctggagtctgaggtgggagaatcacttcaacccaggaggtagaggttgtggtgagccgagattacaccactgcactccagcctgggtgacagagctggacatcagaccctgtctaaaaaaaagcaaagaaaagaatgcagattctatagttgttggttgcagtactacaaatatatcagtgagttatatttatatatattgatacttttaaattagagacatacaaatttaggattattaaatttaataatttaaattttgtattaactcttttgtattaaccacctttttaatactactgccagcagtacttctatctttagagtgtacttttgtatgtagattcactagcttccttttttctctgtgtttgcgtgatataggttttctcatatgttgagtgtacttatatttaaggtgtatcttctgtgagcagcataaatttgaattgtttatttaactaatctgataatcttttcctttaaattggatacttaattcatttacatttagtgttactatactgatatatgggttcaaattaccatattctcatctgttttctgtttgtcttatcttttgctaatttttcttcctcataactttcttacttttggaatactgaaggtttttccctatttaattattccatttcttctttcattagcttgtcttctgtgaagtcttttattactcatactaattaccataaatatggtaacttgcgtccttcatttatcagaactttgtaatattttacctcagtcccacctccccatcagatttaattctatagttctcatatgtttaattctatgtatatattaaactccataggaagtaattgttaccatcataaacatgcagttttcatctaattttaaacacctttaacttttttgtttattttttgttagtatactttgtttatttatttatttctgttagtaaacttccatcaagaaagtatccyatttcttttctgccttttttaaatgaaagcctgctagtgataaatctctcatcttttgtttgttttttcacttttctttacttttgagacttattttccaccaagtataaagtagaatttcttgcctggttggaattttgttttgttttgtttttttccagcactctaaatatatcctatcattattacttgtttttcattatttctatcatgaagtaagcggaaagtcttattgttggttcttggaaacaagatcatttttcctttcactccattgaaggctattttttttaattttgcttttggtgttcaggggtttaccacaatgtacttaggaatgattttattggtattaatactatttgggattcaaaagcttctagattctgtggatcaatgtctttcaccaatttggtaaaattcttagccgatattttctcgaatgttgttactgtccattctttctctccactctccctgagacttcagtcacatccctgctagactgtttgccgtgctcattatgtattctatggcttcttttcatttgtcttctcttcttttgaggtttctcagtctgtacattttctgggtgacctgttgtttggtataaataatcccttttttctgctggattcaatcttttattacatacatttactggatttttaatttttgtatttttattttttagttttagaatatccaattgatactttaaaaaaattagactccaaatatctctccacttagtcatctggaacatattaataacagttattttaaattatatgtctgataactctgacgttggaaacaactgggagtctgtttctattgtcttttcatgcattcctgttttatgacaagcttggtcgtttttgattaaataatgtatgtgtctgaaaatgtataaaaattctggaagatgttatttttctcttaaaatgatttattttcattctgtcaagagttagtgtagaggcaagttgctttgcttcagtcagcaactcaaatgttttgtagcttagttagagattctgatggttgtttctagtttactcttagttctagggatagactttcaggactccagtggaaaccccgacttgtttaccacactctttccttcttggctgactcttaactccaaagtttgtcttcccaactctgggagacttcccaaggatcttcttagtttttcacttctcatgagttcatttttgcatgatgtttatcttctggctccttcaccacttagaaattggcaaatctcttgaaggcaaaagctgtgaagaatgtaggtctcatttctctatgaattatggtccctcacatcctagctgacttcatagccctgaattctaatgtttatcttcttatcctgtgagattgctgaacacactaagatgtagctttctctataacctcctattcaactgtcagcaaatcartaaaagtaccctgagaggaaaatggctagcttaccttawtttgcttccctttacttaagtctggctgccttggttgcttgctgatgccttcaaactgctgtttttagtattttatccagcttttatggttgttgtctttgagagaaaatggaaagggaaaaaatatttattttatttacagttttaaaaacaaaaatcagcatattatctgataaaattattattgctttttgtgaatttaaggaatgttctgaattattgcttcaatattaaaacagtaattattggaacattttgatggattatgaagaaagaatatgtaaaattgggatcgtgtggaaaatctggtatgcatgaaattggcatataaagtaggcctaaacaaagcaggtgctattcttagtaagaagcttcatgccccttatggcatatctgccctgaataatacataaagaaaataatttaacaatatgcgtttgaaaaatatttgttgagcaactactgttttttaagcagtgttctaagcctgtaggtctgtccatgaaggagacaggagtccttgcattccagggttttcaagtaaacaatttagaatagtgcaagttcatgaaaaaaaaagcataagattataataagattatagacggtgatgaaagagctaatttacatgtatgttctatgtatgcatttttcaggaagtgatatttgagctgagaattaaaaaccagaaaataccagtcatagaaaaatctgggtagagtttattaccagcaggaataaatgtggggtgctgaggaaaggaaagaaggccaatgtggctggaacctagtgatcaagagcaaaggtggcatgagatgctgtcacggaggtctccaggtcttcttagctcctgaagggagtagtcagtcatgataaacagtttatattgaattctgggtataatgagaaacccgcagtggtatttaagcaggtgtaacatgatttcctttatctcattagaagtaacattctgctaaatggagaatgattatagtgagataagtgtgaaaactaggtggcagtcaggaaaccatagtacttttttagcaaagagatgatggtaacttggaatagagtggtagtagcagagagaagtggcaggctgagatttatctggagttcggcatcacccgaattgatggtggaacaaatgtggagagtggggccaaaatgttgactcctaggagtttggcctgaagaaattttcctgaaatagtatggattaaaggaggagcagaatggagatactgggtggcaattaagggtctgttttaacatgttatctttgaagcattcgagtggtgccaggcatggtggctcactcctgtaagcccagcactttgggaggttgaggtgggaggattgcttaagcccaggtattcgagaccagcaaccagcccgggcaacaaagtgagacccctatctctacaaaaagaagcaaaaaattagccaggcatagtagtcccagctactcaggaggttgaggcaggagaatcacttgggtccaggaggtcaaggctgcagtgagccatattcatgtctctgcactccagcctgggagacagagcaagacgctgtctcaaaacaaaacaaaaaaattattcaagtggaaatattaaagggacaattggatttatgagtctggagttgagtgatgtgcactgggaaagagactgtacttaacagtaaaggcctgtttaagatcatttagaaagcaggtatagagataaaaagagggcctataattgaatcctaggcacttcaaatttaaaggtggtaagatcaaatacatcaagaaagagggaatcttcagctatggcaatgcagatgctgtgaggtacaaattaaaccactcaggtcttggaaatacctaaacatagggggaaaaaacacctaaattgtaatgagtatatgtgtgtatatatatataaatatatataatatattatatataatatataatacatatataatatatcttatatatattatatatatatattatatatataatatatataaaattagagaatctttaataagaggtgaatggctccaaacacagatttaatttggaagctcccaccctagcaatacctactggtgttcattttatttatgtaaacacacaaatgttgactatgtaatttttcaattaaggaaatagccaataaaattgtgtggaaaaaagatagcggtagcagataataacatcttttacttactaaagagattgtgtctaaatattaaaagtaatacattcccttgtcaaaacacttcatttttgtttgttttcacaaatattttaatgtggattttgagtcaaattttctgtaggaaggtcatggtagattaatgtcaaattagctgaaacaataaacacratgaaaagaaaaatcagccttgtaagacagtacaactaaggagatcagtttaaaacactaatgaggagttgcctctcagcactgggtcattatgattatactaatataataagttaggttcaggttagaaagcaaagatgaataatcttcaaaaggcacagtaaatagtcaatttagttgtctaccttcataatatttactatttccatactaaaagcttacagttgtgggctagaatatatgatattcacgtaataatatttaaattgaatttcatttttttgcttcttcattatccttacctctaccctcctcaataaattcatctcaaatgataagattttccatccatcattgtgaagaataatttatttacttaatgattctggaaatatgggaatgtttataaaacgaaatacaaaaattaagaaatggagtgggcaagtaaaaagacattttcccactgattttagaatatactcaagaaaattaaactagtgacaaaatagatttatttaacttataagctaattcataaattaatggcaaaatttatcacagtatacataactgagaytttgcagatttttttgtaaatagataacattctgatacaattaacagatctccatcagctgcattagatttcaagttgccctgctaccactgtatatatgcacatagataaatatgtatatgtagtgcaacacagatgagaagatataaagttgttttattttgttcgaatatgtattacagagaaccctatgtgctgtatagcaccttatatatctttcttttaagagaacctcataggacttccaaattcttcactgaaatagctcctacttcttatattacctttcgatatgtcagaaagattctttttctggaagctgttgttctcatccacatcattgcacaggctgacaatcaagacactatttctcactttctttaaaactaaatcaggatttgagggagtggagggatgactaggcagagcaaaaggatttttaaggcagtgaaaatactctgtaggatagtataatgatgggtacatgtccaaacccgcaggacgtgcaaggccaagagtgaagccgaatgtaaactataggctttgggtaattttgacgtgtcaatgtcatttcatcagtcattacaaatgtactactctactgggggatagtgataataggggaggttatacgtttatgggggcagtgagcgtatgggaaatctctgtattttttttttttcttttttgagacaaagtcttgctgtgtcgctcagactggagtgcagtggcacaatgtcggctcactgcagcctccgcctctagcattcaagcgattctcctgcctcggcttcctgagtacctggaactacaggtgcgcgccactataccccgctaatttttgtgtttttagtagagacaaggtttcaccatgttgcccaggctggtcttgaactcctgaccttaagtggtctgcccatgtcagcctcccaaagtgctaggattacaggtatgagccactgcacctggccaaaatctctgtatcttcctttcaattttgctttgaacctaaaattctccctaaaaaataaaatattaaaaaataaaagaaactctatgtaccctactgactctttgtcaaagattatctattttttttctcaactcatgcaatgtttaacactttggaccatattatcacttatggttagcctcttataatatggtatggctatttttttaaaaagtcatggtaaaatgacataacaaacaattttttatcttagccacttttaagtgtacattgttgtgcaaccatcatcaccattcagctctacaatgcttttcatcttgtaaaatttgaaatactgcacccattaaataataactccccattctctctcccccagtccctggcaaacactattctaccttctgtctctataaatttgatcattctgggcacgtcatataagtggaaccacacagtatttgtccttttgtaactggcttatttcattcaacatagtgtcttcgagattcttccacgttgtagcatatatcagagtttccttcatttttaaggctgaataatattccaatgtctatgtataagtagactcacacacacgtacatatatggcacattttttgtccattaatccattgatgaacacaggttaattccaccttctggctattgttcttaatgctatgaacatgggcatatgggcttcaatctttaaggtttcagttactcatggtaaactgaagtctgaaaatattacatacaaaaacattttaagagagagagagggagaagctacattcacataacttttattatattatattgttctattttttattagttattgttgttaaatctcttactgtgcctattttataaattaaacttcatcaaagatgtgtgtgtatagaaaaatacattgtatatatgggcttcatgcattgaatgagggtcttaggatgtatccccctgaggataaggagggactactataattctactgttaattctttgaggaaccactatattgttttccatagtggctgcaccattttacattcccatcggccatacacaaggattctaatttctccacacccttgccaacacttctttttctgtttttttttttttctttttaaatagttagcatcaaatgcgtatgaagtggtggcggttcatattttcagtcatcgtttcccagtatttcttgagacaattttgaaatattgtaagagatataaaataactttgatgttggaaagaatagcagtgaagaatgcccatgtaaaatttgagaatcttgaaacatgacagatacaacattgcattaaaggaaattaaatcctggacaattttgcttagcttgtaagtacatatacaacacatatacaaatacatgtacctataagtacatataaaatatatcctttctaaatttggctatattgtcagatacctgagaaaattattatctttatagcctctgtgatatgtcgccaatgcaaggcccatgaaaactcaaaaagagtcagttagtaaatgaactcttttattatttgtataaattatagtttttataatataaatgtaacatatgaatacttgtgtctggaattacaatagacacatttttatctccagggagttactactggcactttttgaaatcctgttttgtcctagacactggacaaaatattttacataaattatcttatagaacttttcaactccgtaagaaagatactattataattagtacattttgtatcacagaaattaaacaacttcctcaaaatgacacagttagaaaacaatagagcacaagatgaatccagttctttctgatgtcaaagcctgccgtgtatactccagatgacctgaaccttagagtaactaaaagcatcagggcttctctgatatataattgtgagaatctcactaaaaacaagattaaattactacagaggagtcttagaatttaaaactctaaaaagtgaaacttaggatttaccaaaaatgtttctaacttctcatatacatgtatggatgtaacctgaaatgctgggttgattattgaaatgtccatatgaacttacaaatttaccagaaaaaaatcaaactaccccatcaaaaagtgggcaaaggatatgaagagacacttctcaaaagaagacatttatgcagccaacagacacatgaaaaaatgctcgtcatcactggccttcagagaaatgcaaatcaaaaccacaaagagataccatcccacaccagttagaatggcgatcattaaaaagtcaggaaacaacaggtgctggagaggatgtggagaaataggaatgcttttacaccgttggcgggactgtaaactagttaaaccattgtggaagacagtgtggcgattcctcaaggatctagaactagaaataccatttgacccagccatcccattactgggtgtatacccaaaggattataaatcatgctgctataaagacacatgcacacatatgtttattgtggcactattcacaatagcaaagacttggaaccaacccaaatgtccatcaatgatagactggtttaagaaaatgtggcacatatataccatggaatactatgtagccataaaaaatgaagagttcatgtcctttgtagggatatggatgaagctggaaaccatcattctcagcaaactatagcaaggacaggaaaccaaacaccgcatgttctcactcataggwgggaaacgaacaatgagaacacttggacacagggtgggtaacatcacacaccggggcctgttgtggggtggggtgaggggggagggatagcattaggagatacacctaatgtaaatgacgagttaatggatgcagcacaccaacatggcacatgtatacatatgtaacaaacctgcacattgtgcacatgtatcctataacttaaagcatamcaataaaaaaagaaacttaaaaaaaatgaaatgtccgtatattttcttgattttttccaaatgttttgaagaaagtttttgtattattaaatgctattcattggtcaatttaagtaatcttcttttaagaaatcattcagarattgtaggtccttgatcgtaattctttttgggtaatttcaatttcaataggttaaacactgtgctggaagatttgagaaagattatcattggtccattttgtcaaaatcatttccagaagtttaagtccttttttcttcatttttagtgtgattcattgattttcctaaggaagaacatttaacttctctcagtattcacaaggaatacctgcttgaatgtttaagtaccaacagaggatttaaagttcttattacttatgagcattaaatgaattcaatactccaaattttatagaagaagcatttctgaagatagaaaataaggataatttttaaacacaagaaatcacatgcttttcatatcattatcaatgtggaaaatgctraaacaacttgctattaaaaaccatttatcagaaacttgtttaattaatatgtcaaatatctgggtttttaaatcatgtataacaatgaaaatattcctaaaaacatattgagaactttaacaaaacattttacagttggaatgaaattagtactggatgattggattaaaagccagtagaaattatatattatcctatttaaatgtaggactatataagttattggtaatcctttttcrtaattttattactttttccagtacctaagtggatactggtgactggtatataataagtaaccaatgaatagatattgaataatgcattgctttgctcaattttctcatctctgagctttcctgtctgtgctactgcaacattactttcttaattatattctctcactccactgcaataatattacagatgttattccctgattaagaatagtataaattgacaatccaacccctcaaatgaaattttttggtgatccaaacgttttaaacatccaataaagatataacatgctagttctctagtaggcacccatttccaggtttccaaacgtttcaacaaaaacatttatatatttctctattgattgcataatgtggagattctgttttgagaatgcacataaagtatattatattctgaactgtaacaaaatgagactctaatttattcacagtcctttttaaatttgtctgtatttttgttttcctgagaaaaatcttatctttatagcctctctggatattgaatatcttgagactagctttaattctcttgatttttattaaaacttctaattccaactttattcgtgaactacatgcttatataaaagtacgtttcatcaaacagctttctctttatctctttaaaatcattaccttttattattttcagtatgctttaatgctttaaaattttattcttgaaacatttggtttttccattgctactttcctattgattgttttcctcatatgtatcttgagattttagtctaggttttataacaagcatagctatatttacagatattttttctataaagttttcaatatagattctgatttttttatcttataaaaaatagttaacaccattaacatttggatttatttctgtctagttctcctctgctcacacacacacacacacacacacgtgtacacacaaatacatatatataaaatgggcagcacactaataaagataaaaataaactttataaagttttacattttgtaactggatattatattgtgaacatccccatgtaactgtgtagtatttgaaacttagttatttaaaaattaaattgcaaatgtatgatcttatagactattttcctgcttccaagacttctttggaactgtggactccctgaaatgccagggtaacataagcgagacagaacagctagcagaacctcagggaataccactgactttatggtgtcagccagtatcatgagagcccacaatgttgcctttcaaaccaagtgatacatttctatcaataattaaataaatttgaaagtacactgccattgcatttgcaatcttctttctttgttctttattcattgcaataataaaaacaaacaaacaaaaaacaacaccaaatcaaatgactgttgatgggggaattataagaatagatgggagtgaagacccaagctgactttacctccaactcaaagatttttgtccactaatctaatttctctttctctctgtgtttgttaaaagtttcaaagtagatgtaggttctcttgccaagttgatactcgtgttctttccttttcaagattacataaaaagtatagcttagatccaacgtatcaacctggaataggtgaaaatatcactattgattataactagtatttaacgaggcttaatatggaccaaacactgatctaggtatttcacatgtattatgttttgtaatcctcacaactttatgaaggaagtatatgtgtgagaaaagatacacacgattagattttgagagccagtgcaaactgcaccgcaggtgtattgcctgtkcaaatttttctttaccactctatattaacacctaagttaaaggccggcacaataarcaatgtgttgcttgataatatttgtaaaacaaatggattagtgaacaagttaatatgtcactctgtggtctttaaaatatatatggaaatgcagaatattaaaatctgcaatacatattttgaaaaacaaaggtgagagtaatgctagccaaagcaggtttgactgcaggcacaactgtccttcccactcttcttaattgaagagtcacctcaatccccatttgaatgttctcttttcaacctcctaaaaagattactgagaatgtagatatttaaatgtattctgttcatctttaaataatttcatttatgtttaagctgcaaaaattgatctgaagttagtctggtatattgtgtactttaagcatgtgatacrtttctaaaatgttcatgtcaagaatatctacaattcaaatcatgaccttcttttggcttgtattctaattttgaagtttctgacctagacacaaaaatgattaactgaagaattttaatagttgtactgttgttcttcacttctatcagtgatgatatttgatagtgtaatatgctgagcaggcaaacaatgaaaaagtcccctccatgcaaaatgtatgtaaaatcagctttcaataagtgaacagtatttactacctgctgttccttttcacyatttgcagtaccattcttagactcactgcaggcataaaccctgggataaggaaaagttaagcctccrttcttcatacctctaataaggctttgccaatggctgcaatcattttacaaccatccacttatgtttaggtttaacagagtcttggcttcataatgaaatacttcattaaagtatttttatgatatctgtttacacatatgttcatagtagaattgcatggtgttctgttatccagtctttgccattcacatggactcagtttatagtgtctggttatgctactgaagatcttcccgctttaccatttgctgttaagtaattgtagtcagacagactgcccaggaagccccatggactcagttttatcccttgggtatcacaaatgaggaagagtttgattccatattggtgaaatactacttctgtttcctaaagatatgttgttttctaagatttgcttctagattttgtgattaaatgttttattggacagggatttaagaatcagaatttcatgacattttgtcctactttaaatggaaatgtctatagacttttctagtgaaggcttttacaaatgttaagggatgattgaatgctcacagcaggacacatggcattacagaaagtctccaaaattattcatccttttggggacaactataaccatgattttttgtgacactcataacctgttgaattggaaaaatattaatgttagaaatcygttctcatgtcacttttaaaattcttctccttttttgcctcctgtagcatgagtcctagtttgattaaactagacacttgattttctccaatggtaacatgtttttaaaaaaggacttttactctgttggaaccaattaggccaatgtgaggaactttggaaggamcatgagcagccaaacttgctaacagcaaaacrtatttttctgaaggcagcatgaaaaggacggaggagttctctaaggactgtgagttccacgggtccttttgagcttcagaaatccagctctcagcacttcataaatcatttctgacctgatgtcactgaagttgtattattatgtggttagtatmaaattcagaaaaattgggagaaaatacaaggagaagaatttgcagggtgattgttgtaagatttttatcatgtcctcttaaaaatggtagcttttcagaaacttktgttaactgctttgcattccatcttgagaaaatgtctgtatagttagatgagcatcatctcctctccttgtttttaaatcacatccaaaatgacatcaggcttgcagccgtctcattttttccttttatttacactcttcacacttcattggcaattgaggtcaccactttaaaatttagggtgaaggctaaagaccagcttgacaaactgttggcggaatgctctcttttgcaagtcttcgttttgaagaaagaatgtgtgatttagaaatatttaagattgtcattttggtagaacttctcatctatcaatgcagggtgcagcatccctatttattaatgttgtgttggttagatatgttcacccattaggtacgtgcagaggtacctgaaaccatctgagaggtggtatcccatttttcataatctattcaattgaactttaaaaataactgagcatcttttatatacaagacattaacagacatttatattctatggtatctactgctagcaacttataacagttttggtggtaaaataaaggcaaacttgcttcataacaaaacaaaattaaattatcaaaaagaaatgctcagttgttaatttaaaatataaaatgagacatgagaataaccttaggttagaaattcagatgtagaaaatatctgtataaagaagttagttgaaatactcataggcatgaaaggtattttgcaaaaagcaaaagtaggcaaaactggatctatgaagttgctccataatgtactagtcaggtgaagtagcacaaattacctagtgtatcagttttcttttgttaacacaacatattaccacaaacttaatggcttaaaacctcacaaatttatctcacagtttaataggttagtagtctgacacaagtctcactgagctaaagtccaggtgtgggtagtattgcatttctttctggaggctctaaggtagaattcattttctaaaattcattcatttaggatagaagctgaaagaatcagtttctacaggctacctgcatcctttggctcatgaccccttcctccatcttcaaagccaggaacaggttgaatccttcgttgtaccaccctaacctcttcttttgcctccctcttatacttttcaggacccttatgattacattgagcccagtggattatccagggtgatcctttcatctcaaggtctttaactgaatcatatctacaaagttccctttgccataaaaagggtcatattcacaggttccaagaattaaatatagacgtctttgagggaccactgtttactctaccataactagcctatctcatttcaattttctaatcagttactacctgtctcttagagttcttgttagcagaaacaaatttctgtgtaataaagtgcctggcaaaaagtaggtcctaaataaaatgttattttccccaaggraaagattattaggaattataacattgggacacacctttgtttaaaaagctctaattaacaagaaccacagcaggggcgcrcatacaggggttggagagaaattcagttagtgctgtcttctggacactccttctatcttcattctctcctctgccattgttaaccttccattttaggcaaggagctgtattaggaaaatgtggtttccttttattaaaagaaaatctctaaattattaatagatattacttttccaaagaaaatttcagaaaggagaagaacaacataatcaaaatctgtggacactttaaagataaggatgatggagaaagactgaattttgcaagcaggttataataactcctgagagtgattgtaatagggtgattaggtcatgcatggactacaagggatcaartagaaaaggagtggtaaagtagtaaacagcagagggtacaggctactcttaagaaagtccctagagaaggataagaaaatggggcaatacataagcttggaaatagatgatgatatttcttttttttttaatttaattttatttatttatttwttttattaatcattcttgggtgtttctcacagagggggatttggcagggtcacaggacaatagtggagggaaggtcagcagataaacatgtgaacaaaggyctctggttttcctaggcagaggaccctgcggccttccgcagtgtttgtgtccctgggtacttgagatcagggagtggtgatgactcttaacgagcatgctgccttcaagcatctgtttaacaaagcacatcttgcacggcccttaatccattcaaccctgagtggacacagcacatgtttcagagagcacggggttgggagtaaggtcatagatcaacagcatcccaaggcagaagaatctttcttagtacagaacaaaatggagtctcctatgtctacttctttctacacagacacagcaacaatctgatttctctatcttttccccacatttcccccttttctattccacaaaaccaccatcatcatcatggcccgttctcaatgagctgctgggtacacctcccagatggggtggcggctgggcagaggggctcctcacttcccagaaggggtggccggtagaggcgccccccacctccctcccagacggggcggctggccaggcgggggctgccccctacctccctcctggacggggcggctggcagggtgggggctgcccccacctccctcccggacggggtggctgccgggcggagacgctcctcacttcccagatggggtagctgccgggcggaggggctcctcacttctcagacggggcggctgccgggcggaggggttcctcacttctcagatggggcggctgccgggcagaggggctcctcacttctcagacgcagcggccgggcagagacgctcctcacttcctagacgggatggcggtccggaagaggcactcctcacttcccagactgggtagccaggcagaggggctccttacatcccagacgatgggcggccaggcagagacgctcctcacttcccagacggggtggcggccgggcagaggctgcaaactcggcactttgggaggccaaggcaggcggctgggaggtggaggttgtagctagccgagatcacacactgcactccagcctgggcaacattgagcactgagtgaacgagactccatctgcaatctcggcacctcgggaggccgaggctggcagatcactcgcggttaggagctggagaccagcccggtagatgatgatatttcatttgcaatagctaaaattgactaagtgttaagtgactctgatctgttgaaagaattcatgaaccaagatcagaaactttcttctgtctttgatttgttattctactctgttaacattatacttctaacacttcccatcactacaaatctttgctattagtccccaaatgctttgaactagagtgattcatttatgtgtgtaatgtcataaattggagaatgtgtaggttcatcttaccttggtaaatacagaagcacaaaaaacaaaggcaatgccaggtatttctccagggtgaataaattttagaaggcaaatttaaactgtcatatttctgattgcctgtgattcacaccattgttgtactctgtgacagtttcmttgaaaggactgtcatgttccatgaggaactcagcctacctgctcttttaccagtagctggtgggaaagccatrctgtgccaatgacttattcacaggaggcaggtcaatcttttgaaaccacagattgtttcaaatgagagaaaaatatgtgagaagagaatagatgtcaagggtagtgctaaagacaaggaaaatgcttgcctgggttttccctgcagctgacgttgttaaaaatgatagcaacttaatgaagcatggcgtactaaatgcattaataagctgagggaggaccttattcattccaatttggactctgctcactcgtgttactcgttttcttaagactggactaaaattgtgagaccttatgggccaacgataccctttagagctgataattaatttgaaagaattattaaagcatatttcttgagctaagaatgcagtgtattcacagtaagaggcagagttaaccatttatcaagataattaagaaaatgcattaaatgtttgctccgtaagagcaagcactaaattaccagtagtagtaatattattatgtgaaagggaatcaatagtttgtttactaaaatgagatgcattagcaagcttttttattctgatataaaaattttcaaatatacacaaaagtatagagaataccgtggactcaaatgtacccaacacccatccataagtattaactcaggacccctcttgtatcagttttcaacccatccacatcctactccacccctccagattattgggaagcaaattccatatgtattactcgcttygtaactacttcattatgtatctctgaaggataagactcttttataaaggaaaccattgtcacatctaaaaattaatactattatactgattctttaatattaacaaatatttactcagtattcaaattcatcacacctgcttccaagttttttaaaaacagttgaatcaggattcacaagaagtcacatactgcatttgttcgatatatctaggtctctcaatcaataacattttaacttccttgcaacttatttttttgaagaaaccacgttgtgtgtccagtagtgtttcttacatcctgcattttgctacttagggttcctgtagtactgtttgcatatttctctactactatatttcctgaaaactgatagataaatttagagagttactctgattcagggttcatatttttggcacaaccactttatagattgtgctatgtgcttccatcacactgcagaaaatatctgggtgtctcttttttggggatgtttctggtcattgatcagcattaatggccacaggtccatcattttatgggggctcccttcatagtaaactgcacagtaaactatacacagtgaaccttgtggtaaactgtagcatcctgtgtactatagcaatttactccatgttgcttttttcatttaacaataaatcccgccattcattgctcttccatctcagggttttcttgcttattattgcttgttaaaattcttccaaatcacatttataatcaagtcgttcagcactaaggaaaaaaaataacattttcatgaaaaaatgaaattgcattacatttatatattctcttagggacattgaaaataagtcttgctatttttcagagctagactttgagatttgcttttttgcagagtgagatagagaagtccttcaaatactgtcccttgaagagttaggcattgatttaaacccttttgaaaaacaatttcaacaaataattgaaaatgttctcttcaaagtattatcattagtcatccagttagattattattattaggaattctgaggtggtggaataattcattttccaatgtgttaacttctcatgagtttaatgtgagtataaaaagtctgttttaactgagrgcagagtattcctttttctcttataatacaggagccagttacaacacaggaggtgaaatggcctgtttgcttacctgcaacttcaggaatttcatgcttagcaattaattgcagtacacacttgtgggggtaggggtaggaggttggataagtgggttgcacttaataattcagtgacaattacaaatcgtttcactatatgtgaaagtatttgaagtaaatttacctgaagatagaaaatatgggtgggcaagctcctcctgaactccccaccacattattctaggtttattgaagtaaatgtaaacttataaggggacataaaactcacacagaaaataataattagacatatttccacattaatgtttttaagtttaaaacatcatttaaaaattttatcactgatgcttgacttaaacaagtccacttatagcattgtcagaatctgtataagtatctcttcagggaatttttaagatgagagtgaacaattttctgagattgcctacacatttttgttacacagtaagagccaggttctatgtggcttaggtggggatggggctttgagtgaatcctctgttgtacacagacttaatacattctccatttcagcccacttttcacctctgttttcatcagacctacctcggtgaggttctagacttctgccctgctgcagctactcagtactttaggccatgacctccgctctccttcctcagcaactcaccacagaccttccrgaaaaatgttaaacccttctcatccttttcttgttattggtttctattttctttctttcttttttctttagcgtcacaggggaagagctgataattgtattggctatatgtatcaactcaaacagagagacattacctgcagttctataaagattcccagattattccaatgggtattaagcttgaaaacatgatgtctatgatcctttctggttctgatattgtataactctcatcacttaatgaaagccaccgttcctatttggataaataagagaattgaaaaacgyactattagaactgagagtacagatgagctttccaaatatattagagatggcatcacagtacatggaaatgttaaaatccataacatgggcaagagcacatactagaaaagtgcagaacctctttagaagtgaagcattttcgttccatgcacatcaatttgctataggagttcagggacaaatagcaatatgggaaggaggcggagctcaacattgagcagaaattagacacatgctgttctcttgagagattaagaaagaataaatagaagagagtaagtcaggtcctatgagaaggataaagcattgtcttccatagagagtgaccttcattaatattttttacggcttttgtggagatcagcctaaggaaacagaagtcctatggccttattacatcattacagaatcacactttggctgggtctcttaactgtgtaacagtggtgctcaaaagtctctgtaaatctccaaaacacaatactctttagtagcatttcttagatttgtgattcttctggggacaaaggatctgggatacaatgggttcccgagtgcagtggtgtgatctcggctcactgcaacctccgccttccgattttcaagcgattctcctgcctcagcttcyggagtagctgggattacaggcgcccaccaccacccccgactaattttttttttttgtattttttagtagagacggagtttcaccatattggccaggctggtctcgaactcctgacatcgtgatccgcctgccccagcctcccaaagtgctgggattacaggcgtgagccaccgtgcccggccgaggattttttttttttttaaatcaagacttagcaatgcatgttctagaaactgattctggttttcagacttaactaacatgggtataggtgagctaagatattaagctgcagggaagggtctagagtagctagagttcctgggctgctcacttcaagctatgaggtctcctgaacactggtaaaaaccccagtgctgtacaaatatcattttatcttagccatgatgttcaagattggaaagcataactctatgtgatgatcattgtccgttgcttattattttgagactaaaggattcttaagaaagaccctattctccatttccacactaaatgagatcaagttcttaatactcttcttattataggaggaacatctaattcaatgctacatcagtaattaaatgatattttgttaggtgacatgcaaatgagtaacaaatggaatatgaaatagaaagttccctttgttatgtaaattgtcaaacacttgatattgtttttaaagttatttgggatttttttaagacaccaagtttgtaacaagtgcccttcaacagaaaagacacttggatatcatgagatgttctcttaggttcctcaaagcctagcagtcatagcattttaatacttactagtggggagtctgccttccctgctgcacaccagaacagactggggtgggggttaatcatctggaaatgaggtattataactactgattttgaagagtctttataatgaaaacaagacacagttaataaaagtagcatagaaaacattagagagttattttattagggccattaaatatttggagtacagtacttagaaaatcactgttaaaattgttacagttactctctgaagcctgctaagaatactgctatttattacatttttaataatgctattcactacattttaaaagtttactcaaaaactacatgactttcaagtcatttaagaagtccaaaagaaattccatgccaacaaatttaattaattttgcatggaatgtgaaagaacccatagaaaataaatgaaagagggatattgttttgaaatgggactcattcagtcttctgtaaggcggtgactgcttttccgtgtcactgctggcagttatgttgaattatagaaagagtctgtggggtctctagtagaacttctcttcgtggattatttttatctattattccagagccaacacaggagctatgaagtcataaatccacattgtagctgcatgagaacttggccttatcacatatttgcatactcagtgctttctaagcaaagttctttatccataaccttagtgtagtcttatttttcttagtgggtacctgtgatctctaatatgctttgctatctctctttttgttttatatctttaaaaaaatctctatgtttttattttttctggaaggaaacaggctcacttggaatatttacctagattctctctttcacaagaacacgcagtattttgtattcattatctcattatctcttccctggttgtgtctttagaaaagaaacaatggataacagagggtaaaagagtttcagtaattttctcagctcacagagacctaataggacaaatactccaggaacgtatgccttagttcctgcagatgacaatatatgctaactgggattcaagctctaacaaacaggcaagaccaatgtcaaactaataaccataacgtggaagcacattacagtgattttggctatccaactaaatgtaataaatatcaaatgcccaccatttcagaagaattataataaggaatatagcatctttaacccatttctcatttgcctgaagaatacttgcagacagcatttgtggcttaatgtttacccygagataacttgtggcttactgtcctaaccttatccccaaagtttgccatgaaatatctcacttttattattatttttgcataggtctagcatattgactttggaaacaaaagacatcattctatttgtagcattctgtgtttgatagtagtatttccatatacaaaatatagtaattattgattgctgaaatcaaatcctagaaaatacagcattcctatataaaaaattattaaattctgatcatcatatacatttctgttacattaggattagagataagttttatttagaaataactctaagaaacgtttttatattttattttcacattgaaaataagtcagatttgcttcagcctcaaaaaatgtgtttatgtaaaattaaatgagagctggcagtgagctgtacattttttttcctaatgggacatgggttatgggttaaagatgtacaagctggccgggcacggtggctcatgcctgtaatcccaacactttgtgaggctgaggcaagtggatcacctgaggttaggagtttgagaccagccttaccaatatggtgaaactccatctctactaaatacaaaaaaaaaaaaaaaaaaaattagccaggcgcagtggcacctgcctgtaatccagctacttgggaggctgaggcaggagaattgcttgaacctgggaggcagaggttgcagtgagccaagcttgcgccattgcactccatcctggacaacagagcaggacgcagtctggaaaaaaaaaaaaagtgtaaaagctagaggccctggcctccacaagcccacaatttagttattcttcttctttatgattttaagaccttgtcaggaatactttgggattatcagtagttaggaccaagatatttcatattttatagcagagacaactctatctgtgcattttataagattaatccattggtatgtttcttgttgaatttctatataaagacattctacgtgatgagttgttcaatatgaactgtctaaaaaacaattccttatgaataatacctaaaaatgcataagtagcaaatatcttttatagtggttgatgtaacatattctatgttgttcctacttttgccctttctctgttacttattttactttgtctttattttaaagataattttatttaaaagtaaaacatttatgttcatacaaaaaatatagcagaatacgggatggaaaataaaagtcctcctcttttcttgactcctaaaggtggcagctttaatatgttcacataattcctctcccaaaatgtcttggcatattcaagcagttacaggcacatacatagatatgtgtgtctatctgcagttatacctatctatatgcctttgtaaatataaattcatcagtatttctcacctgcagtgatactcaataaaacagaatgctcaaagcccagacccctcaggacaaatatcttggctgtccttgctatgctggggtcaatcagatggtctcaggggagaggaggcatttgggaggttgggcagcagtgatttgtcaacaagtacagaagcatttcagtattttatccactagttgttccacaactgtgcctaaaaggctaatactaaccctactttgactcattcgatgggtgatttcccctccatggctctcaagcatgcatgcattcaagtaaacatcttgaaggaatagcatcagagccacctgtattaccgcattccataccaaatttttatatttttaaatctagtcccttagggtataccatagatcctatacacgtatgcatgagttaccatgtcaaaactatgaagcagataaaatttgtttctagagcatccctttcaggattccctctgtagctcagcagtcctgttaatcacattgtagtgagcctgtcctcccaattgtgccccaccagtgacctcatccacttagagcttagagctgccaagctctcatacctcatagcatttactagtcaagaacatatcatactgttttattattatagcacttttcatttgtctcattattacaatatattaacaacacattgatggtggaatagtaatttaaactaattcatatctgtctttctacctagaacattgtacataaatgtcattccataatgtttcttcactattcttttggactacattggtaaagacacagatatgcactaccacaaaacatctagaatatttctttttttacgtcttcaaattctatataaatttgtaaatagagcattgccacattcctctccattgtcactctgttaacagtaacaatacctctttatttcaccccttttcttgcatgtttaccttttgtaaagagaaggtacagaaacccttcatttaatgtgtttcaggttcaatccrttgtcttcataacactggaatttctcctccattattttctatttggggatgtaaaggaatggacatttattgaggatttactgccacaatgctagaaccacaatctgaacataggaatgtgtttatgttgtttttgctgtaccatactaactgcctctaaatggcacttttttgaggattatgtgatataagtaaacaagttttctaaactatcaagcactattcacactgggaatttctagcttgtattttacagtctttaacacagtaaggtgagtaaattggtatgtactattaataaatgttttaggtggtaataattataatggaactttaaacatcaggtgaaatgttgccaatgagttgttactaaaatccagtcttaatccatttcttttaaagccatggttgtcaaaacaaaacatcacttcttagcaaaaaattattagatatgaacctgtaatagtaaaatcatttcagagaacattataagattatagaataaaatctgaaataaaatctactgtagcatttagacttatatttgacataaaatgatgagaatatttgggaattcaatgttattgttgttgttatacttccctaggtgttccagatcgcgtatgtgattgtgaaggcagctaactccccccggcctggaaactggattttggaacgctctcttgatgatgttgaatacaagccctgrcagtatcatgctgtgacagacacggagtgcctaacgctttacaatatttatccccgcactgggccaccgtcatatgccaaagatgatgaggtcatctgcacttcattttactccaagatacaccccttagaaaatggagaggtaagatgagaaaactcaccatttaagcacatttgatacggtgaaataggcctgtcagaaagacctgaatatatcagtaattaatgtcagggagattttaaaataggatttagcaaaagtacatttaaatgagttattaaataaaaaagaaaaacctgaggtgattagaattttaactaccttcatgtgtctcccatctccagtaaagatcagagaagaggaaataggtttaatctggaaagtcaatgattaattttacatataaagagactttctcaacaatgaggattgctaatgattagagaaggattggagaccttaaaggtggccttacatttgagggtactttggtctgaagatggagacaaaagaaatgaatttgtgaagaaatgtaatccacatgaaagacccaaatgaaaagtaattctttcaatcttttgatgtttttctgctgtcaccacatagggctacagtggggtttcttccctgggtcaggctttgtggaacagtaatgtgcaggaagtcttaggttctcagtgatgtgcaagctaggttacgtgcttagttcaaatatgttcttctccagtgtctgtcatcctgtggttaagattttagattcattcattgattttaagccacatattctaaccatggcttcagttgttattagtttattagttgtatgtgggggcggggaggttttttttttgtttttttttttttttgttttctggcttagttgtgtgttcttgatccagttacttaaattctctgcacctcagtttcatcgcccataaatcaggaataataatagttcttacctcatataattgtcaagaggattaaatgcattattgtatttaaagcattagaacaatgctgaaatgcacactaagtactctgtgctatttttattgttttgttgccattaaggaaataataaccattactactattatttttattattatccttagtcttctctcaaatacccaaactttgacttagtgactctcttgaattattcaatatttctttagtatgtttccctgacttgtctccctttagtatatgtgacccacctcctttcatgctacctaattatgtatatctccattgatactcatgtctgatattctctcccacatagtccacacatctgaagctagtatcatcatttatatttacattttcagaaaacccatattcacattctatcatgcccaccccagccaatctagggttatctctcaacacttctagggaaaattagggttttggcataaatctgtcagaccctcattaggcactatttttatattaatgtataccagtgcttcactatattttaaattccatgttcaaaaataccagttttggggaaaaacattccaaatggtactctcagcagaaatctcaatctgccaaatgacaaggactcaaatgcagtgagtcaaacagctgttcaacctgctttgtgcctagaggcatccaattcctggccagtttggcctgaggatatgggagtagggagtgcagaaagagttttgagttgaatttttattattttttatcctagattcagtttacataagactaataattctcaaacaatttaagactattctatacctttaaaaatgattcaattcagaaatttattaagcaatataaaatacacttcggcaggtatgtaacatgcgtgtcacaagcatataccctacccattctctcccttcattaataatggttctccattccttaaaccaagtcagcctgccaatatgaaacaaaagacatgtttattagttaattagttagtttctttaattggctatattgttttcactcctaaacaacacttactaaaaactgcttattgatggtaactattaggagcaactgactgaactgtctctgtgacatgtttccttacgtctatttgtcactcatggggaagtgaatgaaataaggaacagaaagtaattcaaaatatttgccatagaatgataagactgaagaataagaattaaattcagacctctcctaggctatctattcattttatatagcttactttgtggaatatgttacttttttgaatagacaggtgatatcctccaagactctcagctcaatgataatataactgaaataataattgaggtctctgattctcaggtaaatatttcatccataatctggtaaggattaaaagttgacttttaaaagttgacaatcgctaaacttaaaaatggttcagaggagatacaatattgctggatctaatgtaagtagaaagaatcctaattctgakatatcatggcatagaaaaagacacaaggaattagaagacctggattctggtactggttccagttatttgtgggaccttggtcaaatgatttaatctctctgggattaaatttctttaatagatgaattagttcaatgcccagattgttctaaggcagcatggtattttctaaaataatatagctttggctatcatacaacatttgaggatattctaaaagttttggatacttttctctaacattatccagacaaagtagctgtggaataaatctcactcgtcagctttagttttaaaattatgtactttcacataatccctggaatacaattattaattgtttatgttcaaaactttacagagaagtgacagtcaaataagagaaacaaacatataaaccagtaaataaaacatgattgcataagtactgtaacagtagtgtatacagagagcaataaatctccccctgcttgagtggaaggaggcacattgagaagataacttctcagaatatgggaaaaccagcaacaactcttatctcaaaagtctcaaagccaatatgcaaattcatctccaataatgcctatgtgttaaactcggtacatacagaatttacctccattgttgagggatattgttatcagatgtagaattctaggtttgcagttattttcttttggcacattttattgttttctgatttccattgcttatgtagagaatgcagctatccgattactatcttttggagtgacttttctctgatttatttaaatatttttttctttgttcttcagtagttttactatgatgcttcagatcttcactgcccactacaatagccactagccatatgtggtaattcaaatttaaatttcagttaatcaaaattaaattaaaattccatttccccattacactagccacatttcaagtactcagtagccacatgggactagcagccaccacactggattgggcagaaagcaacactgccattattgcacaaagttctgttgggcaatgctactttagattgtacctttttattttctacatatctgcaaagtgatgtctttcatcagttcagaaaactgttcagtcattacctctctaaatattgcttcttccgcattccctctgctctatgattctaattaaaaatgacttggaactttttactgtatacactatgtattttaaactctcttctttagttttcatccttttgtctttctgtatcttcattctaggtattttcttctggattacttctagttcattaattctcttctcagctatgtaaatattgctattaaagttattcataggattcttaatttcatatatttttcagtttctaaatttctctggttcattttctttttttctttctttcttttttttttttttttgagaccgagtctcgctctgtcacccaggctggagtgcagtggcgccatctcagctcactgtaacctccgcctcccgggttcccgggttcaagtggttctcctgcctcagcctcctgagtagctgggattacaggcgcgtgccaccatgtccacttgatttttgtgttttcagtacagacagggtttcaccatgttggtcaggatggtctcgatctcttgacctcatgatctgcccaccttggcctcccaaagtgctaggattacaggcatgagccactgtgcccagcctggttcattttcaaatagaagttgtttctcattttacattgaaattttatatttatagtaaaattttaatttaataatatgatttattctaaaattttcaatattctatttttaatctccttgagcataaagtaaaaattatctttaaaagtttttgtctgataattctaatatatggcctttttggatatattttattttctgtttcatctgctgattctttttatgctgtcttacattcttgtgtgcctgattatctttgtataacagaagttgtatttgaaagagaatgtgtagaaataatttgagagctagtatattgtcttcatcctgtgtgaactttctgatgctactgccaggcaatggaaatctggatcatcttaattcaattttagggattcaaatttctgggacattcagatgattcaaagcattgctataacccagtgacagctgctttaattccagtatacgctcattcccatgctgcttatctttggagtccaagccagcgtgtgtgggaattacgaaagtcccacccatgcagtcctggaatccaacttttgtcctcctaatacagcagggctgtcaaaagagctgctcagtctctcagccatgtgtctggacaggaaaatgctcacaggacaaaagctgtcacaacgtaccaatcacctgtctagacatctcttttgtccttgatgttgagaaggttatcttcactctcttgatagctctcacatggctttaaacatatgtttttgtatatttatccagtttgtctagttgttgtcattgagagtgttgactcttactgtataatctaccataaatagaagcgaagttgcacatgcatttaattttttttattttggaattatgttaagtttacacacatgtrtgaagattatagagaatcctcacattccctcatccagctatccctaggaataatatcttaaataatgacaatgcacatgttaaaactaagaagttagcattgatacattattgttatctaaaccacagaccttattcaggtttcattcattttaccaatttcattttttctcttctgggatccaattcaggtactattttgcatttagtcactgatctgtgacagttttaagagatattttaagaaatattttaagagatatttagagatattttatagactattattcagtttgggtttgcctgatgttttttcatggttaaactgggcttctggattttgggaaccaatactacagaggaaacagtttctcattgcatcaatcattttttattaatatatgcatatttttttcttttttattggtttatggggcttgtgcttctattaataggtagatttttaaaatgtttttaatttttatggttacatagtaggtatatatattttagatagatttttaacgtggacagcagtatctaaatatttactgtgatttgtaatgtatattttttactaagcattgaatggtcattttcttccagaccttcaaaatattccttaaatatgtcagaaataagaaaaacaagtccctccctctctgccttcctcccttccttccttccttccttttttttctttcttctttacaaacaggttctcattgtgttgatcaggctagagtccagtggcatgattatagctcactgcaggctcaaactcctaggctcaagaaatcttcctacctaaaaaatcagcctccagctaattttttaaaatttttttgtagagacagggtcttgctatgttgcccaggccgttctcaaactcctggcctcaagtgatctttccaccttagtcttctaaagttacagtcttctgagattacagacatgaaccaccatgcctggcccagaggaatttttaaggcccacccatgtaacaaggcattatgaaataaacatgtctcaattgttacacactagttagacaacaatgttcatgttttaggcttagaacattaatcggaaatagttttcttgtgactaatgccaaatccactgagtctaaagtttattacatttccacttgtctaaagaatttttgagacatgtgccaaaatctttagaacattagagctgaaagataccttaggtaaatttctcatcaatctattaaaggatattcaagcccccaatttcagcctctgtatccaaacttcaatactgccctatgttcatatcatcactggagaggtctggcctttccttatggcctctttaatcttaattgcatcatctctgatgttttatttggctttgtttgttactccagttactcccacctgtttcccttcatggtttggtttggccccttctctgccctccactccacattgatttcaagagatcaacaaatgttagagaactgggttcaactactaccaagaaagagcttaaccctgaaacctagcatcctaggcctgcacccaaagggagaagagaagctyattctgagctatgagataatcgtaaggtatcaagtctcagggcctggcaaaggagggataatggaggatataggcaagataataatatgactgggtatgtcgttatccaggctgcaaatagaaggaggctttgagcaaaagccttaaaacagttttattttagaagggcaattttctatcatcaatgccaagagaaggctcagcagggaccctactttgtcctgctttgagcaaatgatactgagctccctaataggagttgcagggtatgaagcaacagactgcaggggcctccattactttgaggccaaccacagggtagagctcttgtgggaacagctacataacatgcatgtccagcagtgccccagggaaccaagccatcgagagctactatcacagcccaagtgctgcctctgcagaaagcagtagcccagatgctattgagaactgcttacaagaactgccacttggaagcaccctgagaacttggctttacttggaaatcacctaggagcatttgaaaaatagctactcctgagaccagaacttttaattcattatatttgtcagaggctcattaagccctatgtatattttaaacaagtactcttggtgattcttatgtctgtattcctggcttaatgttcagctatttccagccttttaaaccctgtaggagaacagggcaccagttatttagggaaagaatattggtcattctaactacttccaactgaagaaagagactaactttttctgtcaacaaatgtgataggttttggtggactgagtctcttggcaggtttgagttgagcaaataaacttcgaactaaaactaggttattgatggtcaaaggggtatctgagagaagaatcacagtaataatattgaggaggacgaactttctagatggcactgctttagagatcctagaattaaaattataatatttttctgttgtatgagacttttccctttctttgactcacattattgcttttaatttatttggattgtcactagactgctagctaaatattcgtggttaccatagtgattttgcttccatttcctcatacagaggcctttaagttatttacatatgatttcctttccttcttaccaccaccttctcactctcctggactgcagctcaatggaacttagattcactttgattctgctttgaaacatggcaggcttgtataaaaatccctggagaaaccatcattaaatcttgaagacacttttttttttttttgtaaactgtatgtagagctttgatattattttgatttcctatgtgacagaattttatatatacagacagaatatttttcttcctcttttcatcatctgacattatggtggtccttagaattgcaaatacaggagaaggaagacacaaacccaagactgtattaaaaaatgtttcagaaattctcctttgatataacattgttaaggttataacatgattttgcatgtgagtttgtatggaaatgagggaatggaaatgaagacctagcctttctcaattacccttgcaattgttcctttagggagaaacagcggagtattactaatttgtattggttttcaatagaaatttaggtaaataattatttggggtttcaggcttcctttctctaaaaataattctttttagaccaatgtggggccaatcagtacctggagcaacaatattaaagtacctccttacagtgaggtttatatggagtcctctaaaaaatgaaatgtttcaactctggttggaatacacagagcagctgaaatattttgaaatgacacacacataaaatacataatttatttaaggtaatttattgttatattttaaaaatacatctttttaataaaataaagataaaattaagaggattatattcctcctttttctttgttgatcagttactagactcccttactcctccaaaaaaaaaaaaaaatatatatatatatacaatgcccagaaagtatccacaaatccctgttaaattaatgcagtattgttgaaaaacaaagatggccagagaaactgaatgagaatggaatcctgaggagaaaacaccaatatttaagagacctggttctctcagtgttgtggaacaggatccactgatatggaacagaagggtaagcttctgttaagctaggtaaggaagcttagggttgtgaaagaaggtacaaagacactgcacactgacttytggggaattacctggatttggctttcaggtagctctgccaaggattaacaatagggttcagaaagaagagtaaaccatctaatatgtgccccagccagtttacgtggttataataacgatcaaattagatttttatggcaaaactctctttaacctctacgatatgatagtatttccagcctttttattctcaaggttcagtagctaacattggcttaagcccactcctaactatgaaatgactgagctggctcagcctggaatgagagtggggagcatgagagggacacagccataccacatgaggccatggctagggaaggcagaggctactgaacaagactgaaggaataagcaaagcaaaaaaccacaagcttgctgaagttggaggaccagaaggaataggtgagggtctcagtgctaatgtagggttaatccagggccargtagacaaaaataataataaaaccacaacaataataataataayaaatgatggctagcatttgttgcacatttattttatggagggtgttaatctaagaaatttcccatgtataaattcatatatactaatacttgtcgcattttacagttgagaaacaggtattacagagaggtcaaataactttcccagggttccacagctagtaatttttggagctgtgatttgaattcagtgtattctcagagcaccagaaaggtacaaagctaaaagtttccttctgtgtctggggtttcctggaaaatctgctctgccctataagctcaggagtcccccctcctagcagttcctgctgaagctctatgtgagattgcacagacctgagtttgagctgctgcttattttttattttggggttttagtattttcatgttttaggttaaaaaaattctttaccttttagctttgatgaattacttcatttttatatctaataggtttttttaaccttcactttaattgatttcttaamctctttatcttgctcattttttaatctttttaatgattttaaaatgctgattttaataattttatcttggcatatttatatttatcagtttttctgcttcaagctttattctggcaaatgatgtatatttatatttcttttgtgttgttttttaaatattttttatttttgtttctggaatttaatgtatgtcagttgtgcaatagacttgttagaattttgtttgctttaataatttttaaagtgactttttgcattacttttgatcattttactcttagcttattttgagcttttgatgtctaaatataactttgtttgtctagtgttttagtgtctttagtcattgcttctacatggcaataggaaatatgaccataaaaacctcagtgaaagtaacccacatttagagaaggcttgtattccttaatcccrcccctctacacaccccacccattcracccatctgtagcctccctttcagctgttcttaaaagaccttcccttttaagggaacttacattttcccttcaatactaaatcccaaaagctaatagcaatacagaagatccactgaccaacatttcttcccaagacaataatagtaacttatatgcataattgttaaagcaattttaagattttgttttgttttttgctatccaagttcctaagacatgttattcctctaaaagtttactatatgaaatgattgactaatggttgaacaaatactataaacacataaggaaggtgatatgggttttactcacagaagattcctcaaaacgcatacctgatttggttttaataaggatcacattacaggagatccaatagaagctacttaaaaagtgttttagaaaatgtttttaaatattaatttgcatccattataacattactatttgaatttaacttccttccaatatacctgtagaatgagctattgagtttaacttctttccaggcatggttatggagcctgctagtgtgtgggtgtcccggggccacaccgtattaaataggctagtgataaaatggataggacaagatttctcatcaggaacatttttaaacacagaatctgttgattctgtgttgggggcagaggctgggagaaatagggagatattagtcaatgcattacttttataagtgggcaacagaacccatgttgtgtggtcaaagtactgcagaacttctcaagcattgtacacgtttcagtttttgactacgactttaatggtccacaagaaaggcctctaagaatctttttcgtgtccatttctataagagagaacataatgctgtgttagacatagttgagatccattataataatgtcactacattttgaaataaaattctgaaatgccttaatacataaatccttttatgaagtctttaaaattggctgctaaaaccaataaaattatatttttggaacatagttaaccactttgtgcacataagtgaggctgtagaaactagggttttaaatgacttaaaagatatatatttctccaaactataggtaattatatcaatattactttgacagagatatagtaattctccatcttatagtaaaatttatgaaaacattaagtaaaccaacaggtaaatacatttttggtcaaacaaaactttaaaaattatgtttttcttttatttggctcaagctaattctttctgttatttttattattaattgactactcaggtaaaattctatctgaattgaattgacatcattgatcccattgtcagaaaagacagccctctatcccattcaatttattaaactgctaatcttctggacttttcttcaaagcttgtcagttttgatccaaaaaaacttcagatttcattgtgtggacctgttacttcttgtgtgaaaaacagtatggtttcatggaatccactcttggccattgttaatattgtacagataggcacacaagcatttaaatatgctagcaccttattgcaaaaaaaaaaaagttctacttatattcattgcaatttattatagaaaatgttttctgaactgaaaattataaactgttgtcaataattcaggtcccaattctgaagtgtattgagattaccaaactgtgaagcaggaacaatatttattctctacataaagaaagaaaagaactattaaatgaacttgatattataagaagcacttcaggttgtcaaaactcatattatgacatctataatctggcctaaaatcacaagcaaacattccatgatggaatggcagatcatgctagatttgctggttattatcagttttattttacgttacctaagtagartttaagcctttcagttaaaatatgactcccaagcaaaaggaagaggattaatggattaactrttgtttgtgttatcaataatattggcaataactatttgtctatggtgctgtgtcagttacaaggcactctgccatgcattcttccatctgatcctcaccaaagccttggagatgcttcaagccaaaattgttattattctcattttacagatggaggtgaaggaactgatttgaggtcacactgtggtaaatgttcaacactaatctctggtccaggtccagtccagatcttctgatggcaaaccttataatcattccacttcataaatggaacacttaggtccaatcagtcattttctaaatgtgtatttactgttggtcacaagagtttgtgtgacactgtgtggataattaaatgccatccaccatctctactcggaaaaacccaagggtgtgtcagttaatcagtcttaacaggaaagataatgtactattatcattatggcaaaagtacacttgaaaatacaacaaaggatattgaagctattaaaataagcttcttatccttagggaaactatttcaacactagagctatcatcaaaagtccttgagacaagtaacccaggagtggaatggttrtgattacactttataagcaaacttaaaaagatatcaggagctgctttactaggcccctgctatgaagtgaaaactggagaaaaatctacagcaaagcattctagcctgaggatgtgtactattttgcaacacagcagactgactacagccaaatattttcattggaaaaatgtaaatgaaaaatgttgctcaattctgctacctgggtagtacataagacatgtaatttaaattctaatcagggataacaaaaatcctatgatacttattttgcaaaggaaaatggcagtcctggcaaggttataagttagaaaattatattttctttgtgtaaatttgttctttagcttcattcagtaatcagaattatttatttccttattcaaattgtaagtgccttctaaacccgagcctactactattatgttgagccatgggaaattgccaatatttgactattttagtccattaaaatgcagtttcatatggtttaaactaatatgtgccaaagcatgaatagaaatacttgcaggaatactgtcctaagtataacctcagatgcacacagtattttagcaaaagtatcaatgggaaatcaggcaagtcctttcactgaaacaatttataagtataataatttattttgtgaaggccttttctttaccaaattagtaatatggtgaatattaaactaaacctgagtcatactacatttgtttttaaattttgtagggaagggggraatagcaaataatattttatgctagtaatcaggcattatatcagttgttgtaaggaactacatgaaagttggtggtatacaggttaccagtagtaagtttgggaactgtgttgttttggctcacagaatataaagcgtgtatgtatatacctgtgtttccacatagacacactctgttacccttatatgtattgtataatcacatgtgtagatgttcattgtatctggagtgacagttgacaccttttaggggcattttacatgttttaaaacctgacatccacttacagcacttatctactactctcttcaggataaactacctttattgcaagacttttgctaaaaattcttagattatgtcaagggaaaaaaatcctctattgctttttaaagaaaaaattatcagaatgatttaattttgtgttattttttatctccacattagtttgttatttcagtggttatttcagttaaagacatttttctcttccattatttcaatttgttacattgtatccatttatctcatagaaagataaacttttgtgttgaattagctgtggaagaccagctcacacattaatcactactaagcaaatgcgttacaaaaaagagaggacaacaaaaatgagctggaatacagtttcagttcaaccaccaaacgatttgatatcatgaataaatttcttgggtatatgtagccagtaagtagacctcaacatttagctatttttttcaataaataaatattgagcactgtctttatggcaaacactgtcttaggtgcaggggataatggacattatgcttttgggggattagataagagaggaaataagtcagagaaaagatctctagcacagaaaagtctggttacaagattacagagagagagagaaaaaaaaaactgtagtgacttgtctagggaactgtgtggttgccacataraaaatgtggaagggagtgatgggagacaggctatgttcctagcaattgccttgactcaccataattatttcacctactgaataactgaataaattgagtagagaggctgcttgtaccaaactgtaaaacagtttcaggatgagaaaattacattttaaacatacacttagggaaaacaaaaacaaaaacaaaacacctgccttgcagaaacatgtcatagaaacagattttaggcagaattatttccctgtacaacaattgtgattaagtaaatgttaaaataaaaagaaggatgtttagcagcataaggaatagaaacatttggagttttagctttagcttatacaatgcatcctgttttataattgttttccaacaatgtttacataatgkgagggtcactctttaacatgaggggctctgtcactagaattgcagtgtgttagcccctcattttctccagtgtttttgtaaatctttccattgacaatcttttaataatttccaaaacaatcgggggtaatgttcgaattctaagttcttgtcataaatgaatcaatccagttggcaggagatggatgtagtctttttgctggtgttccgtgctaagaaaagcacacacatttttcttgagagtatggctagccgaaaagcatctgagaattgatggaatcctaaggcagacagaaacgccaaaagtcaagtaactggttttgtctccagcacttacagtttgttgtctgggtgccatgacataccctctactagttaattccattaagcaacatgggccatttaaatataggcaaaacaacaacaaaacaaagcaaacaagtaaaaactctgtgaccacagaaagagcctgtaacatagacagaagactacaaatagtgttcttagaagataaatcattaagacagtagcaaaatgagaaggaatagtgtcctgggcaacataaagtgtgtgtacccttctacctgcacaaacactcaactgaaatttgccaaggctcactagtgtctttgaggcaccctagagaggggaggctagaaataaccatcatcctcagctgttccatggtaaggccctacactaggactcagaggagagatagtttggaacattttatccctatcagtggaaaatagcacagttggtgcctaacttcctttcgttgaaaataacacaggtaattttttagccaaatgagatttttatcaaaaaagcaagcaaaggcagaatgtgaaaaggagctgatatcagtaattccaaggatactaaaatttgttttaaataataaagaaatagcatcttcaggccctttagactttggactccaaaattggatgcagatcaaataggatatttatatattaaaaaatcccaagagaacttgtacagcataaggtaaatacaaatcaaggttgaacaggtataaaataattaggtcaagagcaatcagcaaaatatatgcagaaccaaacaatactttgatattctggtctggaaagagaatttggggttattctgaaaaatactgtcactacaactctgtccagaacccacagctgcagaaatgagtaaacaagtcatcttattagaagactgcaaggttaaagaacagctaaagattcaaaactaaatgacattcttgttagttcccattgatacgattataactcacacaattccctaaaggaaaactacaaaaaggatgtttcttgagataggaatacaaataaacttttgcttgtttgtttgttttgttttaaatccagtrataagaatgaatgttttctgtatttgctttttttaaaaaaactctatattttatgtgcagacatttaacataaaatcttttcccaatgtctttcttagatgattaggtagttgaaagacgctactgtttacgaggcattgctaaaagcttttgggttccatgagggagagggccatgacmtactcctttgtacatttccccactcctccgtttacatcacataaacatatatgtatggtcttccatgcagtcagccaaatcagacaaatcatgcctaggagttgaaagtgggaactgatttgtctagtttgaatattctgattagtgaactagctagcttagaattttgtggtatttgcatatgtcattcatttatgtactacagctacacctaaatcccagaaaaatcggtaacaaaataacctattattctagatttaaattttaaaatccacataagaatattaataacacaaattatttgtatgacaatgacttctatttttttcatttcaccctcagagatctatatacttcctctatccaaaaacaacacagaagcaaaatgttacagagacaccagaatgttgcccagaaaaccatgcattaattactcaagccaggaaattcccaattttgcaactctattttatcatttaagagagatctttccacatgtgtgttctaaaaaagaacagagaaataaccagtcctctgtaacttagcaaaaatacaaattggtgtttccactttgatttctctttttgaaataaattttcagcttgactttcttttgcctcgggtattctggatkatcattttgtagcatctggataattttacattaacatctggagttgagggtctttttatttgtcggatgcatatagaatacttctgtaagaaatgtattttcccagctgctgtttattcattttaaagagacatggttaagtaagtctaacagcctccttaggaaattcaattcctaaattccttaggaaacacaaaccatgtttaatctgaagtcctgccagtctgttttctctcctaccagcttttcccatggcagaaatggttgagatctgtacagaaggaggactttagtctggtaacaggtggtgttgctgagtgcaagggcctttgaaatcaggcctggtttggaatcttggtccagcaatcaatagctgtgtaatcttaggtaactctttgaagtttagtttccgcatcyaagaatgaggaagtataaatacatatctgcccacgttggttgtattaaatgagatamtttacataacacatccgactaaggtgcagatgtaataaatgacagctgttattatcatttatttcagcacgttgcagaaagcaacttacaatttcttcttttcctgacctcctagggcttttatgcatgcaattagcaatttgggatttgcacaaggtttttccagagtacaagatttttgagagctgtgactgaatcttattctttagaaacttgctctttgagtggaggaaaaggaagaaactaagttgactaatgacattataaaagcaggtagagaatcatttctttctgagcttctgtagcacaggctatgaagtgtgctagtaaagtaaatacaattttaagcaaagtttcagaaatcaccataataaaataaagtctgtaagtcccagctattaaactggcagggacctacattcattaaattaaatgcaatgtgcaatgttgttcgaaagttgttcaaaatgtttttagaatttttcttggagttgattgcttttataatgatgacttcacgtcttgactctcagtgattttgtttgtctccttagccccaaaattattcaccttaaaagatgaaatttggtaatattaagacagtcaaaggaatgtcctgaagttctgatcacagctatgaatagttctaaaatcttctaaatatttttgggatatgtatagaaccaagatgatttgtgtgaagggtttttccattcacttagttgtattatattttaatataattgtttaaaaaagattcatgttatagtcacagattaaaaggcagtttttaaaggagatgaattaacagtttcagagaaacaattttaataacatgcattttatacatttatttattctgaaaacagtaattttcaatatactattttcttataaccactttaaagaaattaaggacttgcaggttgtctggttttttactatttttcttatscatagcaaggttggtgctcaataatactagatgagcaactgaatgaagagatgayaaaaataaatgaatttattaccactgcatgttaaagaagtgtacttttttatgcttgtctttgagaaaagtgtcaaggtggcatacatgacaaaacacaactttaaaatgacaacaaaaaattaaaatttcactgaacaaaataaaataaaagaaaaatgcatactagctgctcatctgggatgagttagttattgcaattcaacttgtaatttaatgcagaattttcagacaattagggccaaaaaagaaaatgttaaattagctagtgtctgacaaagaagaaagctttcaaactttcaagacgaacattttattagcaatgaattctcagagcaaatttaatgcagtccttatgtaaggatgtcagatagaaaaaagtaaaaggatttcaagcatcactagtgcaaaggacaatattacttgcttatttctgcagtgtaacaaagatgaagatattctcttaaattttttactcaatgatgattcatgtgtctctgagaaactaagataatatgatttaattctgtgcttttgggatagtctaacttaattcatgaaggagtacaggggatgggcgctttgtgtgtccactttgtttgtcactctcaaatgtcagatgtgcaggcaaattctcagagttaaattacttgacaggaacttaagcatccgtatttgttgccaggtagtcttctgtgtggttaaagtacagaatgtactcctacaaaagcagagaggcggcccgttgccacacaaaagtgttttttcagatggcttatggttagaaccaatatatttttctagcatacagtttgagtgataatagctcacattccccgatcacatgccttgtgccaagtaccattctaaatgccttgcatcttgtaactcattaaacctttacagtaacctcatgcaatgtacactcttgttgttcccattttgcaaataagaaaactgatgggcaatattaccttgcccaagtttatacagctggtaagtggcagagtcaggatttgaacccaggctgatggtatagtctgcgtgctcagccacaatcatgaacttaccctcaaactgcctgtgtttgcataatcatgtggatactacaggatagattctttagactcatcttatgtaggaggaatagtgacatgaaccatcawaagaggagcattaactaaactttgcttgtcttacccatgaaagaacatcagtgtgactccctgccaaatatctgataatgaaaagaaatgcattgtgatcagcaagataaaatgaagaaaataaaaatgtacactgaaatagctgaacgaatgaattaacaacctattttatagcattgtgctggagaagaatgctcatcttacagaggtgattgtgtctaataaaaactgcactggatttgaagtaaaaaataaaaaacaaaaactggatctaatttccaattctatcactcgtagtctctgtaacctcctagtctctttcactgggatcttagatgtgccttcttagaagctaaattttcttatctgtgagttggtttacgattccttcttcctctatccactcactttattgtgatatcaaaataagatagcatatgtgcatatccttggagattttaaagctatctgaaaatgtgccatatttaaacatactgwacatagttaaaagacatgcatctgattaatgtaaaaactataccaatttattgtagtccacttggaaagacaagtagcttacttaaagatctattttgttgcatttaaagttggaaatgaacctgatataaatctcttcccaactactgtgatcctgtctttaatacaactttaatagactggaacatatgccaagagtatacagtcagaatctctctaagaatcaaagactgatgagaaacctctgaaagctgtgaaaagtgtgttattgtttttaattgcttccctaaagaatgagagaaggcraagctgggaccctagtggtattgatgggctgttgctccttatccatgatgygtaagagtgaggaactaagtctgaaaactttttaaggggaaaatagcagtatagcatactgaaagttttgttgtaatatttaaaaatgccaattaaaaaatagtgcaaaattgtataacgcaattatatgagaattgttttgggatcagcggtccaaagacaaagaaagtcccctcttctctccatgttcttttcactgctagcagcaattaacatttggcatatatcctcctagatttcattttttatgcataagtgaagacatatcaataaaatgtgttcttgttatattacatagttcttgttttaacacaagtggaattatcctctacatggtgtttatgatttgtttttgcacttatgaggttgtgtttaaaatgttgtacatttttttaattttagcattggtaaatttactttgtttttattttaacatagtattccactgaaatgtaattatactgcaaattatttatcatatctccactgacggtccttcaggttatttctaacttttcttgattataagcaatgttgtaatgactatcttgtacaagtatgtttatactcttccattaatacttatgtaaataaatctgataagggaaattgtaggctaaagcatatattatacattttattttattttttattaattaattaattaattatttatttatttttgagacggagtctcgatctgtcgcccaggctggactgcagtggctcgatcttggctcactgcaagctccgcctcccgggttcacgccattctcctgcctcagcctcctgagtagctggaactacaggcgcccgccaccacgcctggctaatttttttgtatttttagtacagacggggtttcaccgtgttagccaggatggtctcgatcttctgacctcgtgatctgcccacctcggcctcttaaagtgctgagattacaggcgtgagccactgctcccggcccacattttatttttgatatgcactggcacaaaattgtgtgaagaaccaattaataaatatgtctaaggaatatagtttccattgttttaattatcaaaaaattatcacttacatgggctctagttatacccatgatatgaccaatttaagaaacttgaaaatataatttctagcacgtgtatactaatgcgagatagagaagttttatttacaaccagaaattgttgggtccataaaagaaacaaatatgtctagaacattttaaagttgccagagcagatttcaagatattccagcctgagtccctcagatatgtattttggtgattgtaaaaatatcaaaagaaattatttgtgtccgaaagtcacaatatgcgtgagtcatcaacacaataagataaggctaaaattgagtttcagatattttgggatttctgaaaaaaatttataaaaatccataatgtaatcatttgtaaaattttaaagtttatcattacgaaaaggaaagtcaaaatcaaatgaaataaaacaagctttgttccatgggatagtgtcagtcataaagacttactagttaggtgctaattcattttgagcttacagggttttatcaggatcagactaagtaaaaatgtataattattttataaataaaaatgttttggggtttcagatttaaaaatcaagagtaasaagttttacaatatttactaaagattacgattagtataccacaaaacatctgaactttagatattatttatrtgaccttaaaagtcagacctttccctgccaatgacttaacttctgtctttagtgctattttgtttgaaggcttatttatctgctatgaagtgatttttctacgactttctacatgtctcttcacattgggttaggaaatcttcaaggaaattaatatcctcgggtatacacaaccttttgctgtggtatttgctctgacatggaacaaaggcaaaagatacgggaaaatgtagaagtgggcattatagaagaatccaaatgtgtctaatgtcttcttcatactaattccttctagcctttatttaaaaaatagcttctgaattgcaaggatatttttaagccacatgaatcagtatgccccttcagctggacttttcaaggagcctgtgaatgctgaaatgattaacattatgtgaagctaaattgcactgaaccgtggaaccatgtggtgtggcaatagtgggtggggagacatattagtctagaggtccctgctgagcaaaagacaaagacctccttctccattgtcccgcactgatggtgggcttgggatgtattttcagaaataattatttgcagggaacttayaaaaacaaatgaatcaccctcatcactgtgcttgttccgttttgggatgtttgtctactagactttctaaattgggagatttagaaattcagtaagaaagatatttaaaaaaattttttgaggtcctcagtgtcttctgcaagtacactttcaatttttattacagacagactctcttgatgctgttgtttaccattgcatttttatttaacttgaatattttaatttagcatgagtcattcccatggattagcaactttgtatgctagcatatctagttgtatcttctgtgtgttttcaatggtgtgtctgctactccaaagatcttcctgaattttacatattagaagtggcatagcctcatgacactttatatcaagcaggaagttctggaagatgatgctaacaaatacctcaaatctggaaattgtaggctttagaaaaataaagtcatcttgttagtgaatctctatattagactttctaataccttataaacaggttttcagaaattaattatatttatagcctcgagaaactagggaaaaagctggatctcaaagacattattacaaagcagtagtaaattataaacaatatattttgaattcataattaaaattaacgagtcaattttctgaggcattgacctattaaagatttatgagttacctaaaaycccaaatcttccctgaggtaatagcttcagttgagataaagggaaggtatcttatttgtcgcttcactgcaggaaaaaataaaatttgtgattatgactcattatcatgatgcctattgcaaaattacagctcactcttaaaattatgtgaaaaaagatcattaaatgttttagacatttcttaaaacttataagcaaaactttcaagttttttaaactgatttactggttgtatatgtagctaattgactatgaaaacttgaagcttaactctttgtagaccttccatcataccattgctttataaattattaccagaatattgaaggaaataaacttttttctaaccatatttatgcaatcaatatttattaggtagtttttgagaaaatcttatatgagaacttattccttgtatacmaaatgtttcatggaacaccaccagcatagacatttttgtttactctgtgcaactggatttcgttctggggagcttcaatttgtacatgagctcattttcacaaaccatcttaccgatacttagagtccaaagtgaaattcaggaactatggcccagcaagctttcatgtgctattctttgcttcatgactttggaaatctatgggagaccctgtatcactagacagaatactgaaaagcaggattacatatgaagtttaccatctgatttttttcctaagggtttttacatgaacgtttattccttgtctttttgtgtggattcagcaatctccaggtttactgaacaggggttgtgaagggcagttgttcacaactgagctcattcccactgtgttgatatactccggttcccccacatagctccaccccgctaactcccaacctcatgcatagctccaccacactattgggcttgaatctaggctctgccactttctagctggttcctgagcaagttctttaacctctctgagcctgtttcctcatccacaaaaaggatgaagaacaaaaaggacgaggcaataccttcttaacactgataattaaataagataagcttaaattataaaatcagcacagagggaatgtaaattggttcaaccrttatggaaggaaaaaagtaggaaggttcctcaaaaaattcaaaatgggactgcgaggccgggtgtggtggctcaagcctgtaatctcagcactttgggaggctgaggcaggcagagcattttgaggtcaggagttcgagagcagcctggccaacatggtgaaaccctgtctctactaaaaaacatccaaaaattagccaggcatagtggtgcacgtctgtaatcccagctacttgggaggctgaggcagaagaattgtgtgaaccgggcaggcagaggttgcagtgaactgagatggtgccactgcacttcagcctgagcgatagagtaagactctgtctcaaaaaaaaaaaaaaaggaactaccatatgatccagccttctcacacatatatatatgtgtgtgagatatatatatatatatattcaaagcaattgaaatcaggatctcaaagagatatctgcatttccgtattcattttagcattattcacaatagtcaagatatggaagcaacctaaatatctgttgacagatgaataaataaggaaaatgtggtatatacatacaataggatattacttagccttagaaaaagaaggaaatcctgccatttcaggcaatgtggacaacatgaaggacattatgttaagtgaagtaagccaggagtggaaggacaaatattacatgatatcatttatataaggaaactaaaatagtcaaaactcagaaacatgagagtagaatggtagttaccagggtctgggttggagggggaaacaggaaagtattagtgaaaggataaaaagttttatttatacaagatgaattaagtcctcgagatctactgtaccgcatagtgcctagacttaacattactgtatcgtatgcttgaaattttcctaacaaagtcaatcttacaaatgttcttatcacaaaataataataataaagagagtgagagaaaacttttggaggttattgatatatatgtggcagagacggtggtgatggtttcgctggtgcatacttatctccaaactcattaggttgtatacatcaaatacgtaaggctttttgtatgtcaatcaacctcaacatgttttttttaaagcagtatagaaatacctattttttaaaattattacaactgaaagccttctaacttgtggtgttttcttgaaataataatcgtatcttggttaatagttgagatctaaaagcttaggcctaaattcagatagaaagcttggcacatctgttgtaagttttgaaaccaggtgcacagaccatctttgttccagacgatcttctcagggatgtttgtaaagtgaacagccttggaaggtagagatgatgtccccctgggaagcaaagggtaggtttactcatagcttgggaagagagagatggtgtctccctccagatgaggggaatatatttaccacccataagaaaagatttgaacccattaagctgagggttcctcttctgtaacaccacccactgtgagtggaggcatcagctggcctgctttctatctctctgcaggaagtagagcccaggcaactggcaccaaatatgccaaagcttatgctgcttcctgggctgtgagtaataaagtcccttttccctcttttagaagtctcatatgttctgtcagcagccaccaagctgtgtcaggctaaattgctgtcttgcaagtagaataaaatcccagaccctttgcaatctttttcataaaaaaaattttaaataccatatatttaccgcatacagttcagaattatttattaatagtatattcacagagttgtgcaaccaccaccacaatccaattttagatcatttcaacaactcaaaaagaaaccttgtacacgttaagtgtcattcctgtacccactccctgaaaatctgcttgctctagctgtgttggattgatgtcagaacacaggagggaagggcaaatgcaagggagcaggtaagaggctttcacagcaactcgggacaaatgatagtggcttggagcagggtagcagcatgaaagtagtgagaagtggcggaatagaagatacattttcaaagtggaaccaatagtatttcctgaccaattggctctgccaagaggatgtgctgatcaattttccgtgaggtgtgagaatgagatggctgagggatgagtccatggttttggcatgagcaaagggaaggattgagttgctttgaaatgagttggggaagactgtgggcatagcaggttttgacagagaagaataggagttcagcattgcatatgttaactgaaaatgtctattagacattttggtgaagctgaatagatagtgtatagtattctggaattcagatgagaaatgctgcttaaagatacgaattagagaatttaaaatcatgagactgcataatatcacccaggaagtacaagaagacctagaaaagtaacagtctgagaactgagctctaaggaacatctacctttagaggtcagagagatgaagtagagcttgtaaaaccaaggagcaagcacacacagttttggacacagagatttcccataagagcattgcaaacgttacatattctctttgttggatgtgaaaataatcttttgggaaatgtgtgcttagaccttgatgtgatgcatagggacaaatttctaattctatttgcttcctaagaaaatgaaatgttactaaataaacagcgtcagggcaaggagtccaggtccataaagaaaaacttgcacagcatggtgaataaaattaataatggtgtattgcagattttaaaattgctaaaagagtaaatttcaaatgctctcatcataaaaaatattagtatttgagggaatgggtatgttactagcttaattgaattattccacattgcattcatatattataacatcactttgtaccccataaatttacataattagaaattgtcaatttacaataaaaaataaaaagccatcaaaaaacgccaggcaaaaatatgtgatatacttatacccatatttaaacctacaccataaattatatttaaatttataattctgcctgctgctgttttcagtaattaatatcattaagaaagcacaggttaaatcaaatttcaacacagtatcatttcagtataaaatctcatattttgaataaaacaaacatatctttacacattattaaatgaactacgctgacaaattttgtttcttyttttgagaaccagaaaaacaattatacttagatgggccatctaaaatgtccttccagcttgtggagtaggttgtgtttgtttttcaatgaacatctgtttgacaaattgaaatgctarttatgatttatcatttccatgacatcaaatatccagatagtaataaacgttgatgactaactatatttttcagtttcasccagatgtttggcatcacgtaagataccaccttagttttacataaaaataaaatgtttcttgagtctggcttatcataatggggaggaaactaatatgaatgaagcagaatggttcattttttttctcaatgtgtacaattctactggtaagacttttacaatatcataaataaaattgtactttaaaataagtgtctttcaaacttttacaaatacaaagaaagccagaatcaaaacccaattttgaatatcaagtgttaaatatgaatatcagaaactgaatatatcatcaatacaaattttaaaaaaaataagtttgtaaattcagagtttatccctcagatgttatttcaagcatatatcatagtgacatatccttgaatatatatttaagatccgatagggactgggcacagttgctcacaccagcattttgggaggctgaggcagatggattgcttgagctcaggagtttgagaccagaatgggcaacatggtgaaacgccaccagaaaaaatgcaaaattagcaaagtgcggtggtgtgcacctgtagtcccagcgacttcggaggttgagctgggaggattgcttgagcctggtaggcagaggttgcagtaagctgagactgtgctactgcacttcagcctggatgacacaggcagaccctgtctcaaaagaaaaaaagaaaaatctgatatgataatttagaatatgggtcctcagggccataaaacagcatatgctagtttgttggcttttactcaccatgctgtgcactaaaagtaaaaaaatataaagtaaagcccattcttttaactgagattttgtgccctttgacataatctctccattcccacagccctcagcctctgtaacttctatttcactcactccttctaagaatttgattgttttacatttcacatgcaagggagaacatgtaatctttccaaatgacagaattttcttttttaaagctaaatagtatttcatcgtgtatgtgtacgacgttttctttatccattcatctgttgatggacaggttgatttcaaaatgtggctaatgtgaagtgctgcagtgaacatgggagtgcagatatcttttcggcaaaactgatttcacatcttttgggtaaatacctggaagtgagattgctagatcgcatcgtgattctacttttagttgttttggaaaactccatgtagttttccataatggctgtactaatttacattcccaccaacagtgtacaaggattctgttttttccatattctcgccaacatttgttatcttctttttgatattacctattctgacaggtgtgagatgatatctcattgtaattttaatttgcatttccctaatgattagtgattttttcatttatctcttggccatttgttagtcttcttttgagcaatgtctattcagcttccttgctcatttttaatttttttttcttcctcttaagttgatggaactctttatatatttgtggatattaactttttattgaatatatggcttacaaatattttctccacattcatagtttgtctcttcacattgttgcttcctttgttgtgcagaagctttttagtttgatatgacccaatttgtttgtttttacttttgtggcctatactttgggggtcaaattcaaaacattattacccagatcaatgtcatatactttctcccctgtgttttcttctagcaatttggagttgctggccttatacttaaggctttaattcatttcgaattgagttttgtatatgatgtgaaataaggggccaattttattcttctgcatgtggatacctagtttccccaacaccattcattgaacagactatccttttctcattgtgtattcttagcatctttgtcaaaaataaattggttgtacatgcataagttgatttctgggctattatgctgcattgacctatatttcttttttgccagtaccatgctattttaattaatactacaatagctttgtagtattgtttgaagtcaagtagtgtgatatctttatttttgttttgtttgctcatgatgattttgactgttcttggtttgttgtggttccgtgcgattttaaaattgttttttctatatctgaaaaatgacatcaaaatcttgatagtggttgcactgaaatctgtagattgctttgggtattatgaacattttaacaatattaaattcttccaatccatgaacacaggatatctttccatttattcatgccttcttcaatttctttcatcaacattttacagtttgcagtgtatgcagatcttttcaactccttggttaaatttattcctaagcatttaatcttttttatagctattgtaaatgggattttttaactccaagtatatttcatagatggcattgatacagtaaaatcctttattctgtaaatggcatttatatagtaaaatcttttccatggtgaatgattattagtcttaagtgaaatacaaagatttgattttataagtgaaatatttcttaagtaaactatccttggctgccagtttctttcttaaaagtttaatatttcccagcaacttcctgtggttgactcttaaggatactgaagctgaaaggagcccagcaattctgggtgatggaggaaatacgtggccaggctctgctgtccgtatcttcctcaattttcaacttgaattttatacttctactctgacctttaatttttgtgatctaatttccttttccccaataatatttgtttttgaactagtcttcctcatgccatttaaagaaaaatttcaggaataaggaaaaacacaggagtattaaaatggagaaacatcaatattgttataaacagagcaccccaaaataattattttgaaagagatgcactcatttgaatttataaactctggaatgcttattttaaaattaactaatgtgttaacctacatacaaatttgtatttttacttgaaggaaaagcagcattgctggtagtgcacatgtgcttctgtacatacagattgtacacattgaggatgatgtttatgccataagagaatcatttcctctctttttatcagggccattacatcatttctcaaatagaccactgttaggaagtagggatatataagtataagggaggagactcaagtaaaaccagagtggtgcatatcctacaaattgagaataaggcatattttatcttttaaaataacatattttggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccaggcgtagtggcgggcrcctgtagtcccagctacttgggaggctgaggcaggagaatggcgtgaacccgggaggcggagcttgcagtgagccgagatcccgccactgcactccagcctgggcgacagagcgagattccgtctcaaaaaaaaaaaaaaaaaaaataacatattttagagactcagtaaaataattttaaaggggcagaagtacagatgtagctgttaggaggaagcattatttcagctacagcacattattggaggataggaagagcatatggtattccagtgaaagagcttaattataatagagcagaaaggattagaaacagaaaagaaggtggattatcaggaataaagtcaaagaagggactgaatattgatcagattttcagaaaaacctgcaaacaaaccccaccacatactagcactagtcataggactgagatttgtcaaagctagctctcttctggtgcactctggttcactgtgaatataagtgggccatagagtgtgaccattgtggtctctggccctaggccatggagtgagataattgagacaagagaagtctgtatatcatctctccacataagcaatagagctgattgggctgcctgtaaacaagattttagagactcacttttctttttcttaaaagactgccacacttagccatctgatatggaatggcatctcctcttaatgagcctgtgtctttatttgcaccttatcaaactgggagatactgaagatggcagtgatgctgatagtggtgagacatggaagatgtagaggaaacctacaaagaagcctgagataggagagaaagggtaatttttagaagtagattgggagaactgcattctgggcaataaatattcactggacttacagcgtattcctttttttaaggaaccaagttcacagttgttagaactacaagagcacaacattacataatcatgacatcaaataagcataaaaataatgcttatttttaatttttacaggtgccattttataaactatctctataaagagattaatgttagcttcttgttttggaaataagataatgggagggaaggataaatgaaacagttttgttgccatctctcattgtgagccagtttagaaatgaaaacaaacaaacaaaacaactcttaagcccaacagcaacattcattataattttcctaattacactcccttttctttttgctaagaaagaacggttgtatttttgtccttaatagaaaagggaacagtgcctaaacaacctattataaattcttctgggaaagcatattacaaataattgaaaacaaccctgattctgtgaacttggcagcaaatgtataaaagaaagcaattcagccctggcccctggatgattgattaaatgttttattctttttacctttcattcatgctgtgtttgtcaagaggaaagagaaaaggaatgttgtgaaatgaagtccactttagacaaataacttacaataatgatcagtgacttctcatcagctgtttattcatttttcttgagttgtaatatttcttaatattagctatcctgcatggacccgacagaaaataaggtcctgagttttagcttgtccccaactccctgccagctaaccatcaacacaagctgtatctgagcttctttgagggcatggccctgcagctccctgtggtcagttattagtctgagtccagcaaaggaacaagaacactgtgtgcttgctaaatctacagaaaacttcatcttctggttgtgtgggaggagaggtccctttgtgtactctgtttctttgaaggaactagggatctgttggtgctgtacagatgtcgaggtgcacagagccaacatcctacaaaactagtaaatagatgattaggatccaactctgtacagaataatggtaggaacctaaaccttggggtactgtttacttgtatcaaaattgttgttgtcctataagccatgtaaaattaactacaaatctcctcaatgaaacactttcttagaactttgatatttttaaatgatatctcaccatctgtgtacatcacaatgttgagctacaaatgtggtggctctaacaaaattttaagtatgaagtcagatgtatagwggatcccttctccatcacgttcttctgtttttcatttcccgcttctcacaaactactccccagatgtcaataattctacaatctcctcttcctacaaccttcgtgttggtccttagtcgtctactctgatctcaaccgcaaaagtcaggggatgagactataggccatccccagagcaacagcctcagcacctcagcacagatctggaggggatttgagctagaaagaactctgaccttactcttttttttttttttttgagacagagtctcgctctgtcacccaggctggagtgcagtggcacaatctcggctcactgcaagctccacctcccgggttcatgccattctcccacctcagcctcctgagtagctaggactacaggcgcccgccaccacgcctggctaattttttgtatttttagtaragacggggtttcactgtgttagccaggatggtctcgatctcctgacctcgtgatcggcccgcctcggcctcccaaagtgctgggattacaggcgtgagccaccgcaccagcctctgaccttactcttaattgcttgcatgaaaattggatatggataagaatgcaaacccaagaacatgtcctgctttccttgatgcacattctcctattgatgttcagtgaccttagcatttccagaagcacctctttattgtggatggaaacttacttattcatgttgtctcaggctgtccaggttggtaacaggtaactgctataaagggtggagcacatcctgctaaatggagagatccagtgtcatttacattttttttaactctttcaagggtaatggcaactaacaatagtttctcctgtgtgctagatattgttctaatcattttacataaattatttcttttaatccaccaaacagcactataagatagatattatttttatttacctttgttagagaaaactgaggtatagagagattaagtaaattgtctaaattcacacagatagtaagtggaggagccagaatttgaacacaagcaatttgtctccaacaaatttgatcttaaactatggttaactctctgaacacacacacaaacacacatacgtacatgcaatcacacaaagtatcaggcacatggggatagacaatattagaaaagcatatacatacaaacatccttacagttgtacacatagactcaggtttataaacccactgaagtgaagactcatcatttatgaaaatatacaattttgttctgcaaaataatttaattttttaaaattccttgtgcaatgagaaaagatcagagaggcctacagtttscttttacagagctaggccaggggctgtatttagagtaattgaacacatgattttacttgaatgcggagaaacttgaccaactgtgaatatgcaatttcactctacagatgaaataaaattaaayggggcaaaagtaaagaagaatggagactaggtaaagtgatggaaagagacaccaaaaaattagtcatgtgaaagcaaaactaagaggagagggaaaggtggcaaaagaagggaacattcagagaatgttgatatattgagaggtgagaatagggagttggtaggcaagtgtcagagtgtgggaggatggtgacagtcactaggaactccagtttgcatacacacaatgttaagaacattagaaattagctagccaatggaatgctcagtcttgaagagcttgtgtctctgcttaaactcctgtatgcattagtatgattccataaatttaaagtctctgacatcttgagttttaagctttctgaacattaaatcagtggaggctgctagtagctatcctgaaatgctgcttctatacatatgagtaaaaatccaaattaatgtatttatacagcttttcatttgtgtactcgtaaaatacacacacacacagagacaattcaacacacacacacacacgcgcacacacaattcaacttttctctgaagaacctttgagtcagagaatgagaatgaaggagactgaatttctcttttaagttcctgtctaggttttgttccaatctaatgacacaggatctggcactgtatttagacctcctgctccaagattttatttttattttaaacaagtgttcccacacggggactgaaaacaaaacaggaaaatgttgcttaagttttcctttgagctgctgttatctgactttcaagtgtactgattgttccgtctcaccaatgtaggtcattgtactctcagttactttgttttctatcggaactttctctagcagctctccacattaagggagatcatgttatttcacatatttatttttgttattaacatattttcttcatctccctataatttgaggttttagcactttcttctttgtagaatttaccataaagcatacgtatttttgaaaactagggaatagcttttacttactaaagtacttaagtactaaacctatcataaccaatttcatttattaagatgttagtaagactttaggagttgttggttcttttccggagaataatgctttagcccagcagtccccaacctttttggtaccagggattggttttgtggaagacagtttttccatggaattgacaggggggatggggagtggggatgggtttccagatgaaactgttttacctcatatcatcaagcattagttagagtctcataaggagcctgcaagctaggtccctcacatgcacagtttacaatagggcttgtgctcctttgagaacctaatgccacagctgctgatctgacaggaggtggagctcagacacctccttctgtgcagcctggttcctaacaggccacagatagtactggtccatggcccagcagttggggacccctgctttagccctcaactcttaggcatgtttcagttctgattttggtcagcatagagctttccttctatttaccaggagggtctctactgatatggatcaatggcaggaggtgatattgggtctggaactatcctttggcttagtgacatttgtactctaatctgcctcactcctgccccttctcaggggacctgggcaccgtcggatcccatgacaggtcctacatggtgacctagggcacggtaaaaagtctaccccaggaagcctagaatggatagaatacaaattcatccaacacaaattcatgaagaaaagccaagatctgcagaaaatcaaacagtaaagactattccagaagagcaacaggaggacgataaagaggagatggagttaaaatactgggtctgtcatagacaggattggaatggaatcccaaatcagatgatagaatgaagggaaggtacatggaatagactctcactagtggtgagctttcggtcactacaagtcttcaaaaggggcctagatgaccagttctttttcatccaacaaatgcttattgaacccttcctctgtgggtagtgatgggcacattcagtgaattcagactggaatcgaacacattgtaaccattaaatgagttaatcttatatgagttcatacatacagatcacatgcaagagtgtctcatatccagtaagtttgcaagaataactactattgtttttgtgtacaagatcttgtgtattgtaatttctgaaatagcaatgaggttggaatacatgactaatgattttatcctcttatgatatctctggttggggcacacccaaaacaaaatttggagcaatgcaaatgttcgaggagagtgagagaacttccttctggtgtttttctctaatgacttgctctgaagctactcctcttagattctttcctagctgtgtattcctatatagtcttagcttaacagcacaaagatttaacagtggtgtctgcatttgataaaatgtaaatgagaagctcccaaaagagattgagaagctctattttgacaactcttcttttatctgtgtwattattatatactttaactgaagaaagaaaaacacaaagataaatacaatatttcaacttcgagtactttttaaaaattatttgaaagcatttaaaaatagatgtaaaatgaactcctgtatgtcaaattcctttcagagaaaaaaaaaagtgagagggaagggggaaatttgcatttagtaattttttttgtttttttgaaaatttcaggcacttagtaatcactgttccttttgtacgtcatgcccaatgggaacgataccaggatctttcactcaattctgtggattacaggtcacccacctgggcatgtttcagatgaaactaacctaagctcatcttgagtaaggggcttagaagtaaatgctttgttggttgctttgagttgtacaaagcaggacgaccaccagaggctttctaagaaaaagaatcatagagactttgataaaattggaactcctaaagcagctaaggctttgcttctatttttgatcatttttaaaaagttagttcttctggtgtttggtagttccatagtagttagaaagcactgccacatgaaatctgctattggtagaaaaagaaaatgttacagccaactctgatacaacatgagagagagacagagagagagagagaagggagagaagagacatgttcttctttgaccagcaggaaaaaaaaaaaagctgcacaaaccttttaactagtttcactagcagaaaagaaaaataaaaatataaaatagcaaataatctttaaagaaaactgattttcttattatgctgaaatttattaaagactrttgtgttgactgaagaatatgtttaaatattttgtggaaggcaaagctttcattcaggaatgacaagtgcaaggactgtaattctaaagaaattaaagaaaagaagaatggcaatttaagttcagggacaattggaatcaagcagtaatgatttacagctttttaaaattttcaggcacttagtggtcagtgttccttttatgcgttatgaccagtgggaaggataccaggatcttccattcagttattatgggttacaggtcacccatccgtgacctgtggtcacagtgttaggtatcgaaagcataataccttcttatctaagaaggaaagacctgttaagtctaagcttaggggtagagttgtcaacgatacagtcatatttgttgaacagttcaagttgccatttcttgtattcttggaagaggtaagttaaagaaggttgtgcacagttcttgacattttattattacagcactacctttcaagccactcagtagtcatcggacatgtaagagtggttgttctatttggtcgtgtaaatttctagtgacagtaggaaaaaaaaaaaagacctttattaaagaccttccaaactaattcagtgccctacatgctgcatgaaaatgaggactttccagttctgagtagaaggaatattaaggcacctgaagggacaaatccatttataaaattatttttctttttgtgataaaaatataaatggctctgctagtatactaaaaaatataaatggctctactagtatatttaataatccttcattgatttacctaaacgtatgaagatacccatataatatttttaaaaataagttattgtagctctaaaataatttattagactagaataaataaatttatactagaatttatgatgaacagtcaataaatggaattaaaaatataggtaaaatacagttaaaatatatacaaattttaagtgatacatgcaatgcacaaattgtaaatgtttgattgaggaaagagctaattcattggaagctctagtccagtctatagtatttggggactgctattgatatgttcattcaacaaataattactgataatatagtatgtactgaaatcattatgctaaacactgagggtttacaataaataagaaaatgtataacctcattgaacttaaatctagtagcagacacaagcaagtaaattggcaataaaaatagggggagtcaagggagtttggataaattatagaagaagctcctagacagtccatggaggtatttgtgggaggatggaattggcaacacagctgagattttaaagatatataaagtacatctgtgtaaatggcaagcagtgagaacacagaaaaggtgtttgaggaaagggcctaaagataagatagaccatgacacagaaaggaaagtaaaaatgattcagtgaccatctagtagatatccaatacatatatttgagtgaatgagtgatagactgactatatgaatgggaaatattgaaatataaagaggaaggccagagataaagctctgaaaggtaagcatatattttaagacttcagagtacctaattttctgaatatgcaaatgagcagtattagaattaataaaaataaccctaaaaatgagaactcttggttggagaaaataacaaaatatgaagtaaaggaaaattgacagaatacttcaaaaactgtgcctgatataattggaaataatgcctggaaacagattgagtccataatcctgtatgtgttcattaaggccaggaagattcttggtaaggaaatgtctagtctgaaaggtctaaagattttattaatctgtataataaattatatcttatgaaactcttgtcatttatccagtatatttgaattacccgtgcattactgtttcatatattcatggtactttcatattttataacatttaaaaatatttcaatattccattgatttgaataagattytttaaattacagtgaaagctttctgataaggtatggtaagattatttttcagtaattatgctgatacatataataaagctactgacaattcataaagatgataatacacttagtacaaactgagcttcaatgggattactaratgagtatgtgaggacagagcagaggaaaaggccaagggttgagcactgtggtgctctattatgagaaagttaggaaggattaaagttggcastgaaggggattgagaaggagtagctgaagcggtagaaggaaaacaagaacagtgtgtcctggaagtcagtggagtaatcacttgtctcaaatgctgctaataggtcaaatatggtgagaactgagaactggacatttcatttagtaatgtgaaggacgttggtgactttcccaagagcagtttcagtggaatggaggaagaccaatggaataataggagcattgtggaggaataaaccaaaatgtacctatttaccatccagagccagactcagagyctttactctgtgctagaaacacaatgaccaattgttgcattgttccctttccttgagctttctacagctcacctcgcttcttcaaacatgtacaatcagacctctgaatctgtggattccacatccatggattcaactgactgcagaagaaaaatgttagaaaaaaatctgcatctgtaccgaacatgtgcagacttttttcttgtcattattccctaaataatatggtataacaactatttacatagcctttacattgtattgggtatttaaagtaatgtagatgtgatttaaataattttgaaatatgtgtataggttatatgcacatactatgccatttcatttcaaggacttgagcatcctcagattttgatatccacaggaggtcctggaaccaatccccacaaatcccctgaaactataactgatgaggggtgatggtacttctttttttacacagtcaaaataaaagagattaggcttgtttttgttatttctccccaaataatgccatattgagcatgactggatttaagaggtccccagatgtctcagccactcatttacataaaaattctttgtccatatctgtacatccttaatctcaagctacacatatggatttactgttctgtctcctggtgtcagcttactttcaatttgttttacctgtttcattggcacacttgtagagattgataatacaaaaatgttttaggagagagcataccacacatcaagttgtcaacttcatccacttctgctacttatttcaaagtttctgatacttattcatgatctttcagtagccttcattctcccatccatccattcactcaagaaacttgtattgttagggaatgtattagaattatagctcttcaagctttccaaaacaaatgtagcaacataaatagacaagcataataatggaaaatcgtctatacgagaaatctaattattttaggcacaaatcattttttaaaatgtattctaaaataaaaatgccattgaggcacagaggtcttactaatctgtaaagcaaacatgatttatatagtatgcttacattagtaaatcaggattatttgggtgaacagagtataatattgatatagttatttggttataaaaagagatgtttctgataaggtttccccccctttatttgccttggaaaacaaatttcaaagaagagtgtcattttaaactctaaaaaaccagttgataaccatagtctgatatttgcagttggaatgaattcctgtgacagcatgaacatacacccaccaacatgtctgtaatagaaaccactttggaagacactagaggctgccacagatttctcaggtcctcacagcaagacagtggtggtcttggggatggatacatttcatcttccttgaagacagataccaccctctggctgtcaccccataggaaatcaggaagtatgctaagctatccagtggacttggaattacactgtgctgtgctagtggaaatatcctatccaacattatgatttattttgaaggagaaaggaaaaaaaaatacacacaaaacggtggaaggaagctgcacacaacatcgccaaacagctggcttgttttatatcccagaaacagcttgggactaactatattcacaagatctcttggcagagtagcttgatgaaaataccaaagctgtgagaagtgttcttttgctgaatccttcatgtagctatcacacggtttattaacctaaatgagaatatgtacaccttttttccaaaaaggtcctttgtatgtttaagtgagaaacttactgattcttcatacggcacaaacatgattcaccacagcattcacaccaaataaactctaataatgttcagaaactataatcctagacatgtagcgatttcctcctttctttcaagtagtatttttggggacagtcaagagagaatttgatagaaatgtaagcctgagttcaatggcactggtgacttttttaggtgccaaggttaatctcagagggaaattagttttaatggcttcatccatatatttatccattcttttaacatttaactctaacctccttaagccaaaaatataactcaattctaaacacatttctggctcacctgctaggtgccagaaatgcggatcttgaggaatatacaagatctgcttcactcttttagaatccctgcattagagaggattcagtattttcagattcatattttagaagacattgcattctattccttactaagcatcccaggtagattcaattaggtggaacatattcatatttttatcatgaggcattttgagtctattctttgtgacaccagaattagtttctcatctcagagtttgctgtatttgtctggtgactcaagtagtttattggcagtcagtttgtaaaaggctccctgggattatctaaatgcaggacgttaggaatggaaatatgtatcattgcctctcctgtcaaaaaatgtaattaacacacatgatatatcatcttacaaagtggatgaaaattccagtgggtgaccttgagtcacagctcctcagtgcacacactgtcctgtacccaagcatctcccagatagcacagaactcccacttcctgcatccctgtacctttagcactgtgtgcatgtttgtgtgtgtatgtgtgtgtgagtgtgagtgtgtatgtgtattttcagttcaaaatctaccactcaatttcactttctttaacaattttggtttggttcaatttgttgcataggtaataataatccatttacagaatacaaaaatagtgtaagtatgtgcttcttcctatctgtatgtygagagattcctcattcttttttatggttgcagataattcattatgcagwtatacaatttatttaaccagtcccatattgatggatattaggttatttccagtcctttgatgtgaccaaaaaagattataataaaaaatgctgaaagaataatattgtctttgtcagtttgggcggccataagaaagttccatagactaggtgggttgtaaacaagagaaatttatttccccacagtactggaggctgaaaatctgagatcagggtgtccgcatggttatgctttggtgaggactgtttcggggcttgcagactgctgacttcttgtagcctcacatggttgaaagagagctagctagctctctggcctctttttattaggtcactaatctcattcaggagggctccaccctcaggatctaattacctaccaaacgccttgcccccaaatatcatcacatttgggattagggtttcaacatatgaattttagtaggggggaggcaaacattcagtccattagccatattcagttcacctgtaatatagtatctgtattattttatgtctgtagaataattcctagaagtggaattgctagctcagaattactgtgtgtttctaattttgatagttactgctcaattgactttcttgaaatttgtatcattttacagttatacctgtaaatgtaagaggtatgtatctactctcttagtctaaccatcagagagtattaccaatatttgtggggtttgccaacctgaaaaaatgggaagtttatcagtgtgtttttaattaacatttatcctattatgagggaggatcagtatcttataaacttttaacagtcattttaattttcttttctttgaatagggccctcatatatttgtgcattttgttatggtgttggtgcatttctttattgatttacaagagttctttgagtattaggaacatccttcctttatccgtgccaacagtaccttttattttgtcacacagtttattcttcatcagaattctttgctcttgagaagtccctgtgagagcctgccagccttctacacctttggagggcagtttgttggcaatttctcaatttttctttcacatagaaaatgatctgactgaattttatttctcttgatgtcaactgtgctgaattattgtcttaaaaaattcaccattccattcaggtttaacatattttttagagtgtgattttcatagggtatgttacattcttgatgaatttttatcttcttgacctattaattactaaaaaaaaaaatacagataacgacaacctaaaacaacctattgaaatatctcactgtgatgatagatttgtctagttttccttgtaatttttgttctccatattttaaggctatataatgtgatgttttcaagtacagaattattttaagttcctaatgggttccttttttaatctgatattttataactttttccccaagttttctggtttcccaccataccccagattcttaagtaatttagggcacaataattttcagagaaagaatgattaagaatttatggaaatcttaggaaggtcgaattgacgcagtgccttggaagagagaaatataggtagttgaagtataaggagaaatgcctatgatataaacaaacaaattgcatgtacatgtattaagaagactataacatatatcagttacttcactagatgccagtgcataggcatgtacctgaatctgcgtaactaattgggagaatgggaagttaactttatttttccaagaaaaagaaacaaaatcaatatttaaattttggaaaacataattrttaaattatttttcatattgtgtagattcacatctctttaatcaatgggagaccaagtgccgatgatccttctccagaactgctagaatttacctccgctcgcyatattcgcctgagatttcagaggatccgcacactgaatgctgacttgatgatgtttgctcacaaagacccaagagaaattgaccccattgtcaccagaagagtaagttatgatgaatcatattagagcctacaaatgatatcccacttatctttttgtctgttaaatactttaaaaatgttttcagtgatttgtaggagtggttattatcaaayttttattttagaattgtagattattattattattattatttgaaatttgacagactttcctttgttcagatccaagctgtgccrcttattayatgtgtaacatttatcaaacattttagccttctcaaactttaatttcttcttttgtaaaatgagaatcacaatgtctacttaataatcttatttttcagaataaaattagcctttgtcaccttaggggatctatactactattataattggctttggcgagttactactggaagtgcaggggctttgaaacatttttttgccaccactgagccagtatacacacatgcacacatacagagagcagtatgtcttaaaccttaatgtgtatgggattagccagtgatcttgtggaaatataggttatgattcagtagggcagagctgagacgctgcacttcaaaaactttccaggtgatgctgatgttgccggtttgtgggccatcaaataatttggttttatgcttgattaatgaatcacaagccatagttttaaaaatgcagtgctataggagaaaactgattctacatactgttttattttcctttacaaataaaatattaggggaaaaagtttaaagcatcttttcaaaagctttttgaacacaagagctaacagaagtgctgtcttccagtgttaaacaggaatttgtgggattacaagatagatgatcaacccagattgctatgagtgataaccgtgcttcctcctgtctaccttctmccatattcactggtttatggcacctcccacatatgctgctacacaaccaaggcattattaccagggaagtcaattcagccataactctataaagtaaactcctgtgaatagagtatctactgtatgactagaggtatagctaagaaaaaagactatagggagaaattaatattgtaggacaaagcatttaattctagaatgatccyactaaggtaagaccacygtcatcggttgcaaaattgctgaatcactagggttaatagttacagatcctaaatactcctcacatgttttctttcctcgttacttaacttcccacacccaacctctccatcatcacaagataacttttaaggctttagttagtcccatgcaacatatgtcagatgttttagtgccctgtattttccaaacttgaaataatttccccttgtattatacctcaacatattgtaaattgtctcatgcaaaactaatcattattttatagcaatgtttggatttttcacttgtttaagaaaacattttcaattctaattttggcgggacttaaaaatatacaccaaggaagactggtgtgaaattggagtgaaatttaatctttcttgacagtatgtctatcagagaaaaaaaatcaatgaaaataaattagtgttctttctatcatctcttgcaggaggtagagtgggggttggggtacacatctattatttataactttatcgtacatgagtctttaaaataatgcagtataagtcaacatataaatatgttttttgaaagtactcaagttcaataaacactcatttaaatatataaaaataagatagcaaatttcagctcttcttcatgactcaaaagcaaagcattatacatttatatttaaaatagatttcccagttttaaaagcatttacaaatactactgtatcagctttttaagcaaatatctctatttgtgtctatattattaagtgatgaggttaaatggaaaaaatatttttatactatccaaactccctagccagttccattagttcaaggtctaggtatatcaaataagataacataacaaaaatattttcaaagacactatatgtatgtaacaaaaacaaatagaaggaaaaagaaacaaagaagtaaattggaaaaaggggattcttagtcaaggaactcagatatgtgtccacctacatattctagctaaatctgttttttttgtgtgtgtgtataattggaataatagaactatctaacgctaagatgattatttgaatatgataatgtaaagtgctctgacaattataaaatgttatatacacattaattaaaattttaaaaatagtctagcctccataattatccttaaaaaatagctgggtagattaaaataattagtaacatagctctatgttaacttcatatacaaaggtaattgtatggactatattacatagtaatataaaaatgcaaatgttctgcacaataaacttacagttaatgactttttaattttcttcttaatatggttaaggaatatattgttatgagcacaatttctacccagattttgttggttcttttcaaatccatcaagtaaaacagtgtgcgtatgatttgtgaatactgcagttgctrtartcacaataaaagagggtttcttgcaagaaactatgtaaaacaacttttatgaagaatagctgtccttagccccagataaaaactactgtcagccacaggtactctagcatggacttggtgctgactgggaaaaagatatttctaaaatgcccaactagcttaaattaaaggccactcttcctttgggctaagatcacagtgctaagagttactttgtcagttttgtgagtcctcacttgtcctcaagaaacacaaatgtccttcaaactaaggataaaagcagaaaataaagtttttactgaatgtccccttttgttactttgaccttgcagtcatcttaacaggatttctctctggattgctttttgcagtattactactcggtcaaggatatttcagttggagggatgtgcatctgctatggtcatgccagggcttgtccacttgatccagcgacaaatgtatgtatatttataggatgcttaggcaaaatgaagccctgagctgtaaaatgtttcatgacagtctttgctgacagagaacgctgtaaatgggwgtcaggtccccacttagacagtgtaacagaaatccatgccagggtgaaataagagctggcagttaggatgatagactttgaaatcagccatcacagtataagaaaacagattagtttttcctttttttttttttttttcaaaaaggctccaaactggtctattttgaaatctctctagctatgacagcctgcctcatgatatagctttagagaacgcctgccatcaatcaacctgaccatttcttttaaagtttctaatcaaaaaattaatgcaaatgagtaaaaaaatgtgcagggaagtaaatatataagtgacaatggaacaggaggataaaatagggcaggggcaataagggggtggagggggtggagtgggtgagagagtcaagagagtactgatagtggcaagccggaaaatgccagaatgctttttgatagaattttttcattaatgacaatgaattaagtgaacataacctaaaggagaagatgaatgagcatctatttttcctgtcatagacaaactggtgaaattcaaactcatctcctgtatagtatatggaaaaatacattgaatagtaagatcagtgaatgtaaatcgggccacagattttttttctcaaatattgtaatgcaaatgacattatactcaaagctagttttctgatgattggattataatgttatctcctaggaagattaaagtacactaacatatttttatgggcaaagctgcagtgctgctttctgcctggtatgggtgctttcttcttttttttgttttccattttttaaaattttactttaaatcctggatactcgtgcacaacatgcaggtttgttacataggtaaatgtgtgtcatggtcatttgctgcccctatcaacccatcacctaggcataattttccacaggctttacagagtccctttgtctcactggctttctgcattttaaaaatccctttactgttattttatttggaggaagtgaaaaaatgcatatgccaccatagaatactacgctgccataaaaaggaatgagatcatgtcctttgcagggacatggatgaagctggaaaccatggtcctcaggaaactaacacaggaacagaaaaccaaacactatatgttctcactcataaatgagagctaaacaatgagaacacatggactcaaggaggggaacaacacacaccagggcctatcagatggagggaggcaaagggagggagaacatcaggacagacagctaatgcatgcagggtgctttctatcaggtgtacagatgatcagtgtttcccaggctttaaaagtccacaagacaggcttggaaggccaattccaggtggtaaattgagactgtattcagagcatgcacagacaggagatttagtcctagagacattagatttctggtttacctgcacccctagaggcctaggaatcaactccctccttcttgccatatccaaaaatattaacaacattttgaggggagccttaaaacaagctaatcgaccccmaaaaaacacatagatcccaggcatcagagaaggagaattcagtcttcaagaccactcccagctgggccttcctgctttcttctgagcctaaacccagtgattaaagaaccagcctggacttccttaaggtgatgttgatcaaatatacccacttcaagcctggcaccactttcttcccaggctggctagttttacattttagtacacagtccagatgttttctcttttcttcatagtacctttagagagaggcttcctttatggttctaaatgaggctaaaatttgtgcttcctccctctttttgactagaaatctcgctgtgagtgtgagcataacacatgtggcgatagctgtgatcagtgctgtccaggattccatcagaaaccctggagagctggaacttttctaactaaaactgaatgtgaaggtatgttctttagaagccaacaaaatatgtcattcttcctttccaagaaaaaaagccagtaatgaaaaatagtgaaatggctggttatgcaaatgtgtcaacaaatactcatttatattatcacttcgaagacaacccatatgtctagcttttcctaaagggaaatatctaagaaatgtagcagatgactttatagcctaatagtgacaactggtctttttaggtgacaggtatcatggagaaacctgtgtttctggagattttctcaacccaagaaaagacctaaaaatagtcttgggctgaactgcaaacctaaactagtatgaagtccaattcaactgaatgcaaatattaatattacagtaaatcagccctaaccacatttttttcagctcactaagtatatatggccttcaaaaacagcttgatagacattttaaattaataccaacactatatatcctttgaataacaaattaactcaactcacatttatcatgtacaatgtgtcagacatgacaggtctttaaaactattgaatcataacacaccttaatcacaaaatgttccccacctataagatataaagtcggccttccatatccatggtttctccatccatgggtctaaccaactgcagatcaaaaatgtttgaaaaaaagttgcatctgtactgaacttgtaaagacctttttcttattattatttcctaagcaatataacaactatttatatagcatttacattttgttaggtattataagtaatctagagatgatctaaagtgtacaggaggatgtgcataggctgtatgcaagtactatgccactgtataacaggaacttgagtatccttgaatcttggtgtttgagggaggtcctggaaccattcccatggatattgagggatggctgtattttctttttagtttgagattctgcatatatgctattagctctccttattttctgcactcacttcatttgcttttggatttgtgtctgcctgtttataaagatattatggattagaaatctcccattattacaaaagcatatctggaggcatgagccaccattggatcatcactcaccatgcatggtaggggaccattggaagcccagccttttgtttccttcaactacttccagccatgttctggctaatcccttagttctccacagcttctccatagagaacagacatttgttcttaatagtgactttaaatgtaatgccacccagggatgtttgctctcgagctcctttaaattttaattaaatttctcttctgtttgtagaatatcagtaatcataagtgggagcagcacttgaaggtaggggtcttcctgttgccactgacatgccttcacacagtgataattgtgtaatgttaagtggctctgcaaaatcctttaccactctttacttgtgtttctacgtttaaatacaaaacaaaaacaatcgagcaacttgttagcaatagaggtagactaagcaaggcaagacatttcaaactgctactgtacacatttttaaaatagtggaattgtgaaacactttttttctttccctgtagggaagaggggaggtcgtatttccaaactgaaaaacaaacattttaaaaacgcagaaattcaagatggggatcttagccataaagccatacataaaaatcacactttcagcaatgagtacattcctgaaagcttaagtaaaaattttcttttccaagttgaatcatattccaatcaccttaatatttagaaaaatccttccatgacatgacaaatccctccataaaatgaataatcacattctaattcatttgagtttaatttggattttcatcaatctagcttacataaggcaagataatatctctaaaaagcatagaatattcattcagttgctgagcctttactaaacaacagtttcatatgatatatcttggacattctgtgaaatagtaagttgctgatgatagagaaaaaacatggctttgtgatcagttactagccrtattcttgaaggttacagacagagcggggtaggctgcagcctrcagacagaaagtggggctgtaggtgtagggtcctggctgcacagagtgtgtgatggaccgtttatttggcatcagggttttacatatagtagctcatagttctaaacactcttgacaacacgaattctaaatagtgtgagaataagtctatgttactttatgttttcctctgcttatactggcagcagaagttttgactgttttttgaaatacactattacaacaaagcttttaagaattcatagccaggtccagtggcatgctcctataatcccagctactggaaagaagctatggtgggaggatctcttgagcccaggagtttgaggccagcctgggccacatagtgagaccctgtstgtatcactccgttttcacactgctgtaaagatactacccgagactgggtaatttataaaggaaagaggtttagttgactcacccttbtgcatggctaggaggcctcaggaaacttatgatcaaaggggaagagggagcaggcacatcttacatggtacaggagagagaggagaaagtgaatggggaagagccccttataaaaccatcagatcttgtamgaactcactcactatcatgaggacagcatgggggagctgcccccttgatccagtctcctccctccctccatacgtggagattacaatttcaaatgagatttgggtggggacacagagccaaaccatatcactgtctttcwgaagaaaaaaaaggaattcttgtatgttgccctaaagatataaaactgcttacartgcctagtgatttgtattgattactatgtgttccctaaagtttgaaactctccattaacatagcaaaactactatattctaaatcaaatgtcagcaggttgggaaaggtatttacaacaaacatgacaaggggataataacctttctatattaagagatcttacatatcaataagaaaaaagttaacctgttagaaagatcaaaacaggtattcctcagaaatgacatataactttgtaaaaagataatgacactcataatgaaggaagtatcaattaaaacaatgacatattatttttcacctatcaaagtgtttattcttctactcaacaaatatttgaatgcttattatgtccaggaattgtattcaagggttgataacacacaaggttggtggctatggagaaagtgttttatcatatctactagaggaaaagtcatttgtcatagcgttcctggaggggaattttttaagcgattaaaatttaaattttacatatcctttgactagaaattatgcttccaggaatttaccctatagatatattcatatagatgtacaggcatattatcatgatcctcgtcattattatacaagtgctaccactactgctactaacatttattgagctcagtatttagtatgtttcaggcattctgctaagcattctcaaaacatgtatgagacaagtactaaagtgatgctaggactcgagtttttgcctcaaagtcactcaactggcaaataggaaacttttctaacattagagcgcctccctccacccggcatccttgtcctcccagtatgtgtgtggtgttatttgtaaagggagaaacatggaaactgtgtaactgttcattaatagggacctgataaataccttcattcaagtagtaccctgtgtacccttaggggatacacatgctaatatggaaagggctccatgatttactgttagtaaaaagaaccggttctaaacagtatacaaatgccccttcccttttgtagaataaataaaaagattgagctgtatgcatacaagcacacctacacacacacacacacacgtggaaataaatgtaagtactcctaagaaactcaacatgtcaggtaggaaggagactgcatcgatatatttccctggttctatcctaatataaattcttcatatttagaagagtcttacccaatcctttctggagaaagtgatttttcacttcttggaattcttctaatgtaacatgaaaaagacaaggaggaagaaaagaagaaaaatcaattgctaacttctttataagacattacgctaatgatttcacatgcattatctcacttgtgcttttaaatatcccaatctagtaattactattgaccactccatgtattatatggaaactgagccttcgtgaaattaagaagtttccaatgtcatatgactgctaagtagaggagagcacacccacatccaagacagttggttgcaaaatagcatgatcttagccaccagtaaactagctctcggtttgtcttaattccttggcacctgccatgtatcttatttcattcaccgggtaggatgtgaagagattctggcagtctttagcagtgcagactctggagtctggcttcagaggttggtttccaatactgattagaatatcttttacacgttatttcacttctctggactcaggtttctagtatacaaaaataggttaataataataatacctaattcctaaaagcatttttgaggattaaaatcagtagcaacaaatatggagcatttagaacagtgtctggcattgagaaaacctatgttttagttgttattagtattaaaagaaaggaattatattatacatayttttctttacccacaggctctaatacagaaatttccatatggtagtaattcattacagattacctagctgttaatcattcagtgccatcattgaataatttattatttgttataataggaaattgtaagttgaaccatataaaattgcacgttagtcaaaaccaaatattggcaattgcatatgattgagcttaatttatatgttttaatcatttcaaattctattaaaatgtgtgaatttattaatacctccaatacatccagatactttctggatatgtttgtgtgtgtgtacgctaaatgtaatttcccgtatggtataaaagtctaggccgggggcagtggctcacgcctgtaattccagcactttgagaggctgaggcgggtggatcatgggtcaagagttcaagaccagcctggccaacatggtgaagccccatctctactaaaaatacagaaattagctgggtgtggtggtgcatgcctgttgtccccagctactcgggaggctgagacaggaggattgcttgaacctggaaggcagaggttgcagtgagccgagatcgtgccactctgcactccagcctgggcgacagagtgagactctgtctcaaaaaaaaaatctattatgtataacagaaatgatttttaaatgtatctgaaatcaaattgatgtttattaatttatttttccttaatgcagcatgcaattgtcatggaaaagctgaagaatgctattatgatgaaaatgttgccagaagaaatctgagtttgaatatacgtggaaagtacattggagggggtgtctgcattaattgtacccaaaacactgctggtataaactgcgagacatgtactgatggcttcttcagacccaaaggggtaaagtatgctttttctttcataaagagttatttttttgctttttcatacaaaaatgttttatacaaaaaaataakaattttgaaagcttctgtaaacagttgaacttcaaattaaaaggtaagtaggaacatttcgtagttgaaactgacctaaatctttgaggatgtaagataaaacttttccatcactccagaaagttttatcatggctccttccagtcaaggagtggacccctaggcaaactctgttctgatttttagaacgtaaattagttgtgcctcttagagaatttcataaaaatgaaatcatacagtacatactagtgagtcttttttcactcgacataatatgttaagatttatccatgttgtttgtgcatcagtagttctttttcttttgaaagaaattgctgagtagtatttctctgcacgaacatatcaaaattttaaatccattctcctgttgatagaaattaggatcatttccagttttagcttagctcctacaaataattttatactagttattttatagtcatatttttatttaccttgtgtaaatacttaggaatagaaagcttttttcataggataggtagatgcttaactttataagaaaccgtcaacattttgccaaattagtaataatgtataaaatgttcaccaaaaagttatatgagtttcagtcattctatatcatctctaatatttgatgttgactatctttttggattttagtcatctagtgggtgtgaaatggcatctgattatggatttaattttaatcgtaagggcttattgaccattcctgtatcttctcttatgaagtagatgttcaaagtctaaatatttttttatcctaaaaaccaaaattttaacttatagagctattacccatatcaagtaaatgtttgtgtgtggtgtgaataagtaaccagatttatatggttaacctgaagttctagcaccatttgttgaaaaatcaattgatcatattacatggatcaatttctagaacctcagttatctatttttcctagcatctatttttccctctgcgtgctaataccatactatcttcattgctttagtaagtctagaatttaggtaatataatgtaccaactttattttttattttcaagattgtctatagtaggggcttttttgtgtgtgtttctatacaattttagaatcaacttgtcaattacagaaaatattaggattattgcttagactctatatacaaatatggaaaatggakcttgaggagatgttggtcaaagaatataaaatttcagttagatagtaggaatacattgaagatatttattgtacagcatggtgactgtagttaataacaatgtatttactcttaaaaaatgctgagagtagattttaagtgttctcaccaaaaaaattgataattatgttaggtaatatgttaattagcttgatataaccatttcacaatttgtatatatataatatatatatacaatgatattcaaaatatcatgtcacacatgataaatatatacaattttgtcaaaaaggaaattaaactttaaaagcaaacaagtattgaggaaaataacatcataataatattgaatcatttaaccaatgaacatagcatatctctccatttatttctatcttctttattcatgtcagtgttccagtacagagatcttgcatgtcttttgttaaattaatctttagaattttgctttgcatgactgtaaaaaaaatttttaaataattttccaattatttaatgtaattgttaaagaattttgaatattgactttatgccctatagccatccttaatttctttttttttttttaaataacttcccttttaaaagttactgagaataaagaatacagaacatggttataggcacttacattgctatcaaatgcaggaattcacttcaataagaagtgctttctctgtaagcatggttcatggcaatagaagctccaacttaggagaggatgttttccgtgacaaaaataataacaacaaaaaaaatggtggttgaaggaaaacagtccaaatttacagatgctttaaacttcttttggccttggcatcagctttcatgttaaaaaataaagctggtggggaagctatctcacttgcaaagtaaatggcttgtatgagattggcgaatcttggtcagatattgcatttttaaagcacaaaaccaccggccaccaatatcttcctgtgcatgcatataaattattttcttctaattcaaatggcaacagaggaatcctggcgtgcatgtgcatggagacacacacacatcactaaggagacaggacaaactatcataaactaagcagtatcccaaacacatcatcatctataggctgttttacaaaggtggaatacaaacgaactgaatgtctcaggtaaaaggcaaagtctatttctccaactctgctgcactcatttatcttcttaaggctttcacagaaagcaccgttttatgaacaggcaattcagtacccagagcttgactggagacactaatcaggattgaagtcttgatgcagttcataaaaacccatttaaaaaaaggcatcaaaaaccacatttaaaataaagttgtccatatataaagaatgaagtgtttagaagttcccagcttgtatcctaataagagtactgaaaggtttaatattagcagcctgtgaacacgtagtgaagagagagtctgagaaccaagttaacatccttattccactctaattccacccatgccatgggtaaaaacagttcttgcagtctagagtttctcctccgatggtttaaccgtcagatttttacatcttgggattcaaccatcttggcaagcgtcttcttaattctcaacgctgtgagtctgggggctggattgtgggcccagcattctgacattagcttcaaaactgctcgtagacattcatcactgttccaccgattagacacaattggccgcaaacgtttgacacacacaacctcacgcatatcttcgtatgacggatcactcggtaccatgttataatatggcaattggtagtcttccacgatccctcctgtgatacaacgacgagccatctcccaaatgattaggccgaagctgtagatatcagccatgatgtagggctggaagtggtttttgttcaggctttcgtccagcacttctggagccaggtagcgtttggtgcccaccctggtattcaagggcacatcaacttcatttgtgtcactgttgaatttaacagcaaggcccagrtcagcaatgcagcaactcccatttttcttgatgaggatgtttttgctctttaggtctcgatgagcaattgcgggctttccttgggtgccatamrtttctgtgtgcaggtggcacagaccacaggcagctgaataagccaatttaagcagggctctggtgtccagcgtagcacatttcaggaagtcatagagagatccattttcatggtaatcagtaatcaaatagagctgagtccaggaacctgtacctttaatatctgccgctatgaaaccaagtatgttttcatggcgcattagcacagtttggtagatttctgtttctcgaaaccagctggcttcttcagtggtaaagaatactttcaccgccactctttcgccatgccatttgcccatccgtacttctccatatcggcctttaccaacttgccggaccatctgaatctgtttggcaatagttcgctgaaccaataaaggtagtccagacccactaccagaactttgtgactggtcaataaggtcttttagtgattttccaactggaataaatgcttcatcctgttccaaatcacgattgtaacgacgtctgcttgagatgctcttgcaataatgtttgtaacaaaagcagctggagaagatgatcatagcaattatgcagacagccatagaaatgagcaaaaccagccatcgaatgctgccatcaaaaaayggacctatgacaacagggggcatgtgggttgcaaatactggttacataaattggtccgacaacattctattgtccggcgtagctgggcttttggagaatctttgcactgaaaatcagatccttcatatttcatacaccctgaagctaatgtggtttctccctggtcatcttcttctatgatggcaaagcaacgtccattagttatgcatgtgttattaatagcatcatctgggcagtgccctcagcaatagcacttgaaaaaaggcaaggtatcctctggtgctaaggttactccattttctgactttttctggtcggagtctgatttcatcccagtgccgtggagcatactatccagattctgtccttgaacacgagaaatgatgaacaaataggctcccaataatctgatgtaaatgtatagctgagtcattgttcaattgtaatgtttcctgtgtactgtcacctttagtaattggtcttgctacttcaccaatttaaatgactgtcattcagtgagattttcttgtaaaagatcgcaagcacttgacaatgacttcaactcccactgctttcttacgactcctccaagatgtggctagataaaactgtacttccgattttctccaaacagctttgacctatgcttccatctcatgaattccaagacagtattaaactgatgcatattttcataagtcgctcccggcgtctcttcccgggctccttgccagcgtgccgaggcgcaggcagggtgatggaggcgccccggccgggaggatctgccggggagagcggctttcctcatcgattcgggagcacccaccatgcttaatttctttattaattctagtagttttaaactacatgctttagaaacgtacacataaacaatcattttacctgcaagtacattcaggcttacttcttcctttgcaatctttatgccaaggttaactaaaaatggcgagagctgacatcttcactttgttctgaattttaaagggaaacctaatatttcactatggagtatgatgtgaactgcatatttttttatggacaccctttatcagattcagtaggtcccctactattcctaagttgcagagagtttttataacaaaatggttttgcattttgtcatatgcttttcgaaacctactgaaatgaacataaggattttctcctttattctgttaacggggacaatttatgcaaattgaattttaaaatatgaaggcagctttgcatttgtgaattaatctccatttggttatgatatattatcatttttatatattggatgattcaattgactaatgtttggttaagaattttgacatcctctcataaaatatattggtctataattttattttcttataatgtttttgtcaggttttttattggggtatactggcatcaacaaatgatcggggaaatgcacttcctcttctgttttctaaagtaacttcagattaaaattaattctctttaaaatgcttgataaaatttcctagtgaaactatctgagtctctagttttcttcgtgcattgtattggctattttttattagacatagggttagataggttttgtattaatatctttagggagggtcaatttttgatatattgtatttttcaagtaatttgttcaattcatctaaattgtcaaatcattggcaattggcagttttaaaaattgccttattatcttcttgaagtctatagcatctatatagatatcccctgtgtaatttttaaaatgattaagttgtgcttttctccttttattgatcacttatgttaggggtttatcaattttcctaatcttttccaaaaaaacttctgcctttttattttttgtgtttttattgattctgttctatttattatattattcatttgacctgttttggttttaaatttcattttctttttctacctatcaatttggaaagttaaattatgattttacacctttcttcttttatcatataaacttttaaatatagatttccttctagcagttctttagctgtttctcatgaattcaggaatgctttatgttcattgtcatttatttaacataatttctaatttctcttgtgatttattttttgttaatttccaaatatttgagctttattaaatattatatttttgatttctacactggatgtttatgatctgagaacatactctctaagatgtcaaactttagaagtttattgaaatttaacttatggctcagtgcatggtctctcttggcaaacaaataaatgtggatttttccaatctgcgattatggattcctacctttctttcatttttttcagtatttcttcctgttctttgaagcactgttatgaggcacatacatatttagaatattttgaatctttagatttttatatcttataaattaatattttgataactgtgaagatctccacttaatctcagatatcactttttgtcctaaagtctactttattttttattaacattgccacagcagttttcatatgcttactctgtatggtatgttttttctgattttgtttaactttcaacctatctttattttcatttaaaagatttcttataaagagtaaaatagatggattttttatcctgacaattactgtgtgtttagtccctaaatttaatatagttaataatatgattgggttttgctatttgtttcccatttgtgtcacaaaatttttgttcccattcttccttttctgtctacttttatgttaaacaaatatttttcagtattccattttatttcctttattatctttttagcagtacctctttgtataattttccattccaacttttattttaggttcaggtagtacatgggtaaattatgtgtcatgggatttggtgtacagattattttgtcacccagataataagcataataaaattttcaatcttcacccccctcccacccttttcaagcaggccctggtgtctattgttgccttctttgtgtccatgtgtactcaatgtttagctccactcataagagagaacatgcagtatctggttttctattcttgcattaattcacttaggataatggccttctgctccatccatgttgcttcaaaggacatgattttattcttttttatggctgtgtagtattccatggtgtatatgtactacattttctttattcagtccaccaatgatggtacctaggttgattccatgtctttgttattgtgaatagggctgcaatgaacataggcatgcatgtggctttatgatagaatgatatatattcctttgggcatatacgcagtaatgggattgctgagttgagtgctagttctgttttaagttttttgagaaatctcccaacggcttcccacagtgtctgaactaatttactttcccaccagcagtgtataagtgttccctttctctgcaacctcaccagtatctgttatttttgactttcagtaatagccgttctgaccagtgtgagatggtagtattttaagctcatgatatagtgatatagtcctatcttttggactattgttttcatatattgcacataatttgtaagccagcaatacaatgttgtcatttttgtttgaagtcacaaaactatgaaaacaatcttaaagaaatgaaaagaaggaaaaaaatttacattaaccatacctttcccattttccatactctgtggttctagcttatatatattgccctcctgcttgaaaaatttcctttaacattttttttttggtagtgcagagctgctggtgacaaattttctcaacttccctttatctgaaaatgtctttaatctactttcattattgaaggatattttccacatagttacagaggtgtgtgttttcttctttgtttagcactttaaagatgtggcaccattattttctggatttcattcatccttatgacaacatagccattatttgtttctttgttctatatatatatatctttaattcactagatgatttcaaaaatttttttatatctgccttttgacacttataccatgtatgataaaactttggcccgtagaccaaatctgactcatggcctatatttgtatgatctgtaagcaaaggatgtttttacatttgtaaaggtttgttaaaaggagaagtagaagaaggggagaatgaagagaactaggaggggggggaagaagaggaggaagaatgaagagagtctttatatggcttattttactatctggccctttacagaaaagttttccaacctcagagttaaataaactatgatgtgtctatgtttggctttcaagcttaccttgcttgattcacaaagcttctaggaactataaattgagattttattccacatttaggaaattttaggctattttttttatttttacttattttttttaggcttttgtttaaaacctgttttttgaccagtgtttttccttctctttctaggactccagctgcatgtgtgctagggcgttcattgtatctgaggcagtgctaagtaattttttttctttctccgttctttagattggatcatttccattcatctgtcattatactttggtctacatataatgtatctttaatttactagctgattttaaaatattctcattaggccgggcacagtggttcaccccaggaatcccagtactttggaaggccgaagcaggcaagtcgcttgcggtcaggagtttaagaccaacctggccaacatggtgaaaccctgtctctattaaaaatacaaaatttagccaggcatggtggcaggcacctgtaatatcacctactcaggagactgaggcaggagaatagcttgaacccaggaagtgaggttgcagtgggtcaagcttgcaccagtgcacttcagcctgggcaagagagcgagaccctatctcaaaaataaatacaaataaataaataaataaattctcattatatttacttttaacaatagtatcatgtttgagaaaactttggcctgtagaccaaatcctggcctatggccagatgactacaaaagtagtcattaggttgactactcttcctcctatcatctctacctgatgttaagcatatccagtgaattattaaattgaggtattttacttttcagctttctggagttcttatgttccttacagcttccatttctctgaaatactccataccttcactcattataaacattgtttcctttatattctcggacatatttacagaacttacgttgacttccttgtatgctaatttcaatatctgggtcacctcaggatctgcttttatcaacttctttttttaataaggtcaacattttcctgtttctttcctgtatatctaatacagtagtcctcctttattcacagaggatatgttccaggaaccccagttgatacctgaaatcacagatagtaccaaacctatatatactatgttttttctatctgatacctgtgatgggactaagtgactaacaggagggtagtgtctatacagcatagatatgctggacaaggggatgattcatatccctggtgcgacagagcaagatggcccgagatttcaccacactattcaaaatgacatgcaaattaaaacttttcaattatttatttctggagttttccatttaatattttcgaactgtggttaaccatgataactgaaacctcagacagcaaaactacagatgaggtgaggactactgtaatttatcatctctacaggacatttcggagaatacaatgcagacactggtttctgttatgttcctctgaagagtttgaattggttctaattagtaataaacttgctgagtgatcaccatgaagtcatgaaagtttactttcatactttgttaggacagattagtggaaaactccaggtattcatcaaacatttctaatgtagttaacttaaagtctgaattctctttactttatggttggtagcacctgaaaactcttctcaccttgttcagtttccagcggttgctttccactgaatttcctagaatctcctgagtgaatatacaataaagggatcagttaaggctgggaagggtattgttatgcaaattttgtgaattgcagtttaacagctaaagaatttatctctatgatgttcataaaattattgtcttaaaatttgattttagatttttccacttaatgacatttaatttatatgtgtatataaaatatgccttacctattctgtgcacagtcccaacttcataatgggggaatgaatgaatgtatcttaaacaaatgatgattttgaaactgacctgtgaacttagttaattgagattcagtgaggtatataaataagtctaattttaacactctgatttatagtagcaaacaagttttcatttgtaaattaagcctagatatatatacatatgaactatattgaataggtgggcatttcttgggcaaataatttagttttttttttttttcctattacatctggaaaataaatcttgtatatacagtatatgaacacagtgtagttttgtttaagtaaactagctttgttgatatactatgtatacaagataaaaaggaataaaacatgaaaatatcaataagtattgaatctaagtaacaaatatataggaatttattattctattatctttacttttgtgtaagcatgtaaaagaactggattttagaaattataaacatgtattaaagrtaattcttatagttttctcaataatttgctgctctgtattattaaaactactttgtctataaaagtttgctgaagtgaaaaatattgctgtttctattacacttcgttaaattcattttaatatttttgttaggtatctccaaattatccaaggccatgccagccatgtcattgcgatccaattggttccttaaatgaagtctgtgtcaaggatgagaaacatgctcgacgaggtgagagctgcagcagaatgtcactgctctgataaaaggacaactaaaagccaaatatgattattttcagaagaatattttgcagtaaatgtyattcatgtaataaatttattctttaatctatcagtgtattagcgttccctccaggaagtagtttttaaactcatctcaataattactttcatgtttaattataatgttttcatagcaagaagagttgaattatgtattttgagatacacacacacacatacacagagataaagaaagagagagagtcaatcacaaatctgtggtatatgtaattttttcatatcgtgttatttattagattgtttgtagcttctatgagttctagcatgaaatgccagcgttcactgaggaatgtgtgtgctgtagtgggaaaagcaaatagaagaactcacacactgagatgtaggcaataatatagaaagcaagaagtgttcataaaggactaagaaggtagtagtcatgaattaatgaacagaaagaggctgacactaatttaagctaaagccttcctttgaggaatgaaattcatgaactccaaacattaagaaatcaaatgccaacataactccttgatataaaagcgtttgggagctacttccagggcagttgctcgccaagtttaagtaggaaattcatagaatgcactgggacgcttcttctctagaaagactaaaattaatcaaggctacaatgtagtgtttttttccctaatgactttagcgttaaaagaccagcaatgtttcttargtacaattcttgttacctgctttctttataaaactgtaggattatcaatctgagcattacatgtagactaaattttgaaatattaaaaaacggatacgttwtgatagtcgaatgatgaattactgagctcacttttcgttttaagccttttctctttgtgtttacaagtaaatcacaatgttgttttcattaatatcatttaactcttccctacccctttttgagtaatgagtatatgatcacagaataaaaatggaaaagtagaaaaataaatatacaattcagtggtaattcaggagagataccactattaacattttcatatatttctgtcataatgcatacaaaaatttctgatattgctcctcttaactttatgtgatgagtttccccaaaaatctatgaaaactttctctgaagtctggcttcagcacctaaataacacattattatatggtcgtgccataattatttaccctctcaactttatatggacattaagattgtttcaaatttttgtttattttaaccaatcctttaataatacttattccatataattacttttcaattattgtaaaaacaatacatagtaaaataaattcttaatagtaaagaaataaaataataagtgtcctcttcaacctatttatcccagtcttacttccaaatttaaaaatattgagccttttttccgattcagtttttattttttttaattatactttaagttttagggtacatgtgcacaatgtgcaggttagttacatatgtatacatgtgccatgctggtgcactgcacccactaactcgtcatctagcattaggtatatctcccaatgctatccctcccccctccccccaccccacaacagtccccagagtgtgatattccccttcctgtgtccatgtgatagcattgttcaattcccacctatgagtgagaatatgtggtgtttggttttttgttcttgcaatcgtttactgagaatgatgttttccaatttcatccatgtccctacaaaggacatgaactcatcattttttatggctgcatagtattccatggtgtataagtgccacattttcttaatccagtctatcattgttggacatttgggttggttccaagtctttgctattgtggataatgccgcaataaacatacgtgtgcatgtgtcttcatagcagcatgatttacagtcctttgggtatatacccagtaatgggatggctgggtcaaagggtatttccagttctagatccctgaggaatggccacactgacttccacaatggttgaactagtttacagtcccaccaacagtgtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccacttgttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtactgcctaggttttcttctagggtttttatggttttaggtctaacgtttaagtctttaatccatcttgaattgatttttgtataaggtgtaaggaagggatccagtttcagctttctacatatggctagccagttctcccagcaccatttattaaacagggaatcctttccccattgcttgtttttctcaggtttgtcaaagatcaggtagttgtacatatgcggcgttatttctgagggctctgttctgttccattgatctatatctctgttttggtaccagtaccatgctgttttggttactgtagacttgtagtatagtttgaagtcaggtagtgtgatgcctccagctttgttcttttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgttgttgttgtataagaatgcttgtgacttttgtacattgattttgtatcctgagactttgctgaagttgcttatcagcttaaggagattttggactgagacaatggggttttctagatatacaatcatgtcgtctgcaaacggggacaatttgacttcctcttttcctaattgaataccctttatttccttctcctgcctaattgccctggccagaacttccaacactatgttgaataggagcggtgagagagggcatccctgtcttgtgccagttttcaaagggaatgcttccagtttttgcccattcwgtatgataytggctgtgggtttgtcatagatagctcttaatattttgaattacgtcccatcaatacctaatttattgagagtttttagcatgaagggttgttgaattttgtcaaaggctttttctgcatctattgagataatcatgtggtttttgtctttggctctgtttatatgctggattacatttattgatttgtgtatattgaaccagccttgcatcccagggatgaagcctacttgatcatggtggataagctttttgatgtgctgctggattcgttttgccagtattttactgaggatttttgcatcaatgttcatcaaggatattggtctaaaattctcttttttggttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcatagaggtgtttgtagtattctctgatkttagtttgtatttctgtgggatccgtggtgatatcccctttatcattttttattgcwtctattagattcttctctctttttttctttattagtcttgctagcggtctatcaattttgttgaccctttcaaaaaaccagctcctggattcattaattttttgaagggttttttgtgtctctatttccttcagttctgctctgattttagttatttcttgccttctgctagcttttgaatgtgtttgctcctgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcatgggtttcaaagaacatctttatttctgccttcatttcgttatgtacccagtagtcattcaggagcaggttgttcagtttccatgtagttgagcagttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtttattaggtccgcttggtgcagagctgtgttcaattcctgggtatccttgttgacttcttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatgtttgttggtttaaagtctgttttatcagagactaggattgcaacccctgcctttttttgttttccatttgcttggtagatcttcctccatccttttattttgagcctatgtgtgtctctgcacatgagatgggtttcctgaatacggaacactgatgggtcttgactctttatccaatttgccagtctgtgtcttttaattggagcatttagtccatttacatttaaagttaatattgttatgtgtgaatttgatcctgtcatgatgatgttagctggttattttgctcgttagttgatgcagtttcttcctagcatcgatggtctttacaatttggcatgcttttgcagtggctggtactggttgttcctttccatgtttagtgcttccttcaggagctcttttagggcaggactggtggtgacaaaatctctcagcatttgcttgtctgtaaagtattttatttctccttcgcttatgaagcttagtttggctggatatgaaattctgggttgaaaattcttttctttaagaatgttgaatattggcccccactctcttccggcttgtagagtttctgccgagcgatctgctgttagtctgatgggcttccctttgagggtaacccgacctttctctctggctgcccttaacattttttccttcatttcagctttggtgaatctgacaattatgtgtcttggagttgctcttctcgaggagtatctttgtggcrttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcacttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctacatttttttcaaagttttcaacttctttgcctttggtttgaatgtcctcccgtagctcagagtaatttgatcgtctgaagccttcttctctcagctcgtcaaagtcgttctccatccagctttgttccgttgctggtgaggaactgcgttcctttggaggaggagaggcactctgctttttagagtttccagtttttctgttctgttttttccccatctttgtggttttatctacttttggtctttgatgatggtgatgtacagatgggtttttcgtgtggatgtcctttctgtttgttagttttccttctaacagacaggaacctcagctgcaggtctgttgcaataccctgccgtgtgaggtgtcagtgtgcccctgctggggggtgcctcccagttacgctgctcaggggtcaggggtcagggacccacttgaggaggcagtctgcccgttcttagatctccagctgcgtgctgggagaaccactgctctcttcaaagctgtcagagggacatttaagtctgcagaggttactgctgtctttttgtttgtctgtgccctgcccccagaggtggagcctacagaggcaggcaggcctccttgagctgtggtgggctccacccagttggagcttcccagctgctttgtttacctaatcaagcctgggcaatggcggcgcccctcccccagcctcgctgctgccttgcagtttgatctcagactgctgtgctagcaatcagcgagactccatgggcgtaggaccctccaagccaggtgcaggatataatctcatggttcaccgttttttaagcccgtcggaaaagcgcagtattccggtgggagtgacccgattttccaggtgccgtccgtcacccctttctgtgactcggaaagggaactccctgaccccttgcgcttcccaagtgaggcaatgcctcgccctgcttcggctcgcgcagggtgcgcgcacccactgacctgcgcccactgtctggcattccctagtgagatgaacccggtacctcagatggaaatgcagaaatcaccgtcttctgcgtcgctcacgctgggagctgtagaccggagctgttcctattgggccatgttggctcctctccccgattcagttttttagtgagttacctttagtatctaaataatattcttatcagtacttttatcaccattacatattgcctattgactctccgtcttgaaaggtgaagaaatgtatcattcacaacacctccctccttcattccaccatccatacatttttattatgtgtttcttctacgatatctttatcatgttcaagagagcttacatgtctatttcatcaatgactacatttagactttctcttgaggtcctactatataagatgtgataaagactatcatccctacattcttcaccacttgtcagtgtctgtcaattacatatctttgaaatcttttcaaagattttcacagttacattcagctctggaccaataattaatgcttataattcaaaaatagaaatataataatcaagattgtaatactgtaattagatacatattatttgatacaggctcgaattgcaaaattggacacatatttgtaggtcatttttatcttcatgcttgctctgataacttatttaggaaagagtgtaagakgtggtctcatggtttgcacttcttcatcagattacataaccagatagtagaaaaggatattttagtgtattactggcattcatttgattacgagggaaatacgatgtatttcttctctgatttttcttttagttttcttcattttcttttagtagaaggaagttttctcccttgtagatttgtaagagcactttaaatattaaaaacagtgatagtatatcattttttaataatcagttttcagatttgctttgtgtctcactactgttgataatttctagtgcacaaacttcaaaaattttatgtaatcagctgtcaaagttcaggtaaaattctttacttataataatgataccaacccatgattattatatattttgatttttttgtgtatttcttacatgctttataatcctagaactctcatctatcccaagattagaaaaatgtatttgttttcttcatttgtatgatttcattttataatacttaattttttattccatctagaatttattttgttatatttcataaggaaattttcaaactacattttgttttccaatactcttttttactcatctacatttaatattactttcagctctttagacatattaaatatatttattttattttcggaatctgttagaagcactctgttattgagtctgagtctgcatttttatttctcttctaactcttattcatatggacttcattttcttatgtttcgtaagtgtgtgtgtgtgtgtgtgtgtatgtgtgtgttttgtggatgtatgcgtgcatatgtatttcttagtttattctttcagaagccttgaatttacatgaagttatgtgwtaatgacctaccttatataggacctagaattttttgttgttcttctgtaaaaccatgctycctgaactgtagtctagtcatcagaatttgccagtcaactccaggaaagacattgttttaaagaatgacgtaagctttctagaagtcaattttgtagtttctcatctccaaggggtttctttatttcttgccagcgcaacgattctgttatctgccatctgtctttcgatctatctacctacctacctacctacctacctatctatttttctacgtttaattttattctgtatcttcaactgttctgaacaggaggggttttttggacatctagtctacaatacttccagaaataaaagttaagatagacattgtttaatacatgaagtacttctacatttagcctcaatttctggaaattttaacatcagaaataatgttaaactatttaatgcctttgcaaactttattaaaattatcagatttatttcccatttggtctattgggtaatctattagaaacgaacttactaatatcaaacaatatttattttaccagagtatgttctacttggacatcatagaggatccttttaatgtactttaggattcagtttggtgttttgctcatctggattcataagttaattgcctgtgactcagacacccaccagttgtgctcctttggcaaatcacttaatttctccatgccttagttacctcatctgtgaaacaggaaaaataatagtgtctatctcatatagatgttttgagtactaactgaattaacccctgtgttttgtgtaatgctaagtataatgactaccataagataagtgctatttgagtcttagaagttttgtttatttggggttatcatttgcatttgggtatcaagttagaatttgcttcataaattgaattacatagctctccatttttatatgaccataagagtttcaagttttgaaaacagtctgtaaaaattaactagcattacagaaaaccaaacaccgcatgttcttactcgtaagtgggagttgaacaatgagaacacatgaacacagacaggggaacatcacatgccrgggcctgtcagtgggtgggggtctaggggaggaacagcattaggagaaatacctaatgtagatgacaggtcgatggctgcagcaaaccaccatggcacgtgcatacctatgtgacaaacctggatgttctgcacatgtattccagaacttaaagtataataataaaaaaaattaactatcattaaaacatgtttgtggtagttctttgataatttgtcctcttttgatacccttgattagctttgtttaccgtttccttttgcttgcttttctttttttcaaatctctttacttcctgtggtgtttatattttctcttttttatacttaaatgaattaaattttaatttatctatttttaaaataatggactatttaagcctataagtttacttttgggtacagtttttccatactcaacaaaaattaagttccttttttactgctattatattctacctagatagctatttatttttaattgaagtcttgattttctctttaacccaagagttattaaagagaaatatttaggcattaatttttagaacagttgaattttgcataaaattctctcatcatgtttgatattcagaactaatttaatcttaatttttgtggcatttgatacacatctaaaagtagtaatttatgttaagaaaataagccttagataatttctgctttgataattgagtattttttatagtcaatcacaaactatggtaaatatttagttatataccacataatatgtaatttgatattattagattattcaaattttctgttttttcttacttcatctgtaaatacttaagatgagtaagttagcatcattttcagccattgacttttaaagtttttatttccaatatattttgttgtccacatatttttgtactgataattagtgcttatttgaagcataaacataataatttaaatcatgtttttattatatttttatcaatgtaaaatgagagcttgccttactgaacctagtttatttgagttctactttggccctatttaatatttcacaacttttttttcttttccatacgctttcttgacacacattcattttcttttacttgtaatattttatttgcaatattcctgttcattttgtttatctcttgtgcacattacatgtttatgtttttaataagaacagtaagactgcttaactcattagtatgtatttagtatgcatttctgacactaattctgtcattctgctttttgctttctctccctaatgtttccttgcctttttttccctcctcctttcttctttctgatggactatatatattactgatttgcttttatctttctccagattttgaaggtctgttagttgtattcattcatcctgtattatttctattttttaatcaaagacatgaataaacattgtgttttgtatttctgtatgttaaaaaagtaaatttaaacttttcattcccctcatctattgcttcttatccccaaaatatcaattccaatgaacacctttattttctttagtaatactgccagtggcatgttcttagagtatcattgttaaactgttattttaagtaatatgtctttattcccaaggctactttgcacctgtaatagtctggtggagcaggcttgttccgtgagccactagttttgcatttgttactgcttattcttctcaatgtagcatcatcagcattagcgtttgtggaaatttctccttggtcattgttttctatagccatagtttggtagatgctttgagatttcatctttcttgtttacatttttaatatttctattgacacttagaagatgctatgttcacgtaatcatagaaagcttttaattaaaccctctactctttggttttaactttyctttattgatatatatmaaaaatctatttttgtgtcaaaatagcattttaaaggttactgtcattaaaactttaacaactaaattatgtacttgttttagaaatgttgatatgtggctcatctttctttaggtttggcacctggatcctgtcattgcaaaactggttttggaggtgtgagctgtgatcggtgtgccaggggctacactggctacccggactgcaaagcctgtaactgcagtgggttagggagcaaaaatgaggatccttgttttggcccctgtatctgcaaggtacattgtttattccagtaatgtcccactgtcaagacagaaggttatttttcttggcttctctgttgatttccttggcattaagcaattttaatgacttctggaagtatccataatctattctacgtgtggtgacccaccaggttcactgtagcaggatgtttataaggcacttatctaaaagcctacaaatgcacggaggataaaccacgtttaaaggcttgttattttataacaaaaacactttcaccccattgcccaactagtgtgttaatttaaaaatatacggcactagaaatagcaaccctttaaaactaaagtgcattcaaatctacctttgcatctaattcagtaatgaattctgtcwagggttttattctgaatttttaaataatcttctaaagtttgaacccagataagccttaaaatactcattatattcaaatttttctgttcaattataaaaaagtacaaagccctaatggaattaattaaaggctcaatattttcttccaagattacttttagaaatgcaactttatttgttgtacatgctcacctaataacaaatcatgttaacaccaagggatgcattacctctgcagcttataaacattatgaagcatacaggcatgcacaagtgaaaaatgaaaagactgatttactttacctatagtaatgagttctataacattctgaccagacggtgtataactacattagctgagagaatgaaccattctttgaaaaagttagcataccatacttatgtaaaaatgaaagttactacttttttctttattttcaattaaagagggacccttattaaaaatatttttattaacctgttagtcttatcttggcagctataaaatattatatagttatatttgrtacatgtgagcatatgtgtacatatacaaccattaagccataatataagtagtaaatattagttttaatgaagtgtttatgaattgggacaagaatgtctggaaatatcaagctaaatataataataatagttacataataggtatatgttacatcaggggcaatttaggttcctattttgaactactgaaataataaaactcctgtggacacagtaagcagaaaagtccacaagcccatagtaaaaagttgccatgtcctggaatgtagtaaattttctaatctattacatttcattccaatattatctgaaatgaaaaattgcttgagttgaccaagattgtgtagcagtgtgtgagtgattgcttgcttaaggacacctcccctctccatcttgtatgtctctgtgggcaatcctgcaggctcttagtgcatcttctctagtatttatcaaaacatgtcttgtgtgtgctttattctcttttcaaaactccacagaaatctctaacctttaccacttgctcaaataaaggacagtcaaaactaagcttaaaatggaaaagaaacctcctgagtttctagaatatataaaatcaaacagggaagaaaaacaagtgcttttctacacctaccactcatacagtggtgatgtctggtatttgcaaggaaagggagtaataagcgagttaattttctttggtaaatatagcgagaaaggctggagcaagagagctgtagtgattagcagggctccaagggaaagccccttgagctacttactgcctgctctcagccgaactcaatattgtactgagaattattataatcctaataagaaagatgcctcctgtgtagacacttgaagctctacacagacaattaaaatgcaacaataaacagcaattaagaaatcataaaagagaatgaaaattaagtaaatagcattattaaaataaatgcctttctaccatgtgatatcttaaatagaaaactgtaagttcttataaactaaattgtttcaggattaaaaacttgcagaaagcaagtttcataaaacatctacataattataaaaatcacaaattatatgcatataacatgaattacatcacagaattatatatcacaataatatcacaatatgccacgatgagttatatcaaaatgtgcatgcaatgtactacaattaagtgcctacagtctcttgtttaaaaaataattaataacctagcatttcaacaaaatatgcatacaatttaaatactgaaaagacacttagtgtagtgtatttaaatactgaaaagacacttartgtagtgtatttaaatactgaaaagacacttaatgtaacagttcatactgtttcacaaaaacatgatttgacatagatatgtcaactgattgtaaaaacagcatggatcaaaatgctgcttaagaagcaaaattttattgaaagactaaaatattggagatataaattcaaattaaatgacaggtttttagcagaaggggaagaatatatacataagtgtccatatatttctatccaagttagtaactttaaataagtatttatctgtaaatagaaataatataaatcacatatgaaataatgtgtatataagtattcatctccaaaatgcttattaaccttaaacatttgtacctttattctcttatactataacatatgagtttttaaatagtttttttttatcagaaagaaatatcttactgaagtgtgaagacatttttaaaaagagcttcattaggaagtcttgggcctaattgttttttgttttataaattttaaatgactgctctgtgatgagcccatttcagttgaggctgtattayttttcctgtgggtaaaatgacatactgagctgatatggacatcacttctcccacttttgctattttaaaaatacagatatgctgcataaacatagcaaatagatttataaacatttagattcaagaaagaaagggaaattcctagatgtcagaccaaagagggaaatctaagttaagcataagcaaaagctcaagctaaactgagcaactggggtcatggggtggagggtgggagacaagtcttagttctaagatcagggctaaagtttggagttttaatgccctcactaggacttgacactaggatttggacccacagacggaaattgcagctgaactcmctgaagcagggacactagaaatgctttcagacagtgaaatgggggctagaaaattcttcctgcaagcctacagaggcagctagaaaatttttctcttaggggctctgggtgggtaaaagttactaccttgtgtaggaccgaatccccaaacctgtgtgccacgtgggaatgggatacatttttattctccccttatgtgctggcattcttcaacaagtcaaggaaatgatattcccataggaaaaataatacagcctcaactgaaaatgatctcatcacaaagcaagtaaagtacacaaaaggaaaataactacaaaaggaaaccagtagccacaaaaatgaggatatttgtacacaaagaactagaaagggtagtctgaaataaatttgtattcataaaaatctgtgatcatattcttatcacataaatcataaaaatatgtttaaaatgtacaattataaaagcatgattagaagattgaagaataaacaaagaaggaatagaaaaaagtaatataaaatagacgctatattaaaattcaaaagtaaccaggtttggaaaagaaacatgtataatttacttccagaaatgaaaaaaatatgcagtcattgaaattaaaaattcaatgattgggttaaacaagagatgagaaactgcaggatagaaaatcagaaatataggcctgaaaaaattacctataaattgacatagggaagtaaataaatrtgatgctaactgactcacagaattgtaaaattgaacagaagtttagcagaagttgccaaagaagagattagaagaagttgagggaaacaatattcaaaaaaataatgaaggagagaagaatgatcatgagttaaaaactattataaatcctcagtttgaggatgataaaaaataagtctacccctagtagaaaacctgtcaaccagcaagacaaagagaaaaatattaaaactgggggcaaatatctttattgtgagtgtttaccactcacagtccaacttcatggaaagaatattaaataatatatgtcctttagtaagaatattgaacccataagacagtttcactagattatagtccagaagaatcaatctataaaaagcagtagtatttctatatgtcagtgacaagcaaataaaaaatgtaataaaaatacttagaatagcaagaaaaacttcatgatacctaaaaataagtgtttgtaaaattgagataatttttaaaggttattgaagaacataaaattctaaatgaggagacagctgaggatcaccaagtaccagtgaaaatctgtgaaatttgaaatgtttaccatttctattaatagagttaattagtaccacaatttaggagggcaatatggtattatctastatctttgaaggtgataaaaccctgtcaaccagcaattccacatccaaacatttaccccaaaaaactcttacaatgtatagagaaaaaccatctaaaatgtgctcaacgtaaatgtacttactatgatgaaaatgagaaaaataaatagcaaaaataaattgtagtgtttcctttaatctgataaaagaaacagttaaagtggttgaaatagwtcttcatgtataaaccatgataaatttcagaaacttcaggtggaaaaaacaatgtcattatggtattatttatatcaagttgtaaaacataaaacaatgctacattgtttgtgaatacatatattataattaaaaaatttaaatacacttgtagggtaagtactaatttcagaatagtagttacctctagagaaacaggaaagggaataaaacagaagtgaaatgagattcatttgtatctaagtatcattgctttaaaaatatatctgaggcaaatatraaatataaatattttgttacctctaggttgcatgggtaatgcatgttatrtgtgctttttgaatgtcttaatataatttctaatttaaaatttctttaattgaatgtaaaaaagaattccagatttaaaaagaggagaatgaaatttttaatacaatgtcaactacattattacattttacacataagattttctcttcaacaatgatgttaatgaatattatcatcattatatttcaaaatgtgaaagcagtgctagctcaagacactcaaatgtttataatatttttgcattgttaaaaatgttgaaatttctctcacgaattacaagaggcaagtcaatctcagatatatgacaagtcattgactataagtgctgtctgactctcagtatttgtttatttcaagtaccatatgctagaaattggctcttttgcagtttggtgtcatattatttatgcaaaatcagttggtatgtagaatctcacacataatataaattgacattgatctagttaggaacatgtgcttttatttttatcaaagtcttataatagaaagataaatagtgaagtagaagactagaaatcaaagtctgtattttcatcttgttttgctttgtttttattgcattttccattaagtccttacaggcccacgagactatgtgatctggccttggcttacctctccagaatgttcttgagtttcagtcactgtttttcagctttgcttaaatttcttgagtctcttagttgtttgtagcatctggaattttataagttctattcagatttcttgggatacctcatttctagccctattcctttgcttagccaggcatttttaatggctcggcttaacttcaactttctcaggaaagctgcccctgcatcctcaagtcatatcattctcatggcataatcacttttcaaacctttttcttttcttttatgatctcataatgagtaattctgttttatgtctatcttacctctggtgatgatatggaccctatatattttctttaccattgcacaataagaagataacacaatgactcatacaaaagaaagaaggaaggaagagaactaaaatctcgtgaagctttgacagtcatttagcctttccgattctgttttataatctatgaaatggtgttattgaatcttttctgcctctcagtaggtataattatcacactgaagccctgtacaagtataaagtataaccataaatacctactggattactttttgttgttgtttatattgcttttcccaagtagagataagtttctgttctttttccctgaaaggatttttatggtgtgttaacatttttattggttttggatttccctcttctttttcatttgtgtacaggaatggtcacttcattaacttgtagacttgattcctgggcatttttacaaatggacttcaatgtgtacatttaatcctgaatctaaattacagatgtagaatttttggcataaaaggttcatgcrtgaatgaatttatctcttgcaacccctacagttcaaataatattatgttagtcaattttttacatggacagactctctccttgaccaaattttggaaagtcttctctgagtcctctttttgatgaggcctcatcgttgacccttgtcctcaaacctagcttggttaaagcaagaattctgctaagtcagtgtgttaagaacaccttacccttgatatctgatccctctggcctgtcttcaacaagaatcctgttaatttggtttagcaagaatcccccctacctacccctgatgtctcctcttaatgattgttcgcccctgatccttgctcgtggctataaatctctacccttttccttggcactgaatccctacttgttcatgttgtattgggaatggaggctagttctttactaaggttgctttttctctattgccatagtttctcactgaagcctattttcatcgttttaactactgtccagctctggttctctttcacaatattaaaagctgaacttgtgaaaattgagaactaatgtttatgtatttccttctccctccctaacccatcaactattatctagccttggaaaagtgtgttttaggagtwagtcctcaacaaatactgctaattaactaattatccttcttttgttaacttattttaatactaggatgcattagtctaaaggtcataacagaagaaaacctgtaattaactacaaactaccaaaaaaccaagcatgactgagaaattcctgaagcaattatcacacaaaaaaaataacttaaatgtcactggagctattcctggtaactttgtcagtagtactcccagctgactaacaatcacagttcaatatgtactgctgaagttgtacctagtttataaagcagtagcttctatgagaaagaatacaagaaaactacggtgactatttctccagagaaaaactgtactgaggaaactatagcaaaaagaaaattgatgtcaacacaatagtatctcacttcaagaaatcaaaaacaaaagaacttagtaaaatttttctaattcaactttgtttttaaagggaaaagagaactaaagaaaaaaaagacagccatgattttttgtagcgtaggccacaacattgagctatgttcaaaggaaatagatgtctaaagcacacatttcttcctaaaagaatgaaaattggttctttgggaacaaaaatatcatattgattttatgtaaaggcaaacattcacatggtgcatctgtacataaaatatatctggagtattaaagtttcatggtggggatgattatgaaaaaatgactatataggctccatagggacatgatgataaaaaatagattaagtagattgaaaacactagtctaaagtgaagtgatgtgttttaatatcataatatgtgagaatataaaagtatttacgtatggattatttacaatggaaaaatgactattatagttcatatttcattttattaatgtaattgattagaataatggtatagaaatagcaaaagcagaatatttggttttaagaaaatatggtgatataagggaatgaatattaatttctagagtggaagtctgtagcgttctagaaattaccgtgttttataggctgtagtgtgaaaattatcattaaatacgcaaattgaaaagaatcactaatggactctatacaaataaagtgttaaaatgaatttattggatcaataggagcttcccagtaggaatgctgagaggtttaatagattagactccattttgtttagattaacagttaaaacaactttaaaaatttttattaaattatgtttttgcaaccattgaagtatagataaacaaaaaaagaaaaaaattaattatatgttaataactttttaaaattcatcagtacaaataaattatagaatcataaaggaaaatagaaatctcatgatgattaaaataacattcagtctggaaggtacaaaacttttaccttcatcattcgatatttaggttcaattatattcccatctatgctttagggactgaattggatggtggtaataaggtataatatatggtctgtgccaatcttatggatggcaagaaaagaacaaaattatggttttactgtgtgtatttatttatttatttatttcaataaatgccctttagtagatatttttacatctggagacattctcacatctggaagaggacactgcaacagtagcctattttaatcttgtcatgaaaatcttgggatacatcttttttgctcaactccctggtttttctgtcttatttttttcttcggggcatagtggacactggtgatgaatttggtgtcagatccagaacatgttgtctgtacccctcttacagcagtgattttcttccaccttgtaatatamttatctgaagtccgcctcatcagaaagtacatagggaaactatcgtgactctatttctccaagtagaaactgtgctaagggaactaaagcaaaaaagaaaattcctacttcctttgctataatcctcttgagggcatttttatattccctgtgatatctcatatgtcttgtatatagtagttcagctatgagttgatgaacraataatataaagaataaagcaacgataagaaataatgagcagagcatttattaataatttgatattgataacagaggaagttaaattattcaaagagctcaaccataaagcagatggcttcactttcaagctgggaatcaaaaaactttaagtsctagaatattcatgtcaagaggatcttccaagaataagccaggaatgcaattaggggctgactcatggatgacaatggtcgatgagtcacaaagaaattttgaaaaaacaatgatgtccctggggacacatagaaagaattggaactagactgtcaagatcatatatattaacaagctaatagaaggcgggaaattttggtctctatgaaaatgtgcacaaaagtcccagaacactatacttctgtgtttgaactgtgctactctaaattatataaaatatactctataatgtagtaaagaaagatttctttatgccaatgtctcacattttatagacattttacctgctactgtcaacttaagttactcaagtatagttctgttgatttatctcctaatgaacaaccgctaatgacttaccaattcctaaggaatatctcttaggatggactttctgagggcagggccctggatctcaagtaccaagtgaagttctagcatacaggaagtattaaatacaggctgagtatcccttatccaaaatgcttgagaccagaaatgtttccgatttggtattttttcggattttggaatatttgcagaatacatactggctgatcattcctaatcagaaaatccaaaatctgaaatgctctagtgaacattccatttgagcatcatataggtgcccccaaagtttcaaattttgaaacatttaagattttggattttctgattagggatgctcaacctgcacatttgtcttgaaaaataaataatgaataaacctccaacttttaaaatgaattcttgttcccaatgtctttgctaacatcggtctctcattctatctatgtccacaagttgaatttttaaaccatgcttcaaggatcaggtcaaactccactcctgtcataaagcttccttaagccttatagcaraaattagtgcttcctctatgttcccgtaattatttatttctcagatgcacttaccatattccaccttgcattatagttgattgtgagtatatctttttacccaactagatattggcctttaaagacagacttatttaaagacagaccttgacttatttatcttcatagtgcctagaattcctaccctaatgtgttgcttcaggttattaaataaaattgaatgtgaaattatttaatcatattttttcaaggtcattttactaggctaaaatggagctaaggaaaatgtagctaatgtctgcaaatttctaattgttgaacttagtctgaatctcagaatagtggcattataagctttcaaattagagtaaatgaaaagtagattagaccaagcgcataagaacacagtatacagaacagctgtactgtgtcctcaacgggataaactaaatcataattacagatatgtttcatctttcttgcctttatactcttttgaagatgctctcaacttcagtgctttggggatttatttgtcactgtaagtctgaaattagtttgattagttttgctgatatctatcatttcaaaatgtctgaaatctgccttaaaaagtaagctggcacaaatcttggggcagtgcttattaaggttcccacatagaagtggctgagtttgtaaatgagtcatagaaattcagtatcaaaaagttaatttaaaacaaattattctcttggatataaggaggactgctttgtttattcttaaatttttctccttacttcttcatgctatttttctcttctcttctgattttccttatatgttctcagattttatcatccctatcttctgctcaatctgggtttgtttaaagtgtttttattcagctcgtactatgcgtatagcactttgctatgcatgaaaaacatgactgccaagagatttatttgaacttaataaattttatgaagctaatgctcagtgctgtaccaggaaccatgttattttctcagactataaagttagtaagacagaatttctacctctgaatagattatggtagatagctagagagaacaatctttgagcaatacttttttgtggttgtgatagggtaatgtatacagggccacgaaaactacatggagagagaagttagttgtccaagggaattttttaaaaagcctcagtattgataataagggaattcaaggaagaggggaaatgtagagaaaatgcgtatgtagggaatattacaaatctgtttcctggaaagcaggatgccttcctttagaattattagttaagattaaccactctttaaattgagagattatatcctwccctgtttttcattatatggtcagctttcactggcctgagtccacattttaagctcaactatatacaaataatttttcagwatactgagagtaggattaatgaaaccagtctggagagcagtcacagaatgagaatagatctttcccatagtatcactatgtgactaactgattgtactgatgtgttacagaaaacactgtaaaaagttaaccagaggaaaactttgctttctactttatctgatctttaccccagtttctctacctgtcaaattcctatgcttgcctcaaatgtacatatttttaatctgaaatgtgaaaagtatttataactggtgtaatatcaatgttctattatacatccatgcattaatgtctttaattttaccatgaaattaaatgaagtacctcaataacagaacagtgaactttaaatgaagtagctcaataacagaacagtgaacctaactggccccattttagtcaatctaatgcattcctgcacaggtatttatcatgacatttactytacactcaacctacatgaagatcaacatagtcacttttacgagagtagatttgcatccatccaataatctttctcaccagtgtaattagaaaggatacagcttaacacatagcttttgagcagatttttaaaaatatcattatacgttaaatatagttgagagggtaaaatgaagaatgtacagttaatattttccttatacagacatggacgcagctcataatgttgaaggatacctctgttgctgatacatctctttatttgcaggaaaatgttgaaggaggagactgyagtcgttgcaaatccggcttcttcaatttgcaagaggataattggaaaggctgcgatgagtgtttctgttcaggggtttcaaacagatgtcagagttcctactggacctatggcaaagtaagcaagcaccatttggttctgtttgctgccccagcagccttctttgttgctttcatcgttgttcttttgtatgaacagtttctgatagtgaacttctacataaagttacaggaagaagtaatggaattttcttcaaatgctgttgtgtatttttgctcaaagcctttgaggttgtatttgtaatattgtgtagactggaatttcttagaataggtagacatagtctttttagtgtccatgattactctatgaaacaataatgcaattaaggtttcaactccaagggtgcatgatttaagagagaaaacactacattgtgatatgaattatattttccattactagtatgttcgtatgcaagttgagaaaaactctgtatcatctgtatacataatacatattatccaccaacgctttagttactatttgatgttgcctaggctctttcattattaaaaggggacattaaatataggcaataccttcattctgagttggtttgaaaaattattacttaaactatttaatagcaactgaaattttctttctttaacgtaaatgtgtttacctttctaacttcactgcctacactacccactgccttttcaaatctgtgcaaagagcatgttgtctccctatacagaaaagtgtcagaggaaaatgggaccttctgggaatttcacacagcctgtgtggctggacttaagagtgcagaatggtaggaaatgggctggagagagaaagaagtctagacgggggaatgagaatctagaacttatagggttgaatatactaagaatttgagatattttacttggagtgtcattgaagaaatttaagctaaagactgacattatcagagttgtgttttataaagactactatttagataaactatttcctaaacacttcttcctttcaactttaatcagtgaactaatcctgaacagagctataaaatattttctctgcctgcagtgcttttaagtcaagcctcatattatgaaatattatctatacgttatcaactgtattgctttcagagcagacttcaaagaatcaaccacagatggacatctagtctaacttcctcttttgtttataaagtcccaccccaccctccagactgccccactgatagatcaaagtttcatagccagccaaggggcagagctggtactcaagctttgatcatcagatgctagagacacagaatcccattcaactgtcttacaatgcctcaagggtgacgttagaaagggaagaaatgcaaggaatatattacttgttgtccagaaagtcaacaggttgtacctggtttctatttctcatttaactaagggaattgcagtgattccacagctttgggataagcagagtcaaatagtctatgaagaaattttaaaaaatatttcagccacatagagtcacccttagcattctgcttcccatcacccacaacatgaagcagctcatgcatgtctagtaggttcctggtagctggtaccctaagccctcagtaatcagtgttttgtcctgactaggtaggatgctttaaattagasgtgtagctgtaggcctgaccttggctgaagcataaagatgtaaaaacaaatcattatgcattcccagattcctcctttaaggttccttccatttctgggccagggatctaggctgtaggtccccacagcacttctgaccctatctgaaggaatacatacagtattgccaggtgttgtcatagcaccaaggctggtgggttcaaatatccttaagcctcaaagtagaaattttaaaaagtgggaggggtggaaatactgaatgaaacaccacctttcaggtacttgcatagtttctttctttttccctctgcattacaaatacatacgcaatactttttcaggttgttttttccaaaagcaacaataaactactagtggagtaaaaaatayggaactgaaagtccaactgtttgattaagtgtatgttataaccattgtatgactttgagtgaatttctatttttaagaaagtggtatttggaaccacaattttttaaaaagcataggttcaatgaaaacagattattatagaataccttggaaactcctagaaacatcaaggaaaaaaaataaacaatggaagcctatgtgagtacatataatatgtctaatgatattcataatgctcaggtttttttctaaatgtttgtggtttggttttttttgtttttaatttccaaaagtggacacgaccaggaacatgaaagagaaaagcagctgatagatattttttaaaaattaatgatgactgtgtgttttctctaagatacaagatatgagtggctggtatctgactgaccttcctggycgcattcgagtggctccccagcaggacgacttggactcacctcagcagatcagcatcagtaacgcggaggcccggcaagccctgccgcacagctactactggagcgcgccggctccctatctgggaaacaaagtaagtccacgcttgcttcccgctattctgctttaactgactgatcgtgagaatgggttttagttggtaattcttttaaagaaagacaaaatcaaatacacactgaattggattgccagaaccagctaaatcacattgagttgggcgtttcttccatgttgcacaagaccttaaagagccacggcatccttaatatgcaactttgtatagctgatgttctatgtaaactttttgaatgggcaaataaattaatgaagccgctagtgtattttcgtaaagcaaattataggtattggaagaaactgtgttgtgtttatgtgaaaagagctgttttctggagttgtctgtggtgggatacttactaaagtttttctcatcggtttctatttcatttcaaaactgatactcaggagatttacttttccttctacctgatatgaatgttaattggaaaagaaatgtattacataactaattaaatgcttgccatgaggcttatgtaaacaacatatttgctggagctcaggcagaaactaccctaaaagtgccagattggaagcacgtttgttttaaagcccacacatatgtaaaaacatacacagataaacaaatgtagcagcctcagaaatacaggcttatttttttctgttgtggattacttctatctagatagatatcctggggtttagaattttattttatcttgcctaatactttgttggaaacaaaatttggtgacttatttataaacgtgaatacttgcttgttctgtgaaagttaataccttctcagctgatagttaaaatacctgatcacaccagaaggtgtgatgggaaaatcccttcctaaattaatgttgtttaagcctagtttacacctaacaaaatatagcattatttatgaagaaatcataattgattaagcaaataaaagtatgtttatagtcagtggttttcttgcatgacatgtgagtattgaaatagaaaaacttagtatctcatatgctactcagtgaatgggaactggtggtgttggctggttgaaacacttttaacttatggccagtttcttatatttaacagaactctgaatgctattacaaaaaatgtgtaaatgtctaaaagacattttcartgaacatgtattttaagagacagagtatgttgcataaaattcaatagctgtaaaataaaaatcgaattaaacttttatttgcaaggccctttacagcaagaagtcattttatcctattctatttaggaaactctggtattcccaaaagaacaaaacagcacataagacttgaatttctactgcttaaaattgccaaaaaaatataaaaatatactgtcaatttaaaaaaaaaacaactgagagctccaagaagagccttaggtcaaaattggatgaatttcagaggccttatttcttatatgatggcaacacttaattaaagtagcttataatagaaatattctttaccagattttccatcctttcttctttggtcatatgcatttttttttctgttggctgacaatcaaactgacagaaggaaagcaagcaaatggaatattcggtagaatcagaacaaagaatttggacatcccattagtagttgttggttcccgaagataacttcccttatcctggctgaaatatttttcttataacccacagtgaagctcttcatattcccctaccgatcattttcacatcaaaacactgttcttgcctgtactgccgtttccattcagtgaacaaaataacattaacagggtgtgcaaattgtttgaatacggaggacatttttaatgtaacgtggaagcccttggtggtttactgtcaggcatctcagtatgaatgaaacaatttgccttaataactgaaccatgtaaatttttgatactacaataatactgcaagctctcagaaattaccacagtacatcttaactgtcatgtcacatcacgtaaattatagtcatgatgacatgcttagcttggttgatttaatatcttgctaaggaagtggaaaattgtagggccttgttggtaaattcaataaagccacttttctaaatagttgaggctaaattctttaccagtaattgctgttcgaatcagaaccattgccagaatctgacagaaatagcgtatcaagatacaagtgcatctgcttaaatattgaattttatttacatccatgaccaggagtctatggtacataatccttcctctgcttttttagtgttatttcctaattggaaaaaattatgagatgctattagcttttcctaaatatttatatacagactttcaaacattttccaagttgcttggttataaggcttcttctaacagaagggcgatatgctgtgcatgttctcttataatggagatgccacatgctgttattctttttttaggagcctaatcccaaataataaaagtggctcacatgggacacatttttgctaacatggatgtctgcctggttgtaataaaactcaagaatactagccaatttagcaaaggagtgctttgtatcctgtgaaacatttttcacatttttactgttttggaataatgaagtataagtaagtgattataagtgtatgtgtggataatggatgaggcctaggaaaacttagcacgtttttatactttctatttttgaaattcccacagtctcagctaggagttgttcctccaattttttcccctatgtaccagtgaatatttggcacaactggcagaatcaagtgttaattttcccgcctcgttcttgatagtcaaagagaattaaatcaggcacccacagggctatcctaggtgcatttcattttcaaaatgcttggcaaatgttaatgcttggttttagggcatttgtttaagcaactaggcagcagtggaaagagctagaggacaaagaatcctgctggtttgctgcaggctacagctattcagaaacagtttgggaatttcagagttgggataatttactgccctagtaaactaagtgctactggaacattgcaacagtcatttgcttaaggttgccctagtggtctgaaatagttgaggcagcttccaaaagcaattctctttgcatctgtaaagttctgggagaagctagcttggcttgtctgctgttcctgcattaccattaaggtttgaaattctctcyctgaatattattaaattaatcttatgtgatttgttctttaccaaaacctgcttattttctacagcattatgctatctttctgtttctagcttagagaagcctttaaatttgttcatatagttgccaagaatacctatagtctagtttaagatgcacattaggagagtctgctgacataatagcatctggcttctaaaagtaatctctggtaaactcttttgttttgttgttcttgcttgactttccattctacttcacggatctcaaattaaagctatagatttgaagaaggaaaytgatatttgagatttgtaggacagggtagatctcatcatataaaagaagctcaacaaataccttgtaattgatgctacatgcttaacacaaacaaacaaaactctaagaaattgttttttttaggttgctcagaaatgcccattgagttggatttgtgggagttgaaagatgaattctgtcttgctttacaaaataattaaaaactcgctaacaaatatgttccactctcctttgagcagcatattttgtgacttctttgctccatagtcctcaaaattattcagaagtggagttcaaacccctcctcgccatccataacttcctcctatttaaatcttggattaaatgggttagttaagaagatcattatgcaagtgaagaatggtatggctataaaagtaaataggataaatcaactgtggttgattttttattccataaatcagatcccatcaagactaacttggcaatggagtagaaccaggaagaaggtttgctgcctagaataaactgaatgaatttgtaaaccaaaaataaaattctaagacccctgactgaacggacccccttcttggccaagggaatcccaaagaaacctaaagaaacctgaacatcatgggaagggacgattacacattcctcattataccctgctccctttggagtttagacaccacagaccaacagtaacattaaaacagagattttaaaactgactagacagacactttacagcaacaagataccaaattctaacctcactctggtatagcataacataacagatagcaggccctaaaagaaatcaaagtattttataccaaaatatatttatttgacatattctgaaatgaccttgcaaagctgtctcttggggaaatttgcattctatagagaatctccttcccttactaagtcttttctggagagtcagataccttttaaggtctggcaagagacattcaccatcagcctgctactttaccctactaccttgaggcttcatctacatgacaagaaccgtggcttccacaacccactctcttaactcaagctgacttcaactgttcaggcagaattttactctttcgaccaattgccagtcagaaaatctttgaatccatcaatgacttggaagcccccacctcgcttcaagatgtcctacttttctgggccgaaccaatgtgtaacttagtactggtgtatgtctttgcctgcaactttcgtctccctaaaatatataacgccaagctgtaacccagtcatctttggcacatattctcaggacctcctaaggctgtgtcacaggccatggtccttaaccttgccaaataaacctctaaattgattgagacctgtttctgatactttttggtttacaaattgttaaggataaatgagaaaataagtattaaaaaacaaaaaaaatcaaggactcatttatttcccatagctatgatagaatctgctgtgtaaaagtaacacaaatgcaggagctcaaggtcaaacatagaaacctctgtcttacatatccgtcataacattctcttgacgtttttcctaattaaatttataaagcattagttctaatgttaaaaattgttatataaaaagcattttaatattcacatgcatctgtctacagtgttttacattttrtttataattcgtcaactgaatgaatactagataggagaatgttccatttaataaaaactcttgagaaaaataaaatagcttacttaacagtaatttcaatgtgagttggtttgtgatgtggttggcaacaaaacttacgtaatctagggctacattggcaggaatttactggtcaggacaaaggaggtagtgtttatacagattctgcacaaaacgcatgtcacctaatattattattaaatattattaaatattattaatatttagcttacttgtgaatttctctttttatctttgttaatatacatgacccaagtcatcagctaataaaccaagaaatccaaattaggaagaaatagagccaggattacaatccagatgtgtctatagcccattccagttaagcattttttcaatcagttaagtttattagttcttgcaaggcattgatctttggaatagagatgctgaagcagcttattcaaaagaaagggaacgacaaagatatgaatttataaaaatacaaatgaatgagatgaataacaaatgtcaatagaggggacacaaatccaacaagttttttaaatggtttcaaagctctggcaagattaatcaagcaaaacgtgggtaaaacacaaataaacaattttagaaatgtaaaaatgggcataactgcaattacttcaaaaataaacaaataaggaagtatcagaaaataaacaaattaagagtattatgaaaatttacacacaataagaatacaatttagaaaaaggaatatccttctaggaaaatgcaacttaaaaaaactgactcaaagaaaaaaaatctataatgtcagataaacattaaagtaattgaatcagcagtcaaataaaccttccaatgaagttaactccaagcctattgatttgcaagtaatatcaatcaaaattcaaaaatttttaaaaatgcaaaattatacaaactttccagagaatagaacaaytgggacgtactcctcacataattttatgtggcttgatataaaatcttgacaagaggactatgaagaagaaaacccctacccaaagtcactcatgaacgtagatgaaaatatcctaaataaaatattaacaacccaaatccatcagtttataaaaatagtcaggctaaattggccaagtggattttatcatccgtgtttgaggttactttaaaattagaaaaccagtttaagtaattgaccatattgactgattaaaagagaaaaaaatcaattatctcaatagacacagaaaaagaaatgggtaaaattaaacattcttcatgtctgaaaaattttgaaaactagaattggaaaagcactttaactgatgaaggctatctacataaaaatcaatagcaaatatcttatttaatataaaatgttcaaagtattgtttaagatcacaaacatgaaacaattctcactataacgactcccacttaacattgtgctagaagatgtggacagtgcagtagataggaaataaaatatatagggatcagaaaggaagaaataaaactcacttatagatgatatacttatctgcttgtaaaatcaagagaatctacagacaaattcttaatcagtgagtcaataaggagactatatgcaaaattaatatacaaaagtcaatcatgtttctttatatcaacaacacttttcaaaaaaaatttttaagaggccatgtataatagcaatacatataaatagtaccaaggattaaatttgtagggaaaagccaatggccaagaataatcaaaagaaattatagatggggtgcgatggctcacatatgtaatcccagcactttgggaggccaaggtaggtggatcacctgaggtcagaagttcgagaccaccctggccaacatggcaaaaccctgtctctactaaaaatacaaaaattagccaggtgtggtgacaaacgcctgcaatcccagctactcgggaggctgatgcaagagaattgcttggacccaggaggcagaggctgcagtgagccaagattgggtcactgcactccagcctggggcatagagcgagaccctctccaaaaatatatatatacacgtgtatatgtgtacacgtatatatatgtgtatatatatacgtgtacacatatacacgtgtatatatatatacgtgtacacatatacatgtgtatatatacatgtacacatatacatgtgtatatatatacgtgtacacatatacatgtgtatatatatacgtgtacacatatacatgtgtatatatatacgtgtacacatatacatgtgtgtatatatatacgtgtacacatatacatatacacgtatatgtgtacacatatacatatacacgtgtatgtgtacacatatacatgtgtatatacatgtacacatatacatatacgtgtatatgtgtacacatatacatatatgtatatatatacatgtacacatatacatgtatatatatgtgtatgtacacatatatatgtgtgtgtatatgcatatatgtatatatgtgagtgtgtgtatatatatatatttagaaattctaaaggaaagaagtggggctttttggaaagggattaggtcatgagggttctaatctccatgaatggaattaatgcccttatgaaaatcttatctgatataaagagttaggacttactttaaaagatataatgactaaggcaaaatgctatcagtgtgaaaataaaccaatagacctgaaaaaatagcccatagatatcacatacatagatgaatacttaacttttattgaaataggcattgcagatcaatgacaatgggatagaccctatacagtaaatggtctggtaccactgattatctagagaaaaaaaataaaatttctgcatccttactccacattatacataaaaataaactccccttgaaacaaatcataaattttcaaaaattatgctaaagacaaacctttataaagacaacacattgagatttctgctcctgaccataattgaataatagtatctagatttccttatctaccttaaacaacaacaaagcctgagggggaaaaaatgtggaacaacagtttttagacactcttccacagatagcataaaactgtgatctctgaaaaagagaaacaaatggggtgaggtttacaattgccccaagattattgcctggggacagtctccagggtgaagtgcattggtatattgagaaaaaagccaaacacagcctggccttgccaaattgaaagacagaggttagggttcatggaggccaaggcagctagcatttgtgaggcagcatacaagggaagaggaacctgacctgcacagagagagagacgaggagagagctgcagctatctgcaaagagaaaccggagtactgagttgcaaatatgtgaaagaaaactacctaaggctaatgaaagaatcactaaaaagtagtaagagaaacaattcctgagctgatacagggctgctaatagtttattttcctaacacccaaagtggaatgtcttcataagagggactaaattagctccaaactacaagctactctaggttcaccccaacaaatcttgaaaacagccttaaaagaagtcaacttattccaaataaattaactgcatgccagaacaaagtccaatactatttaattacaacaaaatccagcactcaacaatgtaaaattcatgatgtttggcatcaaatcaaaaactaccaggtacataaacaagcagagcatataagccactaccaggaggaaaatcaatcaatggaaacagaaccccaaatggcaagaaaatcatgtcaagatatatcagaatcaaattattaaaaagacagataactggaaaattgtaaaagcaatcagaaaaaaactaacatggccaggcgcggtggctcatgcctgtaatcccagcactttgggaggccaaggcaggtggatcacgaggtcaggagttcaagaccagcctggccaatatggtgaaaccccatctctactaaaaatacaaaaattagctgggcatggtggtgcacacctgtagtcccagctgctcaggaggctgaggcaggagaatcacttgaacctgggaggcgatggtttcagtgagccgagatcataccactgcactccagcctaagcaacagagcgagagtctgtctcaaaaaaaaaaaaaaaaaaaaaagaaaagaaaagaaaacacaacaggtgcagaggaacaaagataaggaagaatagtttcttgtcagaccctatatgctatggtccaaatgttggtgtccccctaaaacttatatgctggaacctaatgcctaatgtgatagtatttagaggtggggcttttgggggagtgattaagtcatgagggctctaatctccatgaatgggattaacatccttacaaaagaggttgaggatgctgccttgccctttcctttacgtgaaggggcagcaaggaggtaccaccttggaagcagagagcaagccctcaccacacatcaaatctgctgatgcctggatcttggatttcctagtctccagcactgtgagcagtatatttttaatgcttaaaaactacctagtccctgttattttgttgtagcagcctgaatgcatcagtacactttgcaagccagaatacaatacagagatatgttaaagtattaggaaaaaacaacgcaagcaatcaaatgaacaaaacaaatactatcagtctataattctttaccaggcaaaaatgtcttccaaaactgaagaaaaaacaaagattgtttcagagaaatagaagttgaaagaatgtgtcacagactgatgtacacaagaagaaatgtagaaagttcttcaggcaaaagaaaaatgttaccagatggaaatttactcctacaaatagaaattaagtgtatcaaacaggtgaatagcaatgctttgtcactagtgctagctgtcacaagacctctagccagtcatgttttcagctgtagggcctaacaccatggttaaggaatggttacctaaatacacaaacttaaagtagaacttcaaatacttcctgtataaaattttccctctgaagttttaaaaagaaagactgggttgtaagaagagtataaaaaaggcttgcttctccagctctcatttctcatttcaaacttaaagaaagaaaaccagcaccaatttgaaagtgtttcaataaactctcaatgtaaaacttcacgttgttttctgtagcttttcagtaacttcttacactcatgttctatgtgcggctcagkggggaactatctgtatccagtggattgttggttctgacacactagcctacgtgcatatggggcaacccccaacatgctggcccctgccacttgcaatagatcagacccaccccttgtggttgagtgaggcagtattatgtcaattctaaacctggcattttgtttactgttgttgagtgttgttggtagtgggagaagaaaataggtcacagacagtgtgaagacacaaggagaagacagccatctacaagctaaggagagagggctgcaacagcttaattccttgtagtgttcataaagaaccaatcctgctgacagcttgatctcacatagcaaaataatacatgactttttttcctccttgatttccatgagaattgggtgaaagctattactcatataagcggatgacctgattctctcatttttgtggttacctttgattagtgttttggtctttatgcgtttcacagacctgattcaaatgctggatctctgctttattagctttgtgatcttggacatatcccttaatctagttgagccagattctcattatctgcaaaatgaggcttctagcacccctcagaattgtacaaagctctcgaaaatgtccttagcacacagaagctgtccgataaatgccaattgctttatgaatttctgtagttgtatgctgcagtaatttattttggagatcttccttatatcagtaaaagacgtttgttaaaaaacactttgtcacctgtctgacatagtatctggtggtagtaaggataagacatcattaaaaataaaaattgacaatcagagagagttaattttagcaagtacgtagattatatgcctttaatggcagctttgcagcaaagtgcaaaacataaataaatcagttaaccagatttgtgaaatacccgcagagtgttttagactttattttgaaggtgccaaattagagctaacatgcatcgcttcatgtcttcccaagaaaattacatgacaaatatctatctctgcttcactgacaacctggcagtgaaagggatttgaggtttgtgcccatcagtaactaattagagaagtaaatgttataactagtcagtattctgtggctacaatgtggcaagttaaaataatatccttaaggtgggcgctaacgcaatatgactggtatccttatgaaaaaaaaaaaaaaggacaatttggagataaacacaccgacagggtaaacaccatgtgaacatgatgatggccattcacaagcaaaggagagaggcctggaacagattcctcttagccctcaaagggaactaaccctgccgataccttgatttcagacttgtagcctctagaactgtgaaacaatacatttctgttgtataagccacccagtctatggtattttattatggcagccctagcaaaccaatacaaatcataaaacatcaattatttttaaaatctcataattttcattcttgttatatatatataaaacaaataaaaggtgactctctctaatgtataaagaagttaaagaaattgataacagaaaggccagcagtccaacagaaatgaatgagcagtttatagagaaggaaatttaaatggctcttaaatgtatgaaacggtactcaacccgactcatagtatgctaactacactgagaaatcattgtcttctaacatataggaaagtcaaccaaatgaataacacatgccattcctgtggcttcttcaggaacaaaggtcctcctaaattggtagtgtgaatatacattgatgcaatccaaaaaaaaaatccaaagttatagctgggcagggtggctcatgcctgtaatcccagcactttgggaggctgaggcagatggatcacgacgtcaggagatggagaccatcctggttaacatggtgaaaccccgtctctactaaaaaaaatacaaaaaattagctggacctagtggcacacgcctgtagtcccagctacttgagaggctgaggcaggagaatcgcttgaatccaggaggcagaggttgcagtgagcagagatcatgccactacactccagcctgggtgacagagcaagggattccatctcaaaaaaaaaagaaaaaagaaaaaaaaatccaaagttataaatgcacagtcttacatacttctcttctgggaatttattctgtaagtatatatatatatatayayayayacacacacacacacacacacacacacacacacgtgtgtgaaatgacatatatgcaaagtgattcattccagaaatgtttgtaattgtcaccacaaagctgccaatcactgagagactgattaaatgagttttggtacactcgtgccatcaaacactataaaattattaaaaaaggaaggaagatttttgtataataatatggaatgatccaaggtgtattttaaataaattaaacttaggaggccaggtgcactggctcacgcctgtaatcccaacacttttggtggttgagacaggcagatcactggagaccaggagttcaagaccagcctggccaacatggtgaaaccccactctactaaaaatacaaaaattagcgggtgtggtggtgtgtgcatgtagtccccactaccagggaggctgaggcatgagaatcacctgaactccggaggcggagattgcagtgagctgaaattgtgccactgcactccagcctgggtgacagactgagactccatctcaaaaaaaaaagaaaggaaaagaaaaaaaggaagggaagggaagggaaaggaaaggaaaggaggaaggaagggagggagggagggaggaaggaaggaaggaaggaaggaaggaaggaaggaaggaaggaaggaaggaaggaaggaaattaaacctaggaacaaagtagtttatctatctaatctatatgtatgactactatttgtcttttaaagtggagaaacgaatatgtccttgtaattataaggtgacttagctatttagagtcacatctagcatttgcatcaaggtgagtttgtctcaaaagctctgttctagtgccccactcaagaacagatattgtcaaatttgtaaaagatattttaactrgaatagacttgatttttattgctgatttaatctattacaaactattgcttttctattctaagctgttgtaaaaattattgctttaatatgatcacttaataagcattaaatgccccaatcctatctgctaaaaattgtttggcatgtttaattgatcacaaggatttgaatagcactcttatcttttcaagtatcttcaagaaattcttattttcagcagggcatgttgaggaaacataaagcttacattttttattcctgatgtcttctcatcacttccaacagtagccactgagtcaaagcagttgctctctttccttactttttctaaagctctccctctatattagctgtgtctgagattgcaggcagttaaaatccaacatttggcacactgaaaaaggggctatgtgatagggcctccaactgaaatgtgatgaattattaaacaggtagtttgttgggtgattgaaaattacctgtgaaagagtgcttatctccttgaggcacatcgaaagctgacggaattgagccaattagactgactgtctcttcaatgagttgtgacctatcaatggtaatagcttattatgatgataaatgaacccatctctcaaactgaagcctgagtacacacttcagcagttgccttgaatcatgaggccattgcctctcaacttcagatcgacagcagtgacagccacaggagcagagagcatgcatgactagacacagatgattgttttactcagatgaatatatttacagctatttccaaagaaacgggcccttcttttgcattgtgtattcgtatctgaaatagttaccatatgacgtttccttcattaggaagagaacccctccctggctgtagcattctgaaataactggattttgaaggtcttttttttttcttcactttttgtttattgtttacaatgttttaatttctcattcttgtgagtaataactcaactcctggttaagtaaaatttcagaataaaaatattgttttatagtaaagatgcttgtaatatcaaaacaagtatgtttttaaaaaattaatttcatcctattacatttcacattttatatttgatgtgggttrgaggagccccttagagattcttttttctttgtagagaagttttgtagagatcaatagtgtaagaatcatacaagtgtaaatagttttgtttccttttaatttttcaaaatatttgaaaattctttaagtagttactgaaatttggtaagttccatgtgctgctatattgatacattttgttttagaagaattaggagcaaaagggttatttttataatgaaatacaatcttccagttcctaataagtattagacacctgttagctgccaacttcccaaaaatacccctgagaaaaaaaaaaacctgttggtcaagaaagttcacgaagttattacagtaaacaagaacatcaccttgatattcttagtaatgtctcagaaggtgagggtcaggggaagatatttacaggctttagggaaaaggctggttgatttcaaggcaaatcttgagtgagagggaactggttgggattctgcagggtttattatataatagttttggatttgtcaccagagtgaacaaacattgaagaacatgttatgagtctataaggaagttagcttagatggatcacagagcagacaaggttttcttggagattgctcacagcattcttaaaatagggggtggacatttttcttactcccagcattatttagcacaggaaaggaaattgtgttagcgttagaagaaattgtgtttgctttagttcttacagacaatatatttacttaatcttctgtgacactgtttcttaatgtataaaatgaaaataatatgaatacctactttatagtgttattttgagggttaaatgagttaacacatatgcagtactcaagatggtgtctgaaaatgataagcatttggtattagctattattattaactccaactgggcttaatttgaggtcaggcattattttgttgaaattttagaaagactcccctcacacataaacagacagaaagagagagaggaagaaagaagaaaagagagagatagagagaggcagaaagagaaaaagaaagaaagagagaaagaaaaggaagagaaagaaagaaagagaaagaaagagaaagaaaggaggaaggaaagaagagagggagaaagaatggaagaaagaaagaaagaagaaagaaagaaggaaggaagagagggagaaagaaagagaaagagaaggaaagaaagaaaaaggaaggaaggaaggaaaagggagggagggagggaaggaaggagggagggaggaaggaaggaagaggaagcagggagggcaaggaaaggaaaacaatggaaagaataaagaaataaatgcagcaggaaaggaaaaagaataggaagaatttgctcatatctgtctaatttttagggtattttgatatacaaagtaactgactgtcaggacctgtcttagagatgatctggtaggacagtaaatggcttttctttccagttttcatctgggactgggtttgaagtgatcatcagcctcagtgttctggaaataagtcatttataatgaaatggaactggaaataacccacagacaaaaagctttgcaagccattgaagttcccctaggccatttactgccttaagctcgtttttactcatactgcaggaaaaaaaagagtgagtagggaggtggtgttcttatatcacataattttaaattaagatgtgatggttttatataaaagcaaaaatgctttattttgctttttttgttcaagacaagtacagggatgaaatgtaaatatgttaatatctaatcttaagtctgctcttgatccgaaactcttttgaaactttacctagaaaatgatagagcaatttaatgtgtctcacaatctagcagagatttggagggtgatggatagaataagggcttaacacaagaaataatttctgttgtacaaagctcatgagcttcatgcatggtgaaagatatttaggctaaagaaaatgttaactatgcagggaatgaaactcgtgacagcttgatcccataaaactcagcaaggatgaggtttgactctgcatccctgatttatatagtacagtatgtttatttaaaggagataagccaggttaaggggttcagcaaaactgttaaattaactcctttaaaaatctagttattgctatgaaagtctctcaagtgcggtgctcaggcttttttgcatcagtcatctggagtctttatttaaaatgtttattattggccgggcgcggtggctcacgcctgtaatcccagcactttgggaggctgaggcgggcggataacgaggtcaggagatcgagaccatcctggctaacacgatgaaatcccatctctactaaatatacataaaaattagccaggcagggtagcgggcacctgtaatcccagctactcgggaggctgaggcaggagaatgacgtgaagccgggaggtggagcttgcagtgagccgtgatcgcgccactgcactccagcccgggcgacagagcgagactccatctcaaaaaaaaaaaaaaaaaaaaaatttttactattgacccttactctggattcacttatccagaagatctggggaaatctacgtttttaatcagctccccaagtgattatttacccataagaatttggggggcactcttttatgactacttttttaaattactgatgattaattatctgcagatagttccctagactttgactttccaaggctttaaaaaaacaaacaaacaaaaaaacctgcagtatgcttttagtctgaattcagggattgactttcttatccaatagtctatcctgtacaagggaaccctaaaataacctcgttagccaccaccaaagactatgtaaatacaaatttatttatcaatctcattagaaaccgaaccacgcatgtgcacgcacacacacacacacacaccacaccaaccacacatttacattggaataaaatgaatcttagaaagcagctatttttaaagaaacaggaagtctaacatgtactgccattaatttggaatgggagagaaaggagacttggcagaaccagaatattgcgtgaggattgaagatagcttcagattctagaagagtttctagctctttctgaatatgtgttaacagtttcgctgtttgagctctgctacccactagccagttataaacacaggtaagacccttaacttcacagggcctgttgggaagaggttataattttttagcaacagaacctgtttttcaaacaaaatcctaattagaacacccaaaaacaaacaaaataaaggattcaaatgggtgacatggccagtcctggttacagtatgagacagatgccggttacggtgggcaacagaacwgatgctggctacagtggtcgacagagttcattttagttcaagcagaaggtagggctggtgcttgttacagtggccagtaggcctggtttctggttatagcacatggcagagttaggagctctacctacattatgtccccacggcctcrtctgtggtttccccataagaaaactaccttttgggaaaacatgatacaaacagatcaggtgaattagaaggtctcctgcagatttaaaattttatgaatataatgccaaatataatcttacactcagttgactactaataataaataaccctacaaaatatggtaaagtgactccatgacaacaattgaaaagaaaataattgcactcagctgagctattgtccatatctagatgcactgatgatacacaaacccagccacagaaaatgtggcatgtgtcagagcaaagcaactagaatgattcaagacactgaacagccagtgttcaagctacgtaatttcttacctatattacaggaaaaaaccatctaactctttttctacctccaacctccctcctctgaaatgttattcacatacctggtggagaagaatctttataaaactcaaatttgattaccttagtcctctgcttaaaatttcagtgtctttcaatgaaagctcagagaccattctggacttataactcccttgcagctcagaagggacccgtggtccagtaattaaaatgcccgtggtaagtgttcaatgctctctcatgcttttcttctcacaatgtcccttcagtacgggatttctttctaccattttcctgagtaattaccttctagtcatcattcaaaaagcatttaagcattgaattctataggaaatrtttctaatcaccctatcccccagctctggctgagttaggccttctctgcacaattcccatgaaagcacctaccacccagcaggcagaaatatcsctctttgactttctcactaaactgcaaattcctggtgagtgacaactggattctattcttcttctaacctctagaacctagcagattgctttggagaccttaggaacttaataattctttgttgagtgaataaagggatgctttttgtggacagcagttatttctgtttacacaaaagataagagaaaatacaggtaaaattatcctaaattttaaaaaatttgaaacttacaaaaagtgttggatttaagttcctttgtctgtctggatttccgaaatatttttaaaagattttttctgggatcatttaaggcctcatctgttcagaaccaaggggaggaccgaaatagtatgccaaattcttktccagccctcaaattttatgagcctgagttgcattgtgtgggtaaaagtcttgtgctctgtggatcagraggaagttagatgttttggatatttacatagaaacaaagaatttgaagactggaaagaacttgagcaggactctattaaatgtgttttgtgtgagatggttttcaccctgtgttcttgtggttcctccatgctaggggcaggaggtaggatggagcagatagggagtctcttttcctcttaaaccggatgttttttttaaaatcagttttatatgttgagagtccrtggaatggaatgtggaaactgagaccctgaaagattaagtcacttgaacaaagatatacagcttctccagagaccaggcagacactaggtttatgatttcctgacttccactgcagatctcttaccatttttctatgagagwcataaaaaaagaatcagctatttactttctagtcaaggtgggttaaaatcaagccacttgttttcaaacatcgatttcgggttcatgccatcaaattaaaaaattcrcttaactgagtttaatttgctttcacttaggaagcagctgcctttcaakataataaaataaacagatacaataatatttggtcagctgtggcttttaatttaaatgtttgatttaatgttgtttagtttgctggattccaaaatattctctgcaagagaagcatacacattctaaagcatttcaaatgtttattatgatgtcctagaggtggctgtctttctgttgctgtgcataccctgagcagacttgacwttgctttggaagcacatattttctgatagacatattactctcataatctaaaatttttcagaagtgacaaaagtggggttgaccattttcttcttcgctgtctccatgattttgctttttccaagatgtcatgtagttagaatcatacaatgtgttgtcttttcaggytggcttttttcacttagcaatatgcctgtaaggttccgccatgtcttttcttgccttgataattcatttctttttagctctgaatactattttgttgtctggatataaccacagttgaattatccatttacctcctgaaaaacatcctgcttgctaccatgttctggcaatatgaatcaagctgctataaacrcttatgtgataartcttgtgtggatataaatattcaacttatttgggtaaataccaaagagtgcaattactggatcatatggtcagagcatgctagttttgtaataaactgccaaactatcttccaatatggttgtataattttgcattctcaccagcaatgaacaagagttcctgtttctccacattctcaccagcatttcatattgtcaatgttttagacatcagctattctaatagrtatgtagtggtatatcgttgttttaatttgaaattctctaatgatgtaagatgatgagcatgttttcatgtgcttattttccatctgtatataagctttgctgaggtatctgtttagattttttccaatttttaaatttattttcttgttgttgagatttaagagttctttgtatgttttggaccatatcaggtatatcttttgcaaatattttcttgcaaatggtagtttctcttattctcttcacagtgtctttcacagagaagatgatttttaattttaataaaatctaaaatgaatttttatttcatggatcttgactttagtgttatatataaagagttactgcaaactcagggttatttagattttcttctatgttatcttccaagagtcatagttttgcattttatatgatccattttgaggtctatgatccattttgtgttaatttttgtgagggtctatatctgcatttatgtattttttcacaagttatctcagtcaattttctgttgctataacagaatacctgagactaggtaatttataaaggagagagttctatttagcttgtgatcctgggagcttgactaggagatccaagttaggacaggtgcatttggtcaagttctggtgagagtcttgtgctgcatcttaacatggtggagaagtggaagaaaaagtgggcatgtgcaaaatgaccaaacacaagagggagccttcctttttaacaacccaccctcgaggtagctaatccagtcctacaagagcaagaactcactctaagaaaggtattaattcctttttaaaaacctaatcacctctccaaggcaccacctctcaacatcaccccattaggaaccaaacctcactatggattttgattgtgacaaaccatattctaaccataacacaaatgatgtccagtttttctagtgccatttgttgaaaacactttcctttcttcattgaattccctttgctcctttgtgaaagatcagatggccatattcatgcgggtgtatttctgggctggctattctgttccattgatctaagtgacttttttctsaccagtactatattgtcttgataactatagttttatactaagtcttgaagttgggtagtgttagctttacaagtttgttcaatattatttaatgatgtgttggctgttcttggtctttcctctccatataaattttagaatcagtgtgttgatatccaaaaaataacttgctgggattttgactgggattaccttgaatctacacaaattgggaagaactgacatcctaccttgagtcttcctatttatggacatggaatacctctccatttatttaatttttctttgatttctttcactggagttttatagttttcctcatatagattttgtacataatttgttagatttatattgaagtgttttgtggagcatgctagtataaatggtcttgtgtttttaacttcacattccaattttctttgctaatatataggaaagcaattgacttttataccacctttttcttcagacagatggaatcaagtgacttagaaattggctttgttgctctgcctgagtatcttgaaaattctcatcttccttctgagaaccataacctacatatctcaaggttatagataaaatgctacctacaaaatccttgtaatgcttacagtctaaaagactaaataaggcctcaagagattattcaaaatcagagttgttgattcccagtagagtcataaagggctatgttatgttagctgcaattctaatcctatatcaaagcttctgacttccactcccccatatctaaggaggtttccctcaacagttgaaaaataactgcagatactgctttgccatcccatgccacaaaaatgcatttctgaaggatgctgcagagagatatatatttcttaagcccagctcatatctatttctcaaggctgtgtgatatcatagaatgaatgatggagtcaaataaataaatatttatttatttatttatcagtcaaataaatctgatttaattttttagaacttaacatttagtagctgtgagatcttacagagatttcttcaccttgtatcctttgtcactttatctataaaatggagagtgtaaatactacttcttagagttatcatgattctttaatctaataactcatgagacactggatatgtaataggaactgaataattcttaacccccttgctttcccttgacatttccagaaaataaaacttgattgagtatctaagattatataacagatcccactagactaagtgaatctgagggaagatgtatttgtcacttttcttctcttctttggtttttaaaaagtatcattagaaatagaatcagtaactataaacaaatttctgtgtactgatccagtattaacagagaaaataatggttgactgtgccttactgtgcaaggcaaaaatgagctcaagatattatcaaagtcatgaatcagaaagagaatttcgttttacaaatgatggatagccacaaaacaactaggacatacaatctctgattacacaactgcagtctatagctacattctgcagattaaacaccacagtagagatggaaactttattgtttatattttatgaaaactgttctcttttgtttttatgtcagtttgagagtagaagaatatccttgagggcaaaacatgcctttcatacattagagctgcctagagcatagtctggcacattatataaatattaaataattcctataattaaactgatgttctttggaatgaggatggagacacatagttatctgaattgccttaagctagttttgcaataagtagatttttactattctagaatatgtaatgaatgaatcatgctatgttacaagtaagtattaattaatggttgaagtacaaaaacatcttccttgaattatatgataatctacatcacagtgaaaggaatttatcatgacaaatgctagtcaatgttgaatcacagagggctatatgagatccattttcattcttaaagaaaattattatatctttttattaatatggtgratattwactcagtaaataataaagaaaactaatatgaagtrcaatttgtaatattctayttatgatgcatgatttttgttgcacaattagaaaatacttaagttcttgagaatagttggaaagggttgtaatgatcagaaacacatattatacctaaacatgtattaagaccttgttttaaaaattagatcttggagcaagaaggtaagctgtatcattacgttcttagaatacagggttgggcgtgggggctcatgcctgtaatcccagcattttgggaggctgaggcgggtggatcacgaggtcaggagatcaagaccatcctggccaacatgacgaaaccctgtctgtactaaaaatacaaaaattacctgggtatggtggcgtgtgcctgtaatcccagctacttgggaggctgaggcaggagaatcgcttgaacccaggaggcggaggttgcagtgagctgagatcgtgcctctgcactccagcctggtgacagagcgagactccatctcaaaaaaawaawwaataataataataagggtaaatacaaggagtgtgttttgaatacaaaatatctatttttagaatctcaaacccatgagttactttcttccatatataagtcccaacatgttttctataatcagtctatgtctattagatgtgtaattatattaattatgtaaatgcacrtgaataccaaattatttggttaatcttcgaatttcttttagcaattatatactctcctccaggttagattgagctttcccttcaactcagagaaatcagtgtcaacaggctaccttctgtaagactaccagagagctatgcattactctgtacaaaggatatttctcctataaatagtgctttcaatagagaaaatctgttatcatgttgtcagtaaattcaaatattttctcttttggaatactctgttcctattaaaacaagagctgtttccttctttgaaacaagttatttatatttatgtggttaagatatcctatcttaaaccataagacctttttgaatacttcacatacagaaaaatgaaaaaaattaaacaaatatcagagttgctgggaaccccaggatataatctactgtggatagtcattcatagacaaagacacctcctatttataggcttgggacagttcagcttctccaacttgaagagagttttgaagatcaaatacaaatgggtcttgtgaagtttcaaaaaatgtttctcaaagtcctttgagaaaaataaacttgggcctgtagccaatagtttgtattccaggcttttaaaaaaaattcaaatacagaaacatcagattttcattgccataggggtcatgacatmttttaacataagtgcagaaactatctgtaatgaatcaaaacttaaatcagatgacattaagaccagctttgctattaccacagatggcatcacaattaacttttaatatatcaaaaatgtgagtgtactcatatattatcagtcatttgatcatgatattccaacattaacatctcagtgtattgtgaaaatgattcatttgtacaatatttttcttcttctagacttttaatttcttgaaggaaggaacgcattttactcatcttgtagtgaccctccctgtacatgttgcctgagacataataactattcaaaaatgtttacagtattcaatgaaattatataaatcttggtttaaaaagcttgatatacaatgaaacatacttgggcaaattataaagctgttcctgagaatgagctaatacatatttagttgttaaaattctgaggggaaaatgtaaattagatgtgaactacctctacaatataagatagcagtaggctgtaagttaaaataatcatttttctcatttttcagtaacattcattaaatgcctgatacaattctgtactttctgaaaattgactataataaagaaatcctggccattataaaattgtcatccactcataggtagaataaatgagagaattatggtgatctaaatatagaaagcatttaaattagagaacagctgaaattgtgcttctaaaacatttcagtgttgytcattttctatatgttayattgaaaaaagtaatatggaaatgtaatgttttcatttgcagatgcttaaatttagatacatgtttaatactgtaatcattttgatcaaacagcagctatyatttattattcaatatttatatgtaaaacctgaaactttcatctaccttaatgatggtattgtgataaaagtacccatgtatcaccaagmtttgccaattctttttattccttaaagaatatcygacaatttgctggtttgtataagtttgagttaagacaccgtaataatgtcctgcagtatatatgtcaaaatacatgggtcaaaaagacactctaaaatagcagtctccaagaacccaggaagtatgtgatccataggagtgtacatattttattttctttaaaaaataagacagacacttctcaaaagaagacatttatrcagccaaaaaacacatgaaaaaatgctcaccatcactggccatcagagaaatgcaaatcaaaaccacaatgagataccatctcacaccarttagaatggcagtcattaaaaagtcaggaaacaacagatgctggagaggatgtggagaaataggaacacttttacactgttggtgggactgtaaactagttyaaccattgtggaagtcagtgtggtgattcctcagggatctagaacttgaaataccatttgacccagccatcccattactgggtatgtacccaaaggactataaatcatgctgctataaagacacatgcacacgtatgtttattgtggcactattcacaatagcaaagacttggaaccaacccaaatgtccaacaatgatagactggattaagaamatgtggcacatatacaccatggaatactatgcagccataaaaaatgatgagttcatgtcctttgtagggacatggatgaaattggaaatcatcattctcagtaaactatcacaaggacaaaaaamcaaacaccrcatgttctcactcataggtgggaattgaacaatgagaacacatggacacaggaaggggaacatcacactctggggactgttgtggggtgggggggaggggggagagatagcattaggagatgctaaatgacgagttaatgggtgcagcacaccagcatggcacatgtatacatatgtaactaactggcacatggtgcacatgtaccctaaaacttaaagtataataataataaaataaaaataaaataaaataagaccattaaaaaaaagttcatcgtatggattgacactgggctgctccctggtggagtaccagctcaagatgttttgaggaaaaaatttgcatttaccaagtgggaggatttatagtggtgatttcacttgttcattgatttagacatatgaaatattatattttttgcacaactaagttggctttcagattatatgaccatatttttaactaaatgaagctttgctgaataaatacatgacttaatatattccttcaaaaaacatatagtgaaataatattaactacacaaagataagcaatgagcaaaaaaacactagtgcttaccactgctcttggtaagagctttccttcaggcacaaaatgagataaaagtaatgacaaggtaaaactggatgaaaattggtcaacaagtgaggaattaactgccttgcaaaagcagtttttattatacrgaaaccattttgaaagcagttattcagaaagtttctatcagtatatgatttgtagctcaaattattgttggtctatcaatcacaaatactattttctgcataatatagctagaaaatataattatctaacttatttttaaagtcttctaaacatgaagtttcagtgagctttgaagctttttgttaaatatgttaaaatgtcatactttccaaatagtttccaattataaccaattagcatcagaaaatttattagccaaatttcaccaagaacctaatttgtgagagaattgaaaaatgagtaccataatttagtatgctcagccactgatgtaatgcttataatgggacctgtgtattttttgtctgtgctgtatctcttttcagctgtgaaaactattattactaagtattaaaacaaactgagggcaaggcacggtggctcatgcccgtattcccagcactgtgggaggccgaggmgggtggatcacttcagatcaggagttcaagaccagccttgccaacgcggtgaaaccctgtctctactaaaaatacaaaaattagccgggcatggtggcacatgcctgtaatcccagctactcgtgaggctgaggcaggagaatcgcttgaacctgggagacaagaggttgcagtgagccaagatcrcaccactgcactccagcctgggagacagagcaagactccatctcaaaaaaaaaaaataaaaattaaaaaaaaagcctgaacctagaaacggacctacaaatgtcaatacttagtaatatttttaattattaagccaagatttccaaaaataagaaaagcataattgattatactggtttctttttttttttttttcatttggaacatataattgagaaagctttagtatcaagcatatgtaaagactcataaaataataaggaaaggccaaactgcctgatagaccaaaaaaaaaaaaatcaacaataaacattttacagaggagaaacagagaaacatatacagctaaaaacatatggaaggatcttgagtcttatagcaatattgatgagcaaatcaatatgtagaatagcaaatcagtatcattatcaaagagataatggatatctctttatactcaatttattggcaataattaagaatttaaactacagaaatattgaaaagtatttgaatcaaccagatttcttatatagtgctaatataaattggttaaccacttgacattatcttttaaagtttaatattcacacaccctatgacccaacaattttctagatgtatatactaaaggaaattattacatttgtgcacccagataaacacataaaagtgttcataaaagtactgtttatattaagaagagccgacagcagatgcctatccagaggtaaacaaattgtaatatatctggaataacttgttgcaatgaaaataaatgaactacaggtatacgtgataatatgatgcttagtgataggttctcagatgatcacagcatgatggtctttataagcaataacatttttgagcaaacatatatttgctgaaattatctttttaaaaatgtaagaaaataatataaacacaaaattcagcatgtcagggttatgctgcagggtaacggggtggtgaggattgtatagatagttgcaaacattgctcatgttcaacttcttgggttgggtagttggcttttatcactaacaaagtaataagccagggaatacaatgggtaaatgaaaaaataaaatagagtcacgattagaccaatgatgatagtatatcataaatcaagtcttctcatctttaaaatggaattagtaggagtacttagcttcctagggttgttatgaaggttgaaattcttagaataatgcctggtacatagcatttttttttttaagttaagttctagggtacatgtgcacaatgtgcaggtttgttatgtatgtgtacatgtgccatgttggtgtgctgcatccattaactcgttatttacgttaggtatatctcctaatgctatccctcccccctccccccaccctacgacaggccccggtgtgtgatgttccccttcctgtgtccaagtgttttcattgttcagttcccacctatgagtgagaatatgcgatgtttagtttgttgtccttgtgatagtttgctgagaatgatggtttctagcttcatccatgtccctacaaaggacgtgaactcatccttttttatggctgcatagtattccatggtgtatacatgccacattttcttaatccagtctatcattgatggacatttgggttggttccaagtctttgctattatgaatagtgccgcaataaacatacatgtgcatgtgtctttatagcagcatgatttataatcctttgggtatatacccagtaatgggatgactgggtcaaatggtatttctagttctagatccttgaggaatcgccccactgtcttccacaatggttgaactagtttacaatcccaccaacagtgtaaaagtgttcctatttctccacatcctctccagcacctgttgtttccagactttttaatgatcaccagtctaactggtgtaggatggtatctcattgtggttttgatttgcatttctctgatggccagtgatgatgagcattttttcatgtgtctgctggctgcatcagtgtcttcttttgagaagtgtctgttcatatcctttgcccaattttgatggggttatttgtttttttcttgtaagtttgtttgagttctttgtagattctggatattagccctttgtcagatgagtagattgcaaaaatcttctcccattctgtaggttgccwgttcactctgatggtagtttcttttgctgtgcagaagctctttagtttaattagatcccatttgtcaactttggcttttgttgcccttgcttttcgtgttttagacaaaaagtccttacccatgcctatgtcctcaatggtattgcctaggttttcttctagggtttttatggttttatgtctaacatttaagtctttaatccatcttgaattaatttttgtataaggtgtaaggaagggatccagtttcagctttctacatatggctagccagttttcccagcaccatttattaaatagggaatccattccccattgcttgtttttgtcaggtttgtcaaagatcagatggttgtagatgtgtggtattatttctgagggctctwttctgttccattgatctayatctctcttttggtaccagtaccatgctgttttggttactgtagccttgtagtatagtttgaagtcaggtagcatgatgcctccagctttgttcttttggcttaggattgacttgggaatgtgggctcttttttggttccatatgaactttaaagtagttttttttccaattctgtgaagaaagtcactggtagcttgatagggatggcattgaatctatgaattaccttgggcagtatggccattttcacgatattgattcttcctatccataagcatggaatgttcttccatttgtttgtgtcctcttttattttgttgagcagtaatttgcagttctccttgaagaggtccttcacatcccttgtaagttggattcctaggtattttattctctttgaagcaattgtgaataggagttcactcatgatttggctctctgattgtctgttgttagtgtataagaatgcttgtgatttttctacattgattttgtatcctgagactttggtgaagttgcttatcagctttaggagattttgggctgagacaatggggttttctaaatatacaattatgtcatctgcaaacagggacaatttgactacctcttttcctaattaaatacccttcattactttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaatttattgagagtttttggcatgaagggctgttgaattttgtcaaaggccttttctgcatttattgagataatcatgtggtttttgtttatatgctggattacgtttattgatttgtgtatgttgaaccagccttgcatcccrkggatgaagcccacttgatcgtggtggataagctttttgatgtgctgctgcattcagtttgccattattttattgaggatttttgcattgatgttcatcagggatattagtcaaaaattctcttttttgttgtgtctctgccaggcttttgtatcaggaggatgctggcctcatcaaatgagttagagaggattccctctttttctattgattggaatagtttcagaaggaatggtaccacctcctccttgtacctctggtagaattcggctgtgaatccatctggtcctggactttttttggttggtaggctattaattattgcctcaatttcagagcctgttattggtctattcagagattcaacttcttccttgtttagtattgggagggtgtatgtgtccaggaatctatccatttcttcaagattttctagttwatttgcatagaggtgtttatagtattctctgatggtagtttgtatttctgtgggatcggtggtgatatcccctttatcattttttattgcatctatttsattcttctctcttttcttctttattagtcttgctagcagtctatcaattttgttgatcttttcaaaaaatcatctcctggattcactgatttgttgaagggttttttgtgactctatctccttcagttctgctctgatcttagttatttcttgccttctgctagcttttgartgtgtttgctcttgcttctctagttcttttaattgtgatgttagggtgtcaattttggatctttcctgctttctcttgtgggcatttagtgctataaatttccctctacacactgctttaaatgtgtcccagagattctggtatgttgtatctttgttctcattagtttcaaagaacatctttattccagmcttcatttcgttatatacccagtagtcattcaggaacaggttgttcagtttccatgtagttgagccgttttcagtgagtttcttaatcctgagttctagtttgattgcactgtggtctgagagacagtttgttataatttctgatcttttacatttgctgaggagtgctttacttccaactatgtggtcaattttggaataagtgtgatgtggtgctgagcagaatgtatattctgttgatttggggtggagagttctgcaaatgtctattaggtccacttggtgcagagctgagttcaattcctggatatccttgttacctttctgtctcgttgatctgtctaatgttgacagtggggtgttaaagtctcccattattattgtgtgggagtctaagtctctttgtaggtctctaaggacttgctttatgaatctgagtgctcctgtattgggtgcatatatatttaggatagttagctcttcttgttgaattgatccctttaccattatgtaatggccttctttgtctcttttgatctttgttggtttaatgtctgttttatcagagactaggtttgcaacccctgcctttttttgttttctatttscttggtagatcttcctccatccctttattttgagcctgtgtgtgtctctgcacatgagatgggtctcttgaatacagcacactgatgggtcttgagtctttatccaatttgccagtctgtgtcttttaattrgagcatttagcccatttacrtttaaggttaatattatgtgtgaatrtgatcctgtcatkatgatgttagctggttattttgctcgttagttgtttcagtttcttcctagcatcgatggtctttacaatttggcatgtttttgcagtggctggtactggttgttcctttccatgtttagcrcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttcyggcttgtagagtttctgccgagcgatctgctgttagtctgatgggcttccctttgagggtaamccgacctttctctctggctgcccttaacattttttccttcatttcaactttggtgaatctgacaattatgtgtcttgaagttgctcttctcgaggagtatctttgtggcattctctgtgtttcctgaatttgaatgttggcctgccttgctaggttggggaagttctcctggataatatcctgcagaatgttttccaacttggttccattctccccgccactttcatgtacccaatcaggcatagatttggtcttttcacatagtcccatatttcttggaggctttgttcgtttccttttactcttttttctctaaacttctcttctcacttcatttcattcatttgatcttcaatcactgataccctttcttccagttgatcgaatcagctcctgaggcttgtgcatttgtcaggtacttctcgtgccatagttttcagctccatcargtcatttaaggacttctctacactggttattctaggtagccatttgtcctatcttttttcaaggtttttagcttctttgtgatgggttcgaacttcctcctttagctcagagaagtttgatcgtctgaagccttcttctctcaactcctcaaagtcattctccatccagctttgttccattgctggcaaggarcttcattcctttggaggaggagaggcgctctgatttttagagttttcagcttctctgctctgttttttccccatctttgtggttttatctacctttggtctttgatgatgatgtacggatggggttttggtgtgggtgtcctttctatttgttagttttccttcttacagtcaggaccctcagctgcaggtctgttggagtttgctggaggtccactccagaccctgtttgcctgggtatcagcagcggaggctgcagaacagcagatattgctgaacagcaaatgttgccgcctgatcgttcctctggaagcttcrtctcagaggggtactcggccgtgtgggatgtcagtctgcccctactgggtggtgcctcacagttaggctattcagggctcagggatccacttgaggaggcagtctgttcattctcagatctcaaactccatgctgggagaaccactactctcttcaaagctgtcagacagggacatttaagtctgcagaggtttctgctgtcttttgttcggctatgtcctactcccagaggtggagtctacagaggcaggcaggcatccttgagctgcagtgggcttcacccagttcaagcttcccagccacagtttgtttgcctactcaagcctcggcaatggcgggcgcccctctcccaaccttgctgccaccttgcagttcagtctcagactgctgggctagcaatgaacaaggctccgtaggcatgggaccctccgagccaggtgtgggatataatctccyggtgtgccgtttgctaagaccattggaaaagcgtggtattagggtgggagtgacscgattttccaggtgccgtctgtcacagcttcccttggctaggaaagggaatttcctgaccccttgtgcttcccgggtgaggtgatgcctcgccctgctttggctgacacttgatgggctgcaaccactgtcctgcacccactgtcagacaagccccagtgaggtgamcctggtacctcaattggaaatgtggaartcacccatattctgtgtcgctcatgctgggagctgtagactggagctgttcctattcsaattatactggtttctaaaaaagattgtaatatattgttgagagtgaagggagttttatatcaataattaaattattttaaaatattgtttatttcatttctcatacttcaaattacttatttacattttaataatatattagtatcataacacatgtgtataatacagctagaaagagagagcatatataccctgaaggcatttttaattataatattgtaaaaccaaactctaaagactcctgttctaggtaattgattagtccagtaaatgtaggcataagaaaaatgtatgaaatagatgacgttaatctttcatgcacaataacacctttctccagctgtggctctaactgtcctgatggattctttactgctctcagctaatccattatatggttttagacatccaggatagacactgaaaggaataactattacaaaagtaattttaagrggagcatttgattgactgatgctcctcttatgtattcattgtgtgtatgtattgaatttgtgtattcattgtatgtattcaatattcaatgtatgtattcattgatcctgcatatacttgatgatttgattggtggtttgattccagttatattaacttgccagaaactttctagtttccaaacagtgaatacaacttagacctcatgamgcttacattctagttagaagagagaatattaattagataagcacataaaatatacatgtgttagatagtgataaatgacaagaaaaaaagtagagcatggagggcctaggaaggatgatagtggttgaatagactttaattttatatagaatattaggtcagagatctgaaggtgactaggaaaaarttatgtgggtatctggagcaagagcatcttaggacaaagagaaagtaagtgaaaaggccctaagatatgaatgtggctggcatgttcaaagaccctcaaggatggggtaagagtggggaagagttgaaggatatggggaaggggaaaatatcgtaggyctttggcacactgtagttaatgtcttcacatttttcttgcaatgcaatgagaaacacagacatgtaatgatctgagttatgttttaatagggttagtatgattgttactttgagagttggttgaatgaggacaaacagatagaccagttaagagacttggcattcatccagtcattagctgtgaagtctggaccacagtgataatggtgaaaatgatcaagtgtggtttgattccagatacattttgaaggtaatgctgaaaagatatgctaatagtttggctgtggaacatgaaagaaagaggagttgaggattatttcccaactatggacctgagcaactaaaagacttgtcattgatttagatggggaagactgtggtaaaaacaaattttttacrggagatcatgaactcagcttagctaattatataaagttagagatgcctattatatatcgaggtgtaaatgttaaagtgatagctagtatacaagtctgaagttcattkggtcaggaacatctgaactgaagatgtaaaatgtttgaatcatcaatccatatgtcatttaaaccagaagactagatgtgataaccaagaaaatgaataacgagacaaartatgagatctaaggattgggccctatagcaccccaacatttagaggttaggaaactgaggacgaactagaaaggagactaagaatcagtgaccaaaaaagtagaaggaaaaccacagaagtcatgtattgaaagtcatttgaatgaatcaagtgatcaactttgtcagatactgttgatgggccaaataaggtaagaaatgagaattgaccattggatatagcaatgcattcgaccaatgaccttgagaagagtatttcagtggaatgaagggcaacatggaaactagagtggatttaagagagaataagaagaaagaatatggagatagcaagtgtagacttgtctttttctagaaagaaaataagggcatagatacttttatgggatgtggaatggtgctgggacatgtggaagtctcttctattggtctgtatattcttagaaaatagaaaataattgagtatgagaacatgggaggaaaatgctgaagattcaaggagaaaagagaaagtatgaaaaagtatccaggaacatagcaaagaacatggaccagacagcattagggatctatgtgagtttagtaatcatgaatttgaagcaaggtcagtcaacaggtactatgagtttcttcagatgtatccagctcagcagttgcaggtacagagaagatagaggttagatttaactgacgttgtggttaagccaagtgaatacagtaaaactagagattaaaataattgaccatggaatctaagacagtgatgagaaaccctcaagctacagcgatttcccattgtctccctaaatgctattrgtactgtagccaagacaagtctttcttttataggactatacaaggccttagaggatatttagtatccttggcctaaaggataaaggtaaagtggtacagtacacatttagtgtgctgtacactaaatatcagtagcactttgccacaaattaaaggaacagtatataatccttgacagtgctttaactccattgcatttccttcttttttagaatggaatttttttctatatgttccccaaagcaaggctagtttatataacattaaattacttatgcaaatgcaaaaattaatctgaacatctatttattatatctagcacaaaacatagaaacaaagaaggcataggttattattttgaaattatgctttactgaacacataggaattgctaccaatcgtttaaatagttgccttatttcttagacaaatagtaactgaaatgtatggagcattcatgcatatatttggaatgtattaagtgttcatgtgtatacctggcgcagagttaattgttttgcctgcattatctgatttgattttcccacagtgccatgaagtatgaattatcattatcactattatatagtaaacagtataaaaatgtgtctatgacttggagaatggaaaaatgttttacaatattacattctggttgttcacttcccttccattcatgttgacattgaattgttctaggctgctaaggcagcactgtcagaagccacgttttttctaggcatacacacactttattcctttgtcctttagttccttaaactacccatgcactttcctcctctttctttttacattgatgattaaaatagtgagcctgaatttttttaaataaaaaccaactaagttttttattatttattatttggaggaacatatgccctccaaaatatcatttagtgcatcttagacataaaacaatttaactgcttgaagaaaatgtccagcttctgaaatggcatgccattagatattagtgacatttgtttataaacaaataaatgtcttcaacctctatgtagttactatcaatatagccatgcaatatatatggagttccaaatacctttcaaaaagtaatgttgatacagtagtgatcacttatgtccttttgattgaaactgcattatacgaagttctttcctttcagcacaataacctgaaaaatatagctgtctatttaaagaagacattttcttgtttggcagaatattatcatcatacagcatatgtacaatatggtcctaatttgtgtcratatgtgctaggcttagaaaactcactttaagttttactaaatttattttggagtttaactcttacttttgacatgatttatattctaaggagatctcagcttcttcctgcttaaatgacattacatagatagaaaggtatatattcttattatagcagtgtctgccagggctgcagtcctgttgttagaaggctgtcagaattttaaatgtaagccttcctttcccagrtgttatwatttaatcttctaactcctattaatttctgaagactgtggggccatcctatatcttagaacaaaatatagatacgtacattcctgatttttttctccatatttaccttcccccaaatgttttaattttattatttcaaaattataataatagcaatggatttcaaattaaaattctggctagtgaatccctcaggtatttctttatattgactgatttgtatgttgtaggctaaataatgccctcctccaagatacccatagctgaatttccagaacctgtaaatatgttccctcttacatggcaaaagggactttgcaaatgtgactaagtttaagaaccttaaggtgggaagatgatcctgcgttatccaggtggaccgaatccagtcacatgagaccttaaaagtagaagagggggtcagagtgatgaaacaatggaagaagaggaaggagaagtttgaagcatgaaaaatatttcattcatcattkctggctttaaagatggagagtcccttgaaccaaggaatgtgaatgacctctagaacctggaaaagagcattggctgacaaacagcaaggaaatgggaacctcagttccacaaccacaagaaatgaattctgccaacaacctgaatgaacaaggagatagattctcctctagagccaccagaaaggaatgtatccatgccgacaccatcattttagtcattttagctaaaggagacccatattggaatattcgcctacagaactgtattccaacaaggatgcatatgttggaatattcacctacagaaccatgagataatatatttgtgttgctttcaattgctaagtttgttacggtagcaataggaaactaatgcaatgtacagttgacccttgcacaatgcagggattagggatgctgacctctacacagttgaaaatttgtttataatttttagctccctaaaaacataactactaagagtctactgttgaacagaagccttactgataacataagcaatttattaacatattttgtatttcatatgtatatatgctgtattcttataataaagtgtgttagagagaaaagaaaatactaagaaaatcataaggaagataaaatatatttktgttaatcaagtgaaagttgatcatcttaaaggtcttcatctgcatcatcttcatgttgaaaaggctaaggaggaggaagaagaggaggggttggtcttgctgtctcaggggaggcagagacagaagaaaatccgcgtataaatggaccggacttgcacagttcaaacctgtgttgttcaggtgtcaactgtatatgaaggctttcttctttaaacagaaaggaagtattttgtgcccaagatttggagaaagcaatgggataaaaatatcatagagattttatggtatttgtcctttttttccttttccccttcactaagggtcttgaaaaactggtctgaaactccgctccagtagagcaaaaagaagaactgaaagttaagaagatatttttgtgaaaaatgttgtgagacaaattttgacacagggttgaggaactctttttttccgcatctgaccaagggcaggcttgatatcctgaaggttaagagcggctttgcctgaagcaaagttctcactatgggaagttgcagccgagtagtgaagagttatcttgatgggaggccggaacaaatttgctttggagacgtaaagggaactaagaactattcttactggactccaatatgagactttatttctatccattggtttgcaaggcctggagatatatgcattagataaaaagactgtatttgtaattagaaaagcctccagtaattaatgtccaaatatgcaaccaatttaaatgatgtctacataataccacacatagatgaaaatccaaaaagtcaaacattcattataataattcttccaatctagttgttgttatatagaagcccctcagagggcaccccattttgctgaatttcttgagttttttacttatatcacagaatcaggatgttcaaagtataacaaagatgagaagtaagttgaaaaaagaattattagtgatatttcttctaccatatacatgttatcttggaattggaattttttcrtaataagaaatccattagcataaatacagtttaaattgaataagtaaatttcattaaaaacaaaatatttatttgggggtacattttataaatagctgcaaaatcaaaactgcatttttgaaatgtaagccatattgatgctagtaagtcaatatgctcattatcaattgtgtatgtacttttatgttatttagaaaatttaattacacgtacggtgtttcaagtattcaatagataaaccacctaggaatataacagggggcataaaacatattatcgactctgtgtctttatgaaactagataaagcaaagaaaaatctgtcaattactcagccagtttcatcttagtagcctactgtaaattgaggtctatgtttttgagtgaatgaaatctartaaattaagttcaccaggtcttattctagtttattttagatggaaatgtatgatttttaaaagtgggagtaaaatcttacacatatttctgaaatgttaagaagataattttataattcaaacctgtacaagaacttagtttgcctatctgagcaaattttacattcactagtgaatgcccatgtgaaagacaagcaggaaacttccaggggccaaggggcttagaaccaactgaactggtacaaaataaacattaggtatttcagtacgtagagtttgtggacaaaaagaataggctcttaccaattactatgctactagaatatccaattttgcttttaccaagccttagtgaaaagtgaatgaattctaacaagaagactcaaagacactggtgctccccctgtgtctcccttcacttattctrcatggtcagcacctcttcaaaagaccaataataatggtcccctacaagaagtatacaattgctcctctgatgtgaaagcatatgaagaaaataagtgtccaaagctgcataaatatttgcacccctttgagagtatgagaargtgtgtgttttatgttgtgattgataggacaactttcatggcccactttgaactcttagcaggaactttggaatgtcctgagggtctgtctgcctttgtatggcaggaactctgttttcttagaaaatagtaaagaacagtttgtactcctttgttctaaagggtacctatagtttatgggaattggggaacttagtagaaaaatcaccaacgctctcatgtttctcataaaaaatgctcagctttatttggaaactttggccattgttttctttttcttctttcttcttctccttcctcttttgrgttaaaaaggccacagtctgacctacttatatgtgtgatgaaatgtgcagactctgccaaggctatttattctaatgatttatctactcaagataaaaagaaataaagtgaagacaaatctgaaatactgtgcaatgtacttacttgaaagcagtaagttctcatgttagaaaatttccctattaagcaagaaatcttgaacacttcattaaagtcatatgatctgatttttattatcatttaagtcagggaattttagaactaaatgtgtcaattataaaactgtacatatgtatagcctccaaaatgtgttaaacattagttcatatgaatctcaaaatactgtaacacagtaaaatgagcaagaaaatttttgaaatttgcacagtagagacgatgctgttaatgttcaccgaggtaaataatttgtccaaagttctatttctgtgagatactcaactgagacataatctcagcttttttcactttcatattctatattttggttttcattttgttcttaagaaacaagtatttttaaaatgaaacatctggtttcggcagtgctggctaatgctcagaactcccttcccttgttttcttcaatgtcacccttctataaaaacctctgaatatctgaatacgttttaagagcaccccttataaaacactttttgctttgttatgtttcattttgcaggtgccaaagtcacaaatatttcacctcattcagatattccaggtagtaaggctgatatttttatgagtcatttcatctgacaaaattaatttaagaataaataacattgaaatagtaagtagcatgtattttggacttaactcttattttccctatttctattcttccatgttttaatagattaatatatactcatgtgtatatatgtacatgcacactcacacacatataagtatatatatatttatttttcctcatcttatacaagtggaaacatactatacacattataagagcacagtataatttttatgtaatataatttgaagttaattccatattggatagtttcttcattatatgtgtaagtatatgtaatatatcatatgtatctatgattgtgtatttcattgaatgaatgcactcaaacgtgttcagcaatcagcacagaggttaaacattgactctagtactagactgtgaaggttcaaatcctgctttcaccacctgccatctttgtaaccttgaacaagttatgtaagtactcaatgcttcaattccctcatctttaaaatcaatgtaacagttataagattcttaccacataaggttgtgtgtggtgttttgagaatgtaatgaatgaacatatccaaagccacattgtagagtgcttagcacttgcaaagcataatgtcagtgtgagttgtcatttccatcatcatttttaacatgtttaattgcaacccctattgatggacgtacggacattttcaatattttttactacaaacgttgttatacattgtttttctgttgttgttgttgttgttgttggagatggagtcttgctctatcacccaggctggagtgcagtggtgtgatctcggctcactgcaacctccacctcccgggttcaagtgattctctgcctcagcctcccgagtagctgggattacaggtgcttgccaccatgcccagctaatttttgtatttttagtagagacagggtttcaccatcttggccaggctggtcttgaactcctgaactcatgagtcacccttctcagcctcccaaagtgctgggattgcaagcgtgtttcagtgaatagccatgtgcccagctgtttctcacatgcacccttataactgtgggataaatctctgaaggtgaaactgctatgtcaaagtatatatgcatttataattttaacagatattgccaaattgaacccatatattttagacatgctaccaccaatgcatgagagtacttgtttccctaaacccctctctaatagagtatattatcaaacttttgggtctttggcaatccaatgggtgaaaaatgacattttgggctgggtgtggtggctcacgcctgtaatctcaccactttgggaggctgaggcaggcgaatccctgaggccatgagttcgagacctgcctggccaacatggtgaaaccctgtgtttactaaaaatacaaaaaaaaaaaaaaaagccaggcatggtggtgcacacctataattccagctacttgggaggctgaggcatgagaatcacttaattgcttgaacctgggagacagaggttgcagtgagccaagatagtgccattgcactccagactgggcaacagagcaagactccatctcaaaaaaaaaaaaaggaagagagacaattatatttttttccacacaagcatttaaaatctaattcaaaaatctattctgaacttactgaatcccaagaataattaggagaggaaaagaaataatgtttaaataaattctatctgcctgttactatagaacatgaagaatgggttctgtgttcctcttatgaatttctttttaaaacccttcaaagtaggtattttcatgcccttttagacataacataacgtataattcagagttgaattaattttcccaaaatcacacagcaaatatatagactacaattagaaagtgggtaagtctcattcttaaacatatacttttgcattatagtcacatgaaaccactgagcgtgttcatgtgtgtgtgtgtgtgtgtkwgagagagagagagagagagagaaagcccaagagtgagagtttgtcttgaggagaagtgtttaaaaggaatatataaatcaaggatgcactatagtatcaccaaagtaacagtgtgaacttgaacaatttaacctcttagagccacgattgctccatctatacaatagaataataataataaacctacattatacaatttccggagattaaatgaggataaagagtacttttgaaattctaaagttccatgaaaatgttagctttgattacatatggttcagcaattgggtctccttattttttgagatctaccttttttttttgtattatctgtagcttgctaaaataacataccagatgtttttgttttcaaattttaaaaatccagatcatactgatttgttgccatggtatagtagtcagagaatcttgctctgggcagttacaatattttggagattgttttacataatagcaacwataacaggaacaatgataactgctaacttgtttacatttacaaaatgtcaaatactattctagattattcaattgaatcatcacaacaacgctatgaggtagttactgttatattgttttgatttccctgatggagacttgacacaaagagagactaagtaattcactcctgtcacacacagctwaaaagtggcagagctgagtgttttgccccaggtagtccagttctagaactgtactcttttccactatgctataccatcttcctaatactatctgtacaagaaattttctcctaatgaaatgtattgctgtaccctatataagctttagctctaaaattgcagagcaggaagcaggtggataaagctaattgctattctattaccctacaatagaaatttcagtggactaactctaatatttaaataacccactgttaataaactggcatggtgcaattgcatgtttcccagtgagatcagatctagtccaatgtctcagcagatataggaattccttttctatcaccccagacaggtggatctctactcatgtatcttcagagaaatggataccctacaaagcagcacattccattttcaacagctctagatattattttatttatttattttagatgaagttctgctgtgttgtccaagctggtctcaaacccctgggctcaagcaatcctcctgcctcagcctcccaagtagctggaattatagttgtgtgccactgcatctagctccagattttagaagttaattcttacacagggttttctggagggacagaactaataggattgatgtatatatgaaggggagtttgttaggagaattggctcacatgatcacaagrtgaagtcccacaataggccatctgcaagctgagtagcaagaaagccagttcgattcccagaacctcaaaattagggaagccagcggtgcagccttcagtctgtggccgaaggcccgagagcccgtggcaaattactggtgtaagtgcaagggtccaaaagctgaaaaacttggaatctgatgttcaagggcaggaagcatccggcataggagaaagatgaagactagaagactgcgcaattctagaccttccacgttctcctgcctgctttatcctagccacgctggcagctgattaaatggtgcctacccagaatgagggtggttctgtctttcccagccctctgactcaaatgttaatctcctttggcaacaccctcacagacacactcaggtacartactttgcatacttcartcaagtagacagtcaatattaatcaccacattctccaacgctttctcatacaggttctatttctccactatgaacagtgagattttttttctggtatacttgataggccttcaaatgttccaagaaaacaatcatgcttttcctaagtcttctctttttaaatactcccattacctttccaaaccttttgttcagctgttgggaccatcaacatcctggtcacacctctatggatgaagtctaatttgtcarctactctcttaaatggtggtgtcatgaattgatcacagtgctctggatgtgctctgactagctatgactgctcctggatcgccgtttcctttaatctatacactatgtgtcttcctaatacagagagtatgttgtttgcctatatatcataacaaattgaaaatgcatttataacttayaaagtatatattactaggtgctagaatttacactattatcctaatatacagaagctgggaaaagtaatgccatagagttgatttatgtgtgtaaatgtctaagtgacttaaatattgatttttctccttcaactgcagatcaaacttcccaaacactaaagcttccttattttaaaacaaatgcatttgtggttcaccagtctgcagtacagtaagctttttataggtaagctcaaatcacagaaaagctcaaatagatacatctcctttagcctatttttaggactgataaagctaagaacagagaaaccaataaagacatattttaatgatggcagggtatctcatggggtagtacaaatttatcccagttttttatgccttctctatgtgtaatacattgaagtgatatatggtgttgaatgtgattaaaattcagcagatacttatgcaagatctactatctataagatgcttatgcaaaattccatagggaaacattaagacgtgaataaaatctgaattgggccatcactatgatctctccccaaaacgtgggattttcaagtgcatttagaattatgaaataaaccactaggtttttagtgtgaaatgtttacagtattttaattttgaaaactatacttattaaaacagtatgacaacatttattgaatacatgttatgtgctaggtaccaagtgrggagttttatgtttattttctcatttcatcctaagagcaaacttcrgaggtaggtgtgattcgtctcattttagtgaaaattcactgatgctctgaaagcaaaattaactttcccaagggccttgtagtgcttaaaggcagaatcaaaatccacaaccagctctggaaaatctccagaaatgagcttaattttttgtgtgatttatatatgactccaatattaacagacatgtcaaacaactaacacaaccctttacctgtttattttggaagaagacacttaaaatgtattttattaccctgttgattctcctctggagtgtgacttagtatccattgcacctttgggattcttatcttctaaaattcacaaccactttctactgctgtaagaaagaatcacctgcagagttcacgaatgagggaagagtgaaaagggaatagtggcagatcaataccacttggcatcacatcaaaatagtattccaaggttggtgttctggcttctgcttttctgggaaatacgttgtctgctatttcaaaatgccctccatctgaataatgtaacctgaaattcattcaactcatatttagcactttaggccatatccagggttgtggaaggtgtacgtaagcaatgaggattgcctacaaggcaagatgagaactctgttttctatactttctattgttcctccctttgcaacagaagtagaaagggccataccatagccatctactgtccaacatgatgaatatccttaaagacaaaatctttaagcagtaagtgaaaggttaactacaattctcatttaaaaagaaaattgcattgctgatatctctttgttacataaattttccacaaggattatacattttctttttattcatttgttatctatttgacaatagcaagcctgtttctctttagcttaaaggaacttggattaaaattttttctgttattttaatcagcattgatgttgtatattatgagcgtgtggctttttgttttcttggcagagaccttgaaaaaattttgaaccctagtcaataagaaatctctgtattaatataaaactataacttatggtttatttgattagatcaatgtttaattatggataacatgtattttttgcactgaatatttacacacaaattaatctagcccatagtaaaagtgctaatggaatgtttcatccaaacataagttagtaaatggaaaacaaacagctgttgcaaagaccctgtttttgggtctgggcctaacagcacgaagcacttcagagaatttcaccactaccatttactcacatctgttgagattgtactatttcaactcaagatttgatcagtgtatgtcataaagtaacaagtagtacgctaagtcagaaaacttaaaggaaacattaaatactcatttcctatatggaatgttgcctttctaagcacatcatcttcttctatgtgatgttttgcaaatctattcataggagatttatattttcaagtgtgctcaaatggatctgtgttggggaaagataygtgaaataagaaaataaaagctaatccatttgttttaaaattttgtctgcctaccacattttgttggacttcttgttatatgagaactcctaattgtctggttttcaattgcagccaaaagcattcttacctgatcaaactcttcaaattctatttactttgaattatagctgagtacatggaaagtataattgggccttactttgttacacagcagacaaaacatatgctcaagataggtcagtgctattccagtgaataaacattttaacaaaaatttgtatgagaaattcatgttggcctctcattcctctctatatgcctttcacagttactctttttccccttgccaatcaaaacactataatgaatatctcttggccttaacgataagaaacactgtatataaatattgtctaggctgtattttatgagaatgtggagttatatgaaatgtaggaagaaaaaatatgagtgagtaatcctgtgagcagtggacgggctgagcttctaggacactgataagcaatcagtgttagttacacttgaggcagtatctctggtggtctgttccagaactatgtccttgactctgtcacattcatacttttcatcactactttttatacttctgcaatttaggtcacccaatacasgttatcttatcaggttaaactgattgtagtggtcacattgaaaaagaaaaaaaaaatcccaaattcaggacttttcccaaccagttctaattaatgcacgtgtgaaaggacatarttattgtgaaaagaaatgctatcaaaacagtctaatggctacaagaagaaaaagaaaagaagaagaaggaggaggaagaggagaaggagatgaagaagaaagctaaggagaagatgggtaacaggaaaaaaagagggcaggaaaagcagataggaaggaaaaaaaaggtggaagagagaaatgaatgcaggcaggcaggatgttttcctcgaggttttttatttatatcccctggactgcataactcagtttattcccttctaaaccracttttctagaatgtgttgtctctgttcgacacctacaactctggttcattttctatgcattaaggatgatgtaactttaaaacctctcatgtaaattctgcctgttttctaattctacaatcctcttgtttatgttcyattctaataattatcgagcttttaaagaagagaaatctgttcttaactcaaatttatacatacactgaaggaaataacaaaaccttgaagtaaaacactgtttctatgataaaagagagctctacaaatagatgcatgaataaacacttctatgggagggataccttttcagagtttaaggctcgcgggctttgggatctaagaagatgaatcgcttgccctgtttgtgatcctaaatggaaattgacagatatgtttaatttatcctgctcagtattataaagcctttttctcatttgatttttgtgtatccctcctgaaatatttgctctggtaagcaaaagcaaatattaggttttacactccatttagtgaaataacagtgatgataatctgacatcagagaaccaaatgttccaggcttatttcatgaaaaggatttcctctccagaaacattatcctcaataggttatcccatccttcattcctcaattcatatttcttgagattgagagggaaaaaaaaagaggccagaccacaagtagcctactgctaaattcttttatgaagcttagttttatgaattaccttttagccttctccagtcatgtgggaaaactttcctgcctcattaaatctttaatgcaatgtgcaccatgcacactrtattgttatttgtgacattaggttatatattgcatagtaactataatattacttgcaaacaagctggtttttccccctgaaggtagaattaaaacaggtactcatgggaaacagctacttgtgttcttcttttcttaatggggtgaagctgaagaacaggaaaktgaatggcttagccyagaaccatctccaggaatggaggtaaattttttcctgcagtgccttctcaatttgatatctgaatctccctgaagagaatttgccttagtagatatggagaaagagggaaaaggccaagcctttggagacccttatgaaatggaatgaaccgctctcactaaattcactttctctttgtattgaaaagagatataattttcatccctagtaaatatagtcgaatccatccagtaatataagaattgcctcaaagtgaactaaaattgcacttactcctacctgtggaaaaccatatttctctagccaagagaacaatgacagattagttcctaaatagcaggagaaaatgaaatgttctattggctgaacacacagtgctctgtaaaatcagagaaatcaatattgtccccaaaatgaactaatttgaaagtctcaaagatgttcaattttatgaaagactcgtaaaattaataaatgagtctgcaaagtccaaaaatgtggaaaattacagttatttgcagtacgtataacttaccaagaccacttatattttgttagaatttttcaatgaatgttaatggatgaatttttttatatagagttctccctgtttggaatcttttagttcccttatttactgtggttgccactgactctgcatcaggctttggaaatatcactaaaaaactgttttttctttagtcttcttactagtcaaatatcagctaaacaaacaaagaaaataagtgtttgaatggtcagagaactataagaatgagaattctggcaggaaaattcatttttaaaaatccaagtaacagaatggataaatataaaaagaggctagatcagacatacccagacattctcagttcagaatgttcatagcgtattcataattttttcatagtgcctccttgaccaacagaaataagccacagttctatttcttaagtagttagtgccaaacaacttaataaatattcatgttttaacaacctagcaattgtttaaaaagaaaatggacagaaaataataatttttttcataaataaccagaatcacttactgatgggatgtggtacctttggggtagtatataccttctcaaacttgagtatcagattggataatgctatccttatttccttttccacattgacttttgtgcagttcttgcttttrattacagtctcttctgaaaacctttcttaataaagatataaagtggcctaaagtacaagtaagcagaaacatggctcaaaatgttgagaacattcttaagtggaatatagcatgttctaaggtttcaacttgtgaaccaycttgaattagttattgcagtgcccaacagatatttagtattgctgtgtgtccttcaaatgtttacaatattccactgtgcctttgtgagttcactgcagcacsctgggrcacctctacacacagtttgtgaacacaggggtagatagatcctagaggcattgaaactacacggaaacttgaatgacgttagggatcccagagccactggggaatcttcattagggaagtgcaacaacatatgaaatagctcattaaactttccctatcaaaaaaactgaagtcagagagatgaattcagatgcttgatgagaacctacttggtaatggatttgaaggagagagtaaacgttaggatactgaagggattctaagagagtgcagaagcgagggcaaggaggcacaaaacgaaggcggcacctggaacatggaggagtggacagatggagaagaggcagagaattctttatctaaagcaagaggaaagggcaacgtatactcagaatattctcaaagctttttccctgaataatagcatccttcagaaaagaagtcttgtaactgactcattgcaaagtctcttacacaatggtatgtactctttggggaagacacaactggaaacaacaccaggaaaagcttgattttacagcttatggaaagattgtggagttgaaggaaaaatagaaggaaagaaattttaaaaagaataagttaatattcctaggggtgcatcctctaaattgcagagtgatatcttaagcaatccttttaagaattacttaagagcctgagcgtggtggctcacacctgtaatcccagcactttgggagacggaggtgagtagattgcttgaggttaggagttcaagaccagcctggccaacatggcgaaatcccatctctacaaaaaatacaaaaaattatgcagtcatgatggcacacacctgtagtcccagatactcgggaggctgaggcacaagaactgcttaagcctgggaggaggaggttgcagtgagctaagatggtgccactccacatcagcctgaatgacagagcaagactctaggtcaaaaaataaagaaagacagaattacttaagtaagtacttgactaactggttatataaatgtgatcataaacgcatacctttagggtaaatgaaaaagacattgattctaatattgtgtaaatgggtaactgtggcttgggaaaaaaacatctagtaacagtatcctgaaaattgtttaaatggtccgtgtttcacacaacttaaatggaagtaaaacagcttcgctcatgacaattttcaggcaattcaaaatacgttgtaataatggcaaacatgagtatcagagatacacaaaagagtttagaaaaaaatcattttatgaaatatgagctaaaacaatgttttactattatcgctattattattagccctcagcagaatagggtaaattatttctattccttagttcatgttttatattatcgctgacctgcatgaggagcccctatttttctgcgtatttatttgttcctcttttcccccttcccacctctaattcctctctcatagtattttagtttatgtcagggatccccaactcccgggctatacaggtctgtggcctgttaagaattgggcggcacaacaggaggtaagcatcaggcaagtgagcatcactgcctgagctctaccgcctgtcagatcagcggtggtattagattctcacaggagcaggaaccttattgtgaactgcgcatgcgagggatctaggctgcacgctccttatgagaatctaatgcccgatgatctgatgtggaacagttttatcccaaaacccctcctctgtgtccatggaaaaattgtcttccacgaaacccatgcctgatgccaaaaaggtggggagtgctgcaagtttccattatatgtgactttattataaataggtatgaaaaacacattagcaaatcaagtatcataggtgatctttttctacttcatctatagtcgtaacagctttgacattcaaattatacacactttgactctttttattgacaaaatggaaaattatccttaattcaaaatgtattttatttgagcatatgtggtgatttcatatattaagttgatatttttctttcctttttagagaagccatattcaagaaaaatagcatgtaattcaaattttaaataatcaaaatagatttgaaagctcaaaattttggaacattataggcctatgtcccaatattcttcccaaacctcctttcaaacgtatttattaatttagaaaattctaaatagttcagtccttgtttgaaatatatacaacataaaacttttttttctcctgcctttctagaatccttttattgagaaaatgtgtagctgatctgaagaagcatgctgtgtgaaattttgaatgtttatcttaatagaacctaaaatcttccacataggttcacccctcattactcacaataatgccaagtgctgtagtccaggcagatatttattattttatatgtgaaaagacattcgaataaggccatttctcagtggattaggggaatcagagttttctgaatttaagttccttatagagccccatgtaatgagctcttagaagacattgcagagctgcaatttaaaatcctgtttaatcagccgtagcragctatgtgccattctctgtggaacactaagaggaatcagggttcttcctcctccatccagtacattcccaaccaggaattgctgtctggtcagggttggacgtgaaaggccatagagagccaaccctgcgaagccaagtctctgcatgtcagcacagagcaagcagcagaatacagatcatcagctttgttttatgaatatctctatttacagtgctggagtggaattttaaaaaaaggattgcagcatttgcattgaatctgtcactcacagcttcaattttgattcctgtcctataaatgatcttgctttcctatttttttctgaatttctacaaggtgactgtcaatgtcagaaaatgtaaacctcaagtgtacattgcatggggcttggcatgtatattagaaagaaagaagtttgcttaatgaaaagaggataatatttattcaaactaagcctatttaattgcacagaggaaagtataccttctttgcctgttttgtttgaattttaatataaaataaaatttgctgctaaccttttgttttwctttgaccaataacatttctcagcttagtgtatgggctatgtaaagtgcctgtcaaatggagggatgtctttgtkgaaagaatccagactcacagaaagtgagtgactttctggtcagatggttagaactctcccaattttgacaaagatcgttctctgtttgggatttgtaaagctcaaactgtagactaagatgatgacaggaggatctgctgtttggcttcatggaacttaacctatttcagcaagcctgcaatactggggaaaataatacatatatttatgtttatgtcaggcttgcagttgatgggtaaggttcataaaaggttactcctaaataaatgcctatcattcccactccgtactccagtgatttctgcgtcttgcaaatactgccctatagaacaataaaattcgtatacaacagtaagtaaaatatgatttaatagcccatctcctatcccgtaatgattatgcatcttctgtcttgtagctcccagcagtaggargacagttgacatttaccatatcatatgaccttgaagaagaggaagaagatacagaacrtgttctccagcttatgattatcttagaggtagagtactgagagcatgttcacccgtgttacttcctgatgttacttamggttaccagtactgtattttttacctgcctggtttgacactgacttacaggactactaaaaaaaaatataccttaggagwtttttgtgccactcttttgtttcactctgagacatatctagaagattgagtatatttgttgggtttgaatgataaaggagaactttagaccagacttgaaattaaatttcaaacataaggaccatatttccaaaatttaaatattatgaaagtgtttaggtacatgctaatttacatggttgtgtttttcctgttttctcttgcttccagatagattttattgtctactcccttgtttatattagataaaataaaatgaaacaggaaacttgtttatttagctatagttaaatcttgacttcagaatcctgttttaggtaagaaaggtacaggagaaactgctttcaagatttgaagggccataggcaacttcaaaatgctcaaagcctgaagtttccttagaggctctctgccaccctttcttatcatatccattctttccaataatgtatctcctccccttgacactgatacgtattcagaggcacacacatacatgcatgttcattattccaaatgggtagatgttaatttagcaccaggctctgttgtttyctgtcttgaaactttcatgcatgtgaatctatgacaaaatgaaaaattcttttctcaaaatggacattttccagtattggatgaagtggtctgctctctctctttctgtctctctctttctctctctctctgtctctctctytctctctctctctctctctctctctctctctctctmtatmtatatatatatatatatatatatatggcaactagatgtatactttggaattcctttaaggtgaaaagagttctctaaatgtaaagtgttgagtgaaattatttagcattcatgtgaatgaactaagacaagaaggattacctaagtgtcataggtcattcaatatactccttagatgccattgtcctattttgagaattagactgcagtcttttttgttgtttgttttttcccatgtagtaagttcctttaaaataatagcttaattcagttttaagtttctttccctattgttctacacaacccacatccatctacagtttgaaatatgtaactttcgtgcacttttttcaattcaaggtgtttgtaatcacatatatgtttatgagttgtcaggtagctattattttagttaacagggaactaaggtcatgccaaaccaagaagcatatgcttcataatgcatttggctaaggctaatattgaaattgcattgccttcccttcatgtataccacaaatatattccctgaatgacagggaaagccaacctgaaaataaaagtctactaaggccgggtgtggtggctcatgtctgtaatcctagcactttgggaggctgaggcaggtggatcacctgatgtcaggagtttgagaccagactggccaacatggcaaaacccccgcctcttctacaaatgcaaaaaattagccaggcttggtggcaggcgcctgtaatctcagctattatggaggctgaggcatgagaatcgcttgaacctgggaggcacaggtggcagygagccgagatcgcgccgttgcactccagcctgggggatagagcgagactctgtctccaaaaaaaaataaataaataaaaaataaacataaatttttaaagttaaaagtctattgagggtggaggatacaaatatagatatgtttgacacttttgtaccctcttttcagttttactcttttttatttcttttttttccccctttagggtaatgacttgagcatcagcacagcccaagatgaggtgtacctgsacccatctgaagaacatactaatgtattgttacttaaagaagaatcatttaccatacatggcacacattttccagtccgtagaaaggaatttatgacagtgcttgcgaatttgaagagagtcctcctacaaatcacatacagctttgggatggatgccatcttcaggtaaaatcaagaactgcagctccaacgttcacacatttactttggggccaaggtgcaggagccgccccaggagtgaattttttaaggcacctaggatttgctgtcttcaaagagcagataagaacggagccctagttttctgaaagatttttctcttaaacctttacagttttaaatatgcagaataaatttgtctcggtttttattattattgatgattctttcacaattgtcagaacatgtgatcaataacgattcctatattgagaaatgttatattggaaaataaagtctcctttatgatggctcatagcgtgggaagctaaaaagatataaattccagggcacccctatttggaaagtggtttttaaaatatttccttccagtagttgttaactagtttctggcttaatagtatatagattgtaataagaaaagtaagtcttttcatttaagtgaccacccatctcactataaaacactttaagactataacagccatatggtataaaggaaagaatatgaactttggagccaaactgaatagaaattcaataagctttattgcttattttatgtgtgacctttggcaagtgattaagccttgaggaacgtttcttttcagtgtaaagtggatatagtaatgcctacttttcagggtctttgttaacatgatatgtgatcattaggaaagtactcatcacctagaacactttcagtttttttcttgttctccccgccccctttttttaaaagagtgaactacctgacttgaaccaaatatgctcgggtctgattaactgctgtaaggcggctttgttttttttatttttaaaacaatgacatttttatctgacagaattttaacttcaactgtgtctgaatgagctctttacgcttctcgttttctactctaataataaataacacaaggtgtcataggaacttccttctaaatcaggttaagttagacattcaaatgtgaccccagcctgacaacccggtatacctttaatgaaagcaatgtctccaatattggaktttttattgctgacaccaccacctctcacctccctgtccctcatcatttccctgtgctgcctagtttgcctttcactggtaatatttcaacttagtctaatcatcattaccatttcccaaaggagagaactgcagaatcataaacagaaccattgccaaacaatgtacctcttttgcataggcaattcttctagaagctgggttaaaatgccatggagatgagaagcagcacttaggaattaattatgtttttcacatttagcaaatagaggttgtcatgatgtttaaacagtacaaagaaatgagtcctccagctttcaaaatgaatgacaaccaaattgacaaaaaaagtgtctggggggcttatatatttttgtcagcattgcttttcaggctagttaatacaaagacatttccccctgatttatgttggacagtttcagtgtctacccgtcttaaaatcactggtttcatttgcagtcttctgaggtttcgccatacaggaggaatgcattcacagcgcggctctgtgaaatgacacaagagctaatccaagtaggtggctactttctgtcacctacattacctaaagcactgtggttcaataagtaaaagccaatgtcaaatttgaaactcctacccactcaggtgagctgaaagtcggcatgaatctggagtcagtcagtaagcttgttatattttatctttgatctactagtagattgagtcatatttgtaaaacatcacttgaattgatttcaacttgtcttgcacagtaggctttcgacttggtatactgtttgtgtacaagcacaagtaaattgaagctcaacaaaaattcatattcagacttatttacagtggatttacttccatggcagttctttcagcaaatgggcttaggttcctccagttagttatatgattagatggaattgtataacagaaggagaactggactgcgggtcaagaattttgacttttgttttcaactcagctatttaatagttgtaaacataagtatggctttgacctctttggacttcaatcacttcatctgtaaaataaggaggaggacaattgctctgccagcttcaaaargtcaccgcaagaattgaattagagagctgcaaaagcacttggctagtggtaacccagcacacaaatatgaagcatttctatcttatctacttcatcccaaaggatcacattttctccaaataccattaagacttagagacctctaaagaaaggcacatactggcatttccatacatatgacagttcttactatcatttttatccagaatgctgagacccattagataaaattaatttattttcttctcgctgtcttcactaggaagatgaaggcacaagtagaaaactcttcattcttcttttaagaatataagagaaatcaacctaactgaactgtgcatctttcacctttaaattatccaagacttggatttagtaacatccttggtctttaaatcaagaaaggcttttatgaagcacctatattagatatagaactctgcacaaagtgtattttcctctaactttacagtagacattagtagagttcaccaaatttccaatctcatctataggggatattgcatttctctaatcctggagggtagatgtgtcacatgacttggtttagccaatgaaatgtggtagaaatgatgtatttttttttttcctgaggtaaacattgaatttccaatgtgagactctctgcagcttactcagcaatcagaagattaaaaaacagcctggggccgggcacggtggctcatgcctgtaatcccagcaatttgggaggctgaggcaggcagatcacgaggtcagttgttcgagaccagcctgaccaacatggtgaaaccccatctctactaaaaataccaaaattagccagacatggtggcacgtgtcagtaatcccagctactcaggaggctgaggcagtagaatcacttgaacccgggatgtggaggttgcagtgagcygagatcgcgccattgcactccagcctgggtgacagagggagactctgtctcaaaaaaaaaaaaaaaaaaaaaaaaaaaaaagcctggaatactgatttagcacacagaggtcagctgccctaacagtcacccaggcctgtagaggattttacatgagtaagcctttgttttctgttaagccattgagattttggagttgttaccacagcataaccgagtccatcgtgacttcatcacgatataactcatgagtattgcttgaaaataaatacagaatcttttcaaggcaagatatttttacacaacttttagtgtaaattttgcggtttgggatcaaaaaagattatacagaatttatataataaataatctagaaaaattcctttgtaaacaaaggagtctttgataatcatagaaatagtattgataggtacacagtatacctctgccttctgaagttaatgatttgggtaactacattttgaagacattttactgataacactaggacttaaaaagatttttgcagctcacttggcatccggccattggtaagaggtgcagccaacattttaccctacgtttccttcccattatctttgactacctcccaatgctattccataagtgttggattcgttcagtctgcaaatatttactgagcaccttccatgattatctctgtaaatctcagttcctcttgtatacaatggcagaaacaatgtctaaatttcaattggcaattaagtgaaaacataatgtatgttaagcacctgaaatagtatctaacatatgttgggaggcaatgcagggtaacaaggagatctttggttttggagtcatgcttgggtttgaatctatgctgcaccctttgctaatggtattatgttggacaaggctctttactcctctgagcctcagattcttcatttgtaaatgtgaatagacatgggttgttacattgtttattgatacttaaatgaaatgtctttccagcctgtatcatagtacacagaaaatagtagacagtaagtagtaactattaaaaagcagtcattctaggctaggctataaggatacaaaggtggacaaatgatcattcagttcaaagaaggcattgtacagtagagaagacagatatacatatacatactgtacatttatgataatataaatagtgcagaagaagtgtgcacartgcatataaatagtgcagaagaagtgtgcgcagtgcatactggtagaactaagaaggaagcaatgaattcttgtgttagcatttaatacacttttaataaatagctgcaaaagtatcagtttctgtcagttactgctcttactcgatgtgggattgaaaatgtttaaagaaaatatcttgctatatatatataaaaaacaaattatatagcatatatatatatatatatatatatatatatatatatwgtgggtagaaaaaagacaattgtaacatcaagggtatttttgttgttttaaagtgtcatgttttgtgctggttgttttagtgtaatatagcatatcttactctggtgggaaatgtagtaaaacaaaaatattgagaacaatctttaaggcagcaccaagacaacgtttctgaaatagttccaatattattcatagtggcttgtataattatgtcctctctcttcatccatcatcttttctgtattttcaaggcataaaaataagagggaakagtcagctaaagcatttgacttagttgacaattctttgatagctcatgcatctctaaaatttagtactatattattgccaacattatgtatttaaatgaatgcagcttgatatcaagaraatgaccatactgaaggggaaaaaaaaataaactgcagccttcttcatgagtaacacttgaaactgttaaacacattaaaatcccatttaacaaatagcagaacctaatgaacattgggattgctcagtgagtactaatgtggaatattactgggaaagatgtttgagtgttgaagtttctcatagctcagaatggttacacagattaaggagaggaaygtctgttgttcaaaagacaaatgaaatttgtcagttcactgaaaatatttttgtttttgtatcttttttaaaactgtttcttaaagtagtcaactgctcattcttctattttgaaatttccagaactctttgtttaagttttgcatgtcaattttatatgagaaattcttggactgtatctagatacagttaatcaatctgctgtttagtaaattgtggtgatctattgtatgataatcaactagtgtatcaaccatgaaatcatctaattctgaaattaaaaggatcagaattataggtttatcaagtgacagtccattaattccaggcagttagatttcacaatacattcaggcgagttctggtctctggcctcaagttctaatgataacagtttccatttatcttctatgtcaaatcaaacaagtaatttgtcttttacttttctgattttattcatctgaaatgtggctagtagtctttaytgtatcctttgccatggagtttgttagtcattgtttgtaatagaactgttttccattcatctattcatttattatttaagtatttagtcagttacttttgtatacatttatctgtctatctacccatccgtccacccatccatccatccatccattcatcaattcacccattcgacaaaagtctactgaacatgaacatgtatggagatgatcatcctgcatatatagatggcaagataggtttctgttctcaaggagtagcccataagctcatgccaacataagtactggctttagtaactcttcaaaaccccgttgtgttaaggagacttatcaggcccagaaattctgtttctagatatatatccaaaagaactgaaaataggtattatgtgttcatgaatatgaatagcaatattatttatgatagctcgaaggtagaaacaatccaaatattcatcaactgatgaatgaataaacaaaatgtggyatgtacatgcagtgaacattagtcattaaaaggaatgaaatactgatacatgctgcaatgaagttatctagaataggtaacttcatagcaacaaaagcagattgttagtttacaggggttagaggaagaggggaaaagagaatgactgcctaatggattctgggttttcttttgggctgataaaatgtcttagaattagatatatgtcgtagttgcacaacattgtaaatgtactaaatcacagaattgtacaatttattttttaaattttaaataggtttgaaaattttcatcctaccccaaatgtcaaagttcctctctatgtacaacttgaaatgcttaattttatatgatgtgaatttcatctaaactaatgacaagaaaagtaaatgcctgtgacactgcatttttcattgacagggttcctcagtgargggggaaaaaagcatttaatgattttcaaatgacacatgtaacctaaacactataggrcagtgatatttgcctaatctagaaccttctaccaggttgtccaagatgtgcccctagagaatatagcactcaattaatagtgttggatgagtttatttacaggtaaagataattgccttgtgtttagagggtgccatctggcactcagcagccaggatgattccatccaactgcctatatctggtgatttcagggttaatttccttttctgcttcctgatcatatatgagctcatacatattcaaaagtactgtcaagtgtctaggattagcaaagtgggggtaaaagcaatgaaaattttagaaatctattgctgaaaagcttacaatttggataaagatcatcacttttgaagatatgtttacaccttgtaatgagccttttagctttgctctctggcttgattcccaaattcccagcattgattcccaaatctaacaagttatttggtaattgtgaatcactgatcaacaaaaatctaccatcactcctgagaaaggaactgaaaaatgcaggccatagcragaatcagttgcttctttcttatggttacaagatgccatatcatatgctataaaatgtctatcggtaatttttaaaactgtgattattatgagtcaatagtagtcatttaattatgtgctcttagagtttatttaaaatttattttcatgcactaaaatgatttggagatacaaatagtgaaaagtatatttcttgtaatgtttygtagtaatttttatttggtttcaacagtcaatgaaaataggttaataaaatgtctagtatttcataataacctactgtgtgttacatattayaccaagaagtttatattcatttccttttaaatcaagctcatggtgtatggactattatattatctccattgtatagaagaaaaaattgaggcctagaaagaataagttattttcttctaggccacaaggctggtaaatatcagagacaggatataaatcttggtctatttgactcacaaaactgtattcttaataattaagcttttaagatgtccttttacacaaaaataggaaaagcaagtaagataccaataacatttatttaaaatgtgaatgcatagtaagaaaagaaatatgtgtgtgacagcatttttttccaattttccatttggccaaaccagcttttctctaaaataatgagttatgccaaatcactctgctaaaatcaccagattgtacaaaagtaccaataaaatgaaggccatagatacagagaacaatggatttaatttaggccaaaaacaaattccagagatcattctaagtcagtcaactgagcactttgagaaagtttagcttataccaactacaaacaagcagatttatctctaagaaaaagaaaacaaaattgtttccatcttttatttcaatttaaaagctaagatggaatattaatattgcctacttctgctttccttgtttaagcactaaaagaaatcaagcagtcattggaatgttttcttttttaaaagaccctttaactatatgattttaaaaatgtctgtctccaaaaaatgaaaatcaaaacacatagccaagagccaagagacgaggaagaacattctcatatcttttcagcatttggaggtggtggtgattgtgagcactttagactgagccaacttgacctaatatgacaaaggaccagagcttttggttatggtattcatcagcttcctttctcagcatgcataattggcttatatttatgtcattgttgctgtacgattcctacagctgtataatacctaagaactttacttattcaccatctcttttttcctctgccataggttgagctctgttaaccttgaatccgctgtctcctatcctactgatggaagcattgcagcagctgtagaagtgtgtcagtgcccaccagggtatactggctcctcttgtgaagtaagcttgcaagaatgtatccttagtgctttcaaagttccctcaacattgctttcaataacctattctaataagagctgttttttttctatcaataattacacaaataatktgtatcacttaaaaacaaaacttgaatatctaccaaaagctgtggctttcaattagagtattaaccacayaatttcattttgtaactctttctctctgagatattttgcctataactgaaaatctgatgtttctgtctttgctacatatttgatctattgtatgctggatggtagcagaatagcacttcaaaatattttctcttcattttcatcataatgttatccaaaatttagcactctattttttttttacttttctctcattttttaattctgtatcacacttttcctctacttcatttctaagaatacaaccaaatcacaatcatctgaagcatataatcttcagaatgtcaagaatataatatatggaaaaaataccttgatatagaaaactgcctacaggtctttgatttgtttagcacctaatgtttgagatatttattgttgtckcaatatcctagatttataataagattaatggttcttacttaataccgcagtgtgtcatcctaaggtaacaatttttatttgcttctgtgtattttcttttacacagaaaactggtgtgaaactggttttacttgaaacctggtcaaaaaatgtgaacactatttccttgacagagcgcatggctagcagataaataggagcttagtttctttaaaatggtgcctttaaggaatcatttgagtgtactgagatgttccacttcagaacactacctcattatgccatttatagaaatactctaggcattgctttgtcagttctctcgtacttttaaaataatgcatacatctagagatacgcattatagtcatattcatgacagctgtgtttcctttaactgagctcagattcacctttctagaaataaaactagatataacttatagaagtacttgcttttccaaaattcatgtagatgagagaaaaataattatggatatcaattagctatgtcaacccaaatttgattttacatataaaatacacaatgtatttgatgaaacaagagccttttgctcttgattccaaactatttgaacttttaagatcctctctcaattggcataataaataacttaattctactcttgttttaaggcttgtttccacatactttgttctcatcctttgcattatcttttatacaaattctaagtgcccactgaatataaaattacttgaatattacaattgcttaattggctatgcttttagtctcttccttctctccttcaaaaatattttcaayacattctagatatgtttgataaattctgtaaatttacctgtataaattattaataagtacatacaacataatccctgtcctatctgtttagggagacaataaatatctatgaaaaatgggatctcagcactrtataattaagggagaggtatgtgctacagaacatacatgcaataatcattcaaagggatgagctactgcagtggagagagatgcaaagtgtcctggagtggagaaatcttaaattggatgctaaataatggtaacagatagatagaagcatttgagtgtgaaaaaaaaaggagagataataaaagcttcctgtatctgtcacacaataattgtttgataaataaaattactttgtaatccataaaagaacttaattgaatcaagagacaatgaattttggaactttggattttctctctgacttcttcatttcttctactctctaaaattcattttttccttatcaaaactttctgtccctaaattcactattattcagtcctatcctttcattatttcatttgcttttcaattaagtgtagtttgtaaggccagtcattctagccttgttatcactaatatcctgggatcccttaaaagctgagtaaacgccaaagaccattaatgtcttaattccagcttgctgagaacctctggccaaaaaaggatcaaatgactccattgtagacattctcttttacttcatttggggccayagtgttgattcaggatcttttttctcatttctacttgacttcttgtgaagtgttctgcagttaaatctttcaaaaattttcttactttcatagtgctgtcatcatagatttcacttgacagatgagacaggggatatactattaaaaagagtgttatgcaatctcagtttcttcttccatgaaatgaaaataatattaaccacctcatagaattgtttgtttgttcgtactttcatttagctgactagtatttgatgagcgtgtattttgagacaaacaagaccctacacagggaaaatagtgccattaacaatacagatattgtccctgtccccaaggacgttgcactgagtggtggcattaacgatatgccagaaagcaaatagaaataaacgtgacaaattctatgaaggaaataaacagggtgaaataaacagggttctatgataaagttactgcaagtggttgtatgaaggttagaaagtctactttgtaaaagtttgtcaggaaaggcttcctgaggtggtgacagctaaatcgagtgttgaagaatgagagggacaacgatgtaaaaccagctgctaaggaagcagcatagatcgtggagtctgtaaggactggaaagaaggagcgtggctggagccttgtaagcaaggggaaaagtgggacaagaagtgattggaaaagcaaggccatgaggagatttgcacatatgataagaaatgagcattttattctcatggcatggaacatcattacaagcctttcagcagagtagtggagtagtgtaatctgatttacatttttgggttttggggtgttttttgttgtttgagacagggtcttgctctgtcacctaggctggagtgcagtgatgctgtcatagcttgctgcagcctcaaactcctgagctcaagtgatcctcctgcctcagcctcctgagtagctgggactacaggtgtataccaccatgcccagctatttttttttktttgttttaatagagacaagatctcaatatgttgcacaggctgatctcgaactcctgagctcaagcaatcctcccacctcagcctcccaaagttctggggttacaggcatgggccaacgcacccagcctgagttacatttttttgaagaaggcattatggctacagtaggaagaatgtgtcttaggagggcatgaataataggaaggagaagggttaatatgtagttgcagtggaacacagcaatgacagtagttgctgttaggatcatggcagggaatataaaaagagttagcatattctatatatattttgatagtagaacaaataggacttactgattcgagactgtatgtcaggggagagattaaagaaataaagagtttaagaatgagtcatagatgaccagtttgaatgattgatcagttggttgtggtgtcatttactgagctgaggaatagttggtgtgtgtgggggggtgggggcatggaatccatagtccagtttagaaattttcgatttgaaaacgctgtgaagtgtaaatgtcaatgtgtatttataatattcaggtcttaaattcagcatgtctgtctggtctagagatatgtttttggaaggcgtcataaactatggaactgaataaaattacccaggagaaagtgcaattgatttaaaaaagagagaaaaatagcccagcccaagccctgaggagctcctgacgttaagaagcagggtcaaagcagaggagacagcaaagaaatatgctagaaatttgggaagtgtgatgtcatgaagttgagaaaagaaattgtgggaggaaaaggagtcagctaggcccaaggctgatgaaaggttggataaaatgcaattgcagaattgtccatcgaatttggctgcatggaatttggtgacaaggacaagagcagttttaattgagaggtggtgacacaaaacagattagaatggaatgaagtgtgaaaaagaggtgaggaatataatacttgttaagagtagtgttactgaaaagaaaaacatagatgactagaaaagttatatgaggctaagaggacagttttgtcatttgtgttttgtttatttttgatggagacactagatcatatttttttgtgctgatagtaatgacccagtagaagggaaagttattactaatccatcagagagagtgaatattgagaagataacagatgctggaatcagatgacaagtggagtaatatttctttaggaggaaggaccccacattccccacatcacttgtttggaatgggaatatggcaacaaggtttggagatatatgcttagatctctggacttgttagtgcaaaggcagctttaatttttttctgtgagtaataagttaaaatcactggctaaaagagaggtgtaaggagttgggaagtttgaagaaagaagacgtggtatgagtactgcatttgcagagtattaaaacaaaacaaaaaaacttattaaggaaaacttcatgaatatctgtctgaaaacagtagattagttctctcccttttctcaacatccttaatttctacccccttatgaatatgtagcttcaccagcttttaaaaatgtatattacagaaggaaatcacttctataatgaatctagggaggcaaaaaatgtaatggggagaaatgggaagggatttaattgggagaaatggaaacggaacaggatagaaatttgacaattttgggttggttgtgggggttgaaaaatgagaacacatggacacagggaggggaacattatacactggggcctgtcggagggtggggggctaggggaaggatagcattaggagaaatatctaatgtagatgatgggttgatgggttcaggaaaccaccatggcacgtgtatacctatgtaacaaacctgcacgttctgcacatgtatcccagaacttaaagtataataataattttgaaaacaaatttgacactttttttggtactgttcaaattaaggggaaagttcattttattttattttcagatataaagtatcagtacataaatttttttatgtgttcattattgatgttcaaatttgagagtcctcatatcctgaggcagaaggaacatttccacggagcataacacaattctatatcctttattacttcagtggtttctcttctgttttctttttcaactggaaaagaagggcttttcatgatatatgatgttgtactcgaccatccagaaatatagtaaataacccacaagatgcaatttcactggagggtgatcataagctcttagagggcagcagtatttgcctcatgcttattttgcatctcatccattttgtagtaatccccacagatggaaaacttaattaaggatgatggggaacttagagcaggcactgacacagggaatctaagactaaaataccctgttttaatcagaattcagtttttatrtaataaagtgtttcacattttaaacaaggaatgaaaaatacaagcaaagttacagaagaatgccataaaataagctatcaagaatgtgagaaataaatcataaactttttgtgtaaatttgagaaagcataataggatggaggaaatttagcatgaaatacatgaattatatatgtgtagaaattagctgtgtatgtggtcaaatataagtgtgggtgctgcctttcttccaaatcatgtcaaagattttctggaaatgatgacgttaagggcaattagtatatgggcaagtgaacacattccagagaatcaaaattgcttgggatgacatcgggtactctcttaggctaagactatatgatgagtccttttatatcagctgccttttttacagtastttttcttctactttcctgtctgtgcttttttctttgagactgtcacatttcaattctttatatctctgctttattttaccatttcagaagaaacaccaagctaatgcttcctctaatctcatacctgccaataacactaaggtcagtgcaaagccccagtgtcaggaggaatagctctgttgcaatgtttcaataatggcaatgctttgacaagcacatttgatgagtttcctacctgttattttctgttatcagaaaacaaacacaaacaaacaaaaacacctttttgttttaatctccaagactgactaaagccttatctttctctcagtcttgttggcctaggcacaggcgagttaacggcactatttttggtggcatctgtgagccatgtcagtgctttggtcatgcggagtcctgtgatgacgtcactggagaatgcctggtaagtgctctcttctttggggatgctgattgacaaggctgaaatcacctcgacagatgctacaattcagctactaccctggggaccttaaacacttgagtcaagaagtgctttgacaaagatctttgtattgaactgaattggaactgagaatgctctttcatatgtgatctccctaatgaatatgaggaagtgtttattcatattaaatcaagaattaaattagaatcagatatatttttataaggcataacttctgattggaagtataactaccatgaatatatatggtttcactttcttccataaatctatgaaaagtacagtgtacttttaaaatagaaaataatttatatccccataatatgaaaagtgtaaaatataacctttatagtaaacataattaagttttcttcatgttgaaaatgaaaacatactacatatttttatttaaaatgttcataatttaactaaatgcatagtgtcatttgtagattaaaaataaaaacaatatgtaatacatattcaccagagctgcttctcctttgcaattaagtctaagctttaaccagaaaataggctttacaaagtgcaaagcactttccatcctgctaagaaaccttaggattggagaattacactgaatagaccattctgattaactcaagggcacattagttttatattgtctgacatggcatgaagcttgaaacaacacttctcctttcattagtcttgcagaaacacaatttaaaatggtgccaattaaggaggatattatactctcatttccctgaagaatttaaggcggattctgttacctgtaattcttaatgttctatctttctcttgctcattttcccccatttctcttctacttaaaagcttctgggaaaaatccaaaatgaaaattcagggcttttgtttcagtgtaatttggcatttaggtttgttgatgctctttcccttttctctatataagattttgtttaattgcattgcattatgaagcatgagagccttaatttgtggatcagtggatttttgaaatgacatttttatgaatagaaagactaagtgattttcattttaattatgccataagtcttttaaaatgtrctttgggaaaaatattgggttacmtttaaacacttcactaacatgcagtaggaaataatactcagcccaaaactgacatggaattgttttacttaccctaagaagacaaaaataagtatgtcataataccaaactcatgatgttccatatagtcatatttcatgaattcattaggataaaatcaaatcaaattttcatgctgaattcattaggatgaaagcaaattagtccatttgttgatgtgatatttctaaaactagaagccttttttaactaataaaacagtgtcattcagcataattttgagagaaggaagggagagaacagaccctactaatgatgcctagtttactgattttgtttcatgaacagggagataggaggtctccttcaaataacagagcgatcttgaggaaacagtggacatcttgatgataaagacagaatctggtgtttcctgaattttccatcatagctagtaaataggtgatcatgtaggatatactgactttcaagtgccctttctccaaaattgtattgataactaagtgctgatattccattttgagtatatgggttctgatacaatacacaaagaggagaatatttgaatgttgctcatcaaggrcattcttactgttcagctgaccctgcattttagcttcttgtttatttttcatggttttaacccascattaagtagcatggtttttagcatgaaaaataaatttataaatttataaagcttaacttgctttaaaatttgattataaattatctgaaaaatatttttggcaccagaacaaaatctaaacttctgcaatagtgtaggtstatatttaaaagacattttaactcaaagtccatttgaagtaagccaggaagtattcaatgtcacatgggaagatttcatgcttgcttcttctcatagttcttgtggtatgtaatgtgagcaaaattttgtaaagcactttcgtaacaggacacctgtaaaaataaccaatccatcagagtgaagcttccatctttttttttttttttatttccattatataggttgtctgatgcagttttctggtttccactacaaaaatacttgagttttaagatgatttttatttgatgaaacgtgacattagaaaatgtaagaactacatgttatttgtcttttaaatcaataattggaaataaaaaaccctctcaattatgcaagattttcagttgaatgttagaaataccattttcaacatgtttaaggcaaaattaatttttgattcaattttttaaaacccttaagtatttgaagacataattttagttgtatcagtgagataacatgcaaataattttacaaaaaaacaagcaattcttyagtaatagcttagtttagctaaacttaaaaattgaaaggaagtaaaacaaaaatcaaatcggggaaaaaatctttcttcaaatggatccatgttttgcacattaaatcccaatatactgcattattaaggcaactattcatagtgaagctgaccttaatgctatcttttaaaaagttttgttaaaaataaatttgagaaagaattttaaataacttagagaaaagmctgttttcaaatatcaccagttactacagaaatacatatccacatttagttgatgaaattggcacgtgatgtttaaaatttttcaattttctccatgtttaattatgagtcaagcaagcttctcacagatgtaatacagtagtgcattgtccaaaccatcagagtccactgaggccaaaattcatgtctgagctaagaggccatagccccggaggatttctatgattagccacagttcccattaaatcagcaatttcaagctgaacaattgatttttacctagaatcagctacaatttccattaaacatatgttattagtgctctatgactacacacacacacacacacacacacacacacacacacgcaatatcatgtattttcttaaggaaaataaagaaaaaatgaagtaagatttgyataatgaaaaacattaaaatgaatttcaatcatctttttgtaagtatgcatatgctgaaactactgtgttgtttataagctagatattaaattaactttcaatgctatttctctgctgtaaaattgaccatttaacatggaaaaattattcttgctggcagggagcagactaatgacttcgtagacctatttttggcaacatgttgatccctgacaccaaaataataaactctgatgctcatttctttctcagaactgtaaggatcacacaggtggcccatattgtgataaatgtcttcctggtttctatggcgagcctactaaaggaacctctgaagactgtcaaccctgtgcctgtccactcaatatcccatccaataagtaagtaacaaacttaccccatgaataagctcagcatccatttctgcaagtacacttttcatagcaaatatacacttccttttatcccatgtaaataaataataaacacagacatgaattttttcaggaaaattatatgaattttttcaaacctaagatatttaaaactatgaggatttctaagaatttgtaatttttttagctctagttttggtgatttaatttctaagagtagaactcaaatagaatttctacaccaattccaaagaacataaatattttatacaaacacatacatgtgcatgcatgtacacacctacacacagacacatacccatcttcataccttaataaaaggatataaatacagctaatttgggttctaccyatacactatttttttgtgaatcttgggcaagtcgtaaacctctcaaaaagtaaaatgaagggactgatttaactgacttttaagtacccattctatcccttctttttagaaaaattcgttgttcacctagaacaaccacctcttagagcagatttaaaaaaacaaacaacaacaagaaagaacacttgacttcctcatttccttaccttttagaggaatgctatatccagctgcttgaattcacattccctcagggcagcctctctcagtaaacagctaagcacaccccaaccaaaaatgttgttttgtttttaaattgggatacttttttttttttttttttttttgagacagagtctcgctctgttgcccaggctagagtgcagtggtgcaatcttggctcactgcaagctctgcctcccgggttcaagccattctcctgcctcagctggactacaggctgtgttgaataaaaatcaacaatttttactcaaaagtgattataaataactatacttttaaataaaaggaaattmttttctgaagaactctcttaaaggtgagcttagtgcttaataaggttcatatcgtattgtacactttccagctatctctaggcactgtgacaacactgacagagcaaaaattttcaatgatctttaagggaaatctgtcagctatagtcttttaatgtgtagatgtgatcaagtaggtcatacttcaaactcttacccagaatgcgcctaattaaaatggtcttttgttagattcaatgaatactataagctaaagactttgagataattctaacattaagtttaaatgttctccttgaaactgtgcttcctactgttaatccacatgaaatgcttatcctcccaatgaccttctttactcagaattttttaccttactcattgtttggaaaagaagagaaagcactactatttaataaaagcagactactatattctaggccaaacactgtatttggtattatttcaccttcaactataactcagtaaggtagatattattatcctcattgtatagattaagaaatgaaggccattagtagaaaaatggcattatgatgccaattctggagccagactctttggtttaaatgctgggttccatactttccagctgtgccactttaggcaagtcactgaaactctctgtgcctcaattttgtcatcattagttataataggactctcatagggttgatgtgggaaagacataattaaaatgtgtaaaccacctaaactgtgactggatatgatgaacccaatctaagagctgattgttattaacctgctcagagtcataaagtattaaagtatcagagttggaattttagttttaaaatccatgtgctttccaaatctctacggtctacaatgaagacttctttaaaaaaaaatacacactgcattttaagtgataacactaaaagcagtaattaattcattggataagtcaatttatctagcaaggttttgagaaaataagacattggtttaatgcaggggtcctcaaccatctatagcctgttaggaaccgggctgcctagcaggaagtgmgtggttggcattaccacctgagctcagcctcctaacagatcaggcaggcattagattctcatagaagctcaaaccctattgcgaactgcacctgcgagggatctagcttgtatgctccttatgagagtctaactgatgcctgatgatctgacgtggaacagttttatcccaaactcctcccctgcrtctgtggaaaaattgtctccaacaaaasaagtacctggtgccaaaaattttggggaccactggttaatgtatgttagtgatcagaacatttccagggcctaaggcatgagcctgaatgggctcaaaactgaagattctttaacaaccaaggatgttagagaagaggaagaaggcaagagagaaacctgttggaaaataattactataggagaacaaatgaaatatattccttcataattaaaggctactcaagcctatgatagtcataacatgacacaaaacctgcactttggtatatatgcgaagggttagatcacccaatggaagacctacttgtttgccatggctgaatggcattctcttaaccatcttcatttacatgaaactcattgttcacgactaacttgcatttgaggaaagcagaagtattgcatctggccactcgtattgcatctccttctcagccaagatgtcatgagcattagcaccactatcaatccagcagagctggctgcccattgcatcatgtgaattccagctgaatacatattagaattatataattgattgagtatgcaaaccckatggatttaccctcaagtctgaccaacattactataaatgcagaggaaacattagggagataattttgcttggataattataggcattcatgacccattgttgtctctttatttrttgtgcatttacttggataatgggttctaattgttgttcctgaaaaagaaagaaagtctgcaagcattaaaacacaatccatcagtgccaaagggattgggtttccagtgtccaataatattatttcctaaaagatgtatattctaatttggtataattaygttgatcctgatttttaaaaatgcatataacacagtgataacaataccagtaacaccaagtatttaatgattctttcattttcaaaatgttttcacttagagtaagcaattaataattattagtaaatattaataattaccaaattatcaaatattaatataaaatattaaaattagcaaattactaaataataattttacttctagcagtagaattgggactagaatagcaatttattttaaattccagctttcaatgtggtattttaacaagtagaaagagagggcagtgataattcacttagtttataaatcctagaagttttgtgagagggttataatgtcttttacatttaaaacaattttacatttaaaacaactagaaaattatcatggtttagttgcacaactgtgatgagaaaaatccattttcatctaacaacctgaaatgtttaaaaaaaaaatcactaaacaagacacttaatgacctagggaaactatcctttttaaaaatattttataaaaaacattactgttataatgtgagctagaaactctgagatatgaattgaatmtttgcatacaatcctgaagacgagattttaatttccacaggttattcagagaaaaaaaaaaagggagctaaaggttgacgcaaccttcatgggaagtctaaagcttagtgatagttttaccttggtgatttatctatttaatccctggtcataaatcttatagatcacaagcattttggctccaaatttcttagataatattgctaaataaatcaaatatgtaagaagatagagatagattggtataattattatgatgtatgaatacagagaagcatataatatttaaattatacatatatatcaacttcatcaactatttatggtgatcactatgcttggccttctcatcttgttgatgtatatattctagctataggttgtaactaggcagtaaaagttatctggagagaagcaaataacaatgtaactatttcgaatgtttatattctttaatttctggcatcacatagcttataggttaaataaaatatgaaagagacatgtgaatctcwgcctttgaatacttaggatgtgtttgaatatataatattattgaagttgttatagattttcatcagttatataataaaatatattattggcacaaggctggacagagataggacctcaataagttctatctactaatatcactgtaaatactactggtttgtgtgggtcaggaatgctgaaatttaagtttttgaaagaatgaaactcaaatttgagttgacctttgggctcactcaagagatcatattgaatgcacgttgttaaaattaatatagagaaatgtattccaagacaataggtaaatttaaggaaacawtcaattcagccatattctctagaaaattgagaatgctctagatgttttagtgctctttcctacacattgttttatgtgcacatgggagattatgatgggtcttcctggttccatatgccaaaggaaaaaactaaagttcagagaaattaagtgccttgatagtgattatacagcttgcttgtggcagaaccaatattggaactcatatattttgactcacctctctgtgcttcttccaatggggctacagtaatagaaacaattacagaaacattgaaaagaagcaaaaaaaaatcaatagaatttaatgtcagacaaactgtaaatgttcactgtaaaaatcagtaaatcttcactgtttggcaagagttatgttaattatgctacatagttacagttatattaacagctatgttaatataagggactagagcaggatgagaaaactgcagatttaattctttaactattaactaaatacctttcacgttaaatcaacatatcttawtttgtttaaaaatttgtaaaaaaaaaaaaaaggcaaagttttttaaaaaattaataagtcgtatctataatttattatggcaatatgctttcatactttttcagtataaaagggtttatcaaatcaatcatattattccattttgcagaatgggaaacaggtttagagaaatatatygttcaaagacatacttagaaaataaatcaagtctaattaagaaatgcaattgtggagattaaatcagatttcatagtacttaaaggtaattaaagaaataagtgtttgcttaatgattctcctgagaataagtaggagagatcattgaactgaagaagaaaatacttagaaacttcagaaatttatgacgctaacaccaaaatcatgaagtaaatgaattttttctttttctcctcttcctctcagtccctgccccttttcagttatgtgtgaatattctcattaccctcatctccagcttctccactgacattgtgtagccactcaaaatggtttctcttatcctacccaactgttcaagataataattagttgaaaggagtcctgatcccctgttgtgtatgcaaatacagaacatgccctgattttctaaccctaatgatggaagttttaattttatacccatgattaaaggagtgcttgttttatatcacatacaatcccaagaagcaattcattatattttatttcaaatgcatgacagttaaagacacacaaaatattctcacacattgacttaatatgtgtttaattttattttagagtattggattaactctctgtgggagcatttaacgttagaactgaatttcaggacccacagaaggacccacagaagaagtttccctaatgtctgataatcaggaattgttgagcttctattgagcaattgttttgcttttggcttctggctgctctgaatcatttacctgttgattgttcccttttgcattagctgtgaaaaacctcaaagccaaatgttgatccacccttatcaaatgaacatatgttataacatgcattttgaattctaaatacacccttaagtttatcttttttttagtatttttttctctttaaccwtgctttattcttaatgcacatattttgacagatagaattaaattctttttagaacaaggttaattgtttctctatgtatgcattcacatacataaacatatatagattgttgacatagtcacatgtatacacatgtatgtacacatatatatgcatacatatatacatgcttataagtagattataaaaataaaagtatatattcagccattaagagggattattttcatgtccagctttttattggttatcccaataacagcttcccctcctcccctatttgtggaaaatgcccgctgctcttggctttcttgtgtttcctgtggcgtggtttggataatccgggatgaagaacattttctgctggtgtggagctagccaaatagagttaaatgacataatcttggaatcacttgaggtcaatgatgatctcacaatttcctctttgtgtcacggaacaattagcttcatgtcttggccaaaattagtgctaagtgactgcatttgccaaggcaaattctgtagatgttttttattgtgcatgtttatttctcactctaattttatttttgttgttgaatgccatcttctgccatagctgtaactgcaattacagcaataagagagtgaatcttcagtttatgttgttgaaagaatatcaaagcacaaatacagatatattttatgagaaagttttatttggatgcgttatgtygagtatctatattactagaaacttaaacttacttaattcttaccagtaggtttcaatgacaattggttataggaagaagagaatatcacattaagaatctaaagtcctagatcccatactaaattctcctggaaattttgtatatgaccttggttaagaaaaactgtgcctgccctaaccagctcataggattttgtgaaaatgtgataaaattgtaaaagtattctgaactgtaaggagctagtcaaatttaacatatttttattgcctaatttttttctcgaaaaagtgttgatttttgtcagtgagcaccttttacttatgttggttttaactgacatgtgagtgtatttaagaatctgaaatctattttatgaatagctttaaagtgtcaaggccaggtgcaatggctcatgcctgtaatcctagcactttgggaggccaaggcaggtggatcacttgaggtcaggagttcaagaccagccyggccaatatggtgagaccccatttctactaaaaatacaaaaatgggccaggcctggtagcacctgcctgcaatcccagctactcaggaggctgagacactagaatcgcttgaacccagtaggcaggggtttcagtgagccaagattgcaccactgcactccagtctgggcaacagagcaagactctgtctcaaataaaataaaataaaatatttttaaaaatgtcagaagccttgtcaaccaccattgacaagagttatgataaactgatttaggattataaaaaacaattggtatggttttctttcaatcagtgtagtcccacagaggtgggaaacccagtgcttctggttggagtcagtttctcagtagatgatgagatagttacagaatgccaattttcaaagaagacatatatatgctacagagatgcagttctcacttttatgtctgaaaacagtaacagcaaatcaccggatgtggatgagaggaaatcctttttttttattttattttaacctgtgcatcttcagtgcaatcacaatcccgtcaagaaaatcacccatagtgaactgtctttgggtcatgcgtagcaaagtacaggatgctttataaaaggagattctttactcgcagtgcacacgctgggtatgtcttgtctgctgttcatcacagctaccagaactccttaatgtggaatctttgatccagataatatttataaattcaaagcatcccagaccagcctttatctccttgacccagcagattcatttagactttccactgagttgaaatgtttaaaatgatagacttacctggtcctaataycttgctagtatcccaaaaataggaagaactattaaatctttacagaactaccctgagttaagccagagaaatactattcagaaatagtgttcatgatctgatctgcaccaaagttaagaaagtatttcaaagtaattcaagtgtcaggagcaggatcaaatcaggacttggaatgtttaatttgttgttatgtctttaattcatttagccrtcaagcaagtctctattgaattgccctgtcatatataatagaaaacaaatctacttagggaaaacataataagagaaagattaattgagggcatttccctttaaaacrgtagcgcaacagaccttacagaattcaaaatggttgatggcccttcagagagccagtcgagaacgcattaccgtgtgtcaatcttggggtaggggttcatgtatgagaggtgcctctcacaaggcaaagaagcatggctggagtgaaacatgttgctgaaagctaaagctagcacctgagttctctgttggttcttcatctggtgttcagctctattgyttcagacccaaattagaaatatgtgcaaagagagaagtgaattttgaaacatgccagagggtatgagatggcaaggttgcttttgtttggttaggtttatgataagtttaggtagaatatgcacacttgatctcttctgaaagctttcctgaggattccatcagtgtgagggcatacctgcaaggaagcacatgccgcagcctgcacacaggcacgccccactatggcagtagctgaagaaggaagcactgccaccaccactaccacatactgagatttccaaaatcactaacaaatttctccaggctgcttcaaattcagagggatttggctacagaagaaagtatgtgaggctgcatatgtgccaggcctggaggaatttctaaaaagcagctatacatttccacttgttactgatgatcactactcagagcagtcraaagtcagttaataacatgtcacagggatactgctctccactgggctatattcacgtctgcagaaatagcaatgtcatttcatcctccattggccagacmctaatctctgtctctggggtgagaatgaccagcctgtactcttttgtcagagcagtagtggagagagagaaatgagaaaatgctaatgactttgtgtatgtccttcttccttgtccctgttttccgcaacaacatcaacatagctttagcccaacgtgccatttagaccggagtcttggattgatctgtgatggatgccctgtcgggtacacaggaccacgctgtgagaggtaagagtatactacactgtcttgcaaaatgatttctaccttgggagttataaaaccgcagatacaatcatcctttgcatcatcctttggagaaaaaaggccacactcaatgaggtgaaataaagtttctcaacgcacttgtcaaacaaatgcattatatttttgtaatttatttatttttcagaaattgcttcataaatcttcattcactcagagaatatctgattaatgttttaatcttaaaggttaagtattaacctacaatctttgtagaaagcattgctcaagtggaaagtcatgcactttaagatttatcttactgtctgtgtaggcaccatttatttttcataattagctttttgtccttaaaatgtagcttaaatgcatagttcatagttcagcaagtggttcataatttactttaaatatacttgaaaatagaaacaaaatgtaatttattatcatgatttatatcctcttctaattgctcctaaaccagtattttaattcctgttgattttactgggttgctttgcagcagaaacaagagtattattttatgtaatttgtgtgattatatttccttctgaaatgtttttgaagaaataattcttctatatattcagcctcagcataaaagtgatacaaacttcccccttgacatcattgccaaaaacaaaaacctccctctggtttcagcactggaaatagtccctgctgccacccttcctgggagggaggggtgcaaaggaagtgacctactttcactcatcatcactgaggctaaccctgaagagggctgtttctgcccgtcttttcctgtcatcttggcagctatcacccctgtttcaaccaggatgcataaaattaatgaagcaggagcctatcacccagagagaatttagctagcaactagcagtctgtggacaaagtgccaatgacagttcctagcagcaacaagtactatttgtgagtatggaagcatctgtaaattaggaatgaaagaaaaaaaaatgaaacaagcagcatttatttgcaatcaagaaactagatatctttaattgtgtgtgtgtgtctgtgtgtgtgtttaaagaaaggcatgtgcrtattacttactataataggagaacatatcattgccaagacagatttacatcaagtgcctaaaccccccagttcactacaggcaacctttttttagcaactggaaaatgacagctgctctgtcatacaaggctattaaatccacttatctaggtgagcataatctctgatgtacttatattgctttgctttatgtactatactccctatacatgttagacaatagtttctgaaccatctataatttaaaaccctacattttatttaacaaacatctgtttagcaactaccatgtgctgggtacaaggctagacattggatataaatagatgcattttcccatccttgccctcagcacctcacatctttctttaatgcaagtgaggatggttgcttgtattcttgggagaattccatttgaatagtaaaaatcaccaaggagagaaatacctgacagaaagtatgatttcctgtctaaaatctgtattaatctgattcagaagatggcaacatgcatatgcagtgtaatgaatggcatattttatctccagctcaagtttttccacagttgataccatatttttctagccagaatttagattagggttttccaggaatatttaagatttataatttcattgtatttatgtaagccaaaagaacaccttagatagatctaaaatatgagggaaacattttttgtttgagatgtgcctgttgaagtagaagagagggaagataagggtcagggtaaggaggagatactggttgcattaaaaatcttgtaatcaaaaccattctgtaagtgatttgtgtgatcagcttatgcacatcatctaaataagaccagaatttraaaactaaatcaacatttcccaaattgtagatgttcctggaataaagaattctgtgatcacatgagtttgggaagcatccatttgcatgttaaaagttctggcatgtcctacagtgtgtaattaagaaatctgttcaatttgtttagctcagcatttcctaaacttatgtggccataaaccctctgctttaactatatagcaagaatatatctcagactacagctcaggtgggacaagagttataactttatagtctttatcacaatttaatttctattttgagacccctttctctatatgtgggaactgtgaggtcttagaaacataatctgagcccatttcaagttgttttcttctcctctctcccagctwgaatcaaagttctattaagcttacctagtaccaaaggccttatatgcaagggtagaggggagggtataatgtctgtgtgtatatgttgagcaaggggacatgtgatagggccagccagtactgagtatttcacccaagcatgtttctgctgacctatccctttttctccgtcctcctaattacctttcctttcaggtctagaaagtctctcaactactttcattccattcttagaggcacaggaatcattcagcttctttcattccatgctaagacccaccaacatctctaccatcatcatttttccatctgcctttccaaatccatcccattttctatttgaaaaaggatgagctacatttgtggaactggtggctttcagagctcggggtctggcagattcctatgtctctgccttttgccctgtcaaatcccttcattcaaacatgtagcacaagatggccttgcttcttgaatcgagggggtgaagagaaacagtgaacaggggaatggccaaacaagatacaacaaaacatggattggtattctgtcacaagttgaacactagttacagcttggaaaacattcacttagggccaaaacaccactatttttgaggtatcactgctttgctggggaatgatttaaacaaaggaaaaaaaagagtcagagagtgaggggagaaggtattcatgatgatacctttgctaagattctagacttttatcatctggacaagaggagaayaaaaataacaaagagacagaatcttgaagggctaaaagagattaagtaagcaattggaatatcaagagcaattaaaaagactgttgagctaaaagtgagtcaaatgctgaggatacctgcctgatcggacactaagttactttcagaataagtttgtaacctcagcaacatgtcatacattatggagaaggcatttcaaaaagrcaggcaagttcatctggtggattctataggacaacatgaaacttaatgggatacatagacttcttaagcyctccccgctccccagctggcaaatttttaacaacttctccttaagtgatgagagaggggtcaaaagccaggactaatctcacaattgccactgaaaatgtggaaggtgtttgaayctaattgcttaatattttgaaaattcatctacagttttatcctcaagattcatactagatatcaaagaaattcctttttgtatcttaaatttcagttccaaaatcccatttagattttgtctgcttcagaatgtctgaattcgaatcaagtctaatcacccctctgcttactatgctcatgggaccttctattcacttgtgagtctccttgtgcctttgggtcctgaatgcagagcatgggctacagaaataacagaggaggggcagttatacctacctgtagtactgttagcaraattgtgactccagttgaggtgtcaagaggccactcatatgtggttgtgcagtttgtacactgcacaaaggcactcagggaaggggaagattgagggcttgaatccagtttaccctcttcttttccatgaagtccctgggtgtctagtctgtttactttttctgcatatgtctagaaaggacaatttcttccaacttgtaaaaggcaccatktgagcagggaaacaccctcagtcttttgctgattatgtcaaatgggaggaagtaagaacacagcattacagccacgmctctttatacagcagccaccctcttctgtgcctttgccaatacgttccctctgcctggaagattgcagccctttcactcctccayccgagactaactaatccctgttcagctcccaaaagtcagcactatcatcctgaaaatgtccttgattgggcctaatctgagttggttgcccttttgtgtgctgccataatagcatttgcatatctccagttgttctactgctacgttttaaaatgtgtgttcattctccatggactgtagtgtgaagactgtaccttatttgtattagtaccgtgtaaaagtgctcagctgattttttttaatgggttgggagaaaccagagcttttctaatttgcttggctagattaagccagcattatattgtttcattgttttcagtgtatagataatagaaatgtaggccgtgattttagccaaaagttgctgaaaaaatgatggggcagaatgagacaaaagtctcatcagtgtggttgctttcttctcattgttgcttgtctgcacgtccgctctttttctacctctccctctctctcttcctctctccctccctccctctaacattgttcctaaattatcaatagcagcaagtgtaacaaataactgcatgtgttatctggagtcttatttacatttaaacggccctttttcaaaatattgcaatttgatttgaaaaagttaacagatgtggaaaggaacaatgcctttgttatgtcaagatrtccgtttctagcaaggcattcattcgataaactatttttaaaaatgcactcattctgccttgcatatgaaaatgagagggcttgacatttcacattacaattatttttggtggagtgaaaaaccaaaggactgtgatttaaactaattttaattaggtgaatccaacttgatcagactctaacacactatttttattaataaaagttatatgattagcagtattatattctctgaccctcaaattactttttaattcctaacggaacaccttcagaaatctctaatactgttctctgtatagaaacacacacccgtacaccagtaatgtgctgaagtgttgcagaaaatagtcccactttcagtaacatggcatatgaattttctatcacgtatattcacaaattttccttacatgtcctgcaagaaaaaataaataaaagacagatgcttctttagttattctatttaattatagttattttcctcctgaaatgagtttttttattatggagaatttcagtcttattaattgctatctaagttaagaaaaattcccagatctcgttatataaagctatctctccaaagggcagtaactcatcttgaggaaagtgagctgaaaataataggttttcgtttgctgtgataatgatcattgtatatccttattccagtggcacaaagtcactctcttagtggtaaacaaaatgagatgtgaatatatgtggatgtgatcataagctctgaatattaaataagacaagaagaatcaggttaaaattcaaaagaatctccttcttatctttatcaaatgcctctcttgaagggattttgggggaattttgtgcactcaaattttattgcatattttataatacagaattaacaaacaattatatctgtggttggcaatattcttctaagcagtatttatacaactcataagtgtataaaatcttttgtgaatataagtaatttcattttaaaaattatgataaaacatcaaatctatgaattatagtacctaagtacctatacattttctagaaaacttagaatcatcaatgtatctgcaccaaattaatggctctgccccagaattgggatttgttaaagtactctcaatataatgtactggatttaaaccatttttatttcaaatggtagagagcctttctctaaataatgactgcatatctgtgagtagatgagcataaaagtggtgtactactgaggaaattatattctcccacattgtttttgatccccttcaattttgacacttgctgcaaaagactttatcttgrtaagatggcaaagataacagagctagcctgaccataagattcagatgccctgttctgtttctcctttggcaaatgtggcttagtataaagtgtgagcaaatgtcattgaaagagaagacagagcagaatataaataggcgctgcctataaggacgtttctgcacacctgtagcagtaagttgcattttaaaacataacatttaggtcagagaaaatttgctgctatcgtttttaaaaatcttctttgccatgccctataaacaaacttttgtttttccaataatataatatattatataaatagttttatattatattatatttatataatatatataataatatataatatattatatttatataatatatataataatatataatatattatatttatataatatatataataatatataatatattatatttatataatatatataataatatataatatattatattatataataatatataatatattatataatatataatataaatagtttttggtaagaaagaaagagcaggagacaaagaaagaaagaaaacagagagggaaggaaggaaggaagggaggaaagagggaaggagggagagagggagggagggagggaggaaggaaggaaggaaaggaaggaaggaagggaggaaagagggagggagggarrgagggarggagggaggaaggaaggaagagagagagagaaagaaaggaagaaagggagaaagacctggagtttgctaatagagttggcaggcacagttcagtatcaccttatggcatattcctataatatgcaggcatgctttctcagacttccctttagtaaagccttcaatgaaaatttgcctctgaattcatatgcaaatacatacaaatagattattaattcagatatacccacagctcccatccaattaataagaatcttctgagtcacagtttctagttaataaattctgaactcttattactgaatttccttgcgagcctgtttcctcataacaagttctggctgcaacaacaacaaaaaatgtgaaccttacatatttgtagagaaaataaccaattggagtagagacatatgatgtgttgtactacaaaggctttccaacatggacctggattcctccagagtgccagcagcagattcttattatgctttggtctcattttcagtgccagtgacaagattatatatttttttcgggctgaaatctaattactagtgggctggcaggatatcatcttgtatctacactgcagttgtagaaaaacatttttttaatcaygttgcgtttgagaaaaggaacacttaaaaggaaaatccatcatcctgggagaaggggagaatgaaaaatatgtaaacattgccccaactgaggtccccccaaaggctcactgatgaaatttcttgccttaggtgtgcagaagrctattttggacaaccctctgtacctggaggatcaygtcagccatgccaatgcaatgacaaccttgacttctccatccctggcagctgtgacagcttgtctggctcctgtctgatatgtaaaccaggtacaacaggccggtactgtgagctctgtgctgatggatattttggagatgcagttgatgcgaagaactgtcagcgtaagtcctgaactattgatgcccctgacagaaytgatgtattgtacctcaaagtagctgatgagttcttgagtgtggattgaagagtaggaaattatgtggaatacatggttgatagatgcatagaatatacagagtctgcatattccagaacatttccttgtactaactaatagagtaaatacctttaaaattgctgtggtattgaagcatcactgttttccaaatgataaacatgtttttatttacatgcggaaggaagatttttttaatgaacttatgtccacagcaggaaagaagaatttgcatattagatagacaccatgtatccatttttttatctcaattctaatcacttgctttaaataattttttctgcccatgatayttcagtagtagccatcagaaggtgttaatcagttatgctttcatatgttaactttacagtgtcgtattttgtaataggtataaaattctgccaatattttcgcacacaggcatttgtcattgttgaatgattaacctcattttagtttcataatagtcatttaaggactatttctagaatgctctttcagtgttttccttccacaaaattagctactctagggcttcatccatattagtataatacatttctcccctctttaccttttttgctgtattaatactacatagaatttccaaatccttaatgtcagtgggattagaatatgaaggcggatcttgttgcagaagatcaaatggaaagtgaatccaatgttagcatttggccatcatcagcttcatttactatcataatgtttaagcagagtaggttatgagaccagcctatccattcatttctgtcaaatttatgtgagagactcttccaattattcaggtgggtcccaggacatgcagaattatagaaaccactgtaaatgtagcctattatcaactctactgtaagcaccaaagacccagtagggtaccctatttcattaagaaatgtgtctctctcatcacaggtttagaagatgagttctagctttttgttatttaataatgataattcrttgaatcaaaaccaaatcactttctggaccaactggcagctgttaatataacctgtaaattgatctttttttaaagcaaaatttccaacagctcagtgcctttaaacactggattcctgacaaatgtataaaatcatagaaagcctaagaaattcttcctttcccacagatcatctaggatctacattttctagctgtgtgctcctgagcaagatatttgacctccttgagacacagttttctagtctacaaagagagtcatgaattttctgtggggactaaaggatttggcacatagagggtatccagtgagttcccargtcctggagatgctcacacatggtagctgtctttggtagcagtgctcatagtagctgtgcatatcagttgttcaccagtgaattctaaggctaagttagtcatttactgacattttatcctgtcttccaataacccccacccccataaagttagggatattattccactaattttattatggtaatttattgtgggattattttattatggtaattaattattattttattatggtaattaattattgtagaaaattattatgggattattttattatggtaatttattatgggatccatggcatgaagtcttaagaacataaaaaagaatgtgagaataaaaacattttgaccattaccagttttcatactacttgccgtgagtatagatgtgattataatttttaatgctctttgccatataatcacaattaaaagtataagaagcacatttattacttatttttataatttttcatggatacaatatcacttctatgcataagtggtaaaacctcaaggaaagaaagttcctggaaatacattattttggttacctatagatttgttcaagaaaagtacaccactacaaagaaatatattttgcattttaaatttgtgtatatcgttggtgtcatatttttccattaaaatgacactttagcaaaactttatactgctttgttgtttttacgataacattaattaattaccatcatatttatggtaaatttaattttgtagtttacactccaagaaaaagtgactcctaaagtctaaataatttgatattttaaaaatgtatgatatgcataagaaactttcataaaataataaaagtatatacaaattcgataaatcagatgaaaatggatatttaaaggaaaaattttcagcctttccttgtatttcagctatagactatccgtaggctctttcagtttctcaatggcccttactctagtatccccttggcagacactgaagacaaactttgctggaagataaattaagcagtttttagaaaagcagttcttttgtttgtttatttgtttgttttttaaaaggagaacctagagccaggagaataaaatattagcataggctgatagagtacctgtttatagcwtaattttaggttgtgttcaaatcaaaatattcagaaatttaacaaaatcatctatgagtagcctaaattcccatgtcatctcctccttgtatttttattctgatataaatgcaattatatgtaccattaaaaatatagggtacatagtaaacaattaattactattctatttgtgaaaaggtcacttaagctttagactgatttactctacgttttagaataacctcagacagctttataacaaagcaaaaaagacaaaagattacttaaatgaaatatgttttgtatgtttggagatagcatataaactgtaaaataaaagtgattcttaaatgttataatgctatagtcttaagatacttgaaatgatgtttttgttgtcttttaaacttctgaatcttaaaaaaggcataaatatttcacctcaaaccattttttaaacttaacacaaaaccggcacacagtaaatcattaaatcaaaaaaactaactaaayttttctagattaatagtaacattaaaattttgccaggggtgctattaattttgaaaattcctcaaaaytattttagttctaaagtcagtatgcattacttacaatgggataatagtattttaagtgttaccctgatgtatctgtaaagaactaaaacagcgttacaccttgagtcaagaactccaagttcctgtcacgttctggactcacctatatgacacagcaggcatgtggacttgtataagctatggcttctttgaatttcagtgtcttcatgctcaaaattggaatgatgatgatgacattaatattttaatggcatatgatgggccagacatgatgctaaagcctttatgtkaattatccctacagcttgtagagttgttatagggattaaatgatagaatgcctaacagggyacttaacaaatcagaaaacattctgttactgaacttaggcgtccatgttaccatgtggggtatattattatttaacaagcctattaagactattagaaagttttcctgatcacaggtctctcttctctttgcagcctgtckctgtaatgccggtggctctttctctgaggtttgccacagtcaractggacagtgtgagtgcagagccaacgttcagggtcagagatgtgacaaatgcaaggtaaggagtagaggctgacccataaattactttctccttacagattttcactggcttttcatgacatgttttgtataccttcgtatattaaaaggaaggtttgggattatctaattctacaattgaaatgactgtgatcagtgaaaagtttttttcaaactagaacaaaattcattgtacattaccatttgaccttaaacatttttttttggcagtgaatgtgtattatattcgctttaattcagacatttctgaaacaaatagcaggcgaatttaatcttaatctgtggagatactctttcctttgcctttacatttttggcagaataaaatgttactcttggggctgggcgcggtggctcatgcctgtaatcccagcactttgggaggccaaggcaggtggatcacgaggtcaggagttcaagaacagcctggccaagatggtgaaacaccatctctgctaaaaactacaaaaatcagccaggcacggtggcaggtgcctgtaatcccagctactcaggaggctgaggcgggagaatcgcttgaacctgggtggcagaggttgcagtgagccgagatagtgccactgcactccagcctgggcgaccgagtgagactccatctcaaaaaacaaaacaaaccaaaatgttactccctttgctttttagcaaacaccttcttctagttccatcatttaaaagctacttcctgtgagcagtctacctaatggaagtttcagtagagaagttaatcaagatatttttaaagatgcattattttgctaaaacaaaatattcaattaaaatacarcatgttgttctcagtccctgaacataccgattgccctgctttcagtatggcaagcaacttcagattcctccatgagggtggacagatttgctctagcgctttcacaaaaatacattgtatttgtgataaagacagctaagcagaagcaagcatttctccgatgtcaaactggccttactgtaggaagtttgaaaatatcatctgcttctgtctctkgaataatatcattgctctgttttgtttttattttattttatggttggtttttaaagcccaatatgtggcgggatccagagaagcgattctgtgtgctatgtgactgcgatcccgttggctctgtgtcaccgcaatgtgatattacaggaagatgtgtctgtaaatcaggcttcgtagggaaacagtgcaacctcggcaggcaggtgcaccaacaggaggagcagccgcggagagcgcaacgggtgctgggttctcctcagaggtgggctatcggcagctccagcgggtgccctcggggagcctatcgggccccagctccggtaatcccagaggcgctgcatggctcatgcctctgcatgttgtgttctgtgtgctgtggctgaagttccctggtggcattttaccaaataacagttgctaagtgtgcaaattgcaaatgcaaagattagacaattcctaattgaacccttgcccttttaaaaataaccatccgtatgctttaaaaagcatattcaagttcatagggtcataaaactttcaattaaccaaactttcaattaaccatgaatatgtggaaatcaaataaaaatctacttgagagaacctataatcttagaaatggaagagacttcaggcaacctttggggaaagctaactttaataaatgaacaaatgaaggaaaatctagcagagaaattgatttgtccaagaaaactcagcccatttatcaggcatttcatcataattaagaattttgttaatttccacatcaattgtgcttatgtgtacaacaaaygcaagaaacacattttcacacactataaatggacaaatacccaaaacggggaaagttgtttctaattacaaaagtgtggttctcatatcacaggacaaaacaaaacaaatgctggggaagaaggaagagagggagggagggaagaagaggtcccaggctgagctgcagaagagtaggagacaagacttaccagtatagagtcaggacctgtagagaattgaggatagggcatagaagaaggagagatggaaataaaaagtaaagaagaagaagtaaaaaacaattcatggttttatttcttggctcattatcacacattttttaaaaaacaaattttgatgtcagactgccttagatcaaatcctggcctcattacttcctagctataaattccttgaatctttctgtaattcagcttcttcatctgtagtaagatccacttcagagggtttatgtctgcttacgtactccaagaagcaaatgccaagaggtttcctgggggaaaggccaacgaagcatgaagtgggagacagcatagccttctgctgcaatggggttctgactcccgggaaaacacagaaagaaagactgggtaggaaaagccttgtttggtgcattttgtcaaatcttaaattcttggccaagccaatgggatatacccaagcaaattttacccactaaaggaatcctgaattggtcagggaggttctagtatcttacagtaatcagcctgagagaaggatactcttgtggaagctcatcttaattcattcagagtgctataagagcataacatagactaagtggcatgtaaacaatggaaattcatttctcacgattctagaggctgggaagtacaagatccaggtgctggcagatttcctatctagtgagggccctctttctctagacagtcatttacccactggaacctcacttgggggaggaaactctctgaggcctcttttataagtgcagtgatcccattcatgagagctccattctcatgacctaatcacctcccaaaggccccacctcctgtctataccaccaccttgagggttaagatttctacatatgaattttgggggacataaacattcagtccattacagagcacctctgatgggtccaaaagacaagaaactggaggctttcagtcagtaaaattccacactgtaggttgtcttgcaggtagatcggatgaggcgcctccaaggctgtctcagggtagcagtgagaacagtgcatcaggcaggagcatagagagtttttagtaaatgttaggcctgattactattattattaccaatgttgttaaatgaagaaatgtttaaaataattttttttcaaaaacaaatgcatacatttacaataaaagaaaaagataataactgattaaaatgtctccwaaatataaatttagcagaaagtcaacgttcattcaagccctacatatcttacagtactattgtatgaagcagggttttgtcccgagactattttttcctctgcagcagtatgtgtgagagctgagagctcagactctggagccaacctagctgatctggaatcttgactccacaattggttagctcatgaccttaggcaacttacttaacctttctgtgcctcagtttcaccactcaataaaaaagtggtgagaatgacaactstctgccagggttgtcctgaggagtaaatgagtacatatttgtaaagagtttagatttgtaaagggtttagaattttagaattgtgctttgcaaaaaggaagcacaatatatgaatgctagttcttattaccccgagagagacacatttatgggaacctatmcagtttctcactgggtctggatagccactctctcccatatttattttacctcattaatctcaattactgaccatgaatgtctgctccttaagtttgtttactagtggggttttctttagcctttgaaacaaatttttgaacaaatttgtaaacattttattactgaaatttggtagtatttattttgctacaacttagcctttaaagctacattatttaaatatttgaaaagtgaggtagaaccgtttcttcttgtatatttccttacataatcgactttggaatttttaaaatgatagctataatttggaatctcatttgatatttgattgatttaaaggggtgtacacacacccctttaatgagtaaatcaatatgagagtgtggatatatagatgtaaatatatatgagtaaatgtatatatatatgagtgtgtatatatatatgtgtttatacatatatcggcatagatatatgagtgaagacaatttctgaaataaagatgaatacaaagtattatttctatgactcagatatttttcaataccgttttaatatattatgtttagtctttttgtctatgtatttctgtttctgtttgtgtgtctggtggtatgggtatgtaattgaaatttacatagtatttatatagtttcatatttttgtttaatttctatttcatgctatatcctaagcatatttatatcattaaaactgcttcaaaacaggattttaattcttgcatattatttcataatgtggatgtcatcatttaatttattcaacaatttttataacattgtacagttaagtgcctgcatagttattcaccatgataaataatattgtaataggcatgcttttgctttaataatattccaatttctgattatttctctaagccaggtatctaaaattttacatgaatttcttttactaataatgatattatatggttagttttttttatataggtgaatttaatttcaaagtcatgtcatctgttggaactgttacatgcttttttctttaatcatataccacaatctgaattagaactagaaataaaaataaaaccaacagtaaatgtaaagatgagaatgatcgtcaaactcagtcaacccattttacattttaaaaataaaactattcttagctacggtcattttaaaaatctaattttcagtgtgatttcacttttataacttatttttaaaactactaacaataatatctaaaatatataatgaggcttattaatttctctttgggtggctcacgttaagtggcaagatttttttttaccaagaagcaattattaagtctaattttccaaaataagaattatttttacaaagaagtaattaccgagaataattttccagattaaaatatcataataatgtgacatgctttatatttttaaaaaataaccctgaagtattttaagcaggatagatgattttcatttttctgctcggagtgattttttaatccatcagcattttctaacgtttcattttaagcctgataacatgcatttcaagaaagtcagccgaagctggtaatgcaaacttgaccgtaaaagatgatttgttatagatagataagagatatgcatatgaataactcatcagagaatgaaagtttacttacctgatctggtgctttaatacgtgttctcactaatcaatttcaattgttagaatgaaacctaagaaatcaaatgtttgttgaaccaattatttgatcagtgtaagcataacctgaaaattatatttataatgtgaacactatagcaatgattaaaagtatttatggatatgtgacaaaattctatcaaatattagggcaaaaaggattattttaactttaggctgctggtcaataatgttgaaagtatttttaccaagtaggagtccatagatctgaaagtaatcaattcagattactaaaaatgaagaagtaaaattttaaattaagactagaaataccacctataggtcctttccatattgctattgaaatcttgagaagtactgggacaggctggtgaaaatacaacagacagtaaaggaagcgcctaattctgcagttaattttgataaaatttcagaataattgaacttttctctttggatatcatagaaaaggtccatttgattgaatgaaaacccaattgtcataacatcagtgaggaatcctgataactcctaagttcctctgttcccacctgatctttggtattgtgcatcttgcttcacttcgagttaactgatttaaatttaatttttctctcctcttccattgccaggctgggacctttggcctacaatcagcaaggggctgtgttccctgmaactgcaattcttttgggtctaagtcattcgactgtgaagagagtggacaatrttggtgcyaacctggagtcacagggaagaaaygtgaccgctgtgcccacggctatttcaacttccaagaaggaggctgcacaggtctgtaaatatgacttaagtcctacatattcactctgatagttttagrgtctgacttctgtaacagtttgttcttttaaaggaagcacagattgatacaacgtatttaacataatgagtaatgtctacttatttttacrttacttaaaaaatgaaatacatgtcagtttgaaacactgccttaataactgtgtgcaagtactcagtaaaaatcagcagatgctcktttggttgtgtccctccctgtctgtgactttgattcagccagtcactcaaacactgctacggcttgaaagttaaatgttcgatttttctggtaccagtcttatcttagtttaagctcaaaccccacgccaatgcatttcaactttccctttttcctattgcaaaattggtatccggatcaagaaaagtcaaggtgttttttttttcctggtaccccaaaaacatcttttcatctacttttggctgccttgaaaactatgatgttctaagagagaaataggttggctctagatatttagttcatcaaaaaatgcaggcagaggtttctaaccatgattccctcaagcagtattcttatacatccagccacagccttcacccaaatcatgagctaagaaaatatcacttagcattctgcagatgaaagtaaagagtgaacattagccttgatttatatgctgctaatttcgaactgacccttattccaacaatcactagtttgaatattacctttgtttactaatgtcatggattcaacctggataatgctcacatactctcagcaccatggtaagattttaaaacattgttattcactgttgtggcaaatttaagtaggaagcagtaggaataatatttaaaactatttaaagaaccaatatctttcagacattctccagcactttagatatgtggattttaccataaattaagccatgataagttattctaattgataagttattctaattgataagttattctaaatgataagtttataattgtagatcctctaagaatctgtatatctctaagccaatatctgtataacttaaaaattataaagctgtattttaaaatatactctgttctttaaatccaaarctcactgacatttttacttaatatgaattaatgaggtagtattatacatttaaatacatatagtaacaaattataaatgagaccaagaatattattttaaattatagaaagatgacagcatttaataaatgcagacctactagcattctggcccaaagaaacaccatagaaaaaaaaaagcacaaaacaggaagaatagtaatatgactgaggacatgacttgcacaaaatagcctggatttgtctaaatggctccttcagtaactagttctgggaccttgactgagtaattttgtttcattttccatctgcaaaattcatctattaaattaagataataatagtatctaccacacatggtttttgttacaattagttgagttagcggctataaaatatttagagtaatgcctagcatgtaagtgctatggaagcatttatcattattattattatctttattagttttattaattgtgttatacattgtgctttggcacaggaaaactagctarttactcaggttttctttctatttagtgttatgattccgctgaagaactacttaagataatttctatttgcaagtaatgatttgcactgtcccatgacattttttagcatataaatttaaacataatggtaactatttttcttcttaatgaaggacacatctaaaataaatcatttggcttaaaattagcaacaacagyaataaccaaaacagcaatgactaacatttatttagtgtttactcggtgtaaagtatttttctaaacaccttccacagctggtgtgtaatgctgtgagcaatgaatattgtcatttcataaaaagtgaatttagtcaaatattctaaatatattcagtgaaaatgatttagtcatcatataaccaattaaaagtttactcataacattagtcttccatttgaattcaagtatttgggtttcttccctcacttacatttctttgacatgaaacgctgcactagaaatattcttagtagctgggtcaactgccgctatgtggcatgcattccttgtcttggatggctttgaagatattctcaaacattatttttgcaatctttgaaaaagtacaaaaggtagataactttgtacyctttgaatattgcatgatagcaacaaaaatgaaaaatctatagaaaaaagtcaggtggtaaataaaaatcgaaagtatctttatatataaacagtgtccataattcaaccattttaaagtatttgcaaaattggattattctgttgtgtgcgtttctaactatatacatgatgtaccgaatttaagaagcttattaagcttattrgtttttactgcagatcgggctcatcaaggaaaaactaatccgtacagcataaacaaattagaaatgaacttaaaataaatatacaaacaaaatagtaaactttgtagtacccgaatataaggtgttacagttaacrtggaatctgataacaccaattctttcctttcttaaacttcataggaaagctaaaaatactttaacttttgaaattaataaatgaaatacatcttatatttattgaacagctcctttctgaaatacattgtactataatrtaaaagatgaatgaagtaagtttttatttccaaatatccttaagtgtagaactgaaaagaaaataagacaaaccaacacaatataaaactcaacactttgtgtcaaatttttactatttttccccttctttgttttccctcttataccggtgaagcttgtgaatgttctcatctgggtaataattgtgacccaaagactgggygatgcatttgccctcccaataccattggagagaaatgttctaaatgtgcacccaatacctggggccacagcattaccactggttgtaaggtgagtgaaccacttttttgctctgataattttttggrgagatttttgttttgtagagctctgtaaytgggcatttcaaaattcaatattacatcacaaaataatgtagaagtattactataatgtgattacagatattaatcaatatcttacagtttacttgtaggaaagatgatgaagtaaatatacatttatgcagctgaacacttgaaatctacaagaggggtaaaaagaacaaarattctgtaataataccagaaaagagctataacctcatacctaggcacaaggacatacatgtgcaaagtatgaggatatgaggaactaattaattttccaaaaatctatagaaattgcccctgaattatgactaggttttaggtttcaggaagtagttgagatcattctgaagagtcattttaacaacatttagcttggaaaataatcattttttcccattggtagaccatagaaattgacatggccagagtcatgttcagagagatctatctagcatcagcagggatggtaacaatttataaggctgttgaagaaatattaataagagatgccaaaagcctggacccagtcaatgagcgtcagtgaagatatatagggcgcgagttacattttagaactcaggctgatacagcctggtgaattcattgatttggggaataagaaagagaagacttaggatgactcctaggttttgctttgcaatggagtagatgataataagtaccatgtgcagctataggaattataggaggaggagcaagttcaggaaggaaagataatcactttgcatttttatcagctttttgtgaggtattaataaaataaaattcacccatttatagtaatgaattttaaccaatgattacagtggtgtaatcatcccttgtgccccattgcagtgaagtccccatcaccccccatgtgcctactgttttgccttctagcattataattttccaatttctacaacttctkaaaaatagaatcgtagtctgtytttttgagggggggtttgtttgtttctttgtttggcttccttcacttggtgttacgtttttgtaattcatccatattgttgcatgtatcagcagtttgttctaaaaattgcttaataatattccatttgtgtaatgtacagtgacttgcttacctgtttaccatttaatgggtgtttgggtmatttctagtttggggttacaattttgctgtgaacattagcatacaagtcaaaagcatatttatggacaaatgttttctcttttttttcttaagaacactccacatctttgccaactcttggacttttaacccttttttaattttaagaattctgatgcatgtgtatttctcttgtttgcatttatttaatgcccagtaatgttgggaatcctttcatttatttatttgtcatttatacatcttttttgaagtgtttacaaagcttatgcccatttctattttgagttgtttgtttccttagtaatgcattgcaaggattatttatatattctggatacatgttctttaacrtatgttaaagcttgcttttcatatagattgctttttacctagtttcatcatctaatytttataaacactagcttattatctttttcttctatagtccatactttttatgttctacccaagaaagacaaggtccaaagatttctctcccatgttttcttcaagaagttttagagttttagctcttaaatgtaggtttggattccattttgaatattaatttttctatatatcaggtaatggtcagagctcactttttatggatacccaatttttcaaacattatttgttgaaaagactatcctttttcccattgaattactttgactcctttgtcaaaatctatcaactatatatatgtttatgcatttctggactcttttctgcttcaccgatctattcttatgttaatactagttaatatgttaattattgtagctttccagcaagtcataaaatcaggtattgtaaattcctcaacctcattcatcgtttccaataccttttgagtactttagctcctttacatttccacataacttttaaatttagcatgtcaattctttaccaaaaagcctgctaggatttggctgaaattatattgaattgatagatcaatttgggaagaattgacakcttaaaagtattagatatcccagtgtatgaacatggcataactctgcatttttttaggttgttataattttttctcagaaatgtttgtagtttttgatgtgcaagctttgcatatatattgttaaatgtatccgtttcatattttttatcaaaagcaaatgctgtgttccatttcagttttaaattgcttgttactagaatagaaaaatacaattatttttataccttatccttctatactgtaatcttgctaaacttattagttctagtttctttttggtccatttagtgagattttcttgtagataatcatgtcatctgcaaagagagatttacttcctttctaatctgtgtaacttctgtggcattttcttgtcctattgtagtaaactattgactagaagtggtggaagcaaatatccttgccttgttccttagtttaagtggaaagcattgtcttttataattgaaaatgatgttggctatattttacctgtaggtgctttttattgttttgaggatgccccctcgtgtttttagtttgctaagagcttttatcaagaatatgtgttcaattttgttaaatgacttttctgcatctattgagatgaccatatgatatttctttttaagctgttaatatgacagattatactgattgattttcaacatatcaatccagtcttacaatcctcagattaatcctgcttggccatggggattatccttttaaaattatgttgaatcctgtttgctagcattttcttaatgattttggatctacgtttataagaaatattggtatgaacttatttttcttgtagcgttgtcgtcgggatgaggtactgcaagcttcatgaaatggattcagaagtattccctcctcataatttataaaagcgttttcacaatcaatgaggtagaaaacagaaatactttagaggaacccaaaagctcactatttgaaaagatcagtaaagttggtaatattctagaaaggttaatcaagaaaaaagagagaagaaacaagcaatcaaaatcacaaataaaagggggacatcactatagatcctatagacattaagataataatatggtagtaataggaacaagttttgcctaataaatgtgataacttgcatgaaaagaacattccttcttttgcttactttgagtttaattttctcttgtgttccaagtttttttgttttttgttttttgtttttgagayggagtcttgctctgacccccaggctcgagtgcagtggcagatcttggctcactgccagctccgcctcccgggttcacgccattctcctgcctcagcctcctgagtagctgggactacaggtgcccgccactacgcccggctaattttttgtatttttagtagagacggggtttcaccgcgttagccaggatggtctcgatctcctgacctcgtgatccgccagcctcagcctcccaaaatgctaggattacaggcgtgagccaccgtgcccggccaattgtgttccaagtttcttaaggtgaaaccttagatcattgatttgtaatcctttttctctaatatgggcatttgatacatttttttccagaaactactttgtttgcactccacatattttgatatgctgtgttttaattttcacttggtttaatataatctttaatttattttggggataatgtttagtttctaaatatttggggaattttcaaggtatcgttactgttactagtatctagtttaattctaaattgttctgagaacataatctgcattatttcagaccttttgaaaattattgagatttgttttatggcccggaatagtgttcagtttgtttattataacatgtgcacttgaaaataatgtgtattctggagttgttggatgaaaacttctatataggtcaattatccttaacggtttttagatctacatgttctctcagttactgagagtgttggactataactttgtccgtttcttctttcacttctctcaggttttattcacatgtatttttgagcagtgatactaggtgcatgaacatttaggattgctatgtctttttgaaaagttggtgccttttgacattgtgaaatgtctctctttattcctagtaacattccttgttcagaagtgtactttttctgatatttatatagctattgcaactttctttttaatggtgtttgtgtggtatatatttttcacaccatcatctatttcatctccctttttagtattttaatgtgtgccttttttttttttattctgagacagggtcttactccattgcccaggctagagtgcagtggtgtgatctcagctcactgcaccctccaccttctgggctcaagaaatcctctcacctcagcctccagagtagctgggactacaggcgcatgccaccatgcttggctaatttttaagttttttgtagaaatgagatctcactatattgcccatgcttgtctcaaagtcctgtgctcaagtgatcctgcaaaattctgggattacaggtgtataccaccatgcctagcttaatgtgtgtgtgtgtgagagagagacagagagagagagtgtgtgtgtgtgtaaataacatatattcagatctttatttttcaacgaatcttaataatttggccttttaatttgaggagttaaatcatttccacttaatgtaaatattggtatgattggattaagcctgcactttgctatttgcttttgcttgccttatctgctcttgccttttttttttccttattgtcctgccttcttttgcattaatttgtataacatcttctcttgacttttggattattaaatatacctattcattttatttctttggttttgtctaggaatatacatctttaactttccagaatgtacattaaaataatattataccactttacatttagcgtaagaaccttacaacaggaaacctccagtcccctttcctatcctttgtactatattgtcatatatttttacttctatatattatacatctgacaatataagcttaygattttgatttcaatagtcaattatctttttaaacaagaaaatttctcctataactctttttccttgtgtatatcaattttaatgctttaaattcctttgtgtacattaaaattttcatttcatatcatttttcttcttccattaactacttcctaatctttatcattttattcctgttgtttcaggtctgctgacaataattttttccttttttttttttttttttttgttccagaaaggttttttttttttttccgaaratgtttttgcagagtatgtaatcctaaatactggtttgcagcaatttaattatgctttttgttttctttttgtgtgtttaataattattttttcatgggattagttaratctgttggccctgtaggattatagttttcatcaaatttggaaatgaaagttgtcagccattatatctttaaatatttttttgttcttcattcttattgtctctttctggaaatcattttttgtatgttgggccaattgatattttcccccatctcactgaggttcttatttttttaattatttttgtatctgtattttttatttctgatagtttctattgttaagtgtccaaagtcactgattttttaatgcagcctaacctgtttttaatccaattgagtctattttttattttaaacattgtatttttttatcttttaaatttccttttggacattgtatatcttttatttctctactatactcacattttttcatttattcttgaaaatataatgtttataaacattagcatttttaaaatggtcatctgcaaattccatcttttttattgcaggactattcctactgactgacttttctcctgtttctgagtcatattttcttgattctttacatgcctgataatttttatttggatgccagacattatatacttttcattgttgtgtattggattttattgtatttctttaaagaatgttgaactttatgctggcaaacagtttaggtagtcacgggtcacttggattcttttgaagcttgcttttgagttttgttagggaaggtgcagcagaacagtctgaaagcccttctactaagctgtgaaacttctgagaatactacctagttggttactatgtctctttactctggctgttgaaaatatggcttattccaagctttctctgggctgtaagaatttttgcagcctagggttttccaatgccattttccttcatcccatgcatgcacctatcagcattcagtcaatgactcaagagaacgcttctgcacatctctggaattacctttctatctaacttctttctttttgaacacgtattctatttgccatcataagtttcagcagcctcggcttcctcaaactccactctttgtctctcaactcagctataatgcrggctttgggtttaccctctctgtgttgcagcctagaaattgcctctgtacactgcttcatgtttttttccttctctcagaaatcacagtcctgtgcttcctataattcaatatctaaaaacarttgtttcttggtttgtatttttattttagttggttgtgtactttaacagcttaacaaagaagaataaatactgtaaaaactaagaagaggctgttcaaaagaagaatattcttcagtgcctaatgcaacacaaaggtcaagtaggattagtgctgaagttgttcattaaattgaagagcaataataagggcatttttttatgttagtgggagtcgttccaattgattccactgggttgtgaaatattggaacgtgatgaccaagtgtggtcctgtttgaccctatagcagtaccctatagagatgtaaactttttttcctgctgagttagcacagatgaaataatagactctaaccaccttcacatgtatgataaaacatttgaacctggtctagaatatgctgacctagaggaaaacaagcatattgatgattcttcaaggaagttcagatgtctgacttcaattagacatgtgattagaaaaaataaaaactggacaggacattcatttttctattgtcaatagcattattaagtttaaaatgcaagagagctacatttttagaaagaaatcaaaaactcctcagaatttcaaagtgttcttatgaatatgaacaatgctataagtgtctatgactgacttttgcattttcagcttcaaatccaagcatccaccatatcacttggactcaggagtaagccctagggaaacttacaagagttccgttttatccacagaatgctatgatatagccaaactctaattaaactcttgaaattgaagttgatacctcatgttcaagatataaatcaggataaaatacattccaagtttctatgaaaacgtagttatatgtttagtactatcatttttactgatcattagataattactctgttgactaaagttgactgaattttttgattactttaaaatcaccatcaaaagtctagacttctgaatcgagaaatacttcaccattatgaagaattacaaaaaaaaacaaaactcatagagcctgtatcagacaattcttgcattgctataaagaaatacctgagactgattataagaaaactggtttaatgggctcacagttctggagggtgtacaggaagcatagcggcatctgtttctggtgaaggcctcaggaagcttccagtcatgatggaaggccaagcaaggacagacttccacatggcaggatcaggagaaaagcagggatgccatgcatttaaacaaccagatcttgccggtaggaactcatggtcacaaggacagcaccaagccctgagggatcagcccccatgatccaaacacctcccaccaggctccacctccaacactggggattatattttaacacgagaattagtggggacatatccaactgtatcagagacctctcaagtaatttatttatgagcatgtgttttactgtttttaaaactgggatgactttaatttaaatgaacagtgatttgagatttatagcttccctttctttrtgtcatggataatttctctgtgctaaggtgtgagcatacacatcatttgggctgttaytgaagtagaatacgaagcctgccttctttcactagcaggggaatagtgagtaaattctctattgctaaacaaatattacctctatttatgatttaaatttgatgatggccatagtgctatctaaacacatggttaatggtctggtttattctccactataacttcctgaataaacttcctgatttggaaaggtcccaatgtctatttgtactgtcaacaattttgtaaaaattcatgctttggttttatacaattatttggataacttcatattttagttaaagataaagatgcctcacaggataatttaaatttattatttgattatagttttgataacatgattttctattaatacccgattatggcctattttgtttaagtgagttaatacatactcaaagcagttggcaaagaaaaactatgtaagtgaatatgtaagacatcctaattttgaaatttgattctacatctgatgttctttaagttacttggcggtgaggttagtgggttattctatgccttggaagctttgtccatatttataatatacaaataatcacattttagatctttgggtttaaaatatcttctagaagccgcccttattgcagcctttctactgattagcaataattagatagaaaaatacttacctataaagacaagaaataaagctaatcctgataatcatttttttttttttttgagacggagtctcgctctgtcacccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccgataatcattttaataacagaatctgggaagatttttaaccaaatatttgggcatgaaagacaatagaggaggaactggtgatcttggaaatgataatctcataagcaaactactgttagcaggaacagaaacataatactcctggtaatggtggatataagaattaagctgaggagggaaagtgtgagatacacagtgagatgcagccagacttggatctaggagtttggccaggtgctatgcatatgactttaccactgggctgtagatctgagaaggataatagaacagcaccaaaaagagttaagtcacaaagtgcatacaccatatggtggcaaactcagacagagagaggtgataccctttgtaatgccaagtcatgctctgcttgggagacagaaactacactggttttttaaacagtgaaatggaattgttaactggtaaaaggtggttggttactaaaaaaggataaaagaaagctataaggtgtcccgagtacaggtacagaagagcagctactccctctaggctgagggaggaaagacagtgaaggagttaagggctaagagagggcatgctccttctccccacttgcagcaaagctgaggttcagaaatctttcaagagggcgttgctgtcataggaatgtacagcctatggatggtcaaacaaaaccaaaaacaaacacgtcggagtttgtaggcaaatgcatgtctgtagaagctgcccaccgttcttggaggataggagcacgctgggctactgagaagccgacttcaaggtcagagcgtgtgtgcagaccaaagcaagtcagaagggtgcctatggagagacaatgtgccctcccaactaaaggcacacctgggattctttctgggccactgggctcccgtgctaaataatacaaaaataatgatgaagattctttttttttttttagacrgagccttgctctgtcgcctaggctggagtgcagtggcgcratctcggctcactgcaagctgcacctcctgggttcacgccattctcctgcctcagcctcaggagtagctgggactacaggcgtccgccaccacgcccggctaattttttgtgtttttaatagagacagggtttcaccatgttagccaggacggtctcaatctcctgacctygtgatccgccctcctcggcctcccaaagtgctgggattacaggcatgagccaccgcgcccggcctaatgaagaaccagaactcagcttggaagtgtggtgggccgccattatggacttattgggtccttccaaggcctctattgactaagcctatcattctgccaccggatacggagaaatgtctacggggtctacctactgtatcacaaagcagggtgaatttggagctcagaaacagtagatgtataattggcacagctggtccctgaaatgacttattccaagatcctaaatgacattttagaaattcacttggcatttttattaaattgcaagaagatatgagctctgtaaatcaagagcagaaacctttaaaaggataatgtaagacaaaaagacaaatggataagcagaaattaaagatgagagaaataaaattattcaaaagaagttaagattgcaatagggtaatgaaaataagcattggtggtatgtgtatacaataaaacttttcctgtaaaacaggagctgtgaaagtaggataccaatttgagaggtaaatacagcaagaaatgtaaaacaaaggaaaatgattgcagaagacattaggatattatagatttggcagagagaacagagtgatgtactttaagaattatagatgatcctgaaaaagaaaattgattaattagaacagatgtaaaaatcaaaaacaaatctgaagaagaaacagtactgaatcaaaacacaattatgttcccaaactgaaagaactatgttccagtaagttgatggaaaaaaaaaaacaaacccaagcttcagaaaattctagcaaaaatatgaattatgtaaataaagagaaaatcgtgtatacatcttgggcgaagaaaaacgttactaacagagacctcaaatcagaattgtatgcaagaataaatgccaaaaaacaatatactagatgttacttctcttcaagctctccttggattccccaagtctagtctgatgccctttgtatgttcacatagcattttggacttctcctattatataatgcttattctatcatgttatgctaacatatttacttgtctccctctactagaccgtaaggtatgtctccaaataaatgtttaaatgctacaattatgagataataaggtaaaataactttgtctaaaatttaatctttgagacaaagcagttggaaaaaacccatacccagcccctctctacctcagaaagagagaagacacattttctttctaattcacatagcattatggtttctggacgatcatatatttccataaatgcaggaagcaattttaatgtttatgttcactgatgtttcccaagtgactaaactagaatagtacaaagcctataacagatacatgattaatatgtgtttaatggaagcatagaaacattagaattaaaattttaagatatttcccataaagttgtgttaatgrttgctgtttttatctcctctataggcttgtaactgcagcacagtgggatccttggatttccaatgcaatgtaaatacaggccaatgcaactgtcatccaaaattctctggtgcaaaatgtacagagtgcagtcgaggtcactggarctaccctcgctgcaatctctgtgactgcttcctccctgggacagatgccacaacctgtgattcagagactaaaaaatgctcctgtagtgatcaaactgggcagtgcacttgtaaggtatgtgctgctracatgcagctagggaaaacctccctcaattctgtttccattgctcagttttaacttcattcagtgtttgttatacctgcttcattaagctaaacaaacagatggacaaaatctcattgccagacatggagttttcattgrtatgcatttgttggcataccgataaacactgcttttctagagcttattttcaacccaaacccacctttttttctagttggtggagatgatctattttcaatggtatagtgattttttaaaaaatatattagatttgcttcgataaggacaatctgggaggggtggcagggaagacagttcttttaagcatcatcagagaaaatcacagctaaataataaggcttataaaaaccatttctccaaaaattaatctgcaatcgctgtatactagaaaatatatttactgctgtggaagtttagtaaaatttcaacacatataaacgctgtcattacaaacagtgactatgtgcaaatttcagccctcattaatatggttaaatgatgtagaaaaagagccaattaaaaaggtaaaaaggatttttcccctcagatagttctgaaaaatcaattccaggataaatgcagtttaaactgtgtcagaggtatcttttcaagataaaatctrtgcaaaaagggacagaggaaacaggaagataaaatctgggtagtggttgttaaaatggccttgagaattgaggaaaatggcagtttctaccatcaagggcttcggccaataccgagtacaatgctgcattcttatatctcgcaattatgatcatatatttaatacatgttatgtgtgtatatatattacaataattatataaattgatattttaacctgctgcctatttcttacagcttacaatagcaccactgtttaagactcaatgtttttatgttgcttttgaaattttcatgagtctttcatattgctcagagcagaactgtagaaaatgtaccacttacatttaagaaacaatgtacaggccgggcgtggtggctcacgcctgtaatcccaccactttgggaggccgaggcgggcggatcacgaggtcaggagatcgagacaatcctggctaacacggtgaaaccccgtctctactaaaaatacaaaaattagctgggcgcggtggcgggcgcctgtagtcccatctactcggaaggctgaggccggagaatggtgtgaacctgggaggcggagcttgcagtgagcmgagatagcgccactgcactctggcctgggcgaaagagcgagactccgtctcaaaaaaaaaaaaaaaaaaaaaaaaagtacaatacctttagtcttatatctatttaaaaakaargcatttttaaaagatccatgaactcctaacaatgaggttaactacatgtgccatttgagatgtgagtctaatactcagtgttcttctgttttgttttaaattttttaaaaagagtatgctcccgttatgcattctcagggtgatttctcccctaactttgccgttataaactctgagggtctcttgtctttcctcagrtgaatgtggaaggcatccactgtgacagatgccggcctggcaaattcggactcgatgccaagaatccacttggctgcagcagctgctattgcttcggcactactacccagtgctctgaarcaaaaggactgatccggacgtgggtgagtagggaactgctgagccatgtaatggtataatgttagttcctgctggtgtcttttagtcaggcactgaggggtagtagaaaatggcaaaacatttaagtaaccttttcctctgtgaacatttaggaacagcaaaggggtcacgtgccattagagagttggagtaaatgcctttcttatttgttcttaaaagtagttcacttattgataaggaaatagatgccaagtgaaaaagaggaaccttgtccgggaagcattaygttttgagatgggaagagtgagggcaccagagcatgaatgttgatatgagctaacacaccaatgagaaccaggacttgtcacacattcattccaaccaaccttaggcaatcatgatttttggagtgaaaacatgttcatttttcattttcctttaactctttctacatttagattcaatttgtgttagtgtgaaaggctccagtgtccacagatattgtggctttcactatgtgaattagtcaaaaagatttacgtcctgccatgcttgcccactgcgtgtgagttctgttgcttgtgagaacatcatcagaatgggtataggaactgcagatagacatgcagttcgtaacttagttttaaagaaatgtccaaagcgtaaattcagccttctgctgtattttgaccccttgcaggtgactctgaaggctgagcagaccattctacccctggtagatgaggctctgcagcacrcgaccaccaagggcattgtttttcaacatccagagattgttgcccacatggacctgatgagagaagatctccatttggaacctttttattggaaacttccagaayaatttgaaggaaagaaggtaagcacaagaactttaatgtcaagtgagaacaagataaaatctttttagaatcacaccatttggagatttatccaattcctcattcttctttttattttgtcagttgatggcctatgggggcaaactcaagtatgcaatctatttcgaggctcgggaagaaacaggtttctctacatataatcctcaagtgatcattcgaggtgggacacctactcatgctagaattatcgtcaggcatatggctgctcctctgattggccaattgacaaggcatgaaattgaaatgacagaggtaaagttagtcattgtttggtgcaaagatacyaatcaatggttttgcattcagttttgtcatagtgatttctcttcttgttaacagaaagaatggaaatattatggggatgatcctcgagtccatagaactgtgaccygagaagacttcttggatatactatatgatattcattrcattcttatcaaagctacttatggaaatttcatgcgacaaagcaggtaaactctaatagaaaatattcaagctcttattttagagtctgtaaggaaggttattgacctacagatatcagrtaagaaagattggaaagtgattggttttgcagtataatgatagaagataaaccatggaggcttccctgtgacctggaagaagctactaccattcatcagaaaagaaaaatagcatgagaaacacgttaaagggaaaaaaaaatatggaattcactgcagacatagtgagtttaagatgccagtcataaattcaagagatcatatactgtagatcaggtaaaattaactgttgtggtataaatggattataaaagtgctgagaaagtgacctcttcacccatcaggggaaccaggcagggccaagttggtccagtctcctccaactgtgagcattctaatctgttcaccccagtgtgccatacaatgttgtcattttccctrtgcatcatgttgagaaatgattctgaatcactttgaaaaaaatcacacagaacagcaagaatgaatgcaatgttgtcgaacctacatgatgggaatacttcaagggagtattccgtgttttcttatgaccaaaattggccaaytgaaatgaggcttgttgggtctgacacttaggaccacactggtaacattcatgataccggtctcagtgtcctggggcagaattaatctcaagcttttaaagaaagaatgtgacacatgagcccaatattatgagtgtaaactattattttccatgaatataattgtaaaaagaaggaataacatattgtcaaaagtaaaaagatgattgtttaatttgaaagagtatgtttacagaacatgggaatggattagtaatgaggaaaatattgaaatataaaataaagagagaataactaatagaggaaccaggagacttccacatcatggaccctcatggtcatattctttgagtagacggttcaccttatccaatgggataaaatgagaaatcatacagatttaggtaagtttcataccatggaggcagaaagttgaactgagttcatataggagacctcaatttctctttcatgtcagtctctgttacattctatgagaatatagaatcgatatatgtttgtaaatagtcttatataataaattattagacctgcctaggaaagcaaaacagaaaaattatgaagtctctcaatggccaactaatgaatataaaaatactatttttcaaatgtttatactggaataagcacacaagacagcagaaaaycttttatttcatgcagaagatccataatgcttttctgattgatgtagagacttttagtaaaagagtaaattaaggaccaaaattcacttttatatatgtattccttgggtttccttttgatatttctcactataacaggagattatttttatatgaaataataaaaaaaawatacttaaaaaacrctgttatctatactgttaattattttagaatatcacatgtaaattaggtggcagaagccatagcagatttgcatgtcttagaaaatagcaggtaatttcgtgagtttgcaaatagattattttgcaaatggttctgtactgcagtaaaagagtttggtagtaaacagaacatcttgttagtggaactgatagaaacaatattgtcattcatctttaattatactttctttgcttctctcacaccaatttcaccttcctacactgtgacactttgtcttttttttttttcccgccctatgtctttttcttttgtcacactgttttacatacctcaccaaatgagatcttttggtttaagtgaccgtttttttgaaactttagaatacatttttcctaatctcagtaaaaactggggtcatagtctcacaatgctaagaacaaataaagctgtcatcagcatttgattttgtaaggcagtggaattgtggcaaaggtttttaaaaggtttgaatagtccccctaaagtaattaaaataaccttgtatctttatttattcaattataaatttaaatctcaaaagcagagagtttaagagtttatattctgtttgaggtatgaactttgtacattgtatcagtgctggcattatcttttttctttgcttttgtttccttttataaagtttaatttaaggaaatagcaacttttgcatttcagtagttatttaaatggaagctggagtttggccaaatccctgatgcaatcaaagccattgctctctaatcccctgaaaaaaaaaatggtgtattgcagaaatatttgttgttgctgccattcaagcttcacttgatttgtaaacacttgcgggtctgttatgtgcattcatgtgcaagagaaaggagaatgaagccagtagctcctcgggctataaaattccatggagatgccaatgcaaagttaccttcttactcccacagagagcccagagaacataagggagaagtttttcttgcagaaggggagtggtttgcttacagctcaccaccactgtgtgtacttacagggagcagagagtgaaacctgaattttaattgaatgtgtgtttcatcaagaccaatcttcagagtgcagattacaatgctagcaaagaacatgcattcataattcagtttcaataaaacctacctatgcttgttataaagtttatgactcaaactccttaaactcctggaggtaacttttatttgaagcaaaactattcattgtcacattttaaagtttatttcccaaacatgtttgtgttaccagttagtccatcataaaatagtcccagtttatggactacatttattttttaatgaaaagggtattaatatgttattttcaattatgattttcttttcaattataatgactatttcaccatcagaaaaggtgagttaagttacttgaaggaattatttaataaagttaagaaaatattattttgaaacattatcctcagaaagaaatcaatattattagattatgcgtgatcattattttctaggtggttttctaaagttcctgaaaggtcattcagagcattgggaagaagaaatttgsgatagtagtaaattmaaagcaatttcaccagtgcctgtacgaaataattgaatggggaatgaccttgggttgtctgtttgcaagaatataaatgtctaattaattggccgtgtctacctgaagccactcacattttaaaaagtggggggaatatctttataataacttttcaacaggatatcagacatccaatatactaaacttcttatgatttatgtgaatattttgctaatatgtactcttaacatttgaggaagcaaaaatgcaatattaggatttggtacatgagccccagaaatttaaacagcttcaaaacaatgttaattatcttgatttaatcatcccacaacttatctatgtatcaaaatatcacattgtttaaataaatatagttgacccttgaacaacatggtggttaggagcatcaaccccacctcatgcagtcagaaatccacatataacttttgataccttcaaaacttaactactaatagcctcctgttgaacagaagccatactgataacatagtagattaacatatatttgtgtgggtattatatattgtattcttataataaagtgagctagagaaaagaaaatgttattaagaaartaataagggctgggctcagtggctcatgcctgtaatcccagcacttcgggaggccaaagcaggcagatcacttgaggtcaacagttcaagaccagcctggccaacatgatgaaacccagtttctactaaaaatacaataattagctgggcgtggtgttgcacacctgtaatcccagctactcaggaggctgaggcaggagaatcacttgaacctggtaggcggaggttgtagtgagccaagattatgccactacactccagcctgggtgacagagtgagacwctgtctcaaataaataaataaataaataaataaataaaaagaaaaaaraaaagaaaagaataggaagagcaaatatattaagtggaagtggatcattgtaaaggtcttcatcctcgttgtcttcattttgagcagactaaagaggaggaggaagaagaggagggattggtcctgctatctctgggtagcagacgtggaagaaaatccccgtacaagtgaacccatgcagttcaagcccatattgttcaagggtcaacttatgtacaattattatttgtcaattaaaaacaaaaagacaatagaacatacttgaggttgacaaaaacgtgagaaggatattgctgtaggattgattgtttactaggtgatcttaactgactgtcatagtaatctaagtacattctcgctgtttctaggatttctgaaatctcaatggaggtagctgaacaaggacgtggaacaacaatgactcctccagctgacttgattgaaaaatgtgattgtcccctgggctattctggcctgtcctgtgaggtaagctacctcctactaacctgcttaatctcaagtcacttcaggagctaaatggaaatactcccagaagtacctttactgcatacatattcttaatctattttatttaatcttccactcacagtgtgagacacagtggcaagaggataatgttattgatatttagtacaaatcatacctgaagggaaatagttgatcaaaaatttaaagatttgtgaaaatatttaacaatcaggaattaagaatgttttaataagcctatttattatagctgatctattttcttggaccacttctgaagagttagagacatttaaactgcaatgattaggagataggattatactgggttttgaaaatatttttatatagaacacgacaaaacttgtacactaaatagcaggctgttccctttaacataagcttctcagggaaacatatctttgttccaacagtgctgctatgagtcattacagttataaaactatcttttttttttacattttaaaagtaattttaaaactgcttttcaataaacttgctgagatattctcttgtctgccttcaagattgtcaaatttcttaggatctaatttctataattgtgaaatattaataggaacagtacgacttaagggaggtggaatgaatagatgagaaactggcctgrgtttgaatctcgacttcaccatacagtaagcctgagaccctgcactgggtgctacacctctttaggctttagcaggtaaacaccaagtccctgagtaactaccactacactttcacctctcccgcagaccccacagtctgaagcctggcatgcatggggcctccaggactgctccagccctacagctgggattctttctcattagtcaggctggctggtgctcacagcataccagttagatattattaaatctccctcacctacagcctgagtcttatgaagactaaatgagctgttaatgttaaggattcatcacagcacctggtgtgtagatgatgtaagttttgatggttaatattattattaatgtaatcactagttatatacccatgtattgattcagttataaataattttatacatcttattttgtaaataggatttgagaagttgtattaagtatggtacatgagacagatgattccactaggtcaaaactgaagtgcaacttaaaaataatgagtatacatttcttgagagggacatggcatcatgaaaagaaaaaggaatttggtttcagtgaatcctacctagctgcactacttggacaggttacttgctctgtttttgctaaatcttgggtttttacctatacatcctaaggattgatttaaatggaaacgtatgtgtgaaaatccctttacaaactgacatgccattcagcttagttaccatcacatggattccatatagttcaaggaaaaagtttataaaataactgcaactgttttgtgacacatgcttaaaatgattttctactctttcctgtgacttctctgaagggcaatatttatttacatgtgtccattttgagctaataaataatcaagtaatccatctccttattaaattgtatttcctacatctatttatacacacactagtaaacttatactggtaagcactgcttatacagtaagcactgctctttccaatatacatatgtacacatagtgtatgggtgaaaactgagactgtgtggcacatatgaaatgartgacctttccagtgagcattgaagattttaaaatggaggacagaaagaatgtgagatttttctagacaagagatggaatttcctttatcccaggtagcgtttggttttacttttaactgtgtgcacttgatcaatgctcttaattgctgtagaccttcgttattatatagctatccaatctataaaatgacagattgagttgaagttctaaaattctctgattctgcaatattattttgctatagaaaatattctgtaagtagtcaaggttgacctttagatatcttgaagagaaggttattacagctatatttttctgcatttatttgaaataatactgttcacttgtgaacaaaaatgttagtagaatagcaaattattttcatgcaaccaaccttccattctggatttaaaatgttaaaaacctttcttcatatgattgatagactttttgaatagtacattcaaatacatgctttcccattaatttgagtcattttccatcattatatgaaaatgtaaatgagcacaaataaaacaaatgataaatgaaaatcaagaaaaactaagaatatgtacaaattgtcatctgcattagtggcttcaccgtcccatgactttcacttaagcatctatttacagacagtaattgcagtaatatcttagtagagagattacagagataaagacctatctctcataataatgtacctgaagtgttttccacaacccatggcctctaatccattatacctcttatttataattcatcttgattcctaagtgtaattacccaggcataaaatcttatcatcaaagcaagagctaagggcagttttgaaataatacatcccattccagtaacatatgctttgggtcatgaatacacaaagcagttcctctacaatatttttacaaaatgtatagtattctagagacatctgcatctacaggctattttatttcatgtttttatccacaatatggttgcaagtaaacaaaattaagtatcagttactgctaaaatatagccagttgtaaagactcttagcctttgcttgttacctgcactgttatgacagtgcaggcctggtcattaaaaatgttagttttagaaatgcctaattattataatttactatttgcagaaggggccagattaccttcaggagtcaaacaaaggacaccatttcctcaccagatttcttggtgttggagccattgagtttgttatactttatttaacctgtctttgagtgacattaaatataggttattgcccaaactgacctaaactgagctttatgcagttgaaaggttatatgcaggtaccattcttacttatgactttctttcttaaatatggaaaatattcagccttgcgtgtgcagctctctgcagtaatacggaaatcagaaatttgtcaatgatctctaggtcatgttttgatagtttcagcttctatcctgtcttcccatattttaaaagggctttaggcttgcagttgaatggccggtgtctattggatcgccactcagaagctgtcccttgtggctattaaaactgatttttttaaatctccaaataatttatacctatcgtcaacacataaagcccaaaaggcaaaatgtgaaaatagtcttagctacttacatatgcacacatctatcctttatcacttctgttgcacaccagagacccaaagtctctgttttcatgtacagacaagtgttgaggaacatggcatgggtaagttatgttataattttgtttacaaatataacctaaaacaatcatggtatctttatttttagtttatttccagcaaacatagaaaaaactatttgagatagagaaacctattgatttatgtatgacaattattaaacatgctttatctcaagtaatcctcagatccaccctatgaaaagcagaacctaccaytgattgagtgcttactatctcctgtacacttcctaatacagttacaccaacatcatcgactataatttatgatccccattttacgggtgagagaattgaggcccatgatcacacacctacacagcaattcaaacctcaatgaatctgtttccaaaacctaggtaaacttgtactcaactattatattatgcagtcatgtgctgcttaacgacagggatacgttctgagaaatgtgtcgttaggtgatctcctcattgtgcaaacatcatagagtgtacatacacaaacctaaatggtgtagcctactacacacctaggctacatgggatagcctgttgctcctaggctacagacctgcacagcatgttattggtactgaatacagtaggcaattgtaacataatggtaagtatttgcatatctaaacatatttawacatagcaaaggtacattaaaaatatagttttataatcttatgggaccactgtcgtacacatggtcctatcattgaccaaaatgtcattatgcagcagcacatgactgtacaatattcctacattccaggtgaggaaaccaaggcacacagtattcagaaccttactacatacaaagtggtgaaacaggaattaaactcgggtctgcctgattgcaaaatccatgcaaagatacaagatagagtgtttttatgagctccagcacaagcatctatttttattactaaactctgaagaaagaaaggagcgcagtgtgcagccctgagcctaggataggataggtctctacagtctgcttcattctctcctctctaccctcccacatttttgtgtaaatttaatctaattttttgatgaaacaatatattatgaaaataaattaaagatagacgagagcagaagaaaattgagccatgaataatttcaayagtggggaagagaactttggaaaagtttaaattagagtagaaatgggtaagaggagctcaggaaagtatttatttgcttttctttaattccccattgtgttccagawaggattttagatgggactcaaaaagtaacttttttgcttccaattccaacataatcattctcacraacttttgtctcagttcaccaagaggaaaaacattcaatattgacaaacaccctaaaaattatttaaattgaaagaatagtgcaaaataatcaaggaaaagagagaatttctgttttttttttwaaaaaaaacagcacgttttaagtttctaatctttgcgttgtcaaatactctctctctctcttttgctacctcatagaaatttaatccatcaggatacgaaataaatcaaaactaatctaaaatgttaaaactgaaagacactttagaagtcatctgagttaacctactcatttgtgggatgaggaaactgggtctcaaagtaacttgcccatatctctcagacaaaactaacataaaatcaaggcttccctattcattccttttatagtaccaaggagtggtatgcactttttatgtatttatttatttttttgagatggagtctcgctttgtcactcaggctggagtgcagtggccagatctcagcttactgcaacctccacttcccaggttcaagcgatgctcgtgcctcagcctccagagtagttgggactacagacacgcatcaccacgcctggctaatttttgtatttttagtcaagacatggtttcaccatgttggccaggctggtctggaactcctgacctcaagtaatccagccacctcagcctcccaaaatgctgggattacaggcgtgagccaccatgtctcgccttttccatgtgcccttttaaatgcacacatacacaacagagaataaggagcttgccagtgacgctgcgctctaattgtctgttagacttttctaagagttttaaaacaaactcgggcctcaactctcccccagaggaattgactccacctcctctagggctggacyggaccacagactcccactatgggcgcttgtctattgtgtcaggctgcctgtcggggaaaaccacagtaataggaaaaatgtgttgtgcgttagagtagacttcaccttagggctcgccttcacatttggacctacaacgctaaactgtacaattcctcgatgaggagtattacttcttgtgtttctttttcttctaagatttattttaaacttttgtttgagcttcaaggaaacttcctctcaatttgtgtgattttttacacaaatttttacagacagtaattacagtaataacttagtagagagattacagagataaagtcctatctctcatagtaacacacatgcatgcacctagcaagtatgtcaataacacaacaattttatatatatataattttatatacatatttatatattatatatattttatatattatatatataatttatatatataatatataatttatatattatatatatataattaatatatatattcaaggatgaaatccatgcacagaaaatccagttttattcagtggtcagcttgctaaagaattggaataacccacactatgaaccacttttaaatagatcttggtttatttcttcagttatgcttaaactaattcttcaaccatcatttccaggacttattcaataataatggcaaaaatgaaccttgctttttaaataatatgtataaactttattaaattatatgattatgtccaccataagacaaataagactcaaaatagtttgaatactattctcagttttatcagcttgctcaaagttgggacattattaaatctcattagaatttattttaggctgtgataaaagcagagagtctcttgattaagtgcttaattgaagtacttttgcattatccaaatcaaaataaacaaggagggtgctagctattaagctagatctttttaaggagcttctttgtatatttgtctctggactgtctaggccagaaccaaagggatgtggaggtactagaaagttcttaatctgatattttttctggcttagtcagcaatcacttttctttcatcaatgggcataagatttttaagtgaaaaaaaaaaattctacttaaccaaggtggtaaaatagtccccttgtaattctccatgggatttgaaaaactgactyctaccttttattcataaatcaagcaatgtctgcagctatgcatgaggagaggactgagcctgaaacacaagacggttytcatcttcgtgccagagctgtggactaccttccagaaagccagagatgtttgttgatacattttcataataaacccaaatgaagatggaagtcttgattttgcatatgtcagcttcactagaagttttctgtttgctttcagatttttattgcaaaaagaaaaaaattatatcagggaaagataaattttattggtggtctaatagtcgcaagacatgtacagcttttattattttggatttcttacttttatagtctttaaattatatcagtataaataatgcatccataacactttttatttagttttttgctgtgtttcattggacatttgctagttatccatcaagcacagtaaaagcagattttaggtgttaaagacattggaattatctttattccatatgacaatgttatttaaaaacaaacatctttttcaagaaaaatactctttggagctttttcaggctgaattgtatctacaaataaaagctttccttggttaaaatctgattacacatggatgccgcccgaacaccttggagaccaggaagaaatacacattaagtatcaaaatcggcacttgcgtttgtaagtgatgttgcccctgccgcaggtgggggaaggccagtctgtctttgcagcyactgaagagctcaagcgttgctaatgcagtatttctaactttgctgtcctaattggcttccttttctttcaggcatgcttgccgggattttatcgactgcgttctcaaccaggtggccgcacccctggaccaaccctgggcacctgtgttccatgtcaatgtaatggacacagcagcctgtgtgaccctgaaacatcgatatgccaggtagtcctctgagccttccttgaacaaggtccatgtgctcattcctctttacacatgctcagcatctgcatgcagaggccagctaaactgtaagggaatgcaactgtgtgtgtgaaataaaatatgtaagggaaaaagatattcacagattctgcattttaaaaagtaaggaaaaaataactgggagaaccactgagcatgtcaagaaatagaattttagcagcatcttagaagagcaccagaagacatacctatttaaaaattatgtgtgcctttttttctgattattttcttataaataaactttctataaaatttggaaattacagaaaagaattaagaagaaaaaattcacccaaaatgcaacataacattttaatgttttaagtatttcccaccaatttttacatgtgtttatgaataagatttatataacaccatggatgcagttttatgtcttgtcctttacatttttacctatcatgaggttgtattatgttgttagatattatttaaaatctttacgatctttgtttggatgtcccataatttacccatttcccttagaattgaggtagctcttatttttttatgtttctgctggcaccctgcactctctaccaccatctgcattagaacaatcagaacaatcatgtgttccaccctttttatcgtagtcactgtaagaaattcaggttgcccctgtcaccacttgtccctcaagctgtaatctgcccacagctcatctttgttaagcccatctcccacctctgctcaccttctgaaaccattctactgagccttgtggaactcatggtcaaaacaggcaaaataycccgcagaatcctcctcttccctcagtgttctcttcatcatgctctgactgaaacccaactctcactttgcatgctgctaccccggcagccctcttaaggagtagccatcacctttttgtttttttttycccctgagatgctgactcactctgtcgtgcaggctggagggcagtggcgatcctggctcactgcaacctccgactcccgggttcaagtgattctcatgcctcagcctcctgagtagctgggactacaggctcacgccaccacacctggatattttttttatttttagtagagacrgggtttcaccatgttgtctaggctggtctcgaactcctaacctcaggtaatccacccaccttggcctcccaaagtgctgggattacaggcatgagccaccatgcccagctgcagtcgccatcactttctttcactcccttcattcccctgagtctgaaggtgggggcaggttttcctgctcctcgctgccagtttcatattatccatcctcctctacatcagggtccacaacccctgggccacaggaggatattggtccgtggccttttagaaaccagaccacacagcaggaggsaagcagcaggcaaaggagcaagcgcagcttcattagcatttacagctgctcctcattcctggtattactgtactgcctgagctccacctcctgtcagatcagagacagcattagattctcataggagcacaaaccctattgtgaactgcacatgtgagggatctaggttgtgcgctcctgagaatctaatgcctgatgatcaatgatctgtcactgtctcccatcaccccaagatgggactatctagttgcaggaaaacaagcttagggcttccactgattctatgttatggtgagttgtataattatttcattatatattacaatgtaataataatagatagtaataataataatagataataaagtgcacagtaaatataacatgcttgcatcatcacaaaaccatcccccaatcctagtccatggaaaaattgccttccatgaaaccagtccctggtgccaaaaacattggagacgctgctctacagcacccagctttgactctcatgcttccctctatgtgccccctctccatctgcttgtcgaagtcacctactaacctttaaataccccacatcattccttgctgattttccctgtctaattgtcattttccctagcactactcctgtcatcattcttagtgattttaatgtccatgaacttaactcttccatactcttcactttcagtttcttgtgcctctctgktctccatttgaagcgtttttttgttgttgtttgktttttktttktttttttttttttttcccactgtgtcgtttctctctagttcacttcttctaaatacttccacttcaatgtgtgtaatctcacaattgatgcacacacttttttcttgttccttatctcatgctttcactgtagtaaccagcttaatagtcatgatctttcattggtattactgctttgcaacgctcatttccctggctactcctttacttattttttactcaagtgaactccaacactgtgagaatcctaccatctcctccatacctgcaccttctttttttttttgagacggagtcttgctctgtcacccaggctggagtgcagtgacgcgatctcagctcactgcaagctccgcctctcaggttcaagccattctcctgcctcagcctcctgagtagctggaactacaggtgcccaccaccatgcccggcttctttttttgtatttttaatagagacggggtttcactgtgttagccaggatggactcgatctcctgacctcatgatccatgattcgcctccttcggcctcccaaagtgctgggactacaggcgtaagccactgcgcccggccacctgcaccttctaagctgaacgtggctgtagaaaaagacaattgtgccatctaatctcaccttaaattcatgatccctctcttcaaatggaccctttgtgctgctctgcaatcatgccacttttctctcatcctttttcttttccacattcctaggtgattatttcatacctccccctccatcctcaagcctaaacctctcctctcaccccctcccatccttaccctcagttgatggtgttgcctcttatttcattgagaatttagaagctgtcagaagagaggtaacaagctcccactactgcatgcacccacttttctgcatctgtgcccaattattatgactcttttctattactttggatgaattattcttgtttccagaaaagatcacatcttccccctatgttctcaattctacccctctcccgcttgatgacatcactctggctaatctctcctccttcttatattgtcactttttttttccatcttaaaagcaaaaacaaactctcctgactcatttcctttctaagtaaccacttcattcttctccttccatacaatggagagctgtctatcccgtctataatttctcttcatccattctcctttgaattactaaaaacaggctatcacctcctcttctatactggattcaatggctaatctacagccaccagtgttcaccttactatatctaacagccatgtttgccactgtgaatcaccccattcttcttgaaaccctttgctcaatttgctttccagcccatggcattctggagatgttcaaattccatagtggctccttctcagctttcttcattactctgaaatctacatagtggtattcctgggactcaatccttggagcaatttgtttctctaactacattcattcagatggtgatcttacccaggcaygtggctttctgtactgagatattttgatattgacatcccacagtatttactattaagtttatgatttaattttatatccactcattactatggtgtggggaggtaatttttctgcagatatgtattaccactgtaaagaaacatttactgattaatatttccttttccccttgatacattattgtatctgaacatacacaaatttatttcatccatattaagatatgtttcagtataatccattttgttttacttaccttttagctcttattacaatgttctgcttaccttcattttatgttaacatatctgtaaagcaaggtcctttatttctcttctcttctaattaactagaygctcttacatattcttccagctgacacttttatgcactattttaatctcttccacaaattttaattacaatcaaaattactggaattttgattgtaattaaattagcctatttgtaaagaattgctatatttacactagtcactcttctctcttcagatattttatgtcttacagtaaactgttttaaggttgtctatatcaagcacgcatttctcatwtaaaaattctttctatgtatcttacattttcattttaatggtagtaaacattacctgttttgtttcaacatagtaaatgtactaactggtcattattggtaaaccttaactattagaataggtgtttttacatgtatttgatatccaataacttttattttagttctagaagtttatcagttgattcagttattgttawgtttaccattttttttttttttttttttttttgagagggagtcttgctctgtcacccaggctagagggcagtggtgctatcatggctcactgcaacctccacctcccaggttcaagcgattttcctgcctcagcctcctgagtagctgggattacaggcacctgccaccataactggctaatttttgcattttagtagagatggggtttcaccattttagccaggctgatttcaaactcctgacctcaagtgatctgcctgcctcggcctcccaaagttcagggattacaggcatgaaccaccaaacctggcctataatactattatttgcaaatattataattgtgctttcacttgtcaaaagctatatctgttataataataatttcatgtttttaaattgtctcccaaaataataagctttctattttattactgattttaatatgattgccttaagtctttcaccattaagtatgatgctgatggttagtataagaaaaacatttcttgtcatgttacgaaaactgctttctattcctagcttcttaaagatatcctctttcaatcaggataagatatttaaattactcatatgcttaattgtggagagtggagtgggaatgtagatgcatttaagaggtgatcatatataggtttttcaccttaaacagaaccataaatgatattattgactaaataaataacttaatattagccatccatgaattccagaaataattactatcttgctttagtatgctattttttcatcaactgcttgcctgacaaattcaataggcaatttgagaggaaggggttaatctatacacattcttaagcaagaattaaatgtatatgtcttatgcaatcttcactggcatttttagcacagttatatttgctttatatgattaatttagaagcatttataaataatgcagtttaatttcaattttgttaggattaaaattaccrtctttatactgtcctcttttgaccaattgactattatgactatttttgttctctaagaattctaaaagcatgtctattttctgaggaatccctagatgaagtaaaaaataaatacttccattaaacaaacacagctggtataaaccgttatgctccaaatttttatattttctttcatggaactcacaacttttgaatttaggcaactctgttcatctttgaaatggcctcatgaggcaaataagaaatagctgttattactcccacacagtaagtgaggaaactgaagcatactgatttctcttttatgtgcaatatggctctcagtttcatatcatatccattatacagtgcaatgccctctaccttggtatagtggcaagcatgaactctgcagtcagagtgccttgattcaaatcctggcttcaccccttactggtagygtgagcctactcaatttatttaacctgaatgaggtcttagtttcttcatttatataatgaaaacaataatagtggctactcacagagtttttgtaaggatttgatgaaatactcaataaaaggcttagaacattacttagtgcatggtacgcttcataaaagcaattatgataatgatgatcataaagatgataattaccatacacattatctaccatttatagtcgaagaaccaatcagttgataattaatcaaaaaataagtaaaaaaaattcatgtctagcgctatgctagattttcttactgtctcagtccatttcggatgttgtaacaaaatatcataaactgggtagcttataaataacagaaacttatttcccacagttctgaaggctgggaagtccaagatcaagtctccagcaaagtcagtgtctggggaaggcttctttcctggtcatagctgaccccttctttctttgtcttcacgtgttggaaggcactagatagctctctggggtctcttttgtaaaggccctaatcccactcatgaggctccagcctcatgatgtaatcacctcccaaaggccccatctcctattactatcacactgggagacaggatttcaacatacaaatttttggagaacacagttgttcaggccatagcaagccttaacccccaacatgatgatatttggagatgggcactcacttatcttgtttttctttatcttcacacctttccctgaaaatataaagtgcataggaaagaaaactgtagaaagctttatagactaaatattttaaagaaacccagatcaccttgtaactatgctcttcatcatacctaatgatacttgcaagataattgttgcttcatcctaggcattaataaatcctgtacataggcatgttattaygaatagctcagtgacattgctccttaagaaaaaaaatttttttgaagactaaaacctatgtaatactgagtccaaggggatagcgggaggtaagtgaactaacagtaactagtacacacacataggtagtaagtaggtagatagatagatagatagatagatagatagatagatagatagatacagaaggaagatattttcatttaatcattgctacaccctgtagtcagattatttctcctattttttttttcacatgggaatattgaagacttagctagctcaaacaactttttaaagataaaataatttgtggaaatattattttcactctatcataattcttattttaaaaagaaaataataaaaataaatctctataactgatcattgctgttgcctgaaacatttaaccaattacctctatcttcagtaaatagacagatttgtaactagaattcactattttttgttttgtaaaccttatttaatctacctaacaaccttgccagaatagagattgttagcattatactaagttctggaaattaatgctaagaaaatgtaagcaacctataaagccttgaacaaaaagtattagaagcaggtttcaaatccaccacaaactgcgttctccagacggcaagagagtgtaaacactctctgctgattaaatgagtttgattttacaagctcaagtgaattatatcttagagtcgggacagaatctgcaaaagtgactaggggtcatgtatggaaaacacttgagaaattgtgagaacataaaatttgtcgcaggatagtaagcaataaaacatctttccaggttttataaaggaaaataaaatgtaggaaactgattgtcatctccagtgaaacttaagtattgcttacttaacaaatatctgtcaactgtggaaaaaataaacagtgctcattaggaatcagaataggttcactttgtcagaggcaatggctcatgcctgtaatcctagcacttttggaggccaagagcggaggatccaggagttcgagaccagcatggtcaacaaaggccctgtgtctacaaaaaattaaaaattaaaaaaaagaataggttcattcaaaataacacatatcaaactaagtgctaggtttactgtatatataatatctgaaaacctagttttctaaatcccagtaaaatatcaagtttatcagacaatgtgatacatcatatctcaaattcagcaaaaaataataactgctattatgtgtccaaaactgtgtatgtaccaggaccaaaacaggtcactgtacagagattttctcatttattgttacaataaacttatgagatagacaagattatttcttcttttattgttgatgaactgatgctagagaaattaaataacttgcttaagtcataaaacagcagaggccatatccatgtttcaaatgctggtttgtttaaatagatgtttgatgagctatttcatagtatccttgygcacaagattgaaaatatgagccagatgttagccagctgataggttgatgggcatatacgttgctaaaaaaatgtgacccagagtacactctagtgatatctccaatgatgaggcrtaagctttgtatttgaccttgttgtgttcaaaatatctgtaaatgctttggatgatatctatcaaatattcagataatataaagctgaaagtattatctaatgtgttggatggtgggaaaatatcctgacagatgatactatgaattacagttaacaagatgagattaatagaaaagatttgaactcaggtaagctcacttgtttgttcattcctgtggcatctgttaattatgtttccaacatgcaggtctatggcctatggtagatagtaagaatatgaagactgcatgggtcttgccctctaggagcttattctctagtttaggggaaagaacagaggaaatgacacatattagcaattcatgtgaagtaagagtccttacttgattgcagattcactaggtgccaacacagggcattgctatttgtataagatccaaatcaagggaggaagtacatttaatatatttgcaagtcacagctagagacttataatctactatattttgaaagaaaccctgagtaagattgctaaatgtttagcttgaaacaaagatttaggaagtaatagtattcttagatatttgaggaccttccctaggaaaagggaattagacttaattttcatagcttcagaaggcagaacttggatcactcactgaaaattagaatgcatcaaatttttattcaccgtaaggaaaaacttcacagcttatgcaagacgaaaaaagctgtcttataagaattcatgcatttaatgatatctcaaggaaagtatagaaggcattcctgtatggcaagaaggttagattaagtaatttctcaccttaggcctgagatactataatattaatgttatagtcatttgattttgtagaaggaatatataccaacagttttccagtgtgcaaaaaaaaacttaacaaatctaatatattctgatgtattattgaagagatactagcacataccactcttgagaatataattaaacttctcattaggcatccaaaatataggaatttcccctaatggctaatttttatataagaaaaaatactatgtacactatttcaaagcagacagaaaagtcatatgaaaagggtatgtcaaaaaagtttcaaaaagaggctcytgatttatgtgttgtgtgtttgtggacctaaccaggacatttgattcaattaaccaagtttagtatgtcagcaaccctctgaaagattgagaagattgactgtccagagaatattacaatatttgctttctctgttgaagaaattatgtagacttacaggtataagagaaacaaaatcatatttttgaatctcttatttttagtaatgattattggctttaaggattttaattcagttactaatgttatatttaggttacataaaataattcattatgcaattattttactgcaaaagcaaaaggctgaaaattattgttgaagatcccatgtatttttggcacattcatctctataaaatawgttcttaaaacactccccagttaacacttattcatcagcatgacaccttgctgaatgacttgaaattataattcatagataattattttatcttggagccattatctctcataatgctactgttaaatatggaatggctcttttattgcttaaaaatggtggttcctttggatggttgaataaaagaggattatggcacttaaatcaatggcaaaatatgacaaatcattttgccctgctaaccacttttctgcaatgacacttgaaatttgggctttttcatctgaaaaagcctgaccagtttcatctatacttcctggaacatgcattcattcattcagtcattcaaaatagtcatcgaatgcctcccatgtttgatgaactaaaaggagcatttaagccagttttaggtcatcggggaatgtttctcagagaaagtgacatttaaaatgagagctgaaatgaataagtgctagcctgatatacactgtagagctaaggatttgcaaatgaaaagtcccagcagtgataaagagtatccgcataatttgagaatttcagatggccccatgtggctacggcattatatgcaaagaaagcagtggctacagctacatatggaggggtaagcacagtggtggtgaaggcgggggtgggggtggcaggtaatgaagctcttccttgccatgctaatgatttgttattcatcctgactgcatttgggagctagtgtaggctttcaagcaagagaaggkcatggtttgatatgttcataggatgatcactctgattgcagtgtggagaaatcaccagataagaaaatatggagacaggatctttagctaaaaggctattctaataatccaaataaaatatgacagtggccagatgaaaatagtagcaacaagaaagtcaagaaacagagagtaatagactcatggaactgatgatctaatggatacctcggataagagaggcctctaggttgctgaccttggcaattgagtgaatgacagtgacctcagatgaaacgagaaatacaggagtattacaaggtttagcaagagatgaacttcattgttgtcatttcaaatttaagacgcttctgtgttatacaatatttaytcaagaagcaattagaagcagaagtctggaacccattagagatatccaggctgaatacataaaatacagagttttgggcacaccattaactgaagtcatagtaatggatgaaatcaccaaggtaaatgtggaggagaaaaaagagatgaggaccaaagttagaattaagggcgtcaattatattgaacagaaagggaaggaagagtcgataaaggagaattcgagtagcygcagaagtaggagaaacatcaactggcttactcttaaagaagccatgggggctgggcacggcagctcccgcctgtaatcccaacactttgggaggccagggcaggcagatcacggggtcaagagatggagacgatcctggccagcatggtgaaaccccgtctttactgaaaatacraaaattaactgggyatggttacgcatgcctgtaatctcagctactcaggaggctgaggcaggagaatcgcttgaacctgggaggcagaggttgcagtgagctgagatggtgccactgcactccagcctgactacagagcgagactgtctcaaaaaaaaaaaaaagaaagaaagaaaaagaaagaaagaaaccatgggaagagagtatccagaaatatctatcaatggctacagaaaacctacatatgaggcctgatgattgtaagttttgctttagcaacaaagatcttatgggtcatcctggtattatgtttaatggtgaaaccagaagcctgtttaaagggagaatgggagatgaagaagtagagaccaggartgtaaacaatgtctttttaaaagcttatcgaaaataggatagaaattgtcaagcaatttgagacctcacagattttttttttaagacaggaaaggcttgaccaatttcaaatattaatgagaatgagcctgcaaaggagggaataaagatggtggagaaaatggggaggcaggaggaaaggaaaccaatttaggagtggagtagcttcagacaaaggacggaaacaaatgtcaaagggatggaaaataatgtggcaatatactgaattgtttgccaggaaaccaagggagcatccaaattagagctttcttatctcttaaagtagggtaaggtgtagaagtagaagatttgagattggctgggcacgttgggaggctgaggtgggtggatcacctgaggtcaggagttcaagaccagcctggccaacatggtgaaaccccatctctactaaaaatacaaaaaattagcctggcgtggtggtatgtgcctgtagtaccagctactcgggaaggtgaggcaggagaatccctttaytcaggaggcagaggttgcagtgagccaagatggtgccactgcactccagcctgggcgacagagctctgtctcaaaaaaaaaaaaaaaaaaaaagagaaaaagaaaagaaaagaaaagamaagacttgtaccttgtcatattggaaaaccagattcatttcacattgttataaaatctgtaaatgtcacaatataatttcaaatataacaccaaaaatgtaaaaaataaatgatctaaaattcactgtggcaatgtcatagtttcactgcaagaaatagcataaactctcaaaaagagttaatagaagttttaaacaaacattaattccatggcaatatctgtggtggaaatgacgtcagctattgtttgttgtgaattgccacacattccctaccaacaattgtctggccattagaagacacatgaaacataaatacattcttcttgattgaytaaatgaagcagagcccagtctatgggatatcatccaagttcaagctggcggcttcgtggctccagctgagattatcaggaagtcaattcactaacatgtccatctagtttgtaactgacttttttgtttctcaacttttctttcgatattgtttataagatgtaagtcactattttgaccactccaaatcctgtcttataaaatccagctaaaattcaattccaaattcccttcttcctttttctcaactctcaaatgcaaggatcgcattcccacaagataacattcaatgttgcattcttgctgccatgtttattttttgtcaggtggtttttttaaattattattttcccaaagtctaagtaaatttctagaaggtaggatgttctttcattgcctgtttcagtgcattccatgtagctcttcctaactccttattgcataattgattattgtgttaaatataattctgcttcatgaaaattttaatttgaagctatttgcacactattctgaagctattctcatttctttgtggaaaggtgttaaarggtatcaccccaatgtctcttattatgcaagcataagaaagaagatatcgatctgagattgctagttttagattgactcctctgtatttatgaagaaccacctacatctatgctttccaccttgaggtggtttcagaaagcccactagtgggcatgtgccaaggccacagtatttgtagcacctttttctaacatctcatagagctaaaacctgggatatgaagaaacataaatgcctagaagaaataataaattttagagactcgaagtctattccccaatttagagtaggagaaaaatttacatagagattgattcagggaaaagagaatagcaactcttattgtcagtgtagctacgayagcacagtattagtttctcaaatcaaagagttcctttaaaaatatttatatcaaagactgagttctctgtcagtgataaagtgtgtgtgtgagtgtgtgtgtgtaagaaagtatatgtgttcatagacacacattcatagctagggactgtatgataaattacattctaactatcactaaattaaaaacaaacttcttctcccttttcctttacagaattgtcaacatcacactgctggtgacttctgtgaacgatgtgctcttggatactatggaattgtcaagggattgccaaatgactgtcagcaatgtgcctgccctctgatttcttccagtaacaagtaagattgagaaatataaccatatttcccaatcagaaacgccatctgtctagcacatgggctgtctatgatttggctattttttccatgtagacaaaaatctcaatttaagatagagatatttttaataatatagaaacatgacaaaagtgagtatataatgctctatggttcatttttcctttgaaactctgtcccaagtaaataatacttattaattaaaattgaagtaccaatattaatgtaagacatatttataaaacaaatgatatatatatacaaatatgcatggtttcataaatataccagtctaatgcttgcatatagctctgcccataatatcatctatgaaggattgttcgggtgcatattatataatttttgtggctgtttccatttattttatgtgtttaattcaagattgggaaataattatcaagaaaacattgaaaaattgtacaattaaagcaggtgacttattgttatgctccaaaaaawgtcatctcccggaatcacagcctcctttttcttaagatggtctgagcttggtaccatggaaacacagccctaagaagaaacaaaagctggaatatcttatttcagtgctgtctgaacattctgcactggtttatacattgatgaaaaccctaggtgttttcatttacctttttgcccacactacctgcactttctgttaagtgatttatagacttcagtaaggcagggtagttttactctaagaatttgcttttgaaaataatgtatggcagtttgttcagaattagaattctggacactttatcttgagtgttaaacagccacagagcaatttggacaatgtgatctttgcacctgtgcctactcactttcttcttaatcttcggctttgtgtgcattctgaaaacatttcctgtaaatcatctccttttcctctgaaagctcctcttttttgttggctggaatcacaagccttttacagggtgtcaaatgtcaatttttaggtaagctggatattgaagaggataatatacatggtcttattgttcatccagggaccaagtagtatgtgtatgaaaaataacattatttttgtctctctttccctaatttctccttgatgccccgatttatttaattgttttaaaaagtaagccatttggattagaaaaatttaataattaattgataattccctggtgagtacactataataaaagctacaggagatatacaagagaagcatgccattttttggaggagctcactgtaaaacctgtgtgttaaggggtatcaacttaaatgtaaagaaaattcaaaggcacaaaacaccacacttaatactggaagcttcaagaacatatgaaaagaaatagtagcatgtataatggrtcttaaacaattaatttcaggattttcactggtgggaatagtaggaaattatatgggcaaatgcttacaaaatacaaggcatgtgcaaaacctaataagtaacagaatttggaacatggcgttcagacacaatttcatgatcacagatgaaaatgaatgggagaataaagaccatattgtagaaatccttaaataccagtctaagaaatagttatttaattttctatgtaataaggaaacactacaagtttttattttgaaaaaaaggttaatatgattatggccacattttaggaaaactattatcatagaattgagtataatgaattgaaacaggcaaatgagaaaagcatagagaccaattaaaaggctagtatactagcatgggcaaaagataattagaaccagaagtaggtaatagtaataagaatggagacaaaggaatgaatgtgagaaaatggtttaatacagctttacagattcggaaactaattagatgtgaggggtgagggtccgggcagaagttgaagacaggtttttaggcaggttacccccaaaaatggtggtgctattaactgaaatggagaaaccaggagagagccgttagagaagaaagataatttatgtttcaaataggttcagattgatagaacatatctgtctgaatggaaatatgcaaatagctgcaggaaatggaaatctgaaaattgcaggagcagatgaaggaagagatatgttaataagtgaattaaagttggataagatttcccaggctaatgttatccaaggcgagtatatagaaagaatgaaagacaggactttatgttgggaaaggagaaaaagaagagccaaggcaggagcagtcagaagagagggaacccaggcggcactgccattgacaccaagggagagaagagcagtgaacagcatcagttgctgctctcacaagggagacccaatgaatatggtggcaattgactattgtaattgagcaaataaatgggcttgccrcctgaagcacatagaagccaataacgttggcactggcttcggagaaaagaaaggctttactgcaaaattgttcagcaaggagacaagagtcaggttcaaatctgtctccctaatttgggatatggggaaggttgcaagggrtcagaaggcaaggcaaaggatttagaaatgctggcttggcagagtctgattggagggcttcaaatttgatcacttacagtaaggtatattgaggcagattttagccctggatcttctgggccaatggacccctcatttctgaaggagttccaatgtccagrttttgattttgtccctgtcttgttggttcaaggggaggaatagttggttcctggtgttgttagagktcaaaatttttctattgaacatgcctgggctacatgacttgcagcttttggctctgttatacctaaaaggtaacttgacattttgttatcaacagggtaggcccggttttggttggtcctgtagttacactctcagagtcattgatgaattttgaccatcaataatgaaagcagaatttgaatttacagttttaagaaatttcaagaataaaatgatagaatactaccctgattggttagcaggatcaataacagggtgtgttttcatttttgtttcattgttgttttatatgatttgtataatttgagtaaatttttatgcaaaagaccctgaaagaatcaaaatatcaaattaaaatggcaagttcagtggctttcaaactttattgattgcatccactgtaagatacacttttttatatcataagccagaaacacacaaaaacttgtgtgtgtagatatctaaatatatgtattatacaccatgccatttatttaattttgttattttacatttttagaaaaaaaattttagccaaaacctactcaatggatttcatgagtcacttatatcaccatctaaagcttgggacgtattaggctaattaacaaagtgaagacctataaattgtgagaagagaagaattaaaatgtgaagcaaagaaaccagccagggcaaagaaaagaggcacttctccccaagacataaaaacagattctgaggaatagatggaggaggctgagatatctcaatttatgacttcaatctgtgcagtcagtgagaaatatggaggcatgatgagtgattactgactcatttccacggcattagttcaagtcctcattatctcttaccaaaacaaatatggtagaaatttaactcttatgayggagtggcagtgctcacacacccttagaagtttccagtgccttcccaaggaaagatcagactctttgagcattasaaaccctctgtaatctgactacctttccaggctccaagccctcaactccattctatataawgccaagtttggcatttcttgcacttatctagacatcattagcagtctgctcttgctattccctcagacaatccctgtgaaatctaatttatttttaaaggcatttttcaaaccctacctctgccacaaaacctatccatagcacagaatgtattttgtacattttatatacaacgaacacattttactatacagaattatttcaatcattctttcaggagatgaacatttactaagcatatacttcatcccaacactatgaataaaagataaaagatatgtgtcctgtcctgtatgtgtacatatctgtgtctcacacagaattgtaaattctttgaaggtaaacataatgtcttatttctttctttattcaagaaaaagttaatgagggcccaactcaatgctaggcatggctcttcgtactgggaatatataagtgaacaaaacggcctgtgtttcctagccttctggagcttgtattttttataagagagtaagataaagaaatagatatataatgtaatatcaggtaatgacaagtactaccaggagaaataaaggagactcaaggaacttagagtgatgaaggtatgattttagatgaggtggtccatgatcttcacaaacagatgagacttgtgcagaaatgtgaatggtgtgagccatgtgaatacctgcaggaagaacagtcccctcagagaaaaaagtcactgcactggccctgagacagacccatgcttggcagataacaggaggccagggtggttggaacagagtgaatgagaagagggggctaggagatgaagtcagcaaagctctaatgaatatctaactctcctgagggctaaaaatcttccagtggcaagaggtggcttggtacaggataatccagtggtgttattgatggaagcaccagcagcatttgcagataggagataagtggagtgtgagagaggagacacggttgacaccatggtttttggcagagcaaatggaaacatggagtggctgttgactgggatggggaaaattagggaaaggtctggtgtatttttggagggggagaaacttacttttagatctgcgaaggtaggcacaatatttaaatcccttaggactaagtgagatcattcagaggagagaggagaagggaacagaaatcagaaaactgaattgtgaagcacgttaagagatcaaggacatgccatagatccaacaaaggaaactgaaaaggaacaaccaatgaactgggataaaaaccagaaggaaatggtttccaggaagcccatttatctctgcagtgtccataggagatgacacagagagcaagctctgtaaattttaaaaattctgttgaggggagtttggaattagcagccatagggaaatgtaaaagatggtcaccatgagaaaagcacaaggatttctgagtagccctgcagacaaaatgataattgagagaagattagggagttgtgaacagaaagaataaactcaagcttcaagtgagatggaatccctactccctccrgaagaccttttatgtgatataaggaaacagtgcaatccaccataatatcataatttgaaaaaaattrtatcaactattcaagaattactacattcctatacagtaaacactttattatttttttattgacatttcattattttactataacgaaatgtaatttaatcatactggctctttagagtttctcttgaaatgtctaaaatctgtttcttagagcccatatatgtataagagtgtgtgtgtgtgttcgcgtatgcgtgcatgtgcgtgagtgtgcatgcacagatgcagtcagtatcaggctttaaatgaatgagctaaaaatttggcagagtgtgtcagttataagtttattttttgtgaaggcaaaaataaatttgttggataatgcgtttgtgagtagtagatcaatttgttcacatattttgcaaaagttagagcttattactcattcatgtactattgatgtaacgcattagaagacagttaacattagktcctaatkgcacctgaccaaaaggagctgtgggcctggcctatacaccttattgcctgttttcagcatcaactgatttagtgaagcagcaaaaagaaaaatggtgtgtgcagyattatctttctgccacagatacatgtttttaatttccaagtttccaatrcatcattcagttttatctaaygggaatgcagctgagagaagtttgtaacaacccaaaactacatgctaatatagtttagttttcaagtcttgtggagtctttttttttttaatggaataagatcatcagaaatccaggagcaagacagactggctgtggtctaccagcattgtagtaaaaacattggggaagttttataagacctaattattagaaaataccataaaatagtcattttcatagaaaaagctttccctttcctcacactgaatcacattactttgtgttcaaggtaaaatgtagtttgaaatctggatgtaaattagaaaagatattattttattccaagtgaaacatgtattcacacttcacgtcttgaagcaccagtggccatttgggctgagttttcaagaaaaaaaawttatatagattttatgccctttttttaacctaagagatattaagtaatagctattccactatcagacaatgtgcataaattctagtcagatttttcttttgattagtgaacaataggacaattttgctggatgtttagtatattcatggctgtcacatcattattaaattccagaatattaacatgctttgtgtgatgcatttttaatccatcataaaccaaacaatatatatttgtttactgttattaatggtttttcattgtgacgtcctagccttaaataagaacttcagcaataattataaagatggcatttattactacctaaaagtatgtcccaataaccttgatcatggataggaatactattttataaaataaatggattaaactttttttgcaatccttttctttctgattcagtttcagcccctcttgtgtcgcagaaggacttgaygactaccgctgcacggcttgtccacggggatatgaaggccagtactgtgaaaggtaccaacagccatgaaaygtacagagtaatgatatgtagggactatatggtaaagggtcacaataggaaaacattcattatttgaagaacttcaatatttgcatatcctttagaagtttaaattacaatgctttcaaaaccacttgtgtatcttagaatttgtccaaagaaagttgtttatttccaccgtatgtttagactttatcaaagattccaaactatttacaattatctaacttatgctttagtatatatatatatataattttatatgtaaatataacatttcataagaataaatcaattttcaaaagcttagcagtagttactactaataagaaactggctacacttttcttattttaatgcactggaaaatattgtctggaagtaactgaattcacgtcattgttctgaacactatgactacaccagcaagtgtatacataactcaaaatataaatagtatcaagaatttttaattagtacccagacaataaagtatttgttattcagttttccttttcaataggcaaacaatattatttaaatgttttctcttaccatattgcttatgaaatctcataatgcatgtatacagctgttaaattgaattctcagtgtaatccaaatggtaaattaaggagtacagttccaaactgattgtctagaaaagttgcaattaatatcttccagatatatattttctgtaagatcagtatcctggatattcaaacttgtcaccaccacttttggtatattttagatattatctttaatataacagagagttactaatgttaactactaacattatacacacatgatagttttagcataattgatagcagtataaaagttttagaaagatccatagacttcgctcaattccaacagttcagctacattccattttcctcatctataatctcaggaatcattgataggccacctactttacactaatattgtgacaataagtgtgtaaaggacactgttggtgccctgcctaggcacctacactgaagccttctctccaacagaagaggcagaaaggcctgaatgtttmcccgcccttcctgcagtggcccatgactaaccagcgtgagagtacaaaagtccagctctttggcccctaagtggaacaagttttgagatcttattttatgctccagagcactccatggaatcaggctaagactgggacatcacytgaaatyataccyttgattagagcttttcttttccatgtcctgcttcacccactcctttgctagattctcctaggaacacttaaatggtaagcttctttgtaaatataaactaatactaattatcagcatccacttaagagtcttgttttatataaccagcaacagctgtattaatcatggcaataagtaactaaataattagggttaagctttataaatcccaatgcaatttttatacatttgtaaaatatatttctaaataaatccgtatgtggtaactctaaacacagtatccaatatttgcatatatataaaacagtggattcacaatttccataccaacagaaattagcagcaattaaataactcatagcaacaccaaatctaaaaatatttccatttgttctgaagatatatacatcttttggatatagatataggtgatacaagtacatacttgttaatacccaccagtgagctttggtattcatggttagactaatatttatttcctgtacctttaaacaccagtaggatggtgactaaaagcatcgctggacaccaaaaagattatctacagtaattcatgaaaaaaaaattatgatatagctacatttatacactgtagttaccattttctacaaaagcatgtgtatagaataggctagaagggtacactaaaataacaattattgtgttaaagcagaatgattacagaaaatttatttgttaatatccagtagtatttaatcgataaaagctgtcagtttgtgtagcatagagatgagcagggccatacagtatcaaatgtgagtgacttaaagtgtttttccagtcctcaaacattgttatagctttgcattcatcatctctaacatataaatgatcaggttatatttctctgaaaaattgctttattcagctatattaaaccaaagttcttggttaaatttttattgtaaccttccaaataaatttgttccagtgctgagagcttcttaaatcatttaaatcatctttcgacctgctcagactgatcaggttaggtctaaaactgcttaaatttcttgagtatccctgtaatatagaaacctctcctcatactttattttcaatactcttgtaataaactctttgaacatttaatcaatctgaatctgcttagaatacaattattttacctataaatgttaagaagccatttaagtggacttacttaaatgctactttcagtatttgtactctttcattgaaaaaaataatcaaaaacatgaatgtataaaagcctaatgtcacaaatcgttttcttcatgttttgccttttctaaccagcacagggtgaattaactttcacagtcagccatgcagatttcacagtctcaggcagctaaagatggtctatgattatcttgccagtatttatagcttttggctccaatcccctactgtctctcaacttcctcacatacttgcctgttgaacaaaaattctaactgtttgttatatttacactgaccatatataaaacttgttgtccaatctgggacactatattaaaaacaggcagtgtttttagcaattaagccaaaacaacaggtaataggaaattgtcctgggcaaaccagaatgtatggccctgctagcattgtgtaaagttaccaaacttccagtgtcataacmcggagtgaaatacacttaggtgaatggatgcatagatacgtggaagagtcaattaatggactgcatttagggttcatccagttggattctctttctacttttccaaatcagtgttatatattttgtttgcatatcattaacccacttccacagatacacatgaaaaatccatcttgaggaagatatggcaaaaagaaaagatgaataaaagtaaacagaaaatctgagtagcctattgccacttaacttgcctcttttgcctcattggtaaaattaatgggttgtattatttggttattttgagatctgaaattcatgagtatagggaagcccagaagtcaatatagaattgcactcatctctaattatacaagaggacttaacaaaaaagtttatgatctagagcagtcacagacaaactatgacccacaggccaaatttggcccatttctgattctgtatggcactcaattaagaactgttgttacaggtcagcatttacaatcaatttgatgacaggaggcactaagttataacccaaatgaaggataatttcaaacctcaggaagaatccaattcttctcattagtagcctgatattacaaagtaatttaacattattattattattattattaatgttttcaattccatcaacaacagcagaatgctttagaattttatttctttttcacggcataatcttgatttttcctatgtcctgcaaagcctactgtttactatctgaccctttacaggaaaagttaactaatgtatggactcttgctatcagttttgttgcatcaaaacaaaagaccacacacaacaatgtggagacatgacttgctattaacctcttttgctttgtcactgtttcaattcaggtgtgcccctggctatactggcagtccaggcaaccctggaggctcctgccaagaatgtgagtgtgatccctatggctcactgcctgtgccctgtgaccctgtcacaggattctgmacgtgcygacctggagccacgggaaggaagtgtgacggctgcaagcactggcatgcacgcgagggctgggagtgtgtttgtacgtatactaactttgctgttagttttggaggccttgattccagttctgtctcatttccaatgagaaagagtgactctccccgcccgcctttttttttttttttgcaatagttatactcttcattctttctgacactatctatccaccttctgctgttcacctgctgattgcgtgtccatcctgctgagccaagaacagctgagaaaatcctcagtgtgctttagtcagttcattgaaagacctacaatgaakctcctggaggcattttatttgatttgtccatctcagggtttacagttttgcctcaagttggcattgcctttgtgacagattaaagatgtgagtgtattaaaaaatttagaatcctcctgaatttgtaatcgactggacagatactttaagccttgaatgacaactgatgtttcttttcccagcttttatgaaaatccatgggcatactgcttcataattttctcttgaactacaaaacccgtaagcagtaacaatgaagtcaagtatttttactcacgtacagtaagtggagagcagtttgctctcttgctgtctctcttttttcttactgattctggattcgctagtgccatattgaaagtacattgaaatcagtagctaaatataattcttggatcttgcatacattcaaatccaaaataggttatttataaatttaaggaaggagtgctcttctatagtattcttttcctcaaggaaatttattttagcaccttttatttcaacatttacctattgtaatagtatttgtgcatgtcaacatttcttgttttagcatattgtttgagtctaaatcttaatagtatcttaaatagaagaatttttgtttatgttctagttttataagagttaacctcagaagctaaagctggattaaaaaatacaccaaaaagttaagactgggtgttatttgggaaaatagattttaaaatcattttttctttgtattttaaccatctttaatgaaaatgtattacactgaaaataaatgtgaaggtaggtgagaggggagagattaaatgtactgtcaaatacatttatattgtcatatttagttgatagtatatacacactaattcttcccaagtataatgatatattttaatgataattaaagaagtagactatcaaagtattttataatattgctttcaagtcaaataaattattaacatgcacataattaactagataatatatagatattcttaatgtaaacagtccttgaattattaatcatcacttttattaactatccagaagcaaacttgaaataaaaagatcatattaatgttaagcacaaaaattaaacaatagtacattaaaatctggggtagataatataatgggattatttggggaacatttcttttaaagagaattggcattctgcccatcaacaacaatggctttttcatttattgttgatgatcaatacttttttaacattttgaatacatttatcattagaaatcgtaattcatcttttccctatcacatatgtgggtttctaatctccacttgtcccatgtgatattaagaaaagggccaatcctccagttacaaagctacaccagttttataattcttatttgctttattcttgccccacaaggaaaygtatttacaggggttatacatggtatttagttcagttgctggactggaagtgtttatattctttttaaaagaatagcagtttttattccagaaaaaaatattaaattataggattgtttttgatatctagactcttttkctaaagcacagttaattatcttataattatgctgtatagattttccatatactgctcttaagcattagtgatttccacttacttctaggaatgttttctcttcacctttcactaaactaactctaagaattgttacacagagtatctttagacttttcatcttttctcttcttctaaaatttctcccgttatggaaaaatatgccatgattctatgatcttggcctttcccaggattcggtttctacttctactcctagttttgaaatcagataaaataagacacaagtgaggatgtaattctgacttattctcaattttccttttaatatatttctgtatccttaagctaaattagtgcaagagaccaaaaaatggattcacctggggtgtttgatctgcaggacctgttttagcacatgtaatcatggtggaattgcataaggcctgggggtgagagtaagggaggtagcttggctctagcaagagaatttagatgtagtaagagaaatgtctgcagtgcttgttgttagtatagtactgactacaggaaataaactttctcctattgcttagaataagtaaacactcagtttagtagcatgtattgtacaagagttaattttgcttcctttagttacttccctgggaaatataatttagactgatccacatcatggatttgtgtatttcaaaaacagaaaagaaaagaaagagagacagaaatgcatgataaatgacctaagcctgatcattgtgtgatctcaggtaatttgcatattggtgaaaggaatctatacactcactgtaaatttagtttaggctcttatttctcaaagtatataaaattctgctgaagagatcaggcaaaacaaagccaatgcaggaactgtgaaaggacttcccttggacaccttggtccctaaaagatacttatagcttccagggacagttgccagtgacccctggattttactggatccaaaatggaattttttgcagcacacaggccttttatatgtggattttcactactatcatgaagaatgtatacaaataatctgtgtccacgttaggaacctatttagacatcacagtctctcatagttagtgacctaaattcagccccaccatgcagagtcagttcctgagcataactaagcaatttattcaccttcaaattccaggcattctctaaagtcccttttaccacacagggttcatcataatagtaattttatttaaaggctcaccttgactgagaacttaccatttgccaggcactatattaagcattttacacgtggttctttcattcttgtaacattcccattccttatcatccccactgtgtgataagagaactgaatttaggtaggttaagtcattttctcagtgacttttcagtagatccgtgatttgagcatgggtcagtcttacaaatcttattttcttaacctctatgctggctactgataaacagagaaagcaaacgtggtttagccagtatattcaacattaatgaattcagccctttattcatttactgcttccatgtttagagcccattctacctcgattaaaaataaatataaaackagctaaaattacaaaatgagaaattttaagtgtatgtaatctcagtaatgacatttattttctgctaatcattgagactcctctaagatttaaaacattatggcatttatggtagattccttttcatcagagattgtcaagtagagactgtcttctatgcagaagaaaagatactagctgggtgcccagattaacttcacagcctctttttttctaaaaggaattatttgggacagctttacaatgttatgtatgttggtgagttctgaagagatattttattaatttcccaaattaagatttcttcttgataagttaatacaaatccatcctcctctttcaactgtcattcatagttcacatgtcattttataaaatgagaacaactaacctgccttcaagaaacttaaaaatgaacaaagaagccattatttgcttaacagtaaagtttagtattttgaaacacaaaacttggatttgttcatatcctattttctgtaaactcatatcattaacacagaataacccatgtgatgtttaaaatagattatgagtggcatagtaaaatgtattactctcctagagaacagaaattaaaattagtatctgttggcaagatattacttcataaaaattgcctgaaatagcattttataaatatcaaattggtgttgcctatttttaatcactgcatagtggggtttttgggatatatcagcttttattatttatagtcacaatttacttaaattctaacatatatttatttaaaataaaacatacactttgcttgccaatttgcaaaagtgatcatgaactatgttttctacttgcaacctgagataagcctagctaaatgtggtaattttccttaactctgtaaaattggcaacttccaaccacttggtgaaaccggaagtctgaagttttatcctatcttgatctacagagatataatcaacattgtygtttttaatagccagttgccaccaaagatctgatcacaataatgcagagacctttatatattatcactagaacactgttgtacatttataatcaaaaatgattaataatggcagtgattgccccctatatatgggagcagaaacaaaatagaatgtggttatcactgtaatgaaaacaggacttactattctgaaaaatgatgataaacatcagttgatctccagatgctgattactgatctaacactttgcttgttgtaccccctaaatgtcatcctctctctgctcgtactcactgctcaagtaagttyttatttgaaaggacagtaagtatgtcatagttttctrtagtctaagctgtgtcatgttgttcacatccaggtgttaggcaatctataaaacatcttctgttcaccttgtttgcaccttctactcatttgttttgttagtaaaagatatttgagtttcttgttgtcaaccttagcattggtccaggctaacaatgtgtggaatggcaactatcaccgtgattctagatgattttcctagttgttagagatcagtctcagtggtttgtatattattgaggaagctgttctgctagctgattaaggagttgcacagttgaattatcgtatagagacagctgatcactgttgcctttgttttcagcaagttttatttgaagagtaaactaaactctactttgattgcaatttctactctggcaaggctcaggaggttttattgaccttgaaagacaaactaaaatcacataatcttaaagttggaagaaataagtaaactagcctagccttctctttttctgtgacatccacaaaacagacagcatcctaatgcaaggaagcatggtgttatgaagtggctacagaaggtttgaaacctagcttgcaatttgtgtgacattatttaatttcctaaacctcattttcatcctctgtaaaatggatgtaaaatgctacatacatgtatgtgaagtatctaagcataataggtgctcaataaattctaggcattgttatcatcattgttattatgtgaccatttttttccccaaagacctgatgttttgtgcaacgcatcagtttctgatgaaatattttctttagtttaggctgactttcagtttcctgttactatctctaattctaggttcttcaagtcactgaaaaccacttttatggccaccttacatttctcctgtctttaagcccttcacatgcattatttatagattcataaacactctggttgtgactatttttctcatctgtaaaatgaggatatgaatggtacttacctcatagaattgctttaaatattaagtgagataatgatggcaaagtataatacattgccagtcatgtagtgactgttgtgtagataaaaactattatcccattattatttatagtactttcaaagtttccattagtgttttgaagagttacaccatctttgaaccacattgaacttgttttcccatgtattatatatagaattttatttaatatatataaaacacatatatcaatatttaatatataaaaaatatataaaatatatacatataaaacacatatcataaaacatatatataaaacataaatatcgttacttggtatgtcgacaaattcatcagtctcagctgaagtctacagctttcctctctattcaaagaaatgacaggttaaaaggtcttcttaatgactctggaatcaaatttttatttgagaagatatttattttaaaatagaatgactaaatacatcttaataagccctaaatatatgctaatgtaaaagtttctttttgaaggggaaaaagggaagtgagaaatagaaaattcagatccagggaaccgtcaatggcattcatctaggagagttaatttaacatacacacattaacacataattttatcttttgttaaaaatgtgtatttactcattttattcctatttgattagagcagagaatttatgtatcgctacctaaaattggttaatagctttcgccctttcaaaaatactcagtgtcctcattttagcttcagcttctttggtttggatgcagtgtgtgattttttttgtgacagtaagccagtagttattatgcatggggaatcctggtagaaatgcagtattttgtgctaattgctaacagaaagatctgtaatactggctgcatgatttgccccttacatgtgcccagccataacaatctgaatttagtactgtgtttgttaatattagacacaaatttatcctgacacttttataggcaaagcctcggaaacatttagtcatgtaaaatataatcatggtcttgaaatatttgcttttgctcctgtgcattttaggcaggatttcactttgtaaccttattagtattgctgaatttggagaatggtttggaaaggttctttgaggtcctgattgtaagataggtgttcatttacactgagccattactgcactttatcaaagaacagttgtttacagaatgtgaatattccatgtctctacacactcttcagattttccctatgatagtaaattacatttggttttaatttgcattccatttccaatgtttgttgccagacactttggactttttgagggcaaataaaagtagcttctggtgtaagtgaaatattttgtgtcagaataaaatagcaaaccattatgtaaagggcactttccccatgtgtttaccttataacttcatgagctagacttgtacagaagctttgaaaaaatccccatggctgtcatattcataagtctctctgacccattcagasagatgttagtatattgcttggagcgtactataaaacttacctttcacttatggaaatgtgcttgtactttgttccccaaaaagcaaatacagataccataagacatgggataataataaacctttggacacagaaacataaaatggaatgtatgagcccttgaaagagcaattaaatacattttcatttcaacagctgaagatgaggaaccaaaacagatgggcaggggatagaataaatgagagaaaaatcagtattcatcatgcctcttggcattctagtacaccgtagcatattacagtacatcagctctagttctgcattctggtccctgatttattcttgtatgaagtaaaaactgagaaaacgataggtactttccttggaaatttctggaaccatctagtaaggagtatctagccatcctgttatcaacaaactgattcaattccttcttggaaataggtaggttatatattattaaataaattaaagaataatttaatgtttgctatcaaaggcacacactgccctaaaaagcatggtgaaacatcctattatcattaccaagtatctttaaagatcttggaggtgaaaaaagagcaaattgcttgcttgcatcctaggaacatctgcccaaaatacatcttcactagaggtcaaatggaacttttaaaacaatgatgaacttgggctcagtgagagaagaaccttcctattcttcataattcctaataaaattataattgttactactgctgtttttaacctatgaattgcagcttgaaagtctctgatctgaatcacatgtgcaaaacttgaaaaagtgtgtcagttatcgattgtatcagttatacattccaaagtttagtagcttaaaacaacaagtgcatacactctcatgattctgtaggttggcaatttgggctgagctcagttggacagatcttccactgtcacgcctaggggctcccagatggcctcaagcccaaattggggcctcaactgccctttcctctctcacgttgcctcccttcctcaaggaggctaacctgggattgttctgaaggcagcaggggtccaagagtgtgaaagcagaaagtgcaaatttcaatatgttgctctgccacattctgttggtcagagtatgttgcaaagctaacccagattcaaggggaagggaagtagacttcacatcttaatgtgaggtgtggcaaagaagtattaacagtaaccttttttttttttttttttttgagatggagtctcactctgtttcccaggctgaagtgcagtggcatgatctaggctcactgcagcctctacctcctgggttcaagtgatactcctccctcagcctcccgagtagcgggactagaggcacatgccaccacacctggctaatttttgtatttttagtagagatggggtttcaccatgttggccaggctggtctcaaacttctcacctcaagtgatctgcccatctcaagcctcccatactgcttggattacaggcctgagccaccacacccagccagtagtaaccatttttaattgtccccagaaatgatcatcgctttgatctgtcagtcatggtgttctttcctcctaaagttttgtgctgattttcttcccgtccatctctccctttcctgagtcaaaactgaaatccttcaggcaggtatctgaatagtcattcttgttgatcggacagtctctgcctctgcaatcacaagatagttctctttctgtctctaaaccattgtttttaatgtattctcctgttcctcacacatctgtgaggttttctatcttgttctcacattcagaagttttcttccggccaaccccaacctcttccctcttcccctcttcccctctctcttctctcctaacattctacctccctgatcttctcactatttcatgtacttgggcacatgccatgctcaaacattaacccttgccattctctttgtccaaagtgttttgatacccttctctcacaaaaatattagcccacaaatatttactgaatattaactgtgtacaagaccctttcctaggcaccataaccaaggtgtttaaggtcccttctttaacgaggaagaaagaatatataaataaattaagtaataatgtagcccaaacaggcataagtgttaagaaagcaaaggaaatgcagtagtgactggcgcagggtatagggctgggggtggtggggagtttcaggtaacagtaattttagaatcatcagggacttgctctctgaaaaagtgacacttgagcacttgacctgaacacctaggaaccaggtgggagaagaccaagggagaagaattctaggtagagaagacagcaagcaaaaggacctcttccaaatccttgctcccttgaagattgagcatccctataatttatcacctggtccagtggttttatcctttggctacatggtttttcaattactggaatatttttaaaatacagtggttcacgcctatgatcccagcacttggggaagctgaggtgggaggatcacttgaggccaggagtctgacatcagccagggcaacacagcaagaccccatctctatgttaaaaaactagctggatgtggtggcatgtgcctgtagtctcaaccactcgggaggctgaggcaggaggatcactttagcccaggagtttgaggccgcagtgagtcatgatcacaccactgtactccagcatgggtggcagagcaagaccctgtctcagaaaaaaataaaaatagaaatactgatggttagaccttaccacagacccatcaaaaatcatattctgtggtggtgaggagggaaagagcccaggcatctgtattttataaatgttcatgtgattccaatgggcagccaaaggtgagaaccactgatccacaccaatgttgtcacattctaatgtgcagagataatgtgggacgcagattctgatttcctagatctggggtagagcccgattatacatttctaataagcttccaggtggtgccaaaactgttggtctgattgctactcaaagtgtggtgcacagaccaacagtagcaatatcacctgggagcttgttagaaaagcacattctcagtcagagactaagagaaaccaggtgatcaaatcacctcctgattcagaaatactagggggtgtggaccagccctctaggatttccgaaagtcctactggtggttctgaggcccactaaagcttgagaaccagactgtggatcttggtgtttagacacagtcaatttggcacttaactgagttctatgttgtgttttctctaattgtttaatgtggacaagtctgttgaagtttgcattgaacggggctatgaagccaaaataatcttttacttggtttccatgcagtgcaaatttggtttcattctggctaggagaagagtaagagatatagccctagttccagacttctgctctggcctccaaagcctctttgttcattcagcttgtgaagcatcaggagcttgcaaagcccctgcaggtgacgctctacagttgtcacctgcaagaagctgcaggtgtcacctgcaagaagctgatttattaaaagccctgccagggcagtttaatccctgtgaagtgatattgtaactcacctctagctgctgtcctatcaaaaaatcactctccgtcctccttctctttgtttacaagcaccagttaatggttttctctccattaagcagctcaggggactgctgtttagagacctaattgaattcttgccaagtttgggcatgatccagagctgctccaattctcggtattttccatgctatgtattttcccctattctaasatgtatatagcattgatacctctatctgcagaatgtaagaaattgtaactgtatacatgagagtatattataaatgcagtagttcctgctccttggcrtgcagatacacctcattactctgcaatgcaaaactaaaaatatacatgttttttaaatctgctaaaagattcaatatatgttaattttggaaattatacgactatttatgagatctattccataatgaagagtcaacaatccatttgtctctctaccaattctaccacctatcctggcccctaccaccaaatttgaatagcacctctttgatggccaaaaatattatggtgagtgtattagtccattttcgtattgctataaagaaatgcctgaagctcggcaatttgtaaagaaaagaggtataattggctcatggttccatcaggctgtacaggaagcatggytggggtggcctcagggaactttcactcatggcagaaggcaaagctggagcaggcatcttcacacaggcagagcaggaggaagtgggggctggaggtggcacacacttttaaataaccaggtcttatgagaactctgtcatgagaacatcactagggcrgtggtgctaagccattaaaaccactccagtgattcaatacctcccacgaggccccatatccagtattggggatgacatttcaatatgagatttggatggggacacagatccaaaccatatctggtagaatattagcattcttggctacttaaagaatatagtttttctagcctttagcaattatttatctataagactgaaagaggttaatcatcaaagtagggatttgtgagactgcatctaatcatgggtggtaatagactgaagggataaagaggaacagttggcaaataaataagtcaataaatattatcataagaaaacactatagaaagaaaagttatttttattttgactttttattttattttttggggggtggagtctcagtctgtcgcccaggctggagtgcagtggtgcaatcttggctcactgcaacctccgcctcccagtttcaagtgattctcctgcctcagccttctgggtagctgagactacaggggcccgccaccacgcctggctaatttttgtatttttagtagagacagggtttcaccatgttggtcaggctggtcttgaactcctgacctcaggtgatccacccacctcggcctctcaaagtgttgggattacaggcatgagccaccacacccggccttctttagacttttttttttttttaattattctactcaatagataccaagctaaaaatttatatactttttgaatgtgtaatacataaagcatgtggaggtcaaattactatgactttctccagtgcaatctaatggagcaccacacatttagactctggagcatgttttattccctgtggacaggttcctttcgattgctcatgtagggatttaggggrtacttttaatgttatattctatgccttaaaggaaatcttcaatacttgtgcaatacactttttctccccaaatctatttgctcstcctctttggtccctcagtttatattatcgcctctatttcaggttctgggcgacatgcatatctgttcttttgttgttgttcttatctttcctcaaccatcatccatttgatagcattaatattctgagatgagtagtttcatcttccatggaattattcttggaccataaaatatttcatagctgaattctttgaacatctgcctgggatgtttagcagaagtaactactctttgtcacttctctttcacagtttgtggagatgagtgcactggccttcttctcggtgacttggctcgcctggagcagatggtcatgagcatcaacctcactggtccgctgcctgcgccatataaaatgctgtatggtcttgaaaatatgactcaggagctaaaggtaggttggtgcagtcacaagcaagggccagggacaaggtgacagaagcttcacaagcggtattggctgtaattggtaaatgttcttcccacagccccaaatcaagggacacaactgttagggaaattcagagactttcttaaccagtgtttttcaaactcaagaactataatatacagatttctattaagggaaaagagtctcatgtaccccccagtgtctggcctaaatcagttttattatgtcacttaaatatgtgcaaacataaaatcaggtataaactctttatacttatagctctataaaattaaaacaaattartccttacaaaaccaataaaattcaaattaaaaacattaatataaagtaacatgattttggctgaatggaaattgctgcttgcaacaagaataggatattgastattttcacacagttcttccaccagagatgatgtggtaactcatttctcctaccttaccacatttgaaccagagagccccctacaaagggtcctgaaatgaatgtgagcatcacttgacaagtttatgtgactaacgtgctcagtctgccataggctcaaacacacaggcaaatgtaggcactgagatcaggtggccatattcatctctcaggtgcctagcctgggatccagaaatgcttacattaatatttaaggttatcatcaaaatgaaaacacatgattagaatcttgtactaaagagctagaactagtagacctttaaaagttcttcaacaagcaccagtttgataaacactgttctaaattgtggttaaagcttttggtagttaacgaggtaggagaaaacattaaagaaattggggttgtttcacctgatgraaaaagatgaaaggtgtcaacttactatcagtcaattatcagatatttattaagaaattatagaatacctcagcattgcacttggttccctggggatttcatgactcttttaatatcttcactacccttaggaaatgtagattctatgtgctttaaaaataatcattaaacaataatcaagcaattagcaagaatacataatgaccatgtgttttacaaacattcaaagtacattagcgcacagagactggagaaatcagtaagattcagggtaaccagagaatgtaccattactgagagtataatttctgttggaatttgaagtgtagacacaattttagtagagaagtatttgttgctttagaggaaggcatctaagatttattcactacacattggtagatattcttttaggaaatatattctttaattctgaccataacctttaaggtaagtattattatccctattttccagaagaagaaaccaataatgatgataacaagaataactaacatttattgaaaagctaggcaattgactgaagtcttaaatggattaccatacatagcttttacagaaactccaagaaataggaaagaagttgtcatggtctgaatatttacatctccccaaatttatatgttgaaagtctgtcacagtccattggagctgctgtgacaaataccataaactgattagcttataaacaatagaaatatatctctcacagttctgaggctgggaagcccaagatcaaggtaccagcaatgttcratgtctagtgaaggcctgttcctcacagagggtgacttcttgctatgaccccacrtttaattcatttaatatctggatactgaggaaaaggatagctagctctctggggtctctttaataagggcactaatcccaatcatgaaggctacattctcatgactcaatcacttcccaaaggctccacctcctaatatcatcacattgggaactaggatgtcaacacatggatattagaaggacacaaacattctgccttctgccgtgtgaggacacagggagaaggcagctgtgcttaacagagccatgtgagcagaggcagtggtgtgaattagatctgtctggcagatattaaaagtcagacctgctagtgaaagataaggctggagacttcagtgaggcagggtgatatgatggacaaccttgaaagccaggcagaggaacctgagtttaccttgtggtcctggtattcagggaagtgaagagttttaatgaaaagaatgccgatcagttattttccttgtatatggagagaatacagaaaaataaattaaactagaaaagcaaacattttagttgaacatgaaacattttaaaactaatacttaagcaatggatgatgaagtaaagaggatcctatagaagaggctccaatttgtgaacatcttctaagccaagggattcagtgacccatccacttctggctggatattgatccagatgacctggattatccttaaattctagtctttcttgattttttattttgttcttcttccatcattcacttgacatttgtatactgaggatcaccttctggtattataaaaacttaagttatttcacctctttgctcaatttctttaactatgtcagtgctccccaagcttcagccaaagaccatcaaggacacacatgtgatggaacaaagtgggatttattaacttgttgcaacaaggggcactgaacaccatgggggaattgtgggctgtctcaataagaaggtgttaggaataacttctagtatttgaggctgtgctagataacttaaggttagcactcaactgggtgctattcagaagtgggagtaattctgtgagtattttgtgaatcctatctagagggaaggaagaacagagggaggataaagctatgattaataaggaggcagtgttcattcatattagccaggaaatgggaggttggggtagttttgtggtctacacaaaacccgctatggttttgtctgcgcttagacattacagggtagtctctttttttctgtttcattcatcactggttcagagtgaccttgtctaatttagtgtcctatgagattatttatgttccataggaaaaaaatatggccctgctgttaggccagttcctagcaacaccgaggacaggccagttagttagcgcctagccaggtctctatgttaaggcctgccgttctcttttttacctgtgatctgtgtctctgttaattggaatgggagccttaaatgggccaggcaaggagtttatcttaactctaccccttactgactgtgtgatctcgtgcacatttttaactgtcttcaagacagtttgctctttcatgaaatggaataatgcttaccccccatagagctgttgtgaaaattaaatgaaaaaacaaaacataaaaagcctggcacatagtaatttctcaataagtcactgcaatttttattatttgcctgaatatttggcatgacactcaatgtgtaagtgcccagttgaaatagtttccttatcttttctttgaaggtgagaaggctaagttccttttatatacaaaaatgtgttctgtcraacactatcactgcaaggccatttactaaaaatgtttatgggatggaatctttttcagcacttgctgtcacctcagcgggccccagagaggcttattcagctggcagagggcaatctgaatacactcgtgacmgaaatgaacgagctgctgacsagggtaaggtggcaaaattatgaatcttctgaaagcagatagattatgtcaatgaaggaaaattacttcaaagttctgaaatgcaaatcaccttcttcctaattcccaatttggtatataaaatagatgtattctgacttgctaattctgcttcaaatcaaatcatagaaatcagtagcacgcagaaaaattggggatacctggaaattgtcaatggctaaaaagtccagaatgacagtgtattttgagaactttattcagtagcctccgtggtaaagtttgtatctgttctgatttccaaaagcactatctttgattgtgtaaagagaaagaaaaacaaatgaaaatrcttgtggtctctttcatctcatcgtgggatttttgcattagtatagaaatacagtgtaaatcagtctttccacacaaaagaggaaatcttctctattgtgagactccaaagtgcttaagacactttttaaagtcagaatgtaaagtccatgttgcatttatcaggctttttaaagaattggaaattttaaattttcaaaactgcgatggtattaaaaactttttgcagttagagaatgaagaaaacaacataaagcccgccatcttgtggccagaaatatgcatgaagctagaaacggggctgcaaagtacggatttaatttgattatctaagagctttaaatgataaagagtattggagctagaaggttcctggggattatcgagtccactttgtattttaaagaagagctgcctcgggccatgacagtgaaacgaattaacaatggccatacaatttgctaaactcagggacttaagctggacccagtctcaagattcccactggcccagtactttttctacatagcctgctgtcggtttaggaaaatatccacaggaaaatcaaataggcttctgagcacataatgctaaacaacggccctgatgttacaatagcatactaaacactttttcagaatctcatagcaacaatatagaatgtacagatacaacacggagtttcttgccaaatgtatgtagacattagattaaattgagtgcatttatctcatattaatttaatatgaaataattcatatttgttataaataagaattttctaacaggtcatggtagaataaatcaatttaacaagcacacataaatgttcataacatacaaagcctaagttacgtgttggcagatgaaaaatatgaatgaggctcaatctgtcttcaaagaactttgagatgtgtgtgtgtgtgtgtgtgtgtgtgtgtgtacatcagcatttaagtgtatggaggaccatattagacaactgcatgcaggtatataataaaacatgaaataaaataaagtcggaagaaattctggagaaatatttaataatagaataatttcatctgcttaggggtaattagaaaaaatttcatgtaataaatggcatttcattcattcattcacttaactaatactttttgggagtctctcatgttctaggaattatgacactggggatagaagtgtgagcaaaactgcacagtccttgccctcattggcttagtatagtctaatgatctgacgttagagacacaagaagtatttcttttttttttttttttttgagacagagtcttgctctgtcgccgaggctggagtgcagtggtgcgatcttggctcactgcaacctccgcctcccgggttcaagtgattttcctgcctcagcctcccaagtagctgggattacaggtgtgtgccaccacacctggctaattttttttgtatttttagtagagacgggtttcaccatgttcgtcaggctggtcttgaactcctgaccttgtgattcgcctgccttggcctcccaaaatgctgggattacaggcatgagccaccgcacctggccacaagaagtatttcattaagagtgtcagatctttattatgtctcaacctatactctttaccctttccagcagattgtctcatgctatgttttttaaacagactttattttttagaacagcttaaagttcaaagaaaaattgagtgtaaagttcagagtgttctcatatctactccctgcccccacaaccttccccaccagaatggtacatttattatagtcgataaacctaagttgacacctcctcatcacccaaagtccatagtttacattagggttccctcttggtattgtacattcyatgggtttggaaaaatgcattatgacatgtgtccaccgttgttgtaaaatatagaaaagttttactgcccgaaaactcctctatgcttcacctattcatacctccctcytccttgacccctggcaaccactcatatttttactacatccatagttttgccttttttggaatatatagctggaatcatacagtgtggtactttttcatattagcttctttcccttggtaatatacacttaaggtttctccatattttttcatgactttatagctcatttctttgtagtgttgaataatatttcattgtttagacatatcactgtttacttattcattcccctactgaaggacatcttggttgcttccaaattttggcagcatgaatcaagttgctgtaaacatctttgtgcagacttttgtgtggacttaagttttcaacctatttgggtgaatataaaggagcatgattgctggatggtatggtaagagtatatttagttttgaaagaaattaccaaaatgtattccaaatggtcttttctattttgcattcccaccggcaataaatgagagtttctgttgctccacatcctcaatagcatttggtgtttttagtgtttggattttgtcattctaataagtgtgtatggtatctcattcttgttttagtttgcaattccttaatgacatatgatgtcgagcatcttttcataygcttatttgccatctgtatatcttctttggtaaggtgtctatttaggtctttttccattttttcattgggttgttttcttgtcgaattcagagttttttgtatattttgggtaatagtcctttatcagatatgtcttttgccattatttgcttcccctctgtggcttgtcttgttctcttgagaagtgtctttcacagagcagaagtttttaattgtaacgaagcccagcttatcaattaggtttctccttgttgagcctttggtgttgtatctaaagactcattgccatatccacggtcatctagattttctcctatgctatcttctaggagcgttacagttttgcattttacacttaggtctataatccatttttagttaattccaatactattttaaaataaactttttactttacagtagttttagatttcaaaaaacttgcaaagagagtaccaagagccttcacatactccattcccagtctccccattgttaacatcttacattagcatggtacatgtgtcatatacatgttatatacatgtgtcatatacatattagctcatatacatgagctaataatattgaaatattaccattaacccaagactgtattcatattttttcagtgtttactgaatgtttttttactgtttcaggatcccatgcaggatactacattacatttagccattgtgtcttcttagggttcctctagactgtgacracactgtcaaaaatactgtaacagtgtttctgatgactttgagagtttggacaggttcgtgtgtttggtaagctgtccctcaattggggtttgcctcatatctttctcatgattagaatggaattatgagtttttgtgggaaaaacttcagaggtaaagtaccatkttcatcacatcaagaacccatgtgaccaatatgacttattactgtggatattgaccctgatcacctgactaacatagtgtttgccagatttttccactgtaaagttactcttttatgcccttttcatactctaatactatttttatctrcccattcttcagrttcagtaacataaaaggcgcagaaataggactactgaaagcaaagatcactttgatgggttgagaagggggaggaaatgtaaatactcattaattacttttttcctaccatatttataattasaaatatatcttccatgcagaccataaatactcaagtcaacatgaccaattctctctttccctgtggtcaagctgcatgacaatcaaaaggtgaattaatacagatggaattataattagagagttagatggtttcattatccaaaatcaggctaagcacgctaatgcctctatctcagagtcatgaatgatcctgcagttgtgaccagggtatgagaaatgcagtggccacaacttccaattacccatgactacattagaggagacagtgctctagactaggactgcacattggaattaccaggagccctatctcacacccataggttgtgatgcagttggtctggggtagagtcagaccactgggatattcaagaactccccagattatacwgataaagaattactgtgatcctgtagttacctaatagctaagactctcttccctctggaaaatgccttaattggtactgccaatcttttttttttttttttaaacagagtttcacccttgttgtcsaggctggagtacaatggtgtgaactcagctcactgcaacctccacctcctaggttcaagcaattctcctgcttcagcctcccaagtagctgggattgcaggcacctgctaccatgcccagctaattttttttttttttttttttaagtagagacagggtttcatcatgttggccaggctggtctcgaacccctgacctcgggtgatccacccgcctcagcctcccaaagtgctgggattacaggcgtgagccaccatgcccagcactactgccaatctttgttatgctcctttttctctgcttggttggctcaccagtcacttgatacagtctttagatttaagagcacatgtcaaggttgatcctgcatgactgctgtaggagctaccctctcttctttaagggcttttatattttatactcattgtttttaaatggagaaatctaattccctaatatccctgggtaaagaagacattattccacccaagaactcatatttaaaatgtattttgatatattttaattcatgtataaatataaagtaaaaaaattacataatcatatatctctttcaatgcattttgatttgttgccattttattttactcactggaagaacccaagttcctcacatatgagaatcatgtttaacatattcaaactgccctacagtatgtgtgaaatattaagatgctttttgatgatgactctacttacctctatagctattgtccttagctcctttcttttttcagagccaaaattttttaaagacttggagacaagtctgtatttatttctcactccactgctgcctggattttcactcccagcccactactgaaactgtttttataagataaccaatgacaatctggtaactaaatccactggatacttattaattttacttgaaatctctgcagctttgatctttccttccttcttaacatactgtcctctctctgtttttctcttaattctccaacctttcattctaaggctcttcctctcatcatcccttcaaagtcggtgttccttggggactaggcctcagtccatgttttccctcactgtataacactttctttggtcttcaattgccatgtacaagctgttaattcataaatctatattttcaaggctgacttcattctcatgctttggtcctatgtgccttactatggattggacatctcaaactaaactcatcatttcctcttaaagcccattatttctcctgtgtagaacatctcagtgttttatccgccagtatatgcccagtctcccaaagagaaattagcaggttgcccttcactctactccctctttcatccttcatcaaattcagtttccttctatggtgactctttgtaagccttatccaactctaacctgttgttatttatatggcagagtgaacattctaaattgcagatcctatcatstcattctcttccttaaattgtactatggctttccacttttttcaggatgacatacagtgctctcccaccatgatctaatctctgcttctctctcatctctccccactactcatggtctggtcatctggacccctacggattgagggtataagccagaaacctacaaattttctttggtgcctctttcttcctcatgatgctcctgcttatccaattcattaccacacactgggcttccacttgtgtgtatggcattcatctctactaccccactctcatccaatctcatattgtgtagtttgggattaccacatttgttttttagctggtctctctgcttttactcttgttctcctccaaatctgttctccgtaacgtagccagaatgaatgtttgctattccaaatgtgaatacgtcatcgcagtgcttacaaactcttcccctgacttcccttaggctcgtaggataaagaccaaaattctccccttggccacatctcccatcacttgtgcccctggccatctgcactccagccatactgtcccccagccactttgtcccaccacaaagcattgccacayatttctttattttgccttaaaggtaatctacctctccctacattttgttaatttctgttaactccaatttacctttcaaatctcagctcgtgaaagccctctgtgccatcgcaggggttccaagattcctcctgtgcttatcttataccactatttttcctctagtttgtagttataaatttatctacatgatcatttgacaaataactatatagtccaccagactatagactccaaatgggcaagaaacctttttgtttcttaccacagtatcaccaatattatacacataataggtgttaagtcaatatttgtttaattaattgtgaatgattttaaaagcatttgaacaacaagatggaaatgtagacaaacccaaaataaacatttattttgcactctttaaaatgtgttaaaatcaggcatatatttataattatattgttgaatattttgttttcattgataaacacctcttaactatttatattctgtaaggggagaatgctatgtagtagattgaactgtataaaatattaaaattttgtttcacttatattgtattttattgcctattgaatatcaaatttaatgaaaatgaaacatttccaaaaggatgaaactagtttttaaacgatttaagtgccaatattataagtttacaagattttatttatagtttttaaaagatttcaactgctaacagtgttttttatttctccttttatatttttaaaagatatatatataatataaaacaagtcatatctttttggtttggaacttttaaaattggcacgtgaaatatttaggaagaaattccacatggaactggctcattgtcattccacggggtcagctggttgctccttctttccttgtgtgttgttggtccttatggcttgcctgatgagtgcttcactaccacttagacatatggagctggtaatattggaagatgacccttgagagtatcatataaatgatttgatctgaaatctaattttagcaggaaaccatatgagtccacaaatgcaaaggtagacagtatctaagcaatgttatctattcagtagttaggtttgctccattagattctagttttaacataaagaaggcagaaaatgaaacacactggtcatatccaaccaagaaaattatgtgcagattttaagaggcacagtagaactgcttgagctaaagcaggaaagtaacagctacattgttcagaagtaaattaacgtgtgcctaatggtaatgcatgctgcctagacataaatactctaaaaaacaaaacaagaaaaaatagaaaaagaaatgggaaaaaaaaaacctagttgagtgaatgtcaacataaaagaaaaggtaatcaaaggcaagagagatacaagatactgtgtaaggcatcatttacaaaggaacactgtaaagattgcagaatagaggtaagagaatgttaaaataagaaaatccaagatagagaatgaaaggaagattgtacaacatattaggataaatgagaagttatttgtcaaatactcaaaggacaagataatagtgaataagaagaaggatgactaagagatggagatggtaatttaataaaacacagaaagagccaaactgaatcagacagatagttcctatcatgtagtatttagcattcattcataacattatcaatagcctgtcctgggtgagattgatttttgtgaattttgctttggcagtgataccactatctatcaccactacccataggtgatagtgcatttgtcataggcttctttatgaagtctctygtgggtatttttgaccagggtgaatcttcaacttaattactgtgtaatgagacatgatttttaaaaatatatctagatgatgttctgatatgattttgaaatgtgttaattgactgaaagtcaaaacttatatacttaaagtatacattaactggagcagtgtcctccactcacctagaatactccagtttttcatgtattttactactctttctggatgttagccaaacacaaaatagtgttgggtacaaacaaaatataagtctgtgagacaaaaaaaaagtgtatttcatctccaattccctgtacatgtaagttcagataagttacttaacctcctcataccttccttttcacctgtgtaaaaagagggatgatgccttctatatatctctaaattcaggaagagtaagtgagacacacgagagtgctgtaagcctttgcaaacatgtatataaatttggcataactattcacaatagcaaagacatggaatcaacctaagtgcccatcaataatagactggctaaagaaaatgtggtacatacacaccatggaatactatgcagccataaaaaagaatgagttcatgtcctttgcagggacatggatggagctggaggacattacccttagcaaactaacacaggaacagaaaatcaaatactgtatgtcccacttataaatgggagttaaatgatgagaacacatagacatgtagaagggaacaatgttcactggggcctaccagagggcggaggatgggaaggatgagaggatggagaggattaggaagaataacttatgggcactgggcttaatacctgggtgatgaaataatctgtgcaacaaaccccattatgcatgggttttttttttttaacctgtgtaacaaatctgcacatcctgcacatgtatccctgaacttaaaagttaaaaaaatataaaaaatacaagtaattctgaggtacagatgagcctgactgtgtaactcatcctttagcatgctaacccgcattaagttgatgcttttggtgccgggaacctcacgtctcctcctcttctggaatagcctagagaggaagctcttcttctgtgtttagagggaaggtatctccttcagtaagcactgtgctggccctgaagagtcttcctaccctcttcctgccccctactgccactcccaccccaccagcgtggaacttcgtgtgtattcaaaggtccagtttgaattactgtgaggccagtggctagaaagcagtgtagttgggactggagattcwcatgcctggctctyctcccaagcttcaactgtagctcttgagcagcagcttcctctgagcttctaaaaaatgcccagaaaaytgcccagccaaccacatttcctggcaagcatagcaccaggcatatggtcagtttgagtgctattagataggctttagaacttccaagggatcattggtttgattgtcattgtatccaccaatcacccaacatctttgacccacgacaatttgccagacactatgcttggcactctgaggaataaaaagagtaagacagatccctagccttttctaatctatctatctaatggagatatggcaaagcacctaacaaagtcactacccattagagttgtgaatagtggtaataataattatttttgaaaatctaagaaaagagagcatgtgctagaataggtaaggagggcttcactgagaagatggagttggaattgaatctcgaaagctggatttgttttggataagtagagaagagttaagaagcaaaagtatgaacaaaatctttttttgagaatgttccaaaaggaagtaggcaagaagaatggtaataaggttggcaagattggttaggaaaattgttttttagtcctgtatataacaactttagagaatatttactataagttaggcatcatactaggagctggatatatgataaacaaaacagaccaagttctcacccccttagagcttaccttacagttggagaggttgtcaataaataggtgagccaattactaagtaaktctcaaatccatggtgctatgaaggaaacgtcctgctgcaggaagtgtggaaacctaggtagcaccctgggaatggccacgctaaggagaagcacttaaactgaaagctgatgggtaacaaggacccagtctttacaggtgttgaggagaagctcattctaggtaaagacaatgggatacaagaaggtgctaagaagggatgagttttgcatatttaatatactaaaactatgccagggaggttgattgcatagggtcttagtgctaattgttttaacttctttcttatcatggagtttgtaggattcttgacaatttagtattgaagtaatcatataatcaatactaagaataaaatgcatgtgaatgatgactcttacacattactacgtaaatgaaataacctgtacaacagatcataagccagaggaagttaagacaatgaatatgatcttgatcatccagaatttaaaagagacagtgtatgatatacatttactttttaaaatttagacactttgagttataaataagaattggtccacttggtgtgaaattatgatcttttggtaatacagaaaatatattgatgaagaaaaagaatatattttaagtttaaattataatgtacattttctgtaccataagagacactagtggtattgatacattaatccgtaaggtaagatattggaagatgaccaaaatatagatcaagttccttattatggtgttcagtaatatgtgaaagtaagagtggtaccataaagttcagtcaagtctagactagaaaaatatccaaagcagtttagactacgaacatcttttttttttcttttcttttctttttttttgagacagaggctcgctctgtcgccaggctggagtgcagtggcgtgatctcggctcactgccaagctgttgaccttagttagtgattcagaagtaacatttaaataattgggtatgagtatgtgtgtgtgtatgtgaatgtgtttatgtatatgtgtctgtgtgtaaaaagttatttgacccatcagacctttgagtgcaaacacgtgcaggaagccaagtttaaggaaattaatggaacataattacaacactcaccagaaaagcaaggatttgagtaacctagggattggatgcacagtttatcccaaaaaaatttttaaatccaaaagtgaaaataattccattattaatgttttagaagaataaatccagagcattataatactttggttaatactctccaaattattgtgtatatgtactgcaaattatacagaaaaaaaattttaattttccaatggattcttatcctttcatcctttcatttgtgatgttaacacttgcaggatgagaagttagatgataatagttggactttatattccttcatttgtgcaaaaccttgaaaactttcataaattaaacctcttgctgcccttggaaaatcacaaaatgcagtacaattcctctagcgtcttttaccatgttctgtgctggccagacatttagttctatttaaaatccacttacgtatattttaaatattaattctctggccatgcctagtatgcaagcactctggtacaagattctagagtgttaatatgctgccaacttggaccttattcaaaactatattgagacagtttgtgattctctaattcattatctgtagttagactatccatatctttttagtaaaagagaagaaggcttatatattagcatatgcaacacatagaaaaatgaagtataaacctttcagggtactctaaaccttgtaatttttaaagaaacaatgttatacacacaccatttttgtttgactaaatatggtatattttaaccgtgaacacgttgaatgcattccagtgtgtcaaatgatattttaaatgtaaatagaggtgaatgtgcctgagaatactctttgggaggtggggctgttttggggttctgttttactttgctgacactgctgcatgattctgtgattaacaagcatatttctggtgctatcatatggaaaagttagcatttattctcccttaacattttattggcatctttgatgtgttataaaacaggcatttactactgagtagctaagcatttctccctctttgtttctttaattaacgtattgatctaaaacaaatctataggatcaagcttattgaggcagacagcctgtttgtctctcaagagatcattgctgcactccacacactttttcagtaaataaaatatggacaaaactgcaacatgtggaggctgaagattccattaaggacttttggcatctgtaccttaaagatatttcaaaaataattgtgctttattgcttcttctctgccatagcatataacaagcgttttttaaaagaccaaatacagctctctgatttccatttaatggaagaagtaataaagtttaattgtatacgtgagcatggggcatcatttgcaatacatctgatcaataattcatcgattgccgttggctcaaagtaatatttgaaagaaaatgcagccagtgggagcttatctagctgtagcttcatcatctctattaattatgtgtttcccgaatttggatcattaggctaccaaagtgacagcagatggcgagcagaccggacaggatgctgagaggaccaacacaagagcaaagtccctgggagaattcattaaggagcttgcccgggatgcagaaggtattagaaagaatcacrttttaatcatcatttctcccaacagaaaaacacagaaagggatgacacaggactggaatttctcttgttataagtgacatctgtaaaatcaaaggtagagtttcaaaaagtagtgtggttaagatattcaagggtattatctgctgagaacctgtgacctgcagtgttaaattagcgacaatagtgaattagygacaatgagggcagaatagcagtaaattcttgtaacatggctattataattacataagaataggcaacttttgttttgttattgtttttatttgaaagtatttaaagtatttttcattttcaagcaagctaatgtcatcattccacttgatacattaaagcagcactttagtttctccaaatggcttttcaaatactggggactggtttttaatgaacatctgttgcttgggatttggatgtgctactttatgagaagctctggtgcatttagctcacaattctctaggagttagttcttgccatctactaacatgaatgagaaagtggaagccattttttggcaaaagcccaaattaagaaacttaaagaatacagataatgccccatccgcactcgccccccaaaaaaacctagtccttaaatatctgttaaaatataataaacgtgcawgcatgtttagaaattgggaaaaatgctttttgttgttttttgcttgaagcagtaaaacatttttcttgctctgcaatattatgcattttagatactttgcttcataatgtagccaaataaataaggatgtgagatcaacttcaaggcagattctgactgataattcttaggcatcactggccaagaagagacaaactcccaaatgttcaccactgcaagaagcaacagggttttaatttgagagctaatttgaggcaaaggtgtgaggttctgaaacagaaattatttctgccagaaaaatctcagttaattcattgtggtttatcctctgctagatgaagctgttgtactttccctagtattattttccattaatgctacttgaagtgtccccctccaacccaaaacaacaacaacaacaaatcccactgcaggtagagcaccttcactctgagcggatccccaaaggccctagtcaatgctccaggaactttccttttctttccattgacatttcaaacacccaacacctagcagcccatcctggggactcattttcaatttgtttcaatcaaacactggtatgagaataaatgctagcatatgttttagtagatcctattatcaacactgcttactttgttctctgcaatgaaccttccatctcccaccaaagagagatgcatattcatggttacctctttggtcaatatgaatatttgcttcttctgggtgcctagggcctctaggtactatttgtacaatttgtggaccaacaggggtagactggagatggagatttatcccaggcttgctcaccaccccaaatcccacgtctatacaccagagaaaggattacccatcaccaaaggtgtctctcrttccctaaattatgcatagatcargtggtctgattgtgtctgtccagatagggcacccttttctaatttatgtgaagtgccatgtgggatagctatactttagggaaataagaacaccactcacttttgcctgcaggcactatttggtagaattaatccaactgttaaaattgaatgaaaggtcaaatttaaattgtaccagagcaacactaaatgttcattgagatgtaatacaaagcttggcagtttaatggagaaaaaaagagaaagtgggggaaggaagggaggggagggaaggaagagaggggagggaggaaaaaggaaggaagggagggagggaggagagggaaggaagggaggggagggaggggagggagggaggaaggaacagagggaggaaaggggaagggagagaggaaagaaggaagggaaaggagggaggaaggaagaaaggaaatggaaagaaggaaggaaagaggaagggggggaaagaaggaagggaaaggagggagggaggaagaaaagaagaaaagggaaggaaggaaggaaggaaggaaggggaaataagaaagggagggacggaaggaaggactcaccaaaggctttaaagtaggttatactgtatatccacacctctttttctctctctctaaactataataatgagggataaccatcagtacttttacatttttgtttgtcagttgtaataaattgctgtgggaaaagtaaatgcttcagactgacatttatctatttcagctttatgtttggatagatgtactattcatcctatctttcattatgagtcatgacctcgttatagataatcaccttctattcatctaagrcattcttatctcactataattttataatatctaccgtgctatgactcctgattagttcataaataaactgttttattccacgcattattagaattaatgagtggacataggtaaacccattagtgtttatttcctgacatacaataggacttaatcaatgatagacacctttccttcctgtttctcagatcagagtattactttctattcttaataaatttacccatcagaggattttgttttcagtcttagtatgaaaacagttttgcttctcctgaggaatttttacttacctttatagatactgtatgcctcttaagaatcctatttgtattccctgctacrcgtagtctactaagatgcttagtagtggacttaggatgcactgcattgaacgttatggcatggttttctgtctactaattctttccctaatttatacaacttttttttttacctgtagtgctatttccttttattttaattttatctgatattaggatttttaaaaaattacctaaatcctcctttgaattaagttggaaataaataagtaaattccaaagatacatcttttacaatcattttcaatactgtgggaaagaaaatatattgaagtgatagtgcatacttttgaataagagatgaaaaacacattcatctttaagaatgctcagagaagttccagatcctatttatacataggatctggaactatatatatgtatataaacataaaactgtatgtttatatatgtctataaagagtgaaacagacttctattaaaatgatgcttcctttccttttttggtgggggagatttctaagaaaatcatattgcctagcaagtgatagatgcctatgagagaaatggaaaatgacagcattttaaaatttaactttcagtagaaaaataatggaaataaaaattaaactagacagttcaccatacaaaaataatgttaaatgagggtaagtaaagcgcagtgaaataatctggaaaataactataaaactttaaaacactaataataaataaatgttatccaaattaaactggcaagttttaatgggccatgtgtaatttatctgtgtcccgatgaggccatatttttctccaaaacccatatctaaaatttgtttttcataatgaagataaagtagcacacataccaaaaacccatttgaaagatgctctcatttaatccaaaaagatactgaaggcccatgtccattttggggagcttgtattttttttacataacatgggttgcaacaaaaagctggccatggaatagcagtttattccataagcagccaatatatttgctaaaatgtttgttcttttggtcctaaccacattgaaatcttctgggactatttcaataacagtaattgcaacaattgataatatccaactggaaaaaaaaaaacaacctcatgactgagctgcacagtgatgtcctatagaaactttatggggtatgtgttatatgttttgatgtttttcttttttttattctcatgtttttattttcctttttactttaagttctgggatgcatgcacagaatgttcaggtttgttgcataggtatacctgtgccatggtggtttgctgcacctatcaacccatcaaaagaagacatttatgcagccaacaaacatatgaaaaaagctcatcaccactgatcattagagaaatgcaagtcaaaaccacaatgagataacatatgacaccagtcagattggtaattattaaaaagtcaggaaacaatagatgctggcaaggctgtggagaagtagaaacacttttacactgttggtgggaatgtaaattagtttaaccattgtggaagacagtgtggcgattcctcaaggatccagaaccagaaataccatttgacccagcaaccccataactgggtatatacccaaaggaatataaatcattctactctaaagacacatatacagtatgtttattgcaacactatttatgcaaagagatggaaccaacccaaatgcccatcaatgatagattaggtaaagaaaatgtggtacatatacaccatggaatactatgcagccataaaaaagaatgatatcatgtcctttgcagggatatggatgaagctgaaagcttcagcatcctcagcaaactaatccaggaatggaaaaccaaacaccacatgttctcgctcataagtgggagttgaacagtgagaacacatggacaaggaggggaacaacacacactggagtctattgggggttgtggggagaggaaaaggaaagcattaggacaaatagttaatgcatgaggggctttaaaacctagatgatgggctgggcgtggtggctcactcctgtaatcccagtactttgagaggccaaggcaggcagatcacctgaggtcaggcgttcaagaccagcctggccaacatggcaaaaccccatctctactaaaaatacaaaaatcagctgggcacggtggcatgcgctataattccagctactcgggaggctgagacagtagaatcgcttgaacccaggaggtgcggtcgcagtgagcagaaattgtgccactgcactccagcctgggcaacagagcaagactccatctcaaaaaaaaaaaaaacaaaaacaaacaaacaaaaaactggttgacgggttgataggtgcagcaaaccaccatggcatatgtattcctatgtaacaaagcttgctttcttaatacatgatcattttgctaaagtcatttttgtgcaccttaatgattgcttcttgtttacaaatggttttaatttaaagaaattatgtatgccatccaaaagatacagccatatttgccttttccctttctctatctgttgtcattctttttccaccagattcttctctgcagaagtttagctttgagaccagagcacaagagaaatagtgagactctgtctctcatttttcccttcctctatactgcctaggcccagaatctaaattagatcaaatttcaaaagatatttcttatgaaagctgatttatacacgcacacacacacacgcgcgcrcacacacatattcatttaacaaagaaaaaacatacagctttagcaggttgggaagtggcatttattaatatcatcttcattttaaaaagtgagtacaaattatatcagtagttacttacatgctacaattggttaaagtcagctatacagatagcatgcactcagactaaaggatgagatagtaccataggtagagccaaatctgctactgctttcttgaaatctaagaagcagaaagcttcttacatttaatcattggtactctggaaggcttcccacctagtttgctggaccagggagctttcaaactaatcagcctatggttactgtgattctgtaacaaaattgagacacagcctaggtgatgtatcttactgacaatagtggtgaaatattgggaggattctttggcatatgtcaaggtataactgttaggcagtgggtcaagaaagagccaccctcactaacttctaggaatacagcacctgacaataacttctaccacagggctaggaatggccatatttgttctttaagacatgtgattcaaatatttctgctaattaaaccatggctgtcttagcccatttgggctgctataatgaaaatatcatagattttgtgccttataactgaaatgcatttctcatttgtgaaggctgagaggtccaagatcaaggtgctggctggtttggtgcctggtaaggagctgcttcctggttcagagatggctgtctccttgttatagtttcatgtggtagaaagggcaagggggttatctggcatcccttttataagagcactaatttcattcttgcccttatgacctaatckcctctcaaaggctctgtattaatctcttctcacgctgctataaagaactacctgagactgggtaacttatgaagaaaagacgtataaattgaccacagttctgcaggcttaacaagaagcatgactaggaggcctcaggaaatttacgatcatggcagaaggcaaagggaaagcaaggaccttcttcacatagtggcaggaaagagagagaatgaaaggggaagtgccacataccttcgaacaacctgatcttgtgagaatttattcactatcacaagaacagcaagggrggaggtttgctcccatgattcagtcaccacccaccaggcccctccctcaacatgtgggtattacaacttgagatgagatttgaggtggtcggtggggggacacagagaaaaaccatatcaggctctgcctccaaataccatcacattgggaattaggtttcaacatatgaatttgaggagaacataaacattcaatctacagcattggctatcagggttaaagtactgactacaggaacttttaaaccaaagacatatataacgaaaaaagaattataaagatgcattgtggaaagggtatattagacattgaaactcaattctttctactatcccagtgtttctcaagctctagggtacatcagaagctctgagaaggcttgttaaagcccagattgctggtcctcacccccagaatttctgagtctgtaggtttgtggcagggcctgagaatctgcatttctaatgggctccaaggtggtgatgctgctgctgcttataggggaccacattttagaaccactgtactgacccaccttctcacatacccctctgcctgctctgcttgtcctgactatgtacacctgtttcaggagctctgcccagtgcaaaactctctccaagaatagaaattaattttcaggaatctctatgtcataaggagatcttcggatacacccttgaatggtagaaaatgcctcttggccaaccgagacccctcattctaggagttttcaaaggtaatattatagaaataagtattcagctgacaaaagagtttgagaaaacatctctcttaaattcaccaaaaaaatgtcctatagaacacactccaggaaactttagtctaaaactaataatataactgtgtaaatgtttcaattcaccattttaaacttttatttgacgtagaattcttttctcaaatgaaatcctgcccagaacatcagcctataaagcagactcttggcagaatagacatcatttgtagaaaacctgaagcacctggagaatcctacgattccaaggagtacagtttgaaaccccatttaatgcataataaacacagacccttgtgaaggatgctattgctggaaagtgtccttgaagcctaatttataacccttctcctagaagggttataagtctagaccagtgcttctttcttcactcctttaaaaaatgaacacaggagaactatgtggaaatacaagggcaggttcattttcagagatctcatcactgagtgtatttccacactcagtatttttaaactgactgatagccactgctatgactatcttatcagcaatgcagagcttgcgtttccagcctccaagtgttatgctacaggtcactgttttttttaaactcttacctgartatgcttcgacctacttctttattttaattctttctttcttttgaggttagaaacaccatgctttaattgctgtaacccccaaaagaaatataatattgagaaacatattacatttccctgtttgttactgattgttgtcttaactgcctctgtggttcccagcaggaacactcacggcaaaatactcttcatttggagatggtggtgcccagcagatgctgaataccatgttttcatgtggcatgtttgtttactaatttacaaaatttgttttaccccctgcagctgtaaatgaaaaagctataaaactaaatgaaactctaggaactygagacgaggcctttgagagaaatttggaagggcttcagaaagagattgaccagatgattaaagaactgaggaggaaaaatctagagacacaaaaggaaattgctgaagatgagttggtgtgagtagatgagttattattttttcttttgacaaactgagatttccagataatttacagttttctaaatttttatcacacgtataagtaaaagatgctttgtttttccaacctggagatatttgctatgttatctatcatctatctatctatctatctatctatttatctatctaccatctattatttattcatttacttatttaattgtactttaccattgttccaaaatgaatcaaaagcatgttcttgcctacatataatcaagtaaatgatcttttctggtgctgctccttctgtaattaggctaatgagtttgttttgttaatcatctgcattagggacttttggactatcagttgatttttgttttaataaaaatacctttggataaacaaagttatgactttaccattcatatattggccaacctatacattttatcatcttaagaaatgctgaaaagaaaagtcatcaaataataaacacctaatactttcaaataagagttgcgaatatgagggttgggaaaagtgatagtgattttacccatgctaaagaacttttatgataacgcactcaataaaatagatacatctctacattcatagtcagctaacttcaaagtggtagtattactaatacttaaataatttatactaaaccagcaatatcagcacaccagagaacttgttaaaaatacagattgtcagaccccctcccagacctcctgaatcagaaactttggggatgggacccagcaaaccatgtattaacaagcccttcaggggattatgaggcatgttagtttgagaattactgtctttcaagtatttagagtttcttaatgactcgaaaattatcactttagaaaaactaggtaagttaaatccaaaaacttccagatcaatcagttggaagaaaaagaaacatagattaaaattatgctagtctactagcatgacaatgacctagaattctgttcacagtttctgagcaaacataacaatattcatcattacattcaaagtaatagagaaaaggtctcagtacaatgaaacaagtggattgtttgattttggtatgtgaagtgaatcttaaaactcatttcatcaatcagattcctagaatgacatgattcaaaatgttattttacttacaaatttaaaaggtttcttaaaaatctgtttcgcttttattttaattaattataaatggtctcaggtaccagttttcaacttgatttagcacacagtgaatctattttacatgttttcttattttctcattcttttcatgttagcatctctttgtaacatggyttaataccaataaaccctaaggcagtgacatgagctcattgtctattattgggctgggggtggttacagagctgcagaagcccttctgaaaaaagtgaagaagctgtttggagagtcccggggggaaaatgaagaaatggagaaggatctccgggaaaaactggctgactacaaaaacaaagttgatgatgcttgggaccttttgagagaagccacagataaaatcagagaagctaatcgcctatttgcagtaaatcagaaaaacatgactgcattggaggtgagtcttaggggcacttttatcttaatctcagaaggttggggactgcgggggcagtgttgaacatggctggactattcaagttgatgcacatttacaaaagtcaagagtgacaactctgaaagggggcttctaagaaacagaacaagaaatgacttttttttgtttttgttttgtttttaatgaccagttaccatcgcccaaagaatcaaataaaattttgataaattaaactgttgaagatatttaagaacactgtgatacagtggaagaagttctttacagggagtcaggcgaccttggtctcaatgacaactgtgccactatctagacatacaaattgggcaagtcaattaatctgtaagcatcagttcyycaaatctacaataagtgcattatactatagcatacatatagggtatcttcaaatattcatatcatattattttgcagctttcccaaactaattcacaaatcttgttcagagatcttgctgccaaaaatcatagaagttccctacactttcaaattcaatctgagcacatgacaaatagctcaatgaattgagaccagagcttggaaaaattttggttcctctttttctatgcgctgtgttctatgcaaatgatcttttagaaggaactaacatgaatagatcaggtctgcgttattttctcctccttttccacacagataacagttacttctcaactcaagaaattatgggcagcctctatctttttaagagttctgatggaactagaactaaaacagattcctccattattttttcttcttttttttccaatttctttcttaatcttaacatagtaaatwatcacttttcctaagagtaaactcagcacatataacagcagcaccctgtatktgatattaatatttaaacaacaacaactttctccccagagacaaatttacctttgctgttttcaaagtatctgactccaacaggtcagaaaacagcagcagacctatacrtcttctaacacataatttcaccgtcaacagtaactcagcaccctctggcatatagtatgtatgtagaaatgtttgttgaatgacagtaacaattgaatacaatcaaccaggattttttaaatctattcatttctattttcctttagattaagtagtaagaggaagaattacatttttttaatatattttatttccgtgtccctcttctgggacttagccttgtcattctggtagaatattgaagaggcttactttttttcttcactgatgcacctaaccaatttggagtctactgacatgctagcagtattccagaaatactgctgtgaggcaggatgctgggccactgtcctgtcacaggctccagcatgattcrccctgctcggtgacacaccagccgtgtgacttacccgaaggtgcacytgtctattttatggcaaccgtttgataaatgaaaattacctgtgtggaaagcatagtaagtatttgagaaatatttcaagaagagttatatggcacagtcaatagtacctttagctattcgtttcttttagtgatgtttaaaaccagaagtcatcattcttgggcacccctacaaatacctggagcttatgtatagtcggtattgaaattctgagtggtcctgtttggattttccttgtatgtgccacgtttaactaaagacttgtttaaaagttactggataaaatagataaactaactgaatcaatatgaataaggcatagattatttatggttgcttaaaccaaataaataatttggttgctgccaaaatggctgaaaatcacrtggggtgtttgttaagccaacaggtttcatgggctcccacctagagagtctgtgtaggctgctctggggtttggccccatgtgtacattctaacactctccctgggctaatctgatgcctatacaggttcgaggaaaactgacacattgcatctatttgattgaataataagctgcattttaaataaataactcccttataactgtgtccacaatgaaggtaacacaattaatacccaactcaaaaactttttatttattttaaggtggyatgtaattttctttttaaaaattttatcaagcctctaattcattcaggaaacgtgctagacaccaaaattgattgtgtcagtgatgagcccccttagagcagcagcctcagcgtaacctagcaacttgtcaaaaagacaaattcttggaccccatccctaaatgaccaactcagaaactctgagaatggggcccagaaatccgtgttttaaaaattcctccagtgattaagatgcagcttcaaggttgagaaccacgggtataaacactaaaacaccatctctgattacttcaagtaacttgtatttagtgggaggtacacataagcaaaccactccatacgctaccataattatcacaggcgtaagcaaaggagggagtctaagtcacccctgagtttaggaagagctttgtagaggccctgacacttgtgctagatcctaaaggataagcactgggtcacagaagaataaagagaagaacatttcagaaactgggaaaaacatatacaaaggcatggaggaaagaaaatgacattttgggggaaagttcagtggtttgataggcttggaaagaagactgcatgtgaacgactgaagggatagaaagaaagagaagataggcagagtgcagaccttcagttataagagaatcgcattgtgagactaagctaaggaattggtttttatcctgagagccataggaagcaattgaaatattgcagtcatgggttaaaataaaatgttgcagaatttgagtggctcactkaaactgaataaatggttttttatcggaaaatagtgtgatattaggctagaaaagtaggctgggataatatttatctacatatctgtcaggtacctaccatatcaaggtactgttggtaaccagggtatttgaggttgaatagaaatgattcctggcctcaaagaatttacaacctcctgaaaaattcagacatgtyaacctttcactctacataatactatgataatattgactgggagattcagcaaaagtttcacaaaaataacagcatcatagcagaagtggagaggaattggaagaaagacagagcaacaggaaccccagccagagctttggaagtgtaaggtgatcttaggaagtgtccagtacagcagaaaaactttcaaaagctacgtaaaaatctgtagcagagaaggctctggaatttggagccagatcatagaaggctttggatgcagccaactagatggtgatggagttggaaaggcatttccagcagtggagagagggctaagggaactggggacgtcatgggaagaaaagagaagacaaatatttcagtgaagcaaaataatatgtattgagcagtctatccccaaatctaccattatatccttgccaaagaaggcagtgcggatcaagtaaagagtaagttgctacataaagaatacacaggccagcctgagcaacatggtgacaccctatctctatagaaaaatacaaaaattagtcgggcatggtggtgcatgcctgtggtcccagctacttggaggctgaggtgggaggattgcttgagcccagaagtttgagcctgcagtgagctgtgatcatgccacagcactccagcctggatgacagtgagacmstgtctcaaaaaaaaaaaaaagaaaaagaaaataaaagaaaacaataatagacaggaagatagcttttgcaggttcctgaagaatctaccacaccaacacaccaaaaaaaaagaaagaaagaaaaagaaagtgtccaatttgcaaagctctggaataaataaagatctaattaattacaagttaaaagtagaaatataatcaaccttcatatccaaacaataattgagcaattatacttatgccatactttttgtagaataattctccctatacataggccttctttctgtttcttaaatactctaagtttcctatcttargtattttatatgctacatcattttctatctgtgcctctctttgtttttattgtactcatctaatctttctttaagaatatattatacattaatttactcattcattttatctctcctccacacaagccatgaggaacatgtgttcttcctcacatcccccaatcctagaacagtatctagcaaaggcaaaacagattgttttccgtgaataaataaagtgccatagaacaaacccagatactctatacttttgtcaatatttgtgagctccaaatttccatcttttctcggttcaaagctagaacccatcagtatctaatctgaaaacaagacacctctaaaatttatttaacctcatcccagcactytgggaggctgaggcaggaggatcatgaggtcaggagatcgagaccatcctggctaacatggtgaaaccccatctctactgaaaatgaaaattaaaaaaaaatacaaaaataaaaaaaattagccaggcgtggtggcaggcacctgcagtccctactcgggaggctgaggcaggagaatggtgtgaacctgggaggcagagcttgcagtgagccaagattgctccactgcactccagcctgggcgacagagtgagactccgtytcagaaaaaaaaaaaaaaaaaaaaaaaaattatttaacctcttgatcatcatttctgattgagtatgctaagaagcacattttgatctttgcttttacaaaagattctaactcactactttattgaaatcaaaatatatatagctcttcaattaacacacgtgtggaaatatcttccctgtttccagtggcacagcattttaaattaccttgatccattaattcaaacaagccatgttgtaaaagattcttgtgtttctgtacatgctatactttaagtcagctcatacaaaagctaagggctaaaattggcagttgtgtaaaagaatgttagacccttggaagataagatatgacttgtaatcagggagattgtaatcagggacattgggactcttcccacatttgttgtctgtgaagagtgaatgacatatcaaaacttcccctgaattagtgatgggagtagctgaatgagccaagtgtcagcagcacaagtcccaggaatggacttcattttcttttttctttcttttcttttcttttttttttttttttttttgagacagagtttcgctcttgtcacccaggctggattgcaatggtgcaatcttggctcactttaacctccacctctcaggtcaagtgattctcctgcctcagcctcccaagtagctgagattacaggcatgcaccaccacacccagctaattttgtayttttagtagagacgaggtttcaccatgttggccaggctggtctcggactcctgacctcaggtgatccacctgccttggcctcccaaagtgctgggataacaggcatgagccaccgtgcctgacccatttttatttatttattaaaaaatatttattgaggaaactcatctacatactagagatagtgatatataaaactgtctttatggaatttgtgttacagtgcaggagacagtcactaagtcaataaataagcataagctacgaccataaagtctggatgcacgggctgataaacataagttgtttactgatatgtaataaatggtatgttgcatgatattgcataatagattcaatgtgttgtccttcattaacaatgtgtagttcaacaggctgtgcctttctgctagtccctgtacatgtatctgtgatgcattggtatttctgatttttattacctaatctttgtttttagcaactcccggcaaaagtaatcaagacgaatcaatctatataaaaaagaaaataatattgtctatgtttctaccactctgtagaatataattcagataaatgggttctaagaagaacaaaataaggtaattataatagttaaaattacagtgttactgggtgccaggcagtgttctaagctaattcttctccaattttacaatgtctatcaatcatgtggggttcttgttaaagtgcagattctgagtcagtagttcccaggaatggattgagattatgcatttctaatgagcttccaggtgacgctgatgctgctggtgaatgggctgcacattgagtagggagggactaaacattttgtatgaaggtaaattacttccttaaggtttcatagcttgggagtgagcagagctgtgatcccaaaccagaagggctgtcacttggatgtagcttttaatcactgtgccctagtacatagagaatgaytgagacaaggataggtgctattttagataggtaatcagaggagtggctattaccagaatggagggaggamacaagccaaagagtaggaagagcacatagtgggaakatctgcaagtgcaaaggcttagaggcaggaactagttgtatgtacctggcaacatactgaattggtcggtgaagggaaggaaagaagggtatgaaattagcactagctcagtgcaaattttaaaactgtgatttctataatagaagagatagtattttcgtagtcaaggacccaggatctatcattaagtagacaggggtttaaatcttaatcacactgtactatgtgaccttaaaggaatcatttaatatcttagttcatctgagctgctatagcaagagaccaaaaactgagtggcttatatgcaatcaaaacttatttcttatggttctggaggctgggaaatccatgatcaaagtattggcagatttggtgtctgatgagggaccactttctggttcatagacaccgttttcactgtgtcctcacatggtaaaaggatgaacaagctccttcaggtcttttttataagggcagtaatcccgtttatgaagtctctgcttcatgacctggtcacctccaaaggccccacttcctaatcctatcaccttgaggattaggatttcaacatatgaattttcaggggacrcagacattcaggccactgccctttacttatycaatttcccacttatgtaaaaagtgatcaacatgggatccaaagattggaataacaaaatgcttacaaactgtctggcacatattgagatctaaatgaattagcattattgtctatagaaaaaaactataagtggtcaaagcttaaaattataattgatgcagttaaatctgtaggtagaatggtgatttcaggaataggaatgaatcagaagtataaagaataaaataagtaaaaaatagaccccaaatggagaaatagcaatatttgtctctcactgattttactcttctaggccaggattgagtttcatgtacttttgagacaagctatatgttccaaagaaaaattataatctrttctctcatgaaacagtccattaggttgattcttccatgtgatggtttctctatttcttaaaaagtattttccctaagtttccttaaaaatctcacttcaaatttcacagaactcccattgaatacatctgcttatgtttatgctcacaaagtactcatttgtatatarattctagaattcaayatgtagtaccaatataactattcagcacttatattttagttagaaatggatgctccatctttctttaaaagtagttttaattccttaactagtatcgcataacttttcttcgcttggatgactttctcacaatgagaagaagaaataacctgtacaagcctctacatagaagaactcttcaaggactggctaagtagtttatatttttctcatctagccacatttcaacatgatgtaccttttttgctaagcttttattcaaacagctcaggaaagtcaggaatacaaggggtaggattttatgaaaatgcaattttgatgtcttgttcataatggtctacagaaaaagaaggaggctgttgaragcggcaaacgacaaattgagaacactttaaaagarggcaatgacatactcgatgaagccaaccgtcttgcagatgaaatcaactccatcatagacgtgagtattgggtaaaactcaaaagagagatgataatgaataaatgggagccgatgagaaagctcagtaatagaagcaaatactagtacttgttttcttgtggagataaaattatttttgcattattctactgtgaccatgcctatctrttggtgacaactggaatatcactttgttctcccaatggacatgagtgtttgtgtaagtgtactcacacattcacacatatctgtttttgtccacagcgatgaaggacatttcttgttcctagagcagcacttacaatctgcttcaatatttatataacattagttaaaagacaaatgtaaatttacaaacaggcttttaacatgtaatgtctaatgcattacatagagtgatatgtggtcatagaaatgcaaatggcctaagagatcctaatgacatgtatacctatgaagtggcattgtttaaatagataggcttttcttggtctaagttggtttcttaaatttcctagtctatwccattaaataatgactttaattctctattctttttgctatgttagtaagtttgaagtttcattttaaaactaaacatgtgggccaggcacggtggctcaygcctgtaatcccagcactttgggaggccgaggtgggcagaytgcctgagctcgggagttcaaaaccagcctgggcaacatggygaaaccccgtctctattaaatattcaaaaaattagctgggtgtggtggtgggcacctgtaatcccagctactcaggaggctgaggcaggagaattgcttgaaccagggaggcagaggttgcagtgagctgagatcgcaccactgcattccagcctgggtgacagagcaagactctgtctcaaaaaaaaaaaaaaaaaaactaaactaaacgtgtagttatgtctcatagagaaattagtaaaagagaggaggcttgaattcacttgcttaaaatgccctcttctctacatatcagtatgttgaagacatccaaactaaattgccacctatgtctgaggagcttaatgataaaatagatgacctctcccaagaaataaaggacaggaagcttgctgagaaggtgtcccaggctgagagccacgcagctcagttgaatgactcatctgctgtccttgatgggtatgtcatttgtttttggaaatgtttgtgtattttgatgcttgtccaaaggttttgactagcataaatagtagagaatcattttcaaatcctgatttctgttaattatgaacacactagctatatggcctttctgtggataggcttaattaggagggtctgggcaaagcttygctacagcagcatcaaaagtctgatttacaagtagactcaaatatggcttagtaggaagtgaacatagccctaggctacacttagaaaaaattattttctgttctttattaaaaagcacagtggttgccttattagcattttaaataacatatatgaaaayacattctgtttcaaatttcagtttcatgtttctaatggaatcaaaacaatttattgttaaaaggatggcttttgaaaatttggycccatacgtagtctttaagtcttttttatttttcctcttttaagctccagggagacattacattttctcctgtaaaatagcagcttattctagctgggattattacaaaggtcataggagggagagtaaagagggaagtatacatttgacttacaaacagccttctgtgtataactgatatgcttttcctacaattttgggattgtcgtaatttaatagcggtgctattagccccaagaataatttgcccagataaatctacatcacatgcaaagctttgttctcatacttaatacttactgttataaagaaaaaatgctaatgtttgaagaccttggacaatatatgaactatcattttattttatgtcaaacttttgccactttataatgaagggtgggtggcagatgaaacacaaagctaggtatcatcagatccaggctctaagtccttacttggggacatattggtcatttggcctgaaacaggccatttaaccttctgaaattcacttrgtctcttcygggaagtgcacctaccccagaaagattttgtgaaattaattccagtaatgtagtacaagtgctctgaatctcacagcatgcttcacaaataargtgaagaattgtctcatatcacacacctgctagagcacctggttgcagagacttttggaggatgctatgggtatttaagatatgttggtagtatttcatagctgaattattagaaatataagtttaggttatagaaaactataggacaatataataagtagatacttcactattatttggaattgtcatagatatattggccatgatcatttggaagccagatttcrtataattaggacgttcttcatttgagtaccattgagtgccctgacatwcyktttttgaatcatcccaccagaatccttgatgaggctaaaaacatctccttcaatgccactgcagccttcaaagcttacagcaatattaaggactatattgatgaagctgagaaagttgccaaagaarccaaagatcttgcacatgaagctacaaaactggtaagaaacaaatggcacatgtgctgggaatggaagtcaacctttttgaatttttcaaatgtaagtcagtctggaaaatcccagtaaattggtatatttgttttgggytatttttgaagacctcttttaaaatttgcctaaaataaattctcggtatgctataattatagcagaactcttttctcagtcacccactaccactgttagggtsttaaaattatctcagaaaccaagcaagtttgtgctaccaactcacaaaataaaacaggcaaagacaacactctggatagggaattttatcaccattatctcaaatggcattagtaaaaaagaaaaaaaagtaaccattgtatataatcacacacaaattggttacatatgaagtttggctataaaattcactttttaataaaaacatactggatcatatgcttctaaacaatttataccatgtttatgaattaatgaatttttatgaatttttgaattaaaaagctcttaacctttggctacaatcattgttcgtaatacatttggaacaagtattttagagtttgggcattccaarttctatcacattatttgaatgccttcaatggtgacaaatctttatgctttagatgtaaagcaacattttgtacatgagttgtgtgatagtaagttggtagtactatttcaggttaaaaaaatctcataggaatcatcctgaataaaatgttcagaaccatcatttatttattttgtttcacatagaacctaccaaacacatgagaattttttkggggagaaatctgattggacatttgactgtgagtgaaatacacataagcagtggtgttaaagaaactgatcaatattttctttgcttcagtgttgggcaaaaatactttctaggatttaggggatattagagatatcccctaaatgaaccagtcttagcaggttcattttgtgatcataatgaaacatcatattctatgagcaatttgtactgtttttggyttctcttgagtgagccctactaatgccrtatgttctgtygacttcttattcaaaatagtggcatgatcattgcagaagcatttctatgttcagttatcctttcagaatgaatctacttttcaaatctaaactaaattttaatccatcttctgwtagataattttctattttaaagaccctaatttcaagttcaccattttcatttcacctgttttattgtatgattattttcagcacctaaaatggtgcctggcaaatagtaggcacttataaatgaatgagtgtattttttcattataattgacaccttttatgcctgttcataatcttttataccaataaaaatttgctgtagtaattgcttcatccttataaatttcttgtaacattttatgataaggaggtgtttaattttaccctaatttaatacctttaggaaaaatcattttttgccaacatgaagtgtgcacttacttcttaccacccatgcttatacatggtaggctaaccaacctcaaacagagagtgatggtgagttgtaatgcattacaccatgtctgctgttatcattattccttctctctttccacaatcatttaaaaataattaartgtctgaaaaattacaaaataagtgctatagagaatcagtgatttattaaatgactatyggataagaaaaagaagacaatctgtcccagaaattttgttggaatgtttttcatgaacagaatgaataaaattttagtttaatagatcagtataatrtagttctactttgctggaaaagaaatatatttgaaaagcattacgttgagtaattatctagataggactaacatcccataaatataagatctgatataaaagctatagctcaacagagaagaatgagattaaatgtattattaagtatagaagagttcaaagcttaacaatacagaagagtcctctactcctttgagtctagccctataaagaaggaagaatgttttcaataacttaaaaggaaaaacaaagaaacaawttatacatttgcaggagraaaggaaaaggtcaagtagtasagcaaccaacgaccactatgaagaaagtggaggtcagacaatttgagaagaaaaaaagcattgaaaataccataagaaaagaaacaaagaaatgatagaaataacctccaagcataattaagacaatgtttaaaatcaactttgattttttaaaaatttacttgtcttcctatatataaacacacatagacaatcaagaatcacactgaaaggaaaatatgagtgagaaggaagtggatcctttataagcaggagaaagctaayacsatttgtttgtactgcagtattattttgtaaagagtaatagctacttgtcttgcataactaatttctttaaatatcagaatgaaatgttattttaagaatttagacatcatgaaataacaaatgctatttttctattggtgtcgggtgaggaaagtactataaagcatttgttttcctacatataatcaccaagaaaatatctcatttagtacttctctagagggtgcaaggaaaacagaaaggagatatgtcactcataaaatggaataaaaatggaatatggacatcagtaattttttctcatcttagttgctttgatcctataagagactctaaaataacagagaattagatgtttttaaaacatttccaggtcatagtaaactcaaagcctacattatctatcagatcagatttttaaaattgatgaatgtattaatgttctctagaaggacagaactaataggatagatgtatacaagaaggggggtttactaaggaatattgacccacgccatcacaagatgaagtcccacaataggccatctgcaagctgaggagcagggaagccagcccgagtcccaaaacctcaaaagtagggaagctgacagtgcagccttcagtctgtggttaaaggcctgacagcccctggcaaacccctggtgtaagtccaggaatccaaaagctgaagaacttggagtgtgatgktcaagggcaggaagtatccagcatgggtgaaagatgaaggctggaagagtcagaagatctactctttccactttcttctgcctgcttttattctagccacactggcagcttattagatggtgcccacccacattgagggtgggtctgcctcttccagtccagtgactcaaattttaatctcctttggcaacaccctcacagagacacccaggaacaatactttgcatcsttcaatccaatcaagctgatactcaatattagtcatcacaagtccamcccttgtcaacttgaacccatacacatctcctgaaatcatacataatctccaaataaagacaataataacatcataattatacctaacataatacagctatcccttgtacaatcagaagcacactaatccttaacctaaatgctattacataaagttaacaacacttaaatgctgatatgaagtcaatraattttatgtcacatgataaaggaaaaagaaagcaaatgaagatattttcctagtacaagtgtatacatgcacaaacatattcttaacagaataaggaggaaatatatgacaattacagtcttcatttctgcaactggccacgtggttgtagctggtattgatgactaccttcttctactaaccattatgtattccctttgccttctgcaagcacctcagcgggtcatggctttttacctggtggggtgacccaaacctttattctggaaggacctgtgccatttgtagtcctgtctggattgggttggattgggttgttgtagtttcccattgaccttaaacacagaggatggtaatattaagagatgccctatgggatctcctgtattccatgcatgctcttccttgccttcattgtggaatagtagactgatttcaccttgatattctgggtcaattacccagccaacactgmaacccccttcttagcctgttgacttggaggtaggagggccccaattggccaggtggtaatcttaacttccagtttaatggaatcattgttgtatcccttggtgacagcattcttccctctggaactaagatgtctaggccagcagaacataatgttgtgggaacaggaagcaaaattttgctagtgggtcactagyggtgatggtgagtggtgccacttccgcttccaccccttgattctgggacmcgtgaacactggctatgggagaaacagtaccatattttggacactgattcaaggcatacacagccttctggagaactttgccccagtccggcaaagtwttgtcacctagttggcattgtaattatgacttcaaaagggcattccacaattctatcaatccacctgcttcrggatgatgggaaacatgataagaccagtgaattccatgagcatgagcccagtgctgcacttctttagctgtaaagtgagtgccttgttcagaggcaatgctgtgtggaataccatgacagcgaataaggcattctgggagttcacggatggtactcttggcagaaacattgggcgtaggatgggcaaatccatatccagaataagtgcctattccaktgaggacaaacctctgcctttgcatgatggaagaggtctgatataatcaacctgccaccaagaagctggctgatcaccctgaggaaggatgccagacggagggctcagtgttggtttctgctgctggcaaattgggcactcagcggtggctatagtcaggtcagtccatgttgctgagcctatgcataacctccattcctgccaccatggccactttgttcatgagcccattgagcgatgacagggtggctggggaaagaggctgagtggtgtacacagaatgagtcatcctatccacttgattattaaaatcctcctcagctgaggtcacccgttggtgagcactcacataggatacaaatatcttcacagtttttgaccactcagagaggtycatccacatacctcttccccagattactttgccaccaattttttaatcatgcttcttccaagtccctgaccatccagccaaaccattggctacagcacattaattagtatataattacacatctggccatttcttcttccaagcaagtgcacarccaggtrccctgctcaaaattctgccccctrggaagacttccctttgctactgtccttcagggatgtcctagaaaggggctgtagtgctgcagctgtccacttttgggtgctacctgcatatcttgcagaatcatctgtgaaccaggccctagtcttctctkcctctgtcaactgatcatggggaactccctgtgaggccatcagtgcaggcttggggagagaaggcagggtggcaggagtggaggccatgggcrtttgagccacttcctcatgcaactgacttgtgcctttaggactggctcgagcctgatcatgtatataccacttacagttgatgatggaaggctgctgtgtatgcccaactttatggctagatgggtcagaaagcatccagttcatgaaaggcartttaggttgcatggtgacttgatgacytacagtcaaacrttcagtttctaccaaagcccagtaacaggccaagagttgtctctcaaatggagagtrgtgatctgcagaagatggcagggccttgctccaaaatcctagaggcttccacctctaggagtcacctatgggagcctgccaaaggcttcaaacaggatccctgtctgccattgacacctcaaggactattggatctgctaggtcatayggcccaatyggcagagcagtttgcacagcagtctggactygttgcagagcccacttaaaattggcagcctttcaggtcactcaataaatgggcccattttaacacacccaggaacaatgctttgcatccttcaatacaatcaagttggcactcagtattaaccatcacagtgaatgaatagattttctatgacgttgactccttggaatgaccaccagaggcaataagyacactctcagtgacacgaggatatgaggccctcctctgcccatttacactggaaatgtcttagatgtcttagtgcttttcaatcaggtatatccaaacaacaaacaaacaaataaartaagactaatgcagaatgaattccatagttcagattcttcaagataatggaaaattatcacataatctccacctgttttgaaacattatcttctttccttcctttcctccctttctccctttctctaagtcagtggaatagtctagtttaactttgatgtagaaaatttaggcagtcctcaacctctctaggtatgctgaattaaaaaaaaaaaagaatgacatttttaattcccatggcaaatggagttctcctctttcttctgttcctcttcttcaccttgcaatgactgtcattttgtaaaactttctctctgtctctgtctctcttactcacacatacactcacaatgttccttaatatcttctaatcctgaatttcctttctcaatttgtttagttagatcttcactagaaataagtattagaaattgggaaaagtttatactggttgtattagggttctccaaataaacagaactattaggagatggatagatagatagatacattgattgatagatgacagatagatgaatggatggataggtggataataggctggtagatgatagatggatgatagacagattagatagatagatagatagatagatagatagatagataatagattagatgatagacagaaagaataagagatttattatgaagaattggcttacgtgattatggagsctgcaaagtcccagtatctgtgagctgcagatccatgatatagttcactttgagtccaaaggccagagaatcacgggagctgatggtacaaaccacagttcaagaactagagagaaaatgagatgagatgtcccagctcaayctgtaaggcagaaaagaagggaaggaattcctcctttctttgctttttgttctattcagccctcaagagattgggtgatgcacagcaatattgaggagggcaatctcttttactgtcatccagaaacaccctcacagacacacccggaaataatgtttaatttaggtgcccatggccagtcaagttgacacatacaatttacaatsacactggccttcaactccagtgcacaatgtggtcttcctctttattctccaaattcaagttctcttacttgctacagttgtccatatttcttgggaaccatcattctaaaaaatgytgaccaggcctttcttaggcatttctaggaaaaataatataaaatacagaataaagtgaggggagttcagatataatgcatttctcatagaaaaaatgwtagtgggatggttagtaaagaactgtgctgtgtaagcaagatgtaagctttaaacaaagtgaagaaaaggggagaagcctagaaaaaataacattatacagaaagagaatattcttaaatatgtcaacttctcttatagcraatttcccagtgttcattcctaatacaaggagagtaaaaactccatagaaacctcaaaaagagctttttcttgcaatggggttaggtgtctaaggaataaacaggacttttgaaactttactcttatgtgacagatcagtgaggaggaaacacgctgataagaagcactgaactactacaaatacgcttcatttgctataaatacacttcattcactgaactataataaaattcacttcaaaaggaatgtgaacaaaatgaaagaacttggatataaaggggcaaaagtgaacaaaaagatagraaatgtgtacaaatctaagtaagcattatggaaagcataatgataataattattaaatatgtggaattaaaaacaaagtggaactaaaacacaagagactaataamatggaaaatggggcaggtagtcagttatttaataaaagtttttaatattcttgaattctggggaggaaagcaaaaagctaattaactttagttttcactaagaatatgtattaaacattgaaaaaaaatctggaaaaataaaattgacaatattygagttctccagagaaacagaacaaattggaagtgtatatatacacagatatattatatattttaaagaattgactcatgagattgtggggtctggctgcagggaataggtgaatattgccgtcttgaatccaaaggcagtttggaggcagaatttcttcttcttcaggggacctcagtaattcttcttaaggcctctgactgttggatgaggttccccaacatcatggagggtgacctgctttactcaaagtctactgactgaaacgttaatcacatctaaaaaatacattcacagcaacatctagactgctgttttaccaaaaaccaagtaccatagcctagccaagtggatataaattaacgatcacaaacagctaaacattccaaacaagcagacagagagagaaaaaaataaagaaatgtgaaggggaggagaattttcaatcaattctggaaaagacaaaaaaagagaaaaagagaaacaaatcataaatataaaatataatggaattaaatccatatacaacaatcagggtaattatcaccagctgcctcaagaaataacccctgaaatctcacatgatggacataattcaagtttatgtctcacatcacaacacaatgtgagttataccaccttttgcatcttgtagtgacaccatacrgtgtagcctccaaggcagggaagagaaaaaatgaagagacatgtaggcccctaccrtactggctcatgaagcctggaccacgtctggtctgagtcattgaccagaagtagccgtgtgccccargctaactgtaagggaggtctggaaaagtaggaggcacataggatatttgatgagcactaactatctctgcttcaggttgtcttcataataaatgcaaacattaaaattgacaggttactatgattttcatattggattaaaatgtctaaaacaaagggattcgtctakgtatgacttacacaaatactgcaaatcttaggggaacagaaagactgaaaatgagagataagatacactatgcaaactctaaccagaagaaagctggtatgctaccattaatagcaatcaaaaagacttyaatttttttaaaagaattattaaggacaaagaaagtgatcatgatagaataaaaggaacaaggaaaactaaaaaattatgagcctgcaaggtcataataacaaagcctatggataaataaagataaatatatcagaatgagaacattttcatatatataatagggaatgattttaccatatctctcttaaaaagtgatagatcaagcaaagagacacagattttaaaagtaccttacacaagataacttaatggccttatagaactctatgtcaactagataattaattctacatgccccattcgatgaagtaactcatgaaacaaacaaaggaccacaacctagatcataaagcaagtatcagcaaatcctaatgatccaatagcatctagactacatcctcttatcataatgcaatacaattagaaattggtacaaaacaattgacaaaaagttttaaaataaaaaacatacttcaaagtaatccatggcttgagaaaaaaacacagtttaaatttacgaagtatttaataacagaatggaaataaaatttcacctcaaaatttgtgtgtgcaaataaagtggtaccaacaggaaaatgtacagtttggaatgcagatattaggcaagggtaagaactgatactaattatctaaggtttctgctcaagatgtttaaaaaagtacacagaaagaaataaaaataaaagcagaaattaatgacctaaggaaaggcattagacagggttgacaaaacagcaagttgattcttagaataaactagcaaataaacagaagacaagaacaattaagcaaagagagacaacacaaatgaataggatcaagaatgaaaaggggatcataactgtagatacattatagattgaaaaataaaaatggatatattggaggatatgcgcaattttattcaaacacatttgaatacttaggtgaagtaaacartaagtttagagcaaaatttactcaaaaagaaatagtacacctgagaactataaccgttaaataaattgcatcagtagttaatasaacaaaataacaatatgtacaaaaatgtaaaggacccattatgcaatttgttcccaagaatggaaaaagaagaaaaatttcctcagcttattttatgaggctgatacaatcttgatggcaagccctacagaggacagtactacaaagaaaaactataggccagttatttaaatagagaagctacaaatgaaatattataaaacccagttcaaatgtacatattttaaagatctgtaaatatacagtaaaacattaacatttgccagatayrgatgatgggaatagaggtgtctgtattaatttctaatcgtatctatcttatttcctacttaaatagtttaattaaaatgaacctcagaggagatagaaaatctgtcctgcaataaaatctgttctaaaataataaagaaaataggtctaaaatrggtctggaaatgaaacaacaaccctcatcctttacaccagcaagaagttctaaatttctttctttttctaaattcatgatgcatacatgttttaatttcttttaaatgatcagaggctgataattgcaagcaacaatcccctaacctaacttttctctcaactaagctcacagctccaggatcaacaattccaaatctttcaaatattcttcttttactacatctcttagtaatattattgtgccatcacgtatttcattaagtggggcattatctatttaattactgctatgatgaaggagatgtagttcacttacagaatatcacatcacattttcccacccttcagtttcccaatataggtacattactgtgcttagattcttcatttttaacctaatatactgagagcattatttcctgtataaatgatagactctgcactctttaagatgaagctatttatgtcctcattcttccctttagcttccttttttcctcgtcctctcagcttctacctctttaactttgatattgtgatggtcaataacatttacattttatctataaccataattgtgccatggcagaatacagaagtcccttctctgaagacattttattccttaaaggactccctttgattttttttcagtgggccatttgatgcttrattgccagttgctctgtgcagaagagaaggggtattttattccataaaataacttgcagtgaattattcctttttattttcacaactgactctcattctctaccttacctgttctttctgaggcctggccttctccaaattttttctatctccttgctggcatataccctatagtgcaagttgtgggtacaataactgcaaaagattgaggagcaggaactatctaaataaccatggtggctgggtgcagtgactcatgccggtaatcccagcactttgggaggctgaggtgggaagattgcttgagcccaggagtttgagaccagcctggacaacatggcgaaamcccatctctactaaaaatacaaaaattagccaggcatggtgacacatgcctgtaatccaggctactcaggaggctgaggtgggaggatcccctgagcctgggaagtcaaggctgcagtgagccaagatcatgccactgcactccagcctgcgtgacagagcaagaccttatctcacaaaaaagaaaataaaaggcccatggtggtgtggctaggaaagagtgccaaccctgtccaaagggaagctttctttgctgaaattatacactttctttctttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggtctcgatctcctgacctcgtgatccgcccgcccaaagtgctgggattacaggcgtgagccaccgcgcccggccgaaattatacactttctttgatcaacttctttttactccgtcatagttttattccccaccaatctcccccggacagtcactccattttacttagtctcttggtactattctcagaattcaaattttaaattaattaatctgtatttctgaagagctgtttgttttcttactgtatattttgctttctccatgggaaagatatgcttgggagcctcatgcagtcttggtgggagttatgtaaccactgggccagatatgtcagggcacacagcatggtgagccattccctggccagttccatcgcccagagccagaccctttgggccctacacagactgcacagccccagcatgtgggggcttgtataagggaagttctgatgtcacaggatccttggggtgtttcttcaccagctggaaacctctgtggccagtggcacctttgcctgagttttgctgaggtccactgggcacattccgcccactcagcctggcaggctacacttggctcacactaccactactgggctggatcccacacctgccaagggtgattcagggcagagtggcgaggggtgtgtgagtgagcgtgggctccagccactgtgcacagctaagcgtgccagctgcagtgggctgggcagctccaggtcctggctctatgtgaggctgtggctgaaccagacatactacaattggcttccaccactggtaccagggaatgcggtggcacccaggagcttggagatgccaggaaccacagagtctgaaagagggtctcacagccctggctcagggagtccataggtctcagctccccaaaaggccacagcccttctctcctgctcattgctgtcaacatggtgagctggggaagggggtgtgtttcarccctgtttgtgttgtagctctctcatttccaccatttgcgggggggtcccaagttcttgtcccacatcctggaagaatgaggtttgcagacaactggagggttagcaaggtgaagaggtgctttaytgagtgacagtgcaactctcaggaggcctgaaatgggtagctccgttccacaggcaggtaattccagcatctgtgcagcaccctcaacagaggtgagacacacagtgggtagctcctatccacaggtagatcatcctgttgtctgcccacgtctggctgagtccgrggttttttatgggcytcagaggggaggaagtgtatgctgattggtccatgggtggccatgagctggcccaaaaaaagcaccrtaagttctcactccagtttgtggaaccgacagtccagcccccttccttcaggcagtccctggcttgaaggtggagcttcactgagggcccacccctttccacccaggaacctgtatgcctcctgccaccaccaacctgccatccacggcgcccactgrcacccaggctgttcatgcctagggtcaccttcaggcccatgcagagccaccctcaactcccccttggcctccctaatgtgctccttggcacccaaaatccagaaggggccaagatagtagggggctagagtgtcagtgctgccccgagcatakgcacacctggctgggttgcaacagcctcagctttgctctgaaatcagcctgggtgccgggaacagtgagagaccaggaagaaggagcgggcacttctgagcctgtaggggaagagaggtggctgagggcacagggatgcctgggtccacagctggctgggtggctgcagctgcacccagtagggcagggttcccccaccttcaactcggaaggggacatggctcccacttgttcctggctcccaccagctctgtggagcacaaagccagacaggctgacactgccattactgagaccctcttgctctcagaagagttttcatcgcctgctccctctgttttcactgcttggtgactgtggtgttttgttttgttcctatttccttttctcagaaaagaaagtctttagaattaaaatttaagctgacaatagatcccctctccccagggagcagaaatatggatatccctaaaggtcttgagtgtttcggtctttcactattttatactcaatattccatgatttttatctagatatgcctggtggacaacaggtgatcgccaaatataggttgtccctcccatctccaaattctgatgctagaaatcaggaatggctatgatagtccagattttcagaattgataagatatttatattaccctaagagatacggaagttgaacagaataaaaaaattcaaaataaaagtaaataaaattactttctttccctgtttagtttgagatcatgtgtaaatatcagtgaacgtgatgtcatataggatttttttttattgatcagaattaggttcaagttgtgttctggaaacttctaattaaattgagggaagatgctagcaggccagaatttgggaattagatgatctggctccaaattcaatacatattgtctatgtaattagckgtgtcacctaatgtaccaataatgccttttcaagaaacactgtgcagtctgttctgattcctccattggcttaattcctataataaatatagtttccaaagtttataacttaattttcagaatttatttattttaattgacagataaaagtggtatatatttatcatgtacaacatgatgctttgaaataagtatacattgtggaatggctaaatcgaggtatttaaaaatatgcactacctcacatactggtcatttttctgtgttgagaacacttaaaatctactctcttagcaaagccatgctggctttagtgatttttttttttgtacatgatactctcatttgggtcaataatttttttaaaagtctattggaagcagagaaataaattttttgacccagccttagatgtatttaaaagttcagggcataaaatgatagatgtctcagggtttgtgtcatcagtcggaaacacagaactcttttgaacaatgccacaatgcaatctaagtttgatctaattttcttcaagacaataatgctcttggtgccatcctacctgctctttatgatttctacccgtaggtagaataatcaagaggtgagattgatgttgtttttgattctggacattaactagagggaaaattcgaagccctstaagaatggtatctaacttaatagacacctctccattacctttactcaaaactaagactctttgtggtatgggcccaccccacctctagtagccagctgctagtccagtgtctgtctcactgaagcagtctagtggtacacataggtactgagcaattatgtctgtcatgctgtaattgaggaaaaccatccttacttcattttatatttttgaatgctcccttgattgtccttcttggtgttcccataaagctaaaaattcacactcacgaattttaaattatcatgagcaatttgggggatttcctattttatcactgagtctcctttgagtgctcagctgctttcaatcttgacagatactcatctgacccatctaccacccttagggtatgctatgcgatgccagggacctacagccttttaagagatttttgaccaaagccgtctctttggggtgtttcttgactcattttttactcattatttaattttaataacctatagtacttaaaaatgtacagtactatataaagcaccttaaaaattgatgcatggtgattttcttattttaaaattgtgtatgattttttaaattattataaaagcagcttatgtctattatagaaaataggaaatacagaaaagcaagaagaagaaaatataaaatgtgcatacgagtaattacttttgtaatatcattgtatatctactcatatcttttcctatgcaaatagtttttctacaaatgggtgatatttatataactgtttcataacttactatgggaatkaacatcacatacgtattttaaaaaatattctcaaaaatatatttttaaaatgtatattgaactagattctgagaatttacatcattattatagtaagaacattatccttgattttgattcatagtctaacataccaaactctaaatttcttctgttactcactttacataaacacattgcagccagtcaccaacccttacatatatccctgcacagtttgagcagttttctttattgaaaatatttttaatttaaaatcatttaagttttatattatcttggcacattaacccctgtggaaatgtgtaagacttctcttctaaaataaattatttcataaagagagagagtaatagaataagtcataaaccatgctgatgaatttttagttactactgtctttaaaaagtaaacaaaaaaacagaaaataaatattttacatcttttacagccaactctttcaatgagttcaaaaatttcatctctaataaaaaagtaatttggggaacatttaggaaaaaagcaaaatatataaagcaatgtaaacaataacttttaaacttgcttgtttaraaaatcactggggtacaggttagtcagcctgataaactctaacttgccttcacacctccctcctccagcagagcctcctctgacagccaaacatctaggcatttctgtgttccattatggtaatgattgtctttttttataagtgactatatttgtttgtctttcctcttccctccactccagttccattagggaaggcatagtctttccattttgaatatttggtgcttgagataaataaaaagttttgttgggtaaataaatcaattcacttatctattaatcaatggcagtatgctttagcaagagtaattatgaatatctaataagtagtaggaagaggaaaactaacatgtattaaaatgcaattacatgccaagtcatctgttgaatcctaacagactttataatttcattttttcctgctataatgacgttttaaattatctcacattttcttaaacaattattaactaataaaaacatacagcaacttacataaaaatagactctgttttgcatgatatagttgaaatttttatataacttgtatatccatatgtatgaatatatatatatgtacacagactcagaaagagaataccaagaatttattgtttaaaaaaaaaaacctctaaaaagcaagaaacaaaatatcttgcaactcaaagaatctcatttatatttcacatatgctgtagacacagctcaggaactcagatgtgatgcttatgaatatgtataaagtataattagcttagaaaatgctgcttcatcacctgtcctgatattgttgatgtgcttcaataacttaccaagcaatgctggaaaaggttctctccaaattccagtgagttgaaacggtgcttttcacccataacatgttagtgttttccattcccttatcatgtgaaaagcctgtcctttaaacccagattgctggcagactgcttgtaactgacagttgtatgccataagctctttactttaatattttagagagcttcttgaaacattgaggcatgtcttttcctccaaatctcttgatttttaacctctcaattccacggtgcttgcatgaggtgactattctcttttctctggcctatactattacaataaccaattgatggctccttttttcccacacagctgcccaattcatcttcttggactacagctctgatcacactctcctactcagaaactttcaaggcctccaaattgctcattgcccagtttccttactcgcacattcaaaccttccagaaattgactctgacctgtctaatagccttacttctccacattgcccttgacgaaccctacaaacttagggagctgaaatactcgctctcacatccacacatcaaaagtccctgcctgcctccctgcctttccttatactatttctactatatcttctacattcctgtatatactacctgtctcctttcatctgagcaaggaatggttgactaaggatccaggaagaaatcactgacttcctaaaaagcagggaaaaaaaaattgcctggaagcaaagagcaggtgatattcagaaatgcaagaagatagaaaattagcaacacggaggtctgtatcagtacatagccttcagtcagggctgtcatgtttctggatgaaggtgcaagagccagtggaaaatcaatacattgataatcatccagccagactaatcagaaaaaaatcagaaaagtcaccaactaccaatatcaggaatacaagaggtgaaatcactacaacttctgcagatagtaaaggatgttaagaggatattatgaacaattttatggcaataattcaacaatttggataaaaagggcaaattctttgaaaatcacaaactaccaaaactcacagataaataatctgaatagttctatattcattagagaatttaatttgtagttcaaaaccttcacacacacaaattcagttccagatgactttacttgtgaattccaccaaatatttaatgaagaaataataaactctttcagaaaattgaagaggagaaaatacatccaacctcattctacgaggccagtattactctgataccaatggcagacaaagatagtttttaaaaaagaaaattatattatataacaatatccctccatgaacatagatgtaaaagttcatggcaaagttataacaaatcaaatctaatgatttactcaaaggattatacatgatcactaaatgatattaatgccaggatgtaagattggtttaatatttgaaattagtcagtgtaatttaccatatagcaaactaaaaagcaaactatataatcacctcaattgatacagcaaaggcatttgacaaaatgcgtctatttttttttaaaaactgcctactaagagtaggggaacttcactacctgatcactataaaaacctattttttaaaaaaacctaacagctaaaatcatacttagcacaagactaagattaggaagaaggcaaggatatctgcttccattacttccatttaacattgtactagagagactaaccagtacaaggggcaagaaaaaggaaataaatggcatccagattgaaaaataagtacaaatgtttttattcacagatactatagaagtctaagcataaaatcctggtggttcatgcctgtaaccctagtgctttaggaggctgaggcaggtggattgcttgaggccaagagtttgagactagctgggcaacatagcaagacctcatctctacaaccaaaaaaaaagtttaaaaagcataaaataaaatgctatctattaaaaaaaagttactagaactaataagtgagcttaccaatgttataaggtacaacatctatatgtgaaaatcagtcatttcaaagactggcaaggatacgttggaagttgaaattaaaaggttacagtttacaatagcattaaaaatgtaaaagaccccctacactgaatactctggagataaataaaagaaaatctaaataaatcaagagatataccatgttcatagatcagaagattcaatattcctataatcctagtttatacatattgacctacacattcaatgcaatcccagtaaaaatcctagcaaggttttttcctaaaaatttacagatatgttttacaattcatatggaattggaaaggagaaaaatgttggaaaggttatactacctgacttcaatacttactaccaagctatggtaatcagagaatgtggtgttggtatcaatattgacaaatagattattagaatagattaaagagtccagatatagatccagacatgtatggtcaaatgatttatgacaaaaatacaaaagcaatacaaggtatatttaacaaattctactagaggaattgaatatccatgaacaacaacaaaaaaaatgaacttcagtctgtatcttgcaccatattccaaaattaactcaaaagagatgctagacctaactgtaaaacataaaaatataaaacatctaaaaatatataagaaaaatctttgtgatcttgggtaaagcaaagattcttagatacaccaccaaaagcatatcctcaaaaggaaaacaaaattaacaacttaaatttcatcaaaattgagaacttcttcccttcaaaaaaaaaaaagcacttttaagaaaatgaaaagataactacaaactagtagaatatatttccaaattacatatctgataaaggacccatatccagattattcatatgtatcattcaaaactcaaaaataagagcaaataacccaagaaaatttgaacaaaagatttaaacaggtcaccaaagaaggtggaaaataagcatgtgaaaagatgctcaatgttattagtcataaggaaaacacaaagcaaaaccaaaatgatgaccagttagaatgtctaaaattttaaaagacaggttataccaagtatcaacaaagatgtaggcacatgcagctctcatacactggtgatgggaatataaatagttcagatactttagaaaacaggttgataatttcttaaaaacgtaaacataaattaccatatgatccagccattctgcttctgtgtatttactccaagataaatgatggcatatgttcacccaaaaatttgtacacagatgtgtacatatccctatgatgaaataattaccaataaaaaggatcaaatrtggatacacacacaacatagataaatgttgaaactatgttgagtgaaagaagccagacaaaaagagagtacatgcagaatgtttccatttgtataaaattctatgaaatgcaaacctacagtgatggaaagcagatcagtatttgtctggggacagagggaagagaaggaaggatagaagaaagagattcaaaagaaatgatggatatattctctaccatggttgtggtaatggtctcatgggtgtacatattcaaaacttatccaattgtaaattggtttgcatggtttatttatgccagttttaactcaataaaagtattaaacagtattagtcatctctggtcatagtccctccacaatttccacaacttagattttagcctctttcactgttgtttgggccatcttcctcttttctctcttaccaattccatttattttcttttttaaattctttttacttttttttaatttttgaaacttgtattttaggttcaaaggtacatgtgcaggttttttatataggtaaactcttgtcatggaggtttgttgtatagatttcatcacgcaggaactaagtctactacccaatagttatttttctctgtttctctccctcctcccactagctaccctcaagtaggcctcggtgtatgttgttctcccctttgtgtccatatgttctcatcatttagctcccacttataaatgagaacatgctgtatttgattttctgttcctgcattagtttgctaagaataatggcctccaactccatccatgttcctgcaaaggacatgattgcattcgttttatgactgcatagtattccatggtgtatatgtaccacattttatttatccagtctgccgctgatgctattccttattttcttatgctcagcaaatcaaccttttctctccactttaatcctgtgcctcactttgcacacctgaagttagctttaaaattatgacttttaaatgcttgtcagattacrttcttacaaaaaggtattcacactccaaggcactggggaaagctgttttctttttttgtctagtttcatctagtactataaatggcctatattatcttgacaattcaggattgtattatcatccttggttattttaccacaataaggttggcatctactgagacctactttacctctatacattttatccctttccaaattgactcagactcctgagcttcaaaaattcctctctccactttttagagttttctcttctctttgctcattgtcggacagattgtcagctgtcacttctgctgttttcatgtgtttgtttagagaatcttcacacattctttcattgtaatttcctgtctctaaattgttttgattcagaaaacctataaccaagggagtaaaaatgacgtgtaaatttggaacaaatatagaatctgagtgggtaacctgaggcttacttcgtgagttaaagtacattgcatctgtgtcattaattttgacactcttttttttttttccaagatgaatgacacttatgtgatgttactgtatctaattcccaagagaactgtagcaatgagaattcctgtttttcccagcagaaaacatcatcagttttctggagaataatttgccaaggttgtcttttgcaagaactatgttcagtgttcttttttatttatgtagatgtttccaatatatctttttgtagatatgatagcattgtacaatcaatctgttctatgagcaatcaattatttacctgaaagctgttagaataatacattaaaataaatttgaccacagccataccaagttctgtaatcttttctagtttaatgttcaaataatgtgactgataaaaataatgtaactaaggcartccagatgcctttaacgagtgttatgtctgtgataatctgagttcagatttatatcttcaacagtaagtatttagcactctccaacccttcttgcacttgcaatacttttccaatttaaaatttacacataagatcctgtttgatttatctcttggtatatatgaattatgtaatgattgctgaggagcaaacactattaaaatgggtaactagacattcaagttaaacattccttttcccatatcattctattaactttgtgtcaccttttttaatctgagtctaaacaaatatatctttgcttggagataattgtggctcagagattgtcatttagaagattgtgttttgccataccgctttaagatgcattttttaaaagaagcagtgttctttctcatttcagcacttgggagatacaggaaatgctcccctctcagtccacaactagagtgaaatttgcttaaggataaagtcaggggatgtgtttagttcttaatttgcttgacttctgtagcacgtcataatgctgctcagttatgtccttacaacaccgccagttatcatgcatygagtcacttctgcatctcttaatttccatagtgttatgctctcctaatttctccttttcctctgtggaatgccagtcaccttgccagctccactttctctgcctactccctaaacattgaagttcctaagaactctgttctagatcttcttctcataccgtaataaacagtctcctaactttaactaccgaatatgtgctaataatttacaattctatatctgcagcccagagctctttcctaraggcaaactctgtgtaccaactgccttctggatccctccactccattattctatggttttagatgtatgacatttgtttttctgtccacaggcaacaggtcctcggggtttattaaaggaagatgccaaaggctgtcttcagaaaagcttcaggattcttaacgaagccaagaagttagcaaatgatgtaaaaggtcagtgtggccatagtttttattatattccagttaatcgggttgttactgataagatattctatcacactattggagaatgtaatttctttagcatgatttttgtgatgattctataatctatttaatgcaagtaaactttctcactagttttacaaaatgttgtctacctatctcacttcaagtagggtaatatctcataatttgtaagtcttatttctatagcatcacttcacctatatctaatgtatagtaacttttagtgtaataagtttttaagagtatcaaacccaggccagccatagtggctcacacctgtgattctagtgcttagggaggccgaggcaggaggatcccttggtgccaagaatttgagaccagccggggaaacatagcaagatcctgtctctacaaaacattttttaaaaatttagtcaggtgtagcagcgtgagcacataggcatagctacttggaaggctgagccaggaggatcgctttagcccaggggcgtgaagttaccgtgagttgtgatcacactactgtacaccagcctgggtaacagagtaagatcctgtctctaaaaagaaaaacaaaattaaatacatttttctttttctgagatgaagtctcgctctgtcaaccaggctggagtgcagtggtgcgatcttggctcactgcagcctctgtctcccaggttcaagtgattgtcctgcctcatatctgggattacaggtgcatgccaccacacctggctaatctttgcattttgagtagagacagggtttcaccatgttgaccaggctggtcttgaactcctgacctcaagtgatcctcccgcctcggcctcccaaagtgctgagattacagatgtgagccaccgtgcccggccctaaatacatttttcttgtattttatttctgattcaggaatcaaaatgcacaaaatatctactgccatattatgggttttatgttaagaatatatcattaaacatggctgctctctatatgagccattacaattattattttatgcacttatctcttgtctcccatttgaattgccacctgtttctctcttcagtttcattccctaccattttctgtctcatatctgtctccctacccttacctaagtattcataattcctcccaaacatgctactattccaagccttcatgttttcagtattatttcttccccttggaatgccccatccttcacctctcttctttgcctaactgctttcttccagaccttcaggatttagttcaaatgccatcatttccaggaaacctaacacctcatctgatttacatgccccctctctggtatagttttctcataggcttgtcaaaccaccacaatcatggactaattaatattccatcttcttttacaatttttaaaacttttttattgatgcataacagatgtataaatttttggcattccatcttcttgaggaaagacatggggttttgctaactgtgtatttctagtatgcataatagtgactagctcaaatgaggaaatacttattttttacaataaatggtgttggcttatcttacttatcttagaaagagaagaggttttaaaatcatttatatttggcatgttttggtctcagtagaagctgatatgaaattacaagttctatctcgattataagtaaaattttaatagtacaattcttcaggctgtgtattacaggtgaaataaaactccctacacacataattctgctcagcaggtacctcttattacaatctgaagaatgactrtaagaagccaaaacctgtgttcctattggacaaatggactcaatcccgtgactttgcggtcactccttcctatctcatacccttgcccagggctgggaatagggaggaagggagcgaggtgattcatgcaagtgcaagaaccaatcctgtctttaagattttaataataccagggccgtgccctcgcctctatttccccacaaacactggtattataaaaatgaagaaagaattttattttcagscattttttttccaagagaaaaagaaatctaaagacaagcattgtaggaagggttaggagacagaaatgttcrttagtttaaatttmttttttttgtagttcaggtagtacattatttaaagtaatgaaaacccacaractactcragtaataattcctctagaaaaccaagccaaggctatgacggagatgggaatgttttcttgctacattatgacatttctctgatttgtggccaattacggaggttataaaatggctgttaatcagggaaatgccatatattactaccaggaactgctgaaataggccctacagagcaaaactcttgacagcagctattaaaatagagatttagtcatttctctctctatggtgcctggagttagaaggaataaaaatggtgaggccagtataccctccatatttctaatttgttgcttggttcaattcagtacagttcagttagtttgtgagcttcagtcatgaatgacttagtactgctccctgccatttttatgctgtccttgccttgagggaatctgaacttgccgggagcaatttgttttgctttytaatttttgaatatacatctgttaaaagtaaatttgcccttgtgtgagtttgagatttgaagcctgtctacattgcactgatcgaatgtttgtggagataaaaagtattttgttgatggatatgaggcttggtacaaattgatgactgaaagagtgaaaagatgaattagtaccaccaggtgaatgaacactgctttgcagatagacaagaaattttttaaggccgggcgcagtggctcatgccctgtaattccagcattttgggaggccgaggcaggcagagaagtgggagaataacttgagcccaggaggcagaggttgcagtgagccaagatcgctccattgcactctagcctgggtgacagagtgagagcctgtctcaaataataattaattaattaataataaaaatttaaaataatttttttcagtaaaatgccaacttcattttctcatggaatgtgtacgaggcaaggaagaagtagaccttggtttattaaaagtttgagaatattaagattttaaaattatacatcttaccttatattgactaacttttcagttttatttccttcttaatttatccccaatttttgtctttgcccaagataaatgaaattatttaattacttagaaaaataataggtaacatgttggccaggtgcggtggctcgcacctgtaatcctaacacttcgggagaccgaggtgggcagatcacctgaggtaaggagtttgagaccagcatggccagcgtggtgaaaccctgtctctactaaaaacgcaaaaattagctgggcwtggtggtgggtgcctgtaatcccagctactcrggaggctgaggtaggagaattgctggaacccaggatacggaggttacagtgagctgagattgcgccactgcacttcagcctgggcaacagagtgagactctatctaaaaaaaaaaaaaaaaaactaggtaacatacctataaaatagataacacaggaaataaaaagacctattccctggagatctatgacagctcattttaaaggaggcggtttgtctcatagcactgtagcctgtggtatataattacagttaacccttgaccaatgcaggggttggagagcatggacccctgcacagttgaaaatccatgtataacattagactcttcataaacttcataactaaacttcataacataaactttataaactaaaaaaagaatctattcccaagcccaaataatgaatcagtgcattgcttgacatatggtgctgtcccacacagagaacagtatgaaacattattccaatcattaagttttatcaaaccagttgaagccttccttctatacagtggtcctccaaacactcagtcattccgttcagacaagtgggtcttgaagattctgagatcatggatgtaatacacttgcaaacgctaacctgttgagattctgtgttattattttatattttaaaaataagagaataaactggaatactgcagtgctgctaaaccaaagtatgatataggagtgcaattgtgactaagggatccttttattattaaagatatactccttttgaatttgcatattaccctttgcctgaatcagcctttccatagcaggcatgcaaaagacaagcaaaatctgctctattgaccacaattttagactaaaaggatgaaattaagcctgggtcccctggcctactgtggtctggagaacaaagcagtcttttccaggtgaaattgctgatccctcatacaaagttttgattcctcctttagagtgtgaatggtggaaataaaaaaataaaaccagggtggacttccattagagaaaaaacaataagtggcaaaatagtggcaaatatagaggggcaggttctattggaaagattatccctaagagcgagacgtagcttgtcatatccaaccccaccatgtgagtagaggacaagaaacaaacattcagaacactcctgtatatcatctcagcaagagacaaaggcctgtgcaataaaaatggggcttagagctaaaaacttatctgggctttgttgtgtgttcagaatcagagtctgagattctatggcgttttttgcaagtaagttaatttagaccagaaataaacagaaatgccttcaagagacttacagataacataaagggatggtggggcctgtgttaaaccaaagactatttgtcttatttaaaggtattcaaactcaattttcttgctgggcaaaagaaaacaagcctgcaagcccacagtcaccatgtcctagaggagccaaatgcaggtgttgatgtctggtggttttagtttttcattccactggctgcagaggggactcccttttatcccaatatcctgaatctttgcagaacctgctaccagacaagtacaccttccctcctttcctgaagctcctactatgaccccctagtgggaggaagagcatatgcaagcatggtgcttattgcgaacaagatctaatttcttactttcasatcagaagagggtttctccataacctgactccctgtgaaacagtcatctctgaggttsccatatgtggtcactctagtatgtatgtctgtctgtgcagaataagtaatcagatatacagcacatcccaaacttgtgacagctactagggaaagggaagcacaggagtaacaatcatgaaagaaggctagaaatataaaggttcaggaaatgataccgttccgaatcattgtcaccaaattcaatgattgcctgcataatgcagaaaattggagggattttttctaagaagtacaaagattgggtgtagcaaccttatcaaatcaatttgctggagacctaggagagaaatacagttgtagatttcaacttctattcttcctcactcgggtgctcttctttcctacccaggtctcaagatcctgcactgggtatttaggttgacttaggggacagggtctttagaaatctcaagaagccaaaatctgaacacagtcacttatgcttgtaatcccaggtcctttcaaaagtaatcacatttccatgaatttcacccttgtgaatggggcattctttcagggcatttatttgtgccctattcatattaataaaaaataaaaattccatttgagaaactcaactggatggaatttgaatagtcaaattaaacatttccattaaaatttataaaaatcgtcccgatatttagttgaaaagtgaggaatatatacataggtatacatatgtttaggaaatataaaaacgaaataaacttaggttctggaccaagtaatttaaataaaaaaggaataaagtcataaatagcattattataataaaaactggtaaaacacaccaggacaattttcaaaccaatgtcagtgtgttaccttttacttactgcctatggtaaatccagsactttctcatacatctcccagtttatttctcatatcagtcacatgaaggaagatgttttctttatttgccatatgtaaaaagggacagaaatgacatttgaacccacatcttccaactctgtgtcctatagtgatttcattgtaccagactagatttcagagaaatactgtgtagcagttttattttgagatcgtacatagttagttctaatataactaagccctaatttatatttagcatcatgtcagaaacatgataaacaagagtaactgctcattattaatgcaagtgacttgcaactctgccctgcgatttttattctggatatatctatcttgtgccatttcaatgggcatgtgacaaaggaaaattacactgtcattgtgttcccagtcgacccttgctactctgctgcttccattmcctcattgtgagtcctgcttttgccaaactaattctagcacatttttcttctactctatgaggaggagatgagaaagggagagccagacttaaagacgtatgtgtgtgtagcctttgagttttggtggatgtgatctttagagagaaagtagaatgactaggcttctgttattgggtttgagagctgaaggaataaggagagggaatctagaaaataaaactatggattataaattaaatcttcttcttattctccagaaatcacaagtaaaaaaattcagttggattttcttttaactatcgataattctatgtcttcacccttgttacaattcaaactgaatcacaagagttctttcttacttttagttatggatacactatgcctcctctgtcttttatttaaaatcagcccaggagtgcttatttttctaggttttcctcgctattattttgtaagttccattttgaaatctgcaattcttctctgaatagcttctactcatctaattctatcaccaaagctacaaaatgtttagatgtagttcaagaaattccagaaactactttagaaaaargtgatcagcgtaagaaagggcaaattaataaggatcagagtcaagcagctgaaacattaaaaaaaaatcagaacagggttggaatatacacattgtaacttgctagtacaaaaaaaaaatgcagagaatcaaaattagcgctttggaacttgagaggcagcagtaaaaatattcttcaggtcagtcttctgaataattggcccagttgttcagccagcattttgctatcagaatgcagaaagtggtataaacccagggatacccttcaaattaatgatctttctcaccatacatgaatatcttgcttgccagaacatttgaatgctccattattttaaaaactaaatccaatcaagaagctaagaaatgaaatttctacagttccattttcttaagtgttgaagactttcaagctaatatcaaaagagcagccctttattctcaaagaatttgtatagatatcacagtcataatcagactggctttatttcagagagtatgcttttggtagcctatccaaagattttattttagtataaacagtaaaaataacagaagtattataagaaagatgaattgtgattgacagaggagaaaatccaattacttggaaagtatattttgtgggcttagaattgaaaataataatatattagtgactgaactagacatattgatgttttagagccgtgctttgctggaatattttatgctttgtttttcagtgatgtcaggtctttggcttggaatttaacaacagacactttaaacaatgttatgtgcttatattagtataatctgtagtataacagaagtttaaggtgtctgcctataaaaccctttatatgaagtggagtgaatcattaattaatatgtccmgtactcttcttcacatccagacaccgatagttcagaatcctccatctatccacctttccctttgctattcttcacagatgcaggccaacaaagatgaggatagttctccagctgcccatggcctgcacagttcctctaatgagccacatgcacaacctctgagaggggtgtgcacacagtcaaatcaagactgctgtagctctattctttggggcgtattctctcccacctgccttctctgggtaccaggaaagtgatgaaaatcagtcttggtgttgacaaataacatgaagatagcaaataacattcttccccagttaggtggtttaagttttttaaaacattgaaaaacagaaatatatgcacacagaaagcaatttagccagcacaaccgggtataaaatgagaagttttagtacattgtcyctcacggcactattaactgcctcattcattcccagtttctacccactattaattactgtaaaggtttttggcatgttcttctctacccagctcccaccagcccctaccatgccaaatgcttgtatatgtgtcagcatatatatggtgcatcttgcttattttcatggaaaggtcttaaggtttatttcacatccatatccgctcatctacttctttttatagattgcacctgtaccattgtatgaacatgctgtgtggatataaacagcactttaatcttattagggtatttttattcccccctccttttttttattacaaatgaagagctaatgagtatccccaaagataaatcttttacaggtatattgaagggtaaatttctatcagtagaattgccaaaccaaatacatgtctatttaaaattctaataaacttattaacttgctcttcaaacaatggaatcaatctgcacgtccactagcactcttgtgaacacttggcattatcatacatttaatwttccccaatctcaaaaataagaaatgacatcttactgttgcttagttttacagttctttatgataatcttgagtgctttttacgaatttcataaatgattatgtatgtttattttattgtgaactacgtattcttatattttcctcattatccttaaaaatatggaacactttgcatatttgcctgccagttttgcacatagacaatgctattcyactctgaataattacaacttggttatatatgttgcttaggtgaggcttctctgatttctgtaactgtgaccaatttctttaagacaacaaaggagaaaatgagaggaagacaaaggaaaggaggaggacaggaagaaaaggttgagggtgatggtgggaggagcattgctacccaaaatgctctactaatccctagttttgactatcaatccttggtagaatgcagtagttagcattgtttatggaatgggactatgtggatttgaataccaccactgccatttattaaccatgcaagcttaggaaatttactcaacttctctaagtctcaatttcctcatttgtaaattggagataatagtagtatatacatcatcatatacatcatacatcaatgttattgtaaggattaagtaaaacaacccactgaaactgaagaacactaaatgcgtgtaacatacacattcaatgcttgtcaggcattactcttactaaatacttgtccatcctatccaggagggactagaacaacttctctttcttggtcctttctcagtggtcctcctcacttggggactctgtcttgtatttacatgttgcatttctgtggagctaatttaaacaattagtacgcatgtcccaaaacaatttttatggcataagaaactattaaaaatttacctaaaaaatgagctgttgtatccagtcaagagaggtaaataatattgtgggaagtataggatttttcatattttgttttttcaatttgaattttcactaataaatgatgtaagaaaaagaagacagatgaactccatttcagtcttaagatatatttgcagtttaatgcatacctgagtaagatttctaaacttatatcaacagattggatctttattttctttccccttaatgatttcaaattttactctttatattgttgtactcgaatttaaactgcttagttactattacaatataaattaatctaaagtttagagaatattaaaaactagtggaaagcagctagaaaacttatatatgtaatattaaattatctctagcaaatggcatttttgaatattaaagataacattgctaaagtatcaagagaaaaaaactatataaaatttattggacccaatttgtaaaaatattgttttctttatgagaaaaatgactattatcagatatgtgctaaatgttgtttttccatttctttaatgtgtatttttgtccaaataaatattaacaaatattattatactgaagttggaggattctgctaaacaatcatatctgagattttgaaaatctaatccaatgattcattttggtaataaaagtttttaaataagtggaatcaatgggagtgataacaagagggcataattacaaatggaataaaagactaattctttggaggtttcttctctataggaagatatcaaattaagtcagataaagatcagataccaagaagaaaatgtcattgttcaacatgtagaagcatccaataattcaatgataataaaaacacatatttttaaaatatgattggaaatatatttatgtatagatgccaataaattaaatacattttcttgcttttaattaattttatattaaaataacctgaaattgcacatccaagtataagctcagggatgataaaacttatttaatccttttttttgttttttattcgcagaaaatgaagaccatctaaatggcttaaaaaccaggatagaaaatgctgatgctagaaatggggatctcttgagaactttgaatgacactttgggaaagttatcagctattccaaatggtaagcattcaggacactaccaactgtgtcagttgacctgaagttttgaagactgttgttaacttttaccatttttttctaagattattctggtactattatctggaaattagatactgtttttcttactcatgaattcttctttgtgagaatgagaaactaaaccatactttgcattatggtattttttatcttttattgcctttagccagtatccttaggaatgtgttacagaaaggaagatatagacatcttattattrtaaaactcatccttcagtattggcaggggattggttccaggacccccccccacagatatcaaaattcttgaatactcaagtcccttttataaaatggcatagtatttgcatataacctatgcatagcctcccatatactttaatccctagatcatttataatacctaatataatgtaaatgctatgtaaattcttacagtgtattgtttatgaaataatgacaagaaaaaagtttgtccatgttcagtacagacacaaccattttttcccctaaatatccaaatatccaactctccaaggttggttgaatttacagatacagagcccactgacacagagggacaactgtattgtcttctgtgtttcagcccaagaaatcgtgtattagtgaaatagaataaatcacatagacactaatctctaaaatactgatgtaccaccacaaagacacagtttattaaagtacctgcagtaataggtgatagcccactgcattctctcttgataaaattcaatttctttaactattccaactttcaaaaacattagtggtcaaaccatgtctgtaatatctttctacctattagaactgctggaaatttttgcatggtattagttcctgaaagcacacgttattttaaagatactacttttactatttytatattgttaaagcatgatataataacaacaaagattataaacacttattgagtacttaatatacttatgttaagtgtatgtaatcctcataccaattggagcaaaaacatttgcttcatttgctygcatcaattggtcatatatatatatatatatatatatatmtawctcaattggttatatagataacataagtatagataacataggtaacattcagaatagtcacttcactactttaagagctaattaggtattcatacagatacagaacctactgacacagaaggacaacttgtcttctgtgtataacataagttagcactaacacttaacatcagttaagatactgttattatccccactttacaggtgagaaacagacagaggatactgaaggccattgttaaaagtggcacagaggaaacttaaaccccacagtttgatttcagagcctatgatcttaaccactaacctatacacactagtagtcatctataggtacaatatacaaattaggatcaggagacaaatgcacatatttatacaacacagttaatattaaaatctcggtggtttttacttttttaacgtttaaaaacctgagtaacttttcagattttcatgtccctttttcagtagtaagtatatagaaaatttccaatgctgaaaacaagtataaatgcatggcctaacatacctgaaaatgtttctctatcctaaaatgaaaatacgttagtttccctccaacccccaccccaacccctgccctgctttggaaatgcagattaaatcttaagcctcgttttcatgaagctcatgtggataaatttatctcgtgaataagttcagcagcaaatcacaatatgatcttatacaatgaacatttagaatagtcacgtcactactttaagagctaatcaggtattcatagcaaaagtccctgagaaaatttaatttacctaaaaaaatttgcttcatttgctacacctgaatgagacaaagttcagccttttccctttgtaaatgtgtccgaggtcagccagccacagcctcgctttgtcaagcatggattaagccactaactccacaccctttgttttgtttttcataccctcatctgctgacagatacagctgctaaactgcaagctgttaaggacaaagccagacaagccaacgacacagctaaagatgtactggcacagattacagagctccaccagaacctcgatggcctgaagaagaattacaataaactagcagacagcgtcgccaaaacraatgctgtggttaaagatccttccaagaacagtaagatctcctttttcattgtgatgatgtcatttatttcctctcactgtaaaagtatcccagacctgtaaatgctcgagttggaaagaccctcatggtggtgtagtctgccttccttctttcatagattggcctcagaaattgagtgtcatgcagttccaaagctrgaatccaagtcttctagctctgccccggtgcttttttcctctgaaatttttccagttgagaagagattasgaattctcaaggtgtgcctaacattcagcagagagatgcaaaacactttttaatccgtgtgtgtaattaaaaacacagttgtacttgggtaattatatcctcagaactggcgaagtgtcatggaacatagaggttaaggggcacgttcatgaacagacttgttagaacaggatatgaaaatgatatcaacttgaaatgcattaaaatttgaaaatcttgatattttattatttagattccagttacatcacatttctgggaaataaaaataaagcatttatctagtttctaaagactattcacatctcttatatattatataaaattatattgacttaaggatttactgagaaaacctgagagaaaatatcataacttatattattagttaaatatagtcaaaatattaagattttaaaatgcatttttccttttccgtcaaatgatacaaggctatattgggccaggtacagtggttaacacctgtaatctttgcactttgggagcctgaggcgagaggatcacttgagcctaggaattcgagaccagcctgggcaccatagcaagaccccatctttacaaaaaatttaaaaaatagccaggcatggtagtgacattgcacctgtgttcccagccacttgggagtctgaggctggaggatcccttgaacccagaagggtgaggctgcagtgagctgtgatcacgccactgcactccagcctgggtggcagattgagatgctgtctcaaaaaaaaaaaagggggttatcttggtatccttgttacatggtttcaccaaaggagatgcttgggtaatytgtgcttttcactttcaagagactagccctctttatatgccaacatttttgggggggtatcaaaatatttggagtataaaaacaaaagcactgtaattggtattatatgccataaaattcaaatgctgtttgagtggggaatggagcctgatttcagcatcctagcctcaaatcaaatcctatggatgctatgatataatagacattattaatacgactccttcatgagcaaggaagagtacaaacacatataacataaacttcagagccagggtgaaaaaggggagataaaaacattttttaaaattttttaatgtaagcccagaaatggcttctcttgtagctcaaagtttacataataacttcttatgatttatgccaaatcacaatattcccactaaaaatgaatgaaaacaaaattttaatcaaatattactatctctgctgcttacttcataatttaagatatatttttaacttttattttaagttcaggcgtataagtgcaggtttgttacataggtaaacctgtgtcatgggggtttgttttatgaattatttatttcatcacgcatgtattaagcctagtacccattagttatttttcctgaccctctccctcctcctgctctccaccctccaaaagaattccattctattttagattgattctcaactggtagtggccttttgtcatatctctgttttaatcctatcctctattatgagaaatagttaattatctataaatattaattaaattgggtctgttttctatcttactaaaacatagaaataatttttaaaatacaaatagtggccactaaattatatattttgtgtacttttatttgataacaattgcttcagttaaaatggggtgcatttataattagtacctgttatgaaaaataccatttttagtcactactttataatatttatagaaaatacttcctcatgaatttataatttttttttgttttgcttccatgtgaaattgcctgcagaaatcagtacgtatatgtttacttatataccttttagtaacgctcatgcttcattgcctattgcaaaaagtttcagctttgcatgtactatattttggttttgctttaaacattgcgtagctattctttccactgttacagtattaatggtagatgcrtaaaaggaatcttcctttataaaaaggtcatatgtggataaaggtgatataaaatgtttttaatagtgttataaaaagtttggtcaggcgaagtggctcatactctaaccccagaaatttgggaggtcaaggtgggaggatcacttgaggccagaagtttgagatcagcctgggaaacatagcaagactctatctctacaaaaaggaaaaatgagtgaaatatctgtatgatagccacataaaagtggaaaacwgaatttctctatagaattaactagattatgctgtttctgataacacaaattcaccccaacacacgaatgacttaattgcaagaggattaaaatagatwaggtctacaytgttgttgtttttacccactgaagctcactttttcctctccttgtaattattctcaacttctgtagaattatatttggagaaacacataataaaactaggtcttaacaaatgaacaactactgggatatcaaaatgttctctcttaaacatcccacagtttaaattgaaagtcaagaaaaactaaaaaaatagctacaaaaaataataacaagaataacaaaatttaatatatcactatttgaaaaatatgaccaagagtgtcctcagcggaaaatgagagcaactacattactaaaccatcattgaaataacaattctaaacaatcaactttgctgactttagaaaaagcagagttaacttaaagaatgaaaaagatggaaaaattaatgaatttgaagacagaaaatawtagacctgataaatcaaaaaggtgactccttaggaatatagattaaaaattaagtgattgtcaagwttcatcaagaaaaataaaggacaaataggcaaagctctaaaagaggtatcactagacaagggaggaaatttaacacataagagatcacttggaaaaacttcaactgctccggagaatagaggaaaaagaggggagaagaggaacttccaagttccattttgaaacatttggcaaaaacttctgagaacttgtgaataaaagggtctgtaatttgcctaagtctaagtagtctttaactacttttgctctttctcattaatctaaatctaaatcattttgcctcagttttagaataatttgtagaatgtcagaataacaatggagaattaaaggaagggaaaaatgaacaaacggtttattaaaagcatacaaaataaagggatcactgtgtttatgctatctgtatgatgatataacaaacatttctatccagataacatgcatttcaggaagaaaatactgcactcagttcttgatatagcaaatctattagttaaatttaataatagacctatgttctttttaaatgccgctaacagcataagtcatacttatgagttcaaaatacctactttaaaacctaattttaaaaaaatgataatttacttccctttgagcacatgtgattcgttcctgagggttagttctcagtggttgtatgtcagccgcaaagcagatcattcagagtctaacacagcatgtagccttgaaccttaagcagtttaactttttcatcagagtcacagtgacagaaagttgaacaatacacacttaatcagataataaatgacatagtgtggatgagactgccagcatcccagcaatagaataagtggtttaccacgtggcataggccctcccttgaaaagcacatactgaaagtctatggatcagtgatgaccttcaactattttagggttgaaactttgaaattgccaatatgtaaccctttattttttttaacctacaaaaacagctgtttaatataggtcaacctaatatgtaacacagggtaatcaactattcttcaaaatgaaattgaactgcaccatgaaagatttaattaaatgtaggcctttagtctaagggtttttcaacatcaaaatgttcttcaaaagacattttgatagcttctctctttaagaygtgcaaaaaaagacggtgagaaaaagaaagaaaaccaattttgtgtaaaaaccctgatttaaatacagttctggcttggacagactaggtgacattttaaagatgctttcatttccttgcttctgtgactaaagttctattctgtaaaggttaactttttggctgaagttagaaattaagcattgaattaagttcttcatattctctaccttcaatgctaatttttaccttaatcaaaaagaaaaagtggtggccctctgtcctaacatctactcccctggcctgcttgagtctcaactaaaatattgacatttgccatcacacattttgctttagctgttatggccatgctttgtcacrttaataagatgaaattgtttggttaagcatactgctattctaattctgtgtgtgcacgtgtgtgcatgcatatacatgcacactaattttgttctatgcagttgccgatgcagatgccactgtcaaaaatttagaacaggaagctgaccggctaatagataaactcaaacccatcaaggaacttgaggataacctaaagaaaaacatctctgagataaaggaattgataaaccaagctcggaaacaagccaattctgtaagttctttttatcgtcagtatcagtaactgattgtaattgttggattattcatagagggaatgtctttccccaggattccccgttgaatgatcttgggtccttttcctttaactcgaagcgatttggggtaggaggggttggagtgggggagaggttagttttgttttgtttgtaaatttcaaaagacatttcatgagaatgataatcaccacttattgttttaaaactgggaattctggtatattctattactatttgcatagaataatacaaatagcaagaaagaaaaccttattattgtatactaaaaagccatggatgagagtaccttcctcttgctaaaaacaaaccaaaaaaaaaggccaactaatggggttatggcaggaatgaaggaacaatatacagaataagagcaaagagaaacaaacattttacatatatattcttttgtctggtataaacaacaataaaaatggctttggttatactttttacatttattttttgttttggagtagataggaaatagctgatttgtctcaaaattttgctctttacttacccaattagaagtttactaggatagaaacagagctttctagaaggtagcatgctaatgagccagggcagagttgctaagtggcaacgtgaaactttagtcaaaggaaggaagtaagggaaggggaggagaggggaggggaggggrgggaggcgaggggaggggaggggaggggaggggaggggaggggtggtagaaagaaagaaggaagggcagttttcttgtttgaacaagaaaggcttgaactcaaacctttttagatacctcagttttccatgtcaaaaattctgttttttgaacaactttggaactaggatgatcagaaaagccctttcttagttcatcagtttatatttttagtagtatttaagaatacgatgctccagtaacagcatattctttttcctccttattcacatctaacacttctaaacaactccaagacagtaagttcaaggtgaacattgaaaaggaattcacgactgactgaaaaaaaacctagaaaacaacaaaaagattagtgaagatgatgttacataagatcagagtagtaaatcagtgaaaagatctgagaaaacatatattcagctagaatatgaaagccaggcagtatcgttgacatgtgatcattatgtatgtaaagcacaagattaaaagaaaccagatgttacttcaaggtttgaagttttatgtaagatttagccaacatggaaaaagcctctactatgttcagtgttactttccgtaaggtacacaaagacgaataaaggagttctttcactcacaaagtttataaaatagtagggaaaataaaatatgtacacgtaccttgtcacacaatgcagaatgttatgccacattatagaagccgtgagaagtgacataaaagttctagaaagaacaatcacctctagtagggcctgaagatttcctgaagggaaggatttsagccaggcattgaggtgggatagtgctggggagttgggggtggagtcaggtaacagggagagtattctgagaagagggaatgacttaaaccaaggcagtgggagaaggaagttttagggtccatttaggaaaaagaagtccagtttgcccagagtaattgataaaggaaacacataaccagaaagatcaacagaggccaggtctygtcaggccttcaataatcagttaagcaatttcatttaacaacactggtacttgggataagcctcactggttaggataagctgaaagctttgagcatggaacacagtataatcagagctgtgctttttaaatataaatccagaagcagtgtatggggtagatgaaagaaagaagaatgaaggacccaactatagctgtggcaagakaaaagaagaacgtgatgtaccactcctatattttgcaatgttaacttggaagaagcaataagagtaaatattattttgtgaatctcacatttagccacattttctgacttagtcatcaagtggagaaatctagacatttttattatttcttcattgtaaagatttctgagtgcttttcccctcctcacaaaacggtgaaattcagacatgtaagcatataaaacctgtcttaaagtacaaaataaaagaaaagtataggctgggcatggtggctcaagcctgtcatcccaacactttgggaggctgaggcaggcagattgcatgaactcaggagtttgagaccagcctgggccatgtcacaaaaccacatctctacaaaaaattgaaaaattacctgggcatggtacatgcctatagtcccagctacttggggagatgaggtgggaggatcacttgctctggaggatgaggctgcagtgagccatgtttgcaccatggcactccagcctgggtggcaaatagaaaccctgtccccccccaaaaaaaaagagaagaaaaaaagaaaggtacaaaagtaacgttaagaaaaagtaatcattgtccatgcatttcaaagaaattcccaatcagttttggaaatggaattacaacacaatgccttattttttgtaagacgttagaaatatgcaagtagccaatttttttccaaatgagttttgtactaaatgaatattacattttctgatttgtaaatatggatatctggatatgaccttaacacatacttgacatgaccaaaacattaaagacatttattttaaagtagctttctctgggtttgttgattctgaaattgagtggctgatactcctttaaatgaatgacctacttactggatgaaaaatgcagtgaaaatccaatagatataataatgggatactcaataatgtttgagttcatcatgattaactggtaaataatgttgcagtattgaaatgccttaaagatacttaatgcttagtgatttttctttagatgtcttactaaggatctgcattagaaataacaataattgatagagccaaacattctaaaaggatgtttgaatttcagaaatttctttcctcttacaagagtgacatatcctaaagatttcttctagagatacagtattttgatttacctgatttcttctagagatatagtattttgatttacctgatttcttctagagatacagtattttgatttacctgttttaagttgtttaaaagaaatacctataactgaaaatcaaaacagaaagtattcaaaaggaaaagactactgattatgtactggctgtcaacagtttgggctaagtgaatgtttcagtttctgagagtatattcaaaaccagaaaacagaaagcaggtaatccaagagtattttctatatgaatgtgtgagagctgggcaatagattactgtctagtccacttcatgctgctgtgacagagtattacagactgggtaatttataaagaaaataaatttattctcacagttctggagactgggaagtccaagatcaagatgctggcaggttagggacctgtttttatgcttccaagatggcactttgaatgctcaggagaggaggaacattgtgccctcacatggcagaagagcaagagagagagagctctcamccctgtaagcctttttaatagtggcatcaattcattcatgaggacagagccctcatgaccgaaacacttcccaaaaggcccccctcccaacactgttgcactgaggattaaatttcaagcaaatgaattttgttggacacattcaagccatagcagttactctgtaggattaattgccggcatattgggtataacaacatcattttgcttcaagaatcatatttgttagatatgtattctatacaatagattggttgtaacctctagtgacattagatactcagttttaaaatggcttctctcttagacttggagttctcagagcagttagattttagtgctgctgctctgtctgctacacttttttttttttttttttttttgagatggaatctcactctgtggccaggctggagtgcagtggagcaatctcagctcactgcagcctccgcctcccaggttcaagcaattctcctgcctcagcctcctgagtagctgggactacaggcacatgtcaccacgcccagctaattgtttttgtatttttagttgatacagggcttcaccatgttggccaggattgtctcaatctcttgacctcgtgatccgcctgccttggcctcccaaagttctgggattacaggcgtgagccactgcacccggctctgtctgttacactttggcaacccccttttcaacacactaatcatggaatcccgtttttttttttttaccaggcttacctaagcaatgactgaaattcattctgtgaccaaatgatcacatattacatttatattgagtcatctcttctctaaataataactgagggatattattcaattgtgttgtttgttttgttttgttttgttttgttttgttttgacatggagtctcactttgtcacccaggctggagtacagtggcacgatctcagctcactgcaacctctgcctcttgggttcaagcaattctcctgactcagcctcctgagtagctgggactacaggcacatgccaccaccatggccggctaatttttgtatttttagtagagacagggtttcaccatgttggccaggatggtctggatctcctgacctcatgatccgcccatctcagcctcccaaagtgctgggattacagatgtgagccatcacacccagcctcaactgtgttttttaaacaaaactgatttattaggaattaaactagccataatacagccatagggccaagctataaagcatttattaaataaaaatgaagtaaactacatacagtcgctttgactactaattcagccccattcagaattggatatgattgtctgcyagggataacgcactatgctattcagttctactcatgaattccagtcagatcttgatttcttgttcactttgatcctcttatgatgtcaatggtacgtatagcctgcctcagatattaaattttctcaatgccaaggtcttctctgataatgattttggttcactttcagcagcttgctaaaaaatcactatatctgacaccctttcctgaacattaaaaatatctgaagaccatatttttcccacctgccctctactgtgctgtctttctcttgcttctctctttttatctctaatcccttggatgacccttggtatagctgccattgtatcacagaacaccctttgccaagtcccattgctcatctgctttgccatattaacatccaagtaaaaattgtacatttcctacctccattgttttgcaattcattttcactcacctactctcaacactgtatgtagaagggaaattccatgatttgtgaagcaggaactaacttcccaactgaaaaccaccctatccagaagactgtctccctaggacacagaacaaacactctgaggaccatagttggccctgagtcctgcacccagcagttggcaggctggccccacctttttggggaaggcaagaataagaaagtggtttaagcagtaggcttcctggaatgtccagccccaggccaccacactcaggcctccagcagtcaccctcctctgggtggtggaggaaacagcccctgtttctctccagaacacagtgtcctcttcatggagatacaatttgattagcagatcaggtgaggcaacaacaataaacaaataaatgacttatgcggtctgtgggagacgtaacagatcttctgtatccccagaaggtctcaaatctatatgaatttacctattgcaaaaatccctctttagccttctcttttgaatccaaccaatttggcacccaacctttgcagtatacttgcatgacccttggagaagggccacagttctgcccatactcaaacacaaatgaggctcttggagacacctcctggtgtcatgatcatatggaggctgttttggtttctaggctatcttgttgggagtctgcacagccctttcatggaggtaatgatgatgctagttggttttcttccaaatgtgcaaattacatgagtagcacaaaatgctagaagaaatgaaaaaatggaaattcactgctagtgaaggccaagagggcatttgaacaaatggcaaagagagattttacatcttcccctctctctgcctccttctggagcgctatcaatgaacaaagttacagattctctctgagtccaagcaactattttgctatcctgaaagtaaccctttgatggtgattttccatctgaccctacagaaattaaatcaaataatcaactagtgttatttatgattgaaggaaggctctctaaatataagtaaaaattggtatgaacagtattactctattcatataggcattccttttttagcaatttatagtaatttttaaggtattattcaaaagaaaagggagctgttaaatacattartwgtgatagccattggaaattatttccatttcatttcctgacaacttcatgaaaaggtacaatttattctgaaatgtatgttctgagtagaatgattaatattcttcttattgttagaacatctagaacaaaatctatttgtcctctttcaactgtaagagtataggagggttggtaatttcctcttgaaaactaaaagaaaaatagtttcttagtttaagtgataccaaaaccgctgaaatttcaattgtaaaatttcattaaacaaccttaatgaagrtcattctcattagctccatgtaaaatcacctgcctaaaacgttcccatattgataatggagaaatgtatgacgttagaagtttgttagttgcatgcttcaaaaaatagtatgctaacaagacatggaactgtgaacagctcatagtcaaaattctagtggaaaactgctcttctgtgccctcattaatgagtataatggtgtctgcatatgggtgtttaatgatagtatttgatgatagaaaataacttcaaagaagaaacgatgatggctttgtggttgtatggaagctacttcaaactttctgagagatttactcttggttctttgtatcttgttttttttaaagatcaaagtatctgtgtcttcaggaggtgactgcattcgaacatacaaaccagaaatcaagaaaggaagttacaataatattgttgtcaacgtaaagacagctgttgctgataacctcctcttttatcttggaagtgccaaatttgtaagtctaatattcaacttttcattaggctgctgtatgtgtatagctagaggttaatctgaaaatgtatagaatccccaaatgtatatggtccccaaatggtctaacgtaggctttcagatttgaaaacctcaacgtcttaccttacaaaattctgaagagtcaaattaagttagaaggcaaatgaaaggaagaaaactacagtgtttagtcacatttactttcatttgtcagtataccatcatttctgttaaattatactttcagatccagtgatttaagaatgctaatgagaataaagctattttatttacttcttatttatttatcttatttactgttcaaactaaattacaataaactcttccgttaatgaaatgaaaatagcaaagtgtgtactattttttttaccaatggaaactcttctaacttgtgttgaatttatgacctgaactgaaataacacagattatatctacaaaagcccacccataaagttctaatttcttccatttgaactatttgactttgcatgcatggggattttccaaaatgaatatgacttcttaacaaatcattcatggcataagtcaatatttgccatttgggtaaggaattctgggtcaatttgggaaataaaatcatagctgccccctcaaaaatgtcagtgtccttggtgaaaataataatggattctgaatttaaatatttgtttttatctttaccacaagtatcagagtgagaaaggctttggtctcaaaattagacttaattwgaattggtaaaattaacaaacatgcctgagcatwatggactttttttttttttgctttaaggatataaaaataaaatattattttaataatgtataataataaataatattatttgacaagtattatcatgaagctcctaatcatttcacatgtctgcaaatggcgcttattgaaaaacactctgctggtctcctctttaaaggtgctttatatctgatatctcttgtttttgtatttctctgaactagattgactttctggctatagaaatgcgtaaaggcaaagtcagcttcctctgggatgttggatctggagttggacgtgtagagtacccagatttgactattgatgactcatattggtaccgtatcgtagcatcaaggtaaccaacttaataaagattaagataattaaatgayagaattttgaagtagtttcccagtttataagaaaactcctatttccatttcaataaggtaactgtgtatgcatgtaaacacatgtgtatgaattttatacatgtctgggagtgggtatgtttgtcatacttcttaggaactgacaaaccttccaggtattgaccagaggaacaactccatttctgaccccttcatcttgtgtctggtaggaatttgggggtgtcgctgtttcaggcttcctattttgcctgaagaaagtactgccacttattcttatgcaatacaagccaaagcataagagcaccattattgcttgtctttgttgtacacagctcctcctttagtctacatagccaccatagaaaaatgcagtttcaaaacactgaaattcttatgtaacataccaggtccaccctacttaaaatgggaagtaactgagaactgattcagttattctatctttggagctttaatgcaattatcaacatctagtaccatatakattacttatagaactatccctgtcttcagcacttccctcccattttctcttcttgttttcccaattctcaactccctgttaaacccaaagcagctaacagttgaaaggtatggttaagggcctagggctagacatgaagctgatcagagacagagaagacttaaagaactggttaattgttgactctgggtgatacatagagtttcatgctgtttgtagatacttaattttttccataataaaaagtttaaaagaaagagccatgtgcaatggcatgtgctgtagtcccagctacttgggaggctgaggcaggaggatcacttcagcccaggaattcaaggctgtggtccatgatgatcatgcctgtgaataaccactgcagtccagcctgggcaacatagcaagacttcatctcttaaaaaaaaaagttataaaaaaaaatgagaagcaatatttttagttctttttaaggaagtttttcagcaaaagtgtgtgtgcatgtgtgagagagagtgacagagtgcttgcgtgtttggtggtgttgagggaattaagtacttaacyggktttaaggacatttatactcataaagtgcagttcttctttcagaaaagatacattctgttaaagaaggtgaaccttatttgataaattcattcttttgttaccatgtatttcacttaacattgcatcctcaaagaaaaaagattaccaaagtgagacagcagtcagggaaatatgacatcgaagttttgttatgactgcttgtctcaaaagagagaccagattttcatatttaacagctcatggaaatcaatcacttaaaaaagaaaatgaaataaaatgataatagctttcaaaattctgttaattgaatttaaaaatgaacttctatgcaatttgtacactgaaatctgaagggtggatattgtactgtatacattagtatgctgtgccaaacaataaaagatataccattctaggaagactacttcaacaaactgggatccaagatattataaagaattttaggagaaatcatgcagcttatgatatgaaagggtggctcatttggggtccactagctgaattaaattagacaaaatgctgaataaagtaatataaacttgcataaattgtatgtgttggtaaatagtaaattattatgtaagccataggaaaaaggctttccacttaaccaatagcaattccatcagttaactgctgctgtgtcatttcatgtcaatgaacacacacagaatcaggacctggtgctcactggttctggttgaaactgatgtaagtgttgagccaagatcagactctgagtattgattcgagatctaatgaatttggaatgttagaaactaaacagccagttttctcttaaattcttaaaaacaagtctcygcattttatatcttttaaatctggaattaccagaaatgtgatgcatatttcatttyctgtatgttcctccccttcacttcaacacgtacccttgaagaactgggagaaatggaactatttctgtgagagccctggatggacccaaagccagcattgtgcccagcacacaccattcgacgtctcctccagggtacacgattctagatgtggatgcaaatgcaatgctgtttgttggtggcctgactgggaaattaaaggtaatgtgttcatcctcctcctgtttatttcatctttgttgacatctcctgacataattacttcaggagaaggtatgataaagctctgtaaaacttgatcacgttttacttaacttgcatttatgaaaacatgaatttactttgagtaagaattttcttctttgacgattcaacctggaaacacaatatttttaagcctatgtgtatttatttaaacagctgttgttttgtctttatctgtggcatcagttttttgtatattcttgttttagttgcctcaagagcaaagtgttttttaagtatacctcatcttctgaatcgatttatgatttatagatatgaagtgctataaagttcatactcacatctaattaaaagatttatgaatactttgggaaatatcacaggagctataagctttcaaaacatgatctggtttttaaagttctcaagttgctcttattcttataggatgatgcacttaatattcataattgcttcatgacagtccttgcgcatttcaaattgcagaatgcctgccttttaaagaagcttgtgttgattaaatggaattaggtgttgggaaaccactatgggtgagatgcaggagcacaaccaaatataatggataatcctgggcttgtcagaatcatcctgagttgagattagtcagaaaatgtgaaaagccagggtgaccccaaatttatgaggactcaaccttcatatagaatgaggttattttatttactttgagtacgagatgtgactctaaagtatgagaatttattccaaaaccacacgctgaagttatcctcgtttcttagaacttcatataaatgtatatggtacatagtaatatatagtcatattatcaactttctctccttcacagatagataaatatagggatagcacacagtagtacaaaagccatgaattttgaaatcaaatccaggttggatttcctcctcttccacttgctaaaatataaccttagacaagtcacttaaccccttgggctttggttatctcaactagaaaagaatgataaaaatatctaccttgcttgcatattgtaggatacaataatacattttttaatattcttataactcttcctatatgctaagtaatgttctcagtaatttacatgaattaacttgtttaatttttacaacaaccccaaaaagtatgtcttagtccattagggctgctataagaaaaataccatgaaactgggtagtttataaataaacaaacatttatttctcacaattcttgaagctaagaagtctgagatcaaggtactggcagatttggtgtttastgagagccagtttttcatagaaggaggcttcttgctgttctcacatagtagaaagagtgaacaagctcctttggacctattttataagggcactaatttcattcatgaaggccctgcccctcaccatctaaaactcacctctcaaatgccctgcctgctaataccatcactttggcgggtaggattttaacataagaattttgagagggacacagacattcacactatagcaaggcagatactaatattctcattctgtagttaaggaatctgaagaagagagatgttaaatgtcttgaccatggtcacacagtaattagcagagctgggatttgaacataggttaataggcacagtggtcttcactctcaacatcttgcttcactgccacaatgaatagtgagacacacactaccatagagtgtgtgtataaaatatatggcaaatagctgagatgtggtagtcacaccttaaattgtaccttaataattattatgcaaatgtaattggcacaaaaacagtattctatcagtctcagaaaaagaaagaaaacatgaacaaatgaaatctatagcaaaccttaggaaatcattttggccaagaatttcaagactactgccacaccagaatatgaaccaaaagctgaaaacaactaaatgaacttgctcatgagaattcaaatgagcaggaaaatctctcaaatatagcttttcaggatgcaagaagaagcaaaaagcaagcagaattcacaagtaggataatcaatctctagaaaattaagaggttcagagtgatgacagagcattgcaaggacgactccaatgtgcaagtcaggggctccgatcaacaatctttctatgcggctgtgcaatacatggtcacagcagtgggaaatgtacatgttgatgggtttaacctaaaaccatagcagtaggctataccatagagcctaggtgtgtagtaggctataccatctagatttgtgcaagtactgtacagtctatgcttttaactattcagtaactgattttactatttaaaattttaactattcagtaactgttttcttatgtgtgttctaaaaaccaaatgagtcaatgcatgtttttcccagataatctgagtaaatatgggttcactttggcacagagtttttaaagttgtaggcaccagaatataatacagtcatgtgtcactcaatgacaagaatacattctgagaaagttggaattaggcaatttcctcaatgtgcaaacatcataaagtgtacagtacttgcacaaatctagatggtacagcctactacacacctaggctttatggtatagcctactgctccaaggctagagcctgtacagcatgttcctccactgaatgctgtaggcagttgtaactcaatggtaagtatttgtgtacctaaacataaacaaggtacagtaaaaatacagtattataattttatggaagcaccatcatatatgtgatctgtcatttaccaaaacatttgtaatgtgtcaatgccaaaacagttgtttcaatttacaacaaacttctctaggagggaccaggtcattctctttcttcatgattgtgtatcaagcctaagacttttcctgtgaaaatgacaccaggattgaatttgatcagattatttgtcgattctctatttgactccaggccctgtgctgtgtatacaagcaaacgacaccaatgtggtctcatttcctacaaagttgcttactttttctttattcccttgaactcgaaatcttcttggctgtgaacagaaatttaaaaatttacagcagcactaccatagagtgatttatacaagtgcttttaaaaaatctcttctatgtcatcagcrtgtcccctttcttctgatctcaggggaaaaagctttgtgtatgcatggcccaaatttgcccaaagaaaattatgtaggagcactagcatttattgaacaccttctgtatatcaggcactgagattggtgtcataaataaattatctaactttattctcacaaaaattccacattacagacaaaagaatagaattgtggagaaggtcagcagctcacctaaagttagaagctaggaagtgtttatttactgatgatgaaaactggtatagcaaaaagtaatcagcattcgtggattaaatagttgagcttttcccctgttgttgactcatcctgtagtagctctaaggatacggacagactatgatgaaaagatgaatatgtacatatgccaaaatatcagaaagaatggataatgataactttagtttctgctgataataactctcatggataaaccaagattatttgtgaaattccaaattctagcaaataacggtatttctttctgcagaaggctgatgctgtacgtgtgattacattcactggctgcatgggagaaacatactttgacaacaaacctataggtttgtgraatttccgagaaaaagaaggtgactgcaaaggatgcactgtcaggttagttgagatgagaactctcccagggtctgtcctgtgcataataaaagcttcgwttttattgcataatattctattatcatgtggatgatgtggagcaggtttgaaaggattatactcagaggtggaattaccacaaaactaatgaatcttcaagtccctgcctgcatttgcacaggcatttttcaaggccctgggaggtatactagcagtacatttgcatagtcatatgtttttataaaatttgcaaaggtaagagattttggctacaatcagttaagtttccactccaatgttctttcatgtcgaggggtttttttgtgtctgtgagtacctcattgttataatttttttttcctaaagagagctttccccaaactgattaagtttcaggtcttgctgagcatgaattcactatatttatgtttataacaaaattagaaccccagcctaggttttatctcttacaggatttttttttaattgacacataggatcctacaagtgcttcaactggaaacctatgggatytaatgattctgcttcaagagagaaggagaacaaggggccgagatagtccaggaggaaagttcctaatacatgacctcaattataagatagagggtagaatgaataggaatttgaaaatatttaacatcctatcatactaagcatgtgtagagaataaacacttttatataaaaatgaatacaggatataaaatatttagctataagtagaggatttctcagcataaaaatcttagagcccacttatcacccaagcctaaagcaattttgttaaattaaaactataaaacatactttaaatacctgcaaagttaacatgtcataacagcaactcaaaaaccattaagtgctaaggagtttgtgttattttccatttaaaggatatacatacgyttctaggacccaaatcctagcaaagtacacttcacatttctttctctacatctctagagtttcatagaagaaagtagccccaaaatgttatccctctaaaagtcttaacttccaactctttgtttctttttgacatcatggacttgtcaacatgaaattgaggatagtttgaaagcgtgacccattcattgtttaaaatggttttgtcaataatcttaaacaaaatttaacatggaaggttgtctgtaaaattctttcaatacatgaaagacagtgaagcccacattaatattctgctactcacaaaccaacaccaacttttccctaagcgtttctttggtaaacttctaagtaggattttcaaaagcctattatcaacaacaaaacatctaaggcatttaaatatccattcagcagtgcatgtcatgtgaaactgtaacatcactaattatcaattctgcaaagattttgcacttcaacacataaagtattatgctaatttatgattataagagtattcctatgtatacgtagggtgttttgtaggttgcagagattcacgtttacaacttctcctgatgctagaatgaatacagcctagtcctagccatgaaaagacatcaccaggaagggaggaaaaaacaaatactaaaatagttcaaatatcaggcataataaaagtccctttaaaaaggcacatttggagtatactacaattacccacatcagattaagggcatcatgatctgcttcacagaggaggtgacatttgaaatggtcttgacctgaggtaagagtccaaaaagaggagatagcagaagaaatgtgaagaacattctaattcctgaaaccagtaagagcaaagggaggaagagtgggaagccggagtgtttttagaaaagaacaagtgtgaattcactcatacaagattggcaaatgggagaatgattcgggtaagatgcagtggccacataggttcatacacacttcttcccagcataatcatgtttttttttctaccctataacggtagctgaatccaaagtaaaccaacatagctgaagacaccaacctcaaagtactgtgccacaacacagcctgtacacagtgtgcattcacccatatgcctgccttcagcttgatttagccaagcactctatctcggaaatgttcgtggcccacgtcttttccgtcattgtgcatttttgccccatcgctaacacttggcagtgtcagccctttcttatacyccttgtcatcaaactatattcacattttccttttaaggtgaagtgatatgtatactgaaataatcctatattttttaatgttttagtgtatctttttgagctgtgctaatactttgatcaggattgttattgttttgtgagttctctaattacacacttgtgtaagtttttagcaggtcagccccaaccctattttcccataagccctgttatttgtaagaataatttttatagaactcctggtgtttgtttgtttgtttgtttgtttatttgttgytttcaggaaaacacttatcacatttgaacataaagagcaatcattcctactaaagagcaggagtgatttcatggagaagatgtaaaagtgaggctaaaagaggtagactaagaaaatgtcataaagaccttagaatgtcagttttagaaatttgcatttattcaatagtcagtagaagagataaaattgttgttatgctttagaaagagtaatctgtcaaagatatttttaaaagtgtatcttatttttctcatgcttctaaaattcacattaagattaaagtaaggggaaaaatctgctgcaagtaaaatttagttagctgagcattgaaatggtgatattttaatagacttagccccaatattcacctagaacgtagctgctccaaaatagcataattaatctatactaactttaccagacatcaaggttcaaaagagaaacaaaaggcaaattaagaagcctagcatttattaattatgaaagaataggggcttttttagtaaatgcattcagaatgaataggataactctattctattctatgtcgaaatattatagagtgtacctggaaggactcatattatttctcatcccatagtcaccaattcaaagccagacttaccttgtttctcctagtgttttctaatgaattaaatgaactggggggatctacagctctgtktttagccactcccagtccacaactctttcccgcaggtatctccacaatcgcagtaacatcagacagataggtaggtagatagacagatacataaaaatagcctcatgtttggaaaaaatattttaaatgtattcacaagacttatcttagatattcattaattatgcatccaatattgattaaacatatattctctgtgaggcaatttgctatactaaaatctttgtcatcctacaaacatcaactggattctaggatccaagtactgtattgtatgtactagatgttttgagtttgtgcctgacataggacctagcccataatctcttagatggtctcatgaaatttacattctagtgaaggagacagaagaaaccataaaaataaatacaggcctccttaatcgtctgaatctaatttgttccagaaaaatttgttggaaggcaaatattcagagtaggatcctatatataagaaatgtaataatgtattctcagcccatccagaaaccccgcccctttgcccaaataccactaagacacccttaagcatcaatataactatctactaccaagtgcttttacaaaacataaagcacttaaaaaaactaatgayttagttattgcacacctcatgaaaggtgagaggtggtttttacttattctagcacggtggcartagagatggagataagtggaaggaatgaagatgtatttagggtatttcctgccctacaacagcctatagtctcattgctattcagtgatgcattgaataatgacagacygaatagatatgatctgattcatgtgaaatgtctctcttctcagtcctcaggtggaagatagtgaggggactattcaatttgatggagaaggttatgcattggtcagccgtcccattcgctggtamcccaacatctccactgtcatgttcaagttcagaacattttcttcgagtgctcttctgatgtatcttgccacacgagacctggtaaagatcatatgcatagcagagtttccgtgactaaaatgcgtttgcttcttttatcagttattggtaaaatcatcagttattggtaaaattatcagttattttctaaaaagcctgggatgattgtctggcagccaagaatgggtgatacagatagtgcttatatattttcaataataactttaatcacagatacaatttaattactatttattttcaatacaactccccacataatcctttaagcaatacatccggtaataatttttcccagcatggagccatacagcagcaaaatgcttccttaatcttctttcagagacctgagttgaaaaggtgattataagtattctttggcctcatttttttctggtcagtatttcttactgaattctttctgggaacataccttttggttcacttaatatgttttcaaatgaactcacattttacgactgtaataaaaggatatgtcttagaaattttgttgtgaccatgtgcatcataatatcacagccacaaaaattcagaaaatagtaacaccaattctattttcaaaatggatttctgcaacagagtgacatattcagcaatttagccacaagaccctaacataaaccacacaagaaaagtgaacactcatatacttctctgtgtatctaaccactggggtatgtttactctattaatagagagatttcatgagtgtggagctcactgatgggcacataaaagtcagttacgatctgggctcaggaatggcttccgttgtcagcaatcaaaaccataatgatgggaaatggaaatcattcactctgtcaagaattcaaaaacaaggtgagtttttacagtaataatgcaatataggccttaatcatgaaatccaaagtgcacatgtacctgatcaagaggaaggctccgtctataattttagctactcacgagttcagtgaaaaatttatacagtcatttttttggcttagattataggtgatttgggttagacatgactgattgaagagccaaatgcttctctatcattttcttttgaaactgagagcttaatttgaaagcataaaactgtcttacaacttgcaaaattatatcctgtaatatgtttgaaaaatgttgggtgcttttcttttctccctattttgtcaagatgtttcctttaaagtggcccacagtggaatctataggagtggtagggcatagttatcagttctttgctcatttaaattgccaaacatttgtatgcctgcaagtaaataattgatcaatagtaacatgacatgtttatgattcggggacattttaaaacactttcacaaacattgttttatctgatcacataagcaggtattttgttccagtgttagagaaagtaaaatatacactcaaacttttatgtggtcacagacatatatataaaagatctcacaaccaagacagaaatccaagtctattaattctgagtgtagtgctattgctttttaagtatataattgctctaattctgtgtagtatggcattaccaatatctgcaaatgagactttgttacttctgctaatataaatagactcaattaatgttgccaatgccagtgtgacatttcatgaaaatttacgtttaaatttaaatttgtaccgtctttcatttctgcatttaatacatatctgccaggcaccttctaagtaccatgtaagaactaaatgaagttctaagttcttgccttcaaggaacttgcatcgaactggggagatagacaagtatcaatggttagaggatagagagctaattgctgtgatagagatgtatgtagccagcgagcaatctcagaagagagacacttgagtcaaacagagaggtcagtttccactggagtgaccctgaggcacaagctggatgaggagttagctggatgaaaagcatgtatggacatttcagagtagtgaaagttgtgtgaaagcctggagtcatcagagagaataacacatccttttccagctgcatttccaacaggaaactctagagaaacctctcatatgggacaaaaactggctttgcaattctttattttggagtgctgctgcrtacattgttcctgtgtaagagaggcacaatgcacatttgcatgtcagaagctctgtgtagttagttgttcagtaagaagaatgtttagctgtttaacccagcatttcccaaatttctttaatcagagaaatccttccattcctgtaatactagcattctgctgaacacactttggggaatgctttagtaactacaagtgaatccatagcctacacgaatgaatgttggcaggaaattatcagtaggggccaagagataacagaaccagtgcataaggggacatatgagctaagtgagtgagtttcagctttatcctgaaagccatagggataccgagaactctaagagttttaagaaagggtgtgatatcataagacttgtgctttagtaaagtttctttagcagcagtttggagatatgtaacaatttaggatgctacggagtctggtgagcctagtgtctccccaccaacttctcttctatagtagtagaataacagatttgaagaaagaaggagaagatggatatgcattataaaagaaaaaaagacaacctaaatgtccatcaacagatgactgagaaaagaaaatgtggtatatatacaccacagaatactatgcagccataaaaaaagaaggaaatcatgtcttttgcagcaacaggaatggacctggaggtcattatcctaagtgacataacccagaaacagaaaatccaataccatatgttctcacttacaaggcgagaagctaaacaatggatacacgaagacrtgaagatggaaacaatagacactggggactccaaaaggggggagggaggagaaggggtgaagatttaaaaatcgcctgttgggtacagtgttcactgtgtgggtgatgggtccactagaagcccaaacttcactcttatgcaatatatccatgaaacaaaccttcatatgcaccacctggatctaaaattgtraaataataaaaataaaaataaagacattcggaacactaagctgaattggctaatgctataaactctaaagatagtaatatgcttggtagatgtacggtataacaaacagggataaaatgattcaacaacttaggagaacaatttttataaatggtcatcttggaaacgctaatttccataatcagtctgctatctcaacttttattctatccattaaaacaaataaacaaaagatctgtgctctgaatcaatattagtcaaaggtcaagttacagaatcatataaatgtgaaagtagttaaaaatatgttttaggtttactgtaactacagcattccatcaattcagaaagttcttcccccaataggtctaatttttccagattttactagagctactaactgttactgttactactctgtggtccagaaatcagaaagaattttcctttatcccagcctactcagtatcttctgtgacatttctggtttctagttcaatccctttgacacagttggctgataccttctcatttataagtcttctccttggctttcaaattgactctagactcacattgctttttgcctttctgaatactcctgtcaaatgcaccaagcagtcattctcacttttattttgggtattaatgacatgaatcattctccttacttctctattgtatctctatggtatcaccgttaaaaagaaattaagccctatgaggtttagttgttcagaattttgattcttaaattagactgggaacttctaccttctgcccatggttgttacccattctctattatctctggtgtctcaccacaaatttctcaagttaaacaggtgaaattttttattataataaaactatagctgttctgtttttccacatgtcttctcatatatccaatatattttctctaatacttttaaagtattttattactatagcaggtcagttaatatgtattaatttttccttataaaaagaaaagcatcgaagctgcaatggaaaaagcaaatgttataaacaaataattcacaaaagaaaaatgcaaacttcttacataaagttgaaaaatgcaatctcaatagatgacaagcatatggtcattgacttgcagtagcaatatccaaagatcacacttaaagcagtaaaatctaaatttaaaaggaaaagaagaaaggcttggcaaaataaccttactacctgctttgataagattagctcttacaggacacatttattaaataccaactatgcatcagatgctgtgctgcatcagtgaagatgcatacggttcctacccttgagtaacttacctgctgcacaagtagcaaattactgtatctgtttaggatacagtaaacaccaagggagacatatggagggagagaaataaggcactaactgagccctaagtccttttttagttgagggggtaggaggggtggaagcagttgcaggcgatccaggccaaaaagcatcatatgaaaagataaacatgtataaaaacatgaattatttgggcagctgttgtaatcagtttgaattattggagtttaaatttcaaaagagtgatagaagataacgctgggcatgttggcaagggccagatcacaggaagctgtttaaactgtgttgaggagtttgcatttcatcttgatgaacttgattttaagtagagatgtgacagggtaatttcaatttaagtatattactcgaggtgtcagtgtggaagacatattgtcagaagaccaaactgaagacaaagygaacaattggattcaataatagtctaggcaggaggtaaattatgcttgaagtaagagatgcagtgggaattgacatcaaagaaatgcagaataaatccaccatgtgataccattacacagctattagaatgactaaaattaaaaagactgaccatactcagtactggcagaaggtggagacactggaactcatacactgctgctgaggatataaagtggcataacattggaagaggttggccatttcttaaaagactaaatatacatctaccatacaaaccaatcatttcactcctaattattcacccaggacacaagaaagcatattttttatasaaagacttgtaccaaaatgctcacattacttttatctgtgttactcaaaaactgaaaacaaatcacatatccatcgacaggtaaatagatatacataaattgtggtatactcatacaatggaatactagcaataaaatactcagcaataaaaaataaagtattaatatagatacaaaatggatgaatatccaaataggcagacaaaaaaggcaaatttaggcagacacaaaaaaatacatttgtataaaattacatagaaaatgtaaactaatctatagtcacagaaagcagacggatgctacttgtgaatggtatatgtacgaaaaggcaaaaaggagggattacaaatgagcataaagaaacttctggggtgatggatgtgttcattgagtgtggtggtggttctgcaggtgtatacaattacatgttacaaacatggtttaaattatagcatgttaattattcctcagtaaaactgttttaaaaataggacagatattagaggtatttaggagaagaaattagtgaagctgttgattgattagatgtggtgaggagaaagtcaggatgactctctagtttagtagattgggtgggggggtcataagaccaacaaaaaaaagtaagttaagtaatacagatttgggagttagatgataattattttsatttggaatgtttagcttaaagtacgcaaggaaaatatagatgatggtgtctcacctgttgaatgtggacttttaggcaaaaatcaggtccaagcatacatacatttaagtcatcaatacattgtaagtagatataaacttgagtttgcccagatggctaaaacctgagatgtgggcaaaggaagggatattataaaacatcaacattttagaagtgttcaaaaatagaccccagggtaggagattgagaatgaaaggtaaaagaagccagagagcttgacattatggaagccagaagaaatttcctatagggaaggaaatgctaacagcattaaatattgcacaaacatgrattcagataaagtttaaaagaactccactgagtttgggtataggcaggtccctgaggactttagcaagaccagagatgacagagtagtgggagaggaattgaaataaggctccagcaatgtggatgattgctccttttcagtgaccagattatttgttttatatgaattattctcaactagttggcaagagcactgtctcttgaaattcaagtacagtccttcaggagtgttccccatctttcttgagtcagttacagaaccacagtccctgacagaagtgtgccctatcccctaaatgcatcaagtaggatgcaaagttgagaacactcaattagattttcagtggatcaagaaagagaacaaaagaataatagccaaagtaaaaacacttagcttataacaactcagcattgattataaaatatttcttaagtccctactctgtgtctattatttaataaaatccttatttccctacctacttataaatcacatctgaactcatcaactgtgaaattttgtgtcaatagcctacttttctattttgtaaagaaaagaaatagggtaagaaataaaagcaagcattagcatttactagcatttcctggtagaacccacttcatcgctatcactcatgaaggatagagtaaagcactccctttaagtcagtaaaaatatgccatcctgtctctctgccagttaccttttgggccagtgaatttcaattcaattgtgttgctgctctttaatcatgttttcttagaatgatttctaaaaatgcatatattcattcatggataaggaggaaaaccacctccagtcactggcttgcctgtgatagagaggcagaatctcattttcagacaccattaaaatacccaccaagtctgtagaaagagactattttcatcttccagtcaacagccccatatgaaaatacctttgccgatctagataaaaaggaatgtatatgaaaaagtcttgaaaacagttttataaatctattttcttttagcccccagtccagtcaaggagatatatgtgtatgaaactaattatgtatataaaaataataaaataggtgtgtgaaagtaattcaattttaaaatcttaacttgctagctatatttaataggacaattattcttttaggtatttttcttgtttgtttttacaaaagtctggtttgaggtgtccattggtatgtgtattttagtccttttttaataaggcaattgtgtttgattttattgaagacacatctttttgaaatgatagggctataaacttcaagggaattttggaatttgatgtttctctctgttttccaaagaacactgattctgaaagatgatgagttgagtgaaaataatagtatttcgtggtcaaataaatttgggaaatactttttgctctatgtccttctctaggaacattgcattgcatattagcatgctgaaagatctgggcagctataaaattaagaagatacatgtttaactttgtataacccagtatttgtcatatttatttgagccaggaacatccaagaaactagcatcctaaagrataaacatttagaaattcccttataacccactggttcaaatgcccattttcaaacccttgcttattcagatcctacatcagacaaaggtttagaggccaaatctatcatcttacgggactgatgtcaatacgcatcaaggatgcatatgaagtagttaaaggctagatctaaggacatgtggtagaaaagcatgtaattcagaaaaagcctagcttgacccctaagaagggggyggtagtgagagggatcaatgagataaggagttcctgtctgctttctaaacaatgcagtttgaacagagaagtgcctcatctttccttttttccatctatttctgaattcttatcttcatmacattaaaaataccttgagagacccaaaagaaaagcaagaaggcatgaggactgtacctctgtcacaacacttagcatcctggtctaaaatgtaatttacagtgtacctggatctcaccacttccttgtacaacatccccttccacttccatgtacaatcatattttacaacagtgacactttgcagatgagtctaaatcccagtagttcctgtggatagtaaaacttacagaaagagccatagattaggcatrtttctaattaattatctgattcctaattagatatctttgttatttagcatttttaaccttgctttattttctaactacttatctagattatagaaaactacatcaaatggatctttgatgttcagttatagttatctcttttatcttcattggtttgccttcactggtgttcaagctattattttcatgctctttgggggatagtttaataatgtattttattgatgttatttctgtaattattaaattgctaaatatagtgcaagtgcttgagaaagtcaatgttaattctcgaattaaaccaaatttgtcttgaagtattaatgatgatatagatgtggttgatattgctcaaataaaatgttaaactttctttctcctttacagccaatatatcaattgtagatatagatactaatcaggaggagaatatagcaacttcgtcttctggaaacaactttggtcttgacttgaaagcagatgacaaaatatattttggtggcctgccaacgctgagwaacttgaggtaatttagtttatatgtaaagctaaggattaagttttaattaaatgaccactatgctcactagagttctgaagtttaattacaataagaatgtcatataacccttggttgcagaaaggcctaatcaaaaacatcatgttgcatgttagaacaacaccaggatttagaaaccaaaggactaatttgacatctttgttgaagagatggattggagtcgctgtttcctttatatgcacctgctgaaaagaattatgaaagtaattaaaggtagaagccagagttgaatgtggatcttgtaattgctgttctccttctacattcactggagataatggcactctgacattgcttagtgttccgaaaattagtcagtgttccaggatgctatgagtataacctattttattgctaagcattagcatcataatggcgtgttggagctttcccatatgcctaatacaagaactatattagttgttctcatgcccatgccaacatttttttttaatttcacatatgctttttagctagcagtatggggagacacatttgcttcctaatttagttagttcaaaaaataaagtaactaaaaaatgtcagaaaatactcacgtgctgtgtagttaatttactgctcattataaaacataacatagtctataaggatggtacttggtgctcaataaatgttaattacactctaattagaatgggattaattgatttggttaaaccgtaagagtttattacagactaccatgtttttaattttttgttttgtttaattagtttggtattttttaaagggtataaaagttctgtccaggtgtttctactccaaaaagacagattatgtttggaaaaatcccagaatagctgaaaagtgtgatggtcagttattttcacatttctaaacgagcagtgaaagttcagtctcattctatgacagctagtgtgcaggctgaaatttcttctccccaaatctaaactcatagatgaagcaactgtctaattatctgatgagcttcatggtgcaaataaattggctctgcattcattgtaatgtatttgtgttagaaaaataaatttaaagtgtcaagtcagaaaaacattacaaatcaaatttaaatagtaccacagttattacctagaaattcatttgccagtcattcaccaaaagtytgttgagtatctactatgtgacaggctccataccaaatactaggaatccagtggttgttcaaatctaagatttgctttacaagatcattaaccatatattattgagtgaattaaatacagccaaacctaaggttattcaaatctagcttcatttattctagtgatgattttaattatcataaaataatttttaggaattatctataaaggtgtgcctgttaaattctataaaatctgttaaaatctgaatctgytaaatgaatctttatcactaaaatgtttttactttcatgatacagcattgcataattacagtatactatttccatggtgtggcacattatttcaaaacagccattagaggtatatttgtgattgataaaggaaccaaacattcatagttacctgttattttgcctgcagacaggttctcagtatgacaaagtgcaaaagatgtggtaaacataaattatttttacatgcattgttaagctcaagctgtttgagaggcaatatttataagccattcatgaacactacagaatagtgacattgtacattttcccatttattagattgataagaacaagtactttaaattcatatttcaaagtaaaaattttccaagctgatattgtgagctacggtcatattttgattctaatttcactgccgtcaagggtataagtctatttttagttctattggggcttttgcatttctttcctttgtagatccctgtgaaatgattttttaaagatttatgattaaagtttattgttttactaaatgaaaatgtaattataagtaaattgtttttatttttgttttttttttcctctttcccgttatctagtatgaaagcaaggtaaaatttaaatttatgcatgccttcttcgagtgcatgggttgggtaaatgtggcttcttagataaagcagccgtgcagaagcagagcaacaccagtacagctttgttcatagtatgtttcacgagcaagccgtgcattctgtgagagttctcctgctgccccttgctggccgacattctgctgcttacccaccatcagttgggctgcaatttgagttgtctcaccagcagtgatgagatttgctctgctcacttgttcaaccatctgcacacagtgcccctggtgaccagcagcacacactcaaaaggcagctggtcaatttctggtacacagtctagttctgggaaacacggtaaagtggtctcttgagttgaaccccgggccctggcctccctagtgccatgctgtctgctgaagaatcaaactgtgctctcacatgcttaccactgccttcttgctttttgcaggcctgcagatatgcaaacattyacacagcctttgcacctcttgtcaaagctgtttatctattgacatgtttatttaaaactagctatggtgccagatgaaggaatctctggaaatactatatttaaaataagtatttgcgttaatagtaaagaagtgtgagatagttctcctagcttctcaggagcattttaattcttactagcattagcataaargctgtgagcaatgggcctccataaatggctgaacaaacctcagagatgtgcagggctggtatcctctggctagagctaaaagcctggtgttttggcatttcagagcccagctgtgccagatttctggaaagaagataataaagccgaactgatccaagaaatttttaaaaccgaggctagatttttaataagagaaatagaatatacagaaatgaaagtagggaaaaataaaccatgcgttttatcatgatacagttgtaagaccactagttgtgctacatttgctgagatggctaaaaagcgaaggctggctttcatggaaatatatgttaataaaattctgggatggcactgtgtaggtttgtaattttgcctttgagtggtgaccctcaagaaacagggacccgtggttaccattgagtccagtcaccttatgtgactatttatcccctgtaattgtcctaatattgaggttgctaaatcatattttggaatggttctttgtgtttccatgaaacaataaactatataacttgtaggagtgatttactttagtaacaagacctctgaaaaaaatggtgataagtcagtctttccataaaggaaaatatggaagcaagtgaacactgttaatgaaattcaccttctctgtgcattatgcaagaaaaatataagcagaattctcaccctacagttgggcatgttctttataacaaccagctgactgactgaacgaaaagaaaaccttgggaacaaggaaaaattatcaatgaaaataaagaagttccagaaaggagtgcgggggtggaaacagacagacacctgacatgaaataaatcacctgatatacacygccaaggtctaatttgtttttccacctgtttttcctcatgccatgtgtttttcattaagataaaaaaaggaacttggcatcatgggacaatgaggagagaattaatcatcaccctatcaactacaatatattgatgccgactggacagtttttaccgatgctgattamcaccacataaagaattatctttttcacttctatataccttcactattcaaaatagtagccacaagtcacagtagctatttaattgtaaattaaatcaaattaaataacaataaatattcagtttctcattgagacaagctacatttcaagtcctaatagccacatgtggctagtaackactgatttggacagtgcagaacagacaatatccatcatcacaggaagttctgtggaatagcactgttataattaaagaagtatcatcatcactgacattctgatagcctttgtttgttgagcacttactgtgtgcagtgctattccttaatttattaaacctttgcaatttgattatgtagrtactatgattattattatcatgcccatttcacatataagaacactgagtcttggagaacttagatcacttgcaacatctggactcaagggcaaggacttcatttcctaatctgctggcacacttgccccattttatgaagtagtatgcaaaagtaaacattcaagtgtagtttgagtataaaagtcatttttcaattttattgaaaaaataaaatgtatgggtttttgcatttggttgctttattttgtkattgttctaatgtagaatacagactttggggtcaatctgtaaactaaattaatctgttaaaaaaaaacatttttttattttgagacagggatctcactctgtagcccaggctggagtgcagtggcacaaccataattcactgcagccttggcctcctgggctcaaaagatcctctctcctcagcatctccaagtaactgggactccaggcacacaccaacatgcccagctactttttttggaggggagggcaaagacagggtctcactmtgttgcctcaggctggtcttgtcttgaactcgtggcctcaagcgatcctccctcttcggcctcccaaaatgcagggattacaggaatgagccactacactcggccagtaaacctaatttttaaacatctgttttttagactatataatccaaaagaatgtttcttrgactttgttttacttaaaagccttaaagagatatgtaatattatcttattttttagctatctcccaagaaaaagcctcaaataaaaaaaaatctttttcaaaataaataaacgttttcagatttttttttctaacttttgagcaaggtttttaaaaactttttggtatatagtttgtttatgctgcctatgcaattatcttstctttggtgaaaaaaataaaacttatttcattacacatrtaaagcatcaataagaagtcagttaattcctgtacctcatgtttaaatgctgtgggtgagattattgytaaaggggagaaggactacaaaaagactccttctgcaggataacatgaacatccatttagaccaaccagtagayaatggaaaccagagtttgctgggtacacgtgtgcacagtttgatagacatgtgcctgcatgtgtctgctccacaaggcttccttcccatagtcagagactacactaccatcaccctaatgatattgcttttgcttttcatttgactattcaataggccagaagtaaatctgaagaaatattccggctgcctcaaagatattgaaatttcaagaactccgtacaatatactcagtagtcccgattatgttggtgttaccaaaggatgttccctggaggttggtctgtttttgatagttctctaaacacatttatatcagatttcrcttacttagtgtggctgctcctacaaggatcagtcttttgttaatatattttacttttctactgatcctactcttaaacgataaagcaagattaaagcattctctaaattaccatgataaaaaatggtattatgaagtcctagaattgtgatccaatttyccaaatgtatagctctttatagcacatatcattaatactaatctcttttctgtttttctctttttttccaacactacttttcccttttccttatttttgtcatccattttaaatttattttacttttatgtgttgtatatagctttattagcaaccttacattttttctggaaccattsaagtttacacaagtagcaagtagtaatttacaccgtagccattagtgcatagtctgttgtctacaaacttgaagtctagcccccttgtctttgaaataacatagactgggacctgtggcaatcaactctgcaaagacttgtgtttgacatgcctgcaaagtcctttgttagctgatatcctcagtaactcttctttgatgctaaagcatcctagcattcccctattttygtttaactattttgcactgtttcttcagttgacactgacccatatgtgagaaagaccccggccatagctctactctcttaaaatatccataagcaagagtcaatagtcaacagcaaatattagcaagaattttatagaaactcaatagtgatcagcttgtttttaaaatgaaaaygttaaatatgtcattctcatacatttttaattatcctatcataatacaattattcattttgtctgctgcttctaatcaaaattatcttaaaccactccaatagaattagggaaatgaagggaaaatgtgggtaaagaaaaaagtaaatccaccayttgaatgatgaggtttaaagactggaacagaactttcaggatcttcattgttcatagctacaggctccaatttggaattggccatagacacccactctgagaagtttgggaataagaaaagagaaaayacattaagaactaaaactgtaaggacccatactgkcttcttaaaggaagttttactgagaattttaatcttcaaagcctaactctcattcacattcaaaagatatatacatgaggatggaaactgtccggaaaatgaatagcctctgcacgtggaaattatgattccctaaaggcactttgcagtaaccaggaattattttgcaactaaaatatgaggcagaaatttgatgtggataaatattgaaaagtctgcacagtagttttatctgaactatctaaaactccatgatttgaaaattggaatagaaaacagattatacattttaccagctcttgtgtcatttaactggtcttgaaacactgtgggaggaaaatagcctacattaaaggattctttgcttttactcctacaaaatctaggactttaaaaatgaatattttaagcactttaaattcctaactacatgggcttgcttaaataaatactagcaaattcataaagtrgaaagtcctcctgccattaaaagtgactatctacatttactgagagagtgatatcttccacatatgtaagaaaaaaaagtcattaggaatgaacatgtctatcaagattcattttaaatayagggaggaggagagaggaagatggcaaggttgtgaaagagtgaatgaatgaatgaatgaawgaattatagaaagctatatgcttctgcacagctttgagattgagatggggagctgattttctcccttttgcaccttatttacatttctacttgaaatgtaactgttttaattttatactgagcaaggacaatggtattactttaatattgagaaaaaactagactatgcgatgtttgktttatttatttttaaggtttggtcttatcactggggaaaaatgcagacacagataatggtcatacccatctgtaaaacataaacaattaagtgatagagtttattcaagagatattcgttacagtgttttcaaaggaaacttagggacaatctccctagacatgtacytgcttgtgtgtcagtttgacttaaatctttggtttaaacaacaacaacaaaaaaaggtacctaacagtgataatcttctatatttaaaatcaaaagctctagaataaaagtagaggctataattctgattttaacaaaaactgctcagaagatttgaagttatcatataactagaaataatatttcttcaactgctcttaaactttccatgttttcctgctttctaaacctatgatstatttcataatcacattaattgcatcgaggagggtgagtgagatggagaacttatttaaattttcatttctaatggtttctactcttcttttcctttactcacagaatgtttacacagttagctttcctaagcctggttttgtggagctctcccctgtgccaattgatgtaggaacagaaatcaacctgtcattcagcaccaagaatgagtccggcatcattcytttgggaagtggagggacaccagcaccacctaggagaaaacgaaggcagactggacaggtaccctcacacctagctgataatgcattttccctaatgcttatataaagcagttaacttacttttgtatttttagtttcgtatcatttatttctgctctcatcttggctagcaaggactgaacattccatwtttccatgctggcctcctatttcactcrcatcatctccccaggacaattgtcttctctaggatgttcctgttgatcaattgtaggtgcaaagtcaccctcatatttgcacctatatttcctatgggtttaacatatgcatatgtaaagaggacagcttaaaatatattcacattatcttaatttctactgtctccaagtccgactccttaccaaatctgtagacagtcagcttcggtcccttaaatttaaatgtraattcctctaagatcattttcccagttgcacaagctgaagwaatagtcttttgggcctgactcatcccatcctctctggacacaaagaagggcagaaaatggatctgggagaaagcaagtagaacacaaccaacacagacagggacaattwtatcccaatagcattcaaggatgttaaagcctaaagaatgtcaaccagccgggtgtagtggcccatgtctgtaatcccagcactttggcaggtcaaagcaggaggatcgtttgagcccaggagtttgaaactaggctaggcagcatgataagaccctttctctacaaaaaatgtttaaaaattaamtgggcatggtcgtgcacaactgtgattccagctattcaggactgctattcagctgttcacgccaccacactctagcctggatgacagagtgagactctgtctcaaaactttttttaaaaaagagtatcaattttgcaaggacataaactttagtatctatatcccctgtccatttgrttctgttaaaagcaatccctcaactgcccagatttaagcatcatacctcttattgccttggtattctttaatatcttcaatcacattttttaaaacgtaattttccatttaatctagtttttctcaatgaaagggttcataggaattattttgtctgccatgaccaaaagaacacaatgctttacaaatatatccttaagtatgcacatacccttgtaaaccagatcatgttatttgtgattacgtgttttaaaaatcaattttagtatgtaacatttagtgatcaatcatattatgtaacaaatcttatttatttttctaaaaaatacaaagcccacacaaaatattcacaaagagaacccaaagatgtataaccacgagtaacttggattatttcaggaatgcagaagtggtttaatgttagaaaatcaaaatatcagccaggcacagtggctcacgcctgtaatcccagcactttgggaggccaaggtgggtagatcacaaggtcaggatttcgagaccagcctggccaacatagtgaaatcctgtctaatttgtatactaaaaatacaaaaaattagccaggcatggtagcaggtgcctrtaatcccagytacttgggaggctgaggcaggagaattgcttgaacctgggaggcygaggttgcagtgagccgagattgtgccattgcactccagcctgcgcgacaatgtgagactccgacycsaaaaaaaaaaaaaaagaaaaagaaaaaaaagaaaatctaaaaataatataatcttgtcaatagatagtaaaaacatttggtaaaatttaacagtcattcatgatttttaaaaaatacttaagtaaactaagaggaaggaacttccttagccatctataaaaaaaaaactataacaagtattcctgatttaaaaaaaagacattataaacatttgctataaaatcaagcccaagaaacagatgactattttgactgcactgatcttagctagcatagtaagaaaagaacaagtaaatatagcacaagaacaagaataagaacaaatatataatttaagaatcattataacaaaatagacataaagcccatatggagaaaattataaaatttcattgaatgataccaaagtatttctcaatgattatagtcaataaattggtatagtcaacatgttaatgaagatattaaagactcaatattaaaaatatgtcatttctccccaaaatgatatgtagattcaattataataaaaatatcaccttatttttctgtgaatcatgacagcttattctaaaatttatatcaaagatgaaattcctagaatagaagaatagcgtagttggggctgttccaccagatatcagcacattagaaggtaaagttttgtattgtggarctatcatgttaattcatgtataactgtgcaaataggaaagaattgagaaccctgaaaatacacaagcatagatggaaacagcatttgacaataagtggcattgcatttcatttaaaaaagacaacagtgaactgttcagtgaatgatttcagggcaattggttattcatatggaaaagatgaaactaaatttctttttcatatcaaaccaaaaaataaattcacaataaattaaagtcttaaatatggaaggacaaaaatctttaaaattcttagaagaaaatataccaggattaaattttgaccttcgggaaaagaacacttgattgaacaaaacaagattatragtggaactgcattaaaattaaactctttggtcatcaaacaacacaaaacacaagcctcagtctggaaatgtacagtatatataatctacagggaatacagtccttgtccccaaaaggggaaaagctcactgcagtttataatgggatatcgaaaccatactggttgytatagtattagaaagaacagtattggaaagatgtgaatcaaagagtgcccttgatcactgctggtagaaaaagtaaatttctaaagtcactttggaaaacaatttggcactatctcctgaagttgaacatgtgcatactctctacaagccagcaattccactcctgggtacagacccagatttttgcacatgggcataataagacatgtacaagaatgtttatagaagtattctttataatagcagagaaactagaaacaacccaagwgttcatcagctggagaacagagaggcaaactgtggcacttttgcataatgggatatcaaggaataagaaaaaggaataaattataactaaatataacaacataataaatagaaaataaataaaaatgaaaaatgtgctatatggtaccatttttgtagatttctcatacaagtagcactaaacaacatattgtttacagacacatgtgaatttcaaaaatattttttaaaagtaaggtaatgataaacataaaatccacatttgtggttacctctgagatggagaagcaaggagatggtattagaaagaaactcataagagatgcaatggtattgtttctgaaatttggtggtagatttacaggtattcatgttattatacagtgttaacgcagcttcatcgtttacatgtatatcactcatattgtgaagaatatatcaaatagtcgtaataaaaatatttttgaagagtagagggagaaaagtgttattttatttcatttcttactacacataataagcactaaataaatataaaatacaaatgccctcgtcaatttttttgtttatcttgaaaaataaacttttttctcatattgcaaatgataagctagttataataagaataccagatcaaatattctgaaatagatttccactaaaggatacttgattccttcatcattgccagatatttaaacactacctactggctccaaatttctcctcttcaagataaaagaaatgaatgtgaatcaccagctttcaggatagtgcttaaaataaaacagattcctattaaaacaattacaataagaaaacactatgtagtatagtataaagtaagttaaaatgacattttaatgttttaacattttaataactcatatctactttataaaatatcatagtatatgctatctgaaggaggaaccaatgttaaatagtataagtctgttagacataattagatttagattcagtgctggttaaattgacaagttttatatttcaaagctaacggttttgatacccatagagttatttgtgattcctttctgctaaatgggtttgatatggcaaaccatccatgagctaaggaatttttaattgagtagtttgtgttttccctttgacagatggtgagcacttatccagatcctcaaaatgttctgtggtggacacgtaactacatacatgatttagtaaattattggaacatgatgatgtttgatggaatctgtctctaccaccatagatgactcatggagaactgagccatcactgtgtggcaggtgcccccatactccacaagaaagggagagcacgtggcatcagctctagggacaaggactgcattcaggctccctggggttcatgatgggatatcaaaaccacactggttgctatagtaacagtagcaagaagaaagcaggcatgcttgtggatgaaaaattatcttccttctttctaaatgtgggaggcaggttacatgtttgtgatagcgatctattctaccagctcagagaacaaattgaagtctaaatactcagaatgccacaaggttgggagtcaggcctgattctcagaagctagctgtccacttgtgaatataagggagagggattttgttgacaccctttgtctcctgatgggttttataagttagaggaccaacgcaagcacagctgttactttcagcatcacaaatctgctttgcagagaactgctatattaatatatccactttccagatcatctcacaagcaaaaatggtaaatgattagaaagatatttccagctgttttcaaaacsgtttgagaaaataaagtcttaatttctcaggtaagatctcagagcagacgaacctgtggttctgccagggaatctctaaagctaagccataaatgagacttctgtttaatcttcaataaccacttgctgttgcaggcctattatgyaatactcctcaacaggggccgtctggaagtgcatctctccacaggggcacgaacaatgaggaaaattgtsatcagaccagagccraatctgtttcatgatggaagagaacattccgttcatgtagagcgaactagagggtaacaatagcactaaaatatttattattgtaactcaggtgaacttcctttgctagcatcggtatctatcagtatctgcctgaacctctgtgtgtgtggacmtactatgcattgcaaaaggataccgtagyttaattccctcttctttacttttcatacttcgggaacctcatttgcytcagcccttaggagttctacccttaacatttttattcgtgcagttatctmcacctttggaaaaaccaaatgcattttctgaagctataaataagaaaaatccctccctctgcccctcttaaatattacctcctcaaataaggtatgcacacagyraaactcacaaatcagctccactggagccagcaggctttggcggtttctatctcattcaggttccaaagcagttatggcagctgcttagctgtcacagatacagagtgtggcagcagctgcaggacctattgagcctattaagtgcatatcttgtccctgtcccccttcccaaggtttgcagggtccctgcagagtggctttctgagggaacagaatcaagggaggggaggaaaatgactgctgccctgagcctggccacctttttacaaatctaccagagtgcttgccccagccctgggccagggaattggctttactcatgcacaaactgatgactttctttagaatgctgcaatactttatacttactttattaggaaagtcatctgtatttttcatcaaaatattgtatgacaactcagagagataattagtttagaaggacaattagagaaaaaagaaacagaagcccagagacttcaggggttcagacctccaagccagcaatccatttatcagactgaagacatagaaaagaactggaaatccaatttgatgaggcctcaaaacacagaggatacttttaaatgcaacgagtatgaatatgtagcagtagttcagccaagccaatactatcctgcagtgaaagacctacatttactaattatcctcttggggaaaacatttagataagcaataaagatttcttaccttctaagtaaacaacaaagctttcctcagtttttattattattattattaggtagaggattaggctgtaggatgaattgatacaaagcgttcatgcagaatggctactgagacgtttagaaaccatgatcgagacaaatgagggatcatttatttggacaaactgagaacttttactaatctaayagccagatattgtagtcatggtctctgaggagaaatgcaaactgaatgctctcatttgaatcttagaatgctttagaatcctggtttcacatgtcttctagattagatgttaggccctttgacaaactttaatccttttcattgcggaaaggactttttaaaagatttaaactttagccgggcgtggtggctcacacctgtaatcccagcactttgggaggccaaggcaggtggatcatgaggtcaggagttcgagaccagcctggccaatatggtgaaaccccgtctctactaaaaatgcaaaaacattagccagacatggtggtaggcgcctgtaatcacagctactctggaggctgaggcaggagaaatgcttaaaccagggggacagaggtttcagtgagccgagatcgcaccactgcactccagcctgggcaacagagcaagactccaactcggaaaaaacaaaacaaaacaaaaacatttaaactttaaggaatttcaataagtaactgcagatttgagaaattagtttaccgaaatcactcaaaatgtgttattttgttgagaaagaattctggaattcccaaatgcattacactgttgtaccactatgccactatgtccttttaacaggtgcttcttcaagaagggcattttattatgccaacttcacagctgttgaccatcaatccaacctttatttgattaagctcagtatatagtacatcactggaaaccagtcatttagttaattggccatataaacraacagttttgccattcattgttaattacaggataatatatgacatattagtgtgtagtcactgaactctgtgccaaaacagtaatacatttgctaccataatggctcattcggcactctaaggttaaaatgcaatctactctataagcaagtgccacattaaactgattgaccagagatcgcaagtgaccatgagaacttcacccagaaaaaatttttaatgctttatatgcctattctatggcatgatttgtgtcacatactagacaaagatgatttgttttcattgttctgaatgtatgtgagatctgtaataacatcctttcatcacagatgagaaaatattaactaacytgcccaaaatcatgtactacaaataacaggaccaggtattaaatgagatgatatatttgacttaaatacctccatctatgcacagccaatagattattcttacatttttgtgtgaccataaaggtttatattactaaatgttgattatgatgtatgattattaatttggagatatttgcattatcccaacacttttcagattttcagactatgcatgtcagtcatcatttcttttcctaaaatcctggacaaaatgatagctttaataccgcctcacaaaataattggattttcaccaaactgggggccaagcttctcaagaagctccttctcccttgtcctctgcctctctttactcctcctccctcattctctctcccttccaccccttcatctggaaaaatctccctttagtcactttggtatctaatttcttggcactccagtgacctctgcctcctatatctgctttgtcctctgatccttctcctggcatccgccttggtggccagcagttcttactggacaaaaacatcaaaccctaagagcctgaagtagttacttaagcaaataggacaagcaactgaactgaktttttcttctgggaaagctttcttcacacaggtacagaaataggctaaaggtcaggaagtagggtgagatattttaggagtcatttggggtttccagaatgagataaagattttaacactgaaccctaaatattttctttcttaacatccaaagtatgttcaaacagaaaaaagattagattctatttattatgtaaattacaaacattaggacacatttctcttaatatcttcttccacgtatgcaatccaactgatatggtttwaaaaaaaatcttaaacccacattccaaacaaataagaaatagggtataagtaatcargtaattatgaaactctaagaatcagccaytgaaactgtaaaaaaaaaaataaagctgacctattacaatactaaagtaatacaaagtttaatgtacctttttgcacatagcaggcctcagtaaaaagctgttaaataaatactttttaaaaatggaaaacacaccagaatcataatggacatattggcaatgtccttctcaataaaaactaaagaaatgatctagatttgatgttcctaaaaggtaaaataggagcaggatttagctgtagttttctagcaatgccctttttaagtaatacagcctcagggcaatcccttaattaatattttccgctgtttgaagtaggtatttttatctccatcttataaatgaatgaaatggacctgagcatgattaaataacttgcccaaggtcacacagctagtaagcttccacactagtacttaattccagtatgttcctcctgaaagcccacactcattctccatcaccaccctgtgaattggtttaaaaaaaataagggtcactatgatggtccttgtggcagaaccacactacagagagaggctacaccagaaagaggaaggcctctagctttttaaaattctaatcaagaacagagatttactctccttggacaatctttaacagaggcttatatccttcattaaaaccttagaagccctgtgatatcatgttgctaagaagaggctgctttcagctaaaggggaaaaagagtgtaggggaggggcttctcagtgagtcacacatacccggaagtgagtggttttctgaaattctcgtctcaggaaaccaccgacactcttagcaaggaagctgaacctcctgggttttgccaacacatttttccatagtttggtaaagaaagaaacctcaaaagtatgtcatttccccctattttctctttgaaactaaattttaccggtcccttcttcacccccttaacagtgacgtttttgagccacagcgaaatccattttttgtccctttctcttacttttgaattatcttacttgtaaagtgccaattcagagcatctttaccctggcttattgttttttccagttctacatgtggttttacttctttataaagtcaagtaagagggtactttaggactgaggtttccatccaagtactccggttttctctccagatatgaagtaagttttcagtaatccattcatgatccccaggctagtgactaatgcttatgactaatagcaccatgatgactgttaagaccgaaactcaaaacttgcttccggaacaaaagagaaaatgcctttggtcattttcatcagaactctttgtctccttctgattcttggcccagggatccaaggattgttgtaaataagtagcatgaggttctcaattagcagtgtgtgagttctctctcataagcaaattaggaaaattaatgaaacagccactaaggaaaatcattgcaaggaacaattagcagggtgtccttgcctgcctcttctattcaaaagccatcagctacattctttataaaaggtgctttaagtgtttgctgttgattcctgcaatctaagctctcaggagcatggtttgttccctagcaagaagataatagccagcacaacccaaggaagaccccatgctttgctaaacctgccaacccttatacggttagacattactgcacactgcagaagcctcagttctcacaggctcatgtgttgggctgcacagcgctgttgtcagctctacaagaggctaatgttgcagtgcgccatgacctggtttcagtaaactttcaggaagagtgaacgagggagtcatggaacgagatcctgagaacagcgtttgcttagtgtagaattcctaagcatccaattttggctcccttaaaagctatggttgagaggggtgaagggtggcaggaaagaatttgatttccaactgtattgaatcagatgtgacttatacttgtttatttttaatattttatcagcatctttrcagttcaagtggatgaaaacagaagatacatgcaaaacctgacagttgaacagcctatcgaagttaaaaagcttttcgttgggggtgctccacctgaatttcaaccttccccactcagaaayattcctccttttgaaggctgcatatggaatcttgttattaactctgtgtaagtggatctcctcattactactactaattttttatttttatttcttgctattaggggtcccaatgcatctacattgtctacagctatgcaggggaggagggaaacaatgaggatcttcaayttagactgagaaaagcacactaatggacttaaaaaggcatgcggggattgggcttaattgtaaggaagcaaaaaaackaaaataaaaaaatcttatttattacattctattagccccatggactttgcaaggcctgtgtccttcaaaaatgctgacattggwcgctgtgcccatcagaaactccgtgaagatgaagatggagcagctccagctgaaatagttatccagcctgagccagttcccaccccagcctttcctacgcccaccccagttctgacacatgtaagtgtttatattatccccattgctttctaatttttacccagtattctgagtcatttcagaaggaagattattcaggatatctagtacactctgatattagaattgaaagaaatataacctatctaaacctattcttacatcttcattgaatgacttacctatatttccatcttcaattttgtttacaaaacagtacattttcagttgaaatgttggaaaacacagaaatatccagaatcatgaataaaagacacttataataccatgacagaggcaaccatgttggtttccaggcccttttatctgcatagtagatgtcctaccttgtatacaatttggtgtcctgtttttagaaactagtaatacaccactaaaactgtttctaggccaggcgcggtggctcacgcctgtaatcctagcactttgggaggccaaggcaggcagattgcctgagctcaggagttcgagaccagcctgggcaaccacggtgaaaccccgtctcttctaaaatacaaaaaaatagcctggcatggcggtgtgcacctgtagtcccagctactcagtaggctgaggcaggagaatcgcttgaacccaggaggcggaggttgcagtgagccgagatcacgccactgtactccagcctgggcaacagagcgagactccatctccaaaaaataaaaataaataaataaataaaaactgtatctaaacatcatataaatgtgtatgtctaatatgattttatgttaagtatatatacacacagagacacacaactattttatagtattggaggtcatatagccttgattagagcatgggctcaagtcagactgctggtattcaaatcccagcactgtaaccgaccatctgtgtgaatttgggaaagctacctgtccaatctatttctcagtttcccatccaagtactaaccrggcccaaccctgcttagcttttgagatcagaaaagatcggatgctttcagggtgatttggccatagactatttctgtttcctcatctgtcaaatgaggatattaacagcacagacatcaaagactttgtatcagagttttaaaagataatgtttgttcaatgactcacatatactgaacgtttaataaatggcataagtactatgtagtaatgataataatgagtactttcaccagcccagggctaaacaattttcattcaatattatatgtaattctcataacggctctgtaaaatatagtctttctacttttagtcgagttaataagaattagctatcttaagcaaccaacccactcacaccactagtaaaaggcagagtaagaattttattctagcgagtcagactccaaagtctgactccttatctcyggaacactctgcctttccaatttattctacttttaatagaccatggtaggctattgagagtgtttccagtttttcactattagaaactatactctgatgagctcctctatgcatcaagctttttcattatttccagttattcttaaaatagataagtagttaggaaattataaggccaaaagatgaatatgtctaaggttttcaatacacatacctgaattgtttcttccacaggctatgccaatttacattcttatcaccaatacaacaaagatggtcacagtcactacactctttacagctcatgtgttgtggttatattccataccagtaatgggtgggcaatgttgtcttgagtgcagatcttgaaaactcttgaatatctcattctcttccttagtgtccacgatggaattggttgagcaatgtgctccttgcactagaaatagttattcaatgagaggccagataaccatcattcaagaaaactggttatttactccaagcatcctttcatcctttgtaaaatagagatatttcatctatcttgcctacaacatagagttatgaaaaatcaaatgggataatgtatgcggaagttatctgaaaactggaaaaagcatacccacatagacactctgaggaatccctgcatttagtgaataactactatgtgtccagtactctgccaggcatttcatatctgttatttcattttattcccaccctattgttttatttacatttatttatattgccagaagtattatatttcacaaaggaaaatacctaagatcacacagctagcaagtggaaagctgtcagtcatggggggttagttccaggagttgatttcatcctaaagcattcctgagatctgccacatggatttcagaatgtttcctcagctctttcataattcagccacaggttagatctttgcttagcaaaggtaaggttaatgatcctcctcttcaccctcatatacctgaaaatcatgtgtttctcagactcataaacatgttttcagttgaagaattagaaaacatcatgagttgaataaacttttttgaccttggatcctaatgtccacttataaaaatgtttctaggagaaaacagcctaatttctaaatgactaacttaaaattataaactaaaattggcaagagccctaaagatcatctggtccaatcaccatcttaatgcatgggttccttttacatgatacttacagcctttgcttgaacatttcattgacaagattttccagtgttatgacaaggcaggctcgagttgttagaaagccatcggttacattaagttaaaactgagtccctaaaacttctatgtaatgattgtatttctataggcaaacacattacatttatgtgtcctctgtctaacatcccttcaataatttgaaaatagctaagtcttctccttccctaggctaaccatttccctagcttaggtattctttgtattatctcatttctaattactatcccctccatgatcagtattcttaaatttgaaatattcccttcataatatggcacctactgctcaaaaggaagtcaccagctcaggggacagtgtgacccctccctcccttaattgttaccatatttctattaatgcacctaagaatgttttaatgtttttaatagatatatcatgctactaattccaaatcgggtaccatattcaatcaagcagaacctcatggaccttcttctctaccactagaacatcctccaggcaggtctctcagcctgtgctggtttggatttttagggataaccctgccagcctccatggatcaccttacttttctaagtacttacacaaactgcattttatagggcctctcaagcacatttttctgtggtatttagagatcacactttttccttttttctcaaaataaagatacttgcccatctgggaatggagatttttactcatttaaggttcttttttttttttataaccttctgttctaatttcgatttccatttcctctcagcagtgtatgttttaacttttccgaaaacagagcattccacttagtagatgagacagaagcaaaaagttgagtagcatgccaaattggttggtttagaaagaatcacagaacattagagctagaagacaccctaaagattccaactcttaacttgcacatgaggaaagaaagccctcaaacttacagcatggcccagggggttacacacatgagcgatagttggcactaaaacccagatatctaaattccaactgctatttcaccttctttttgtttgtttgtttgtttgtctgttttttgagatggagtttcactcttgytacccaggctggagtgtaatgtcacaatctcgtctcactgcaacctccacctcctgggttcaagcaattctcctgcttcagcctcccgagtagctgggattacgggcatgcaccaccactcttggctaattttgtatttttagtagagacgggatttctccatgttggtcaggctggtctcgaactgccaacttcaggtggtctgcccacctcagcctcccaaagtgctgggattacaggcatgagacactgcgcccggcctatttccccttcttttgcacattataattagttatgactgtgtggtcagaattagattttttagaactttccatctctattaattgtattatattttagaaatcagatcatgaagccacacatatcttctgttttaatttgtttcctttcttatgttctttttgtgtgtgtagggggaaaagggtgtcttctttttaaaggttactaaaagttaaaagttttacagtttattttgtaacaaatatttattaagcacctactaagtgcaaagatgaatacgatattatcattgctagtcagagaaaaagagggagagttgctttttctgccatagccctcccacttttattccatgaattctggcaggttacttgtcccttctaaatgtaaaataattaatggacaaataaggataataatatcttccttctaggattactattatgagggaataagttatacattttatgcaaagcacctagcaccatgcttggctcaaagtaacattccatctctctatttattcttttgttagtttaactttaacttctgtgtttctttaacttaattattctagttagtttaacttttcacatttttagggtgggtggcaggtgctggaaaaaaagggatgtggtgagtattcaatttttaagcaattccaaacccttttattggtttgatatgtaatgatgatatatacattgtaatgatgtggttattaaataagtcctctataattttcacttctcaccattttccatttttgtatcagaatttagattctttattttttttttcttgctctgtcacccaggctggtgtgcagtggcgcaatcatggcttactgcagccttaacctcccaggctcaggcgatcctcatgcctcagcctcctgagtagctgggactgcaggtgcattccaccatgcccggctaatttttgtatttttaatagagatgggatttcaccatgttggccaggctggtctcgaactcttgggaagtgatccacctgcctcagcctgccaaagtgttgagattacaggcataagccaccacgcctggcccagaatttagctttttaagagttgttatttaagaactaagacttaaaagttaactcctgaagtgagaactgcctatttatgagctccatatttgtgctagcacagttgacagaaaagatctattctcagtgcccttctttttcttctttacacccatcacacccaatcctgccagcaacttacagcatgaggacaacattcactatactacagggcaatgtaagggtgtcttgagaaagccctgccttgtgaaatggattatgtcaatcttatgattaattcatgttgaacacgctagattaaagagcatttcatgcatattatctcatttgatattatggtagcttgtcttctctttatacttctctcttattctttagcccatcgagagctagagaaaacatttctacatgttctatttgtggatatttttcatggaggatggcaggaggtagaggtagataagaggctgaacttcaagtattacagaaatttgttgacatgtggaaacgtgacaagttctctgcaagtatgtgcactgtttagaccaagtctttttaacaaggatagcctgtgtggatttgtagataatgagctggctgcattcttttacttgaattttattgaagagttcagccgtaaacctcacagtttaaaatgtgaaaactaagaaaaacaatacaagtagccatggagaattcctgtactgatgagctctctttgggatttggggaaaagaagtgagcacagaaggaaagaatagaggaaaggaaagcgatttccctagcagctttagtgctacacctttaagacctaagtacagtcaaggccaaaggataaactgattggatactgatatgtatttaaagagaaaacatacattttccacttatcaaggaatccttgtttagacattaatgtataaatattactgtaaatgcccaagacccaccaaaagagcttaagtgcagtgttaacaataattcagtttctcaataaacatcttgagtagggcttttatattttagaagaagattaaagtcagtgctataaaaagtatcttccacttattcatccataaagaaaatcatgacaaataagcaccagatgtgattttagcccacatttattagagaaattaattattgactcatgaaagaagaaaattatgcaatttctatgatgattcattgtttggtgctttcaagaacaaagatgccagttttgataaatgtaatataaatctctgctcaggacccaggaaattcaagagatgcttatcaacgaatcatacgcactcctgaatctaagaactcatttccaaatgtcagccaccaatctgcagttagttagaaaagaccattgctttattctgacctgaagttaaatgagtgacagtgtgggggtgaaaacgttttggccccgttaccaatttggtgcactatctacttccctaaacaaggctttgggagcatggcttcctccataattattcccaaccacatcactgctctaatcaacaggtgcaccaccacgcgagactccccacccaagtcctgtctgcctacaacttgtaacctgccaagcaaaggcaaatgaaaaacaagcgtatctgtcctcctttcatatcccattttccccattatctatttctagtactttaaaaagtccccacaaggtggcagaattgtaacacgttgagattgatgagcctctactgagactgtgaatttttttttttattattattgttgttttaacacatttgagagattagtgcgtccaaaacaacacaggtaaagcatcacatccatagagatgaggacgccttcaagtatacactagcttagaaaaggatgattcatcttgcaatgaccattctttaaaagttccttaaaattacctcattagatcttttctcttacccttttttcttagcttagatttcagtggcaagcagagttgaaaacatcatccttagtgacaagatcattttatttctgagcaaagcacagggcagtttctattccatctcacttgttccccctttaaaatgctagaaggaaaaaagaagcttgagcagctggatgagcagctccacccactgtgggacatgaggcagaaggaagagaagaggaagcaacaccgggcaaagcaataaactggtgctgccctgaacacatcatgttttttttctttttgagacaggttcttgctctactgtccaggttggagtgcagtgatgcaatcatagctcactctaaccttgaactcctaggctcaagtgattctcctgccttggcctcccgagtagctggggctttcagcatgcaacaacatgcccagctaattttttatttttttaatttttttgttgttgttgttcttttggagagacagaggggggcaggggtcctcactttgttgcccaggctggtctcaaactactagcctcaagcgatcttcctgcctcggctttccaaatgctgggattaaaaacatgagccaccacgcccatcccttacacccatcagacttggtttcagtttacccaaggaaaagtgatgcaaggaagacaccctttaaccaagcaagggggaggtcgagatttgtacaaaacactaccaaattagagggtggggaatttttgtcccatttaaatcctaaggtacatatttttaaaaaccctcttacaccagcacttctcagtccttttccaactgccagtttaataaaggaaggtgatagaagttttattaaaacagtatccatcctgttgcaaatcaatgattgatagtaaacatcaccttggatgtccttaaaaacaaaggactatacaccataatggctttaaactttgaggttacatgttagagtgatcagtttggtacaactcttttccataacattggctcatctgagaataccgttttattaagcactgcttctgcctgcttcttgagggctgcccgttgcagaaacggaggatctaatccaggaggtgttcttcttcctaaatttcaagtggatgtaacctgtaatgattcttaaaagaactttgacaaagtccctgtccttttctggtcaaaggtttttttctaaaatggcttgaccagtgccttgtccatctagaaaatctcatagtatacaacgaaacaacaacaaaataaaaacaaaccaaaaaactgctgcttagctcaggaccagttttggatacacctgtccagtctaccagcaatccaaaagttccccataacatacagctgctaccgggagtgtacaactgccaccttgaaaattttttaaattttaatagagaagttatattgacatttacatatagtaattagacgagtgactgtaaccgcaataatatggacataacccactggtggttctcttttaagctacatgtaattgtttcctaattcctcagcatccatccacctttcttaatccctcaattttcagagctgagggtgtaaagatgtttcagtgaaattctgcccccagtggactcacagcagataggattatcttagtgatttctgaggaagactgcaagctgcgtgtgtttatcgagacggtcctctgtccgggaaatatcgtgagaggctgataaaagatcccaattctattaatagaagtattcatgactgagatcttaagctacagaggcctttccattcgggctctttttgcaggcagcgtaataagaaaggtgccacatgctgcctctaaaagaggccattcagctgtgcgaatgaatagcattttcctgtcctacccacggggttttgcatagctgtgtgaatttcggccacagtctgctctttataactgaccatctcctgggaagcaagaagggaaatacttccatgaagaccaattttacggcatttcaaaacactttaagccttttacctgctgtggcagagtgcttcgtttgactaagatcaagagaaaagagaacaaggcttttcctcatcaagtaaaaatttcctgtgtgctgatgagtcatctctgaggtacactctttgggaagaacactgtgcatcaaaagcctgccttgggctgcttgagaacctctgctgagtcagcactcactggggcagcggcccagccagagctattaagtgcagatcttaaaaacagatatgttggtgagagtgtgcaggttattttctcatgtactgcatgttctaagagatgtcataagcagcctgtatatcgacctatcttgtgaaaatagagaacagggaaaggaattgtggctttggtaatttaaggagccttgattatttatggagctgtgtgttatggtagccaaatgtgatctactcagccaggactgctgtatgctttgcaaggcccagtgcaaaatggaaaatgcagggcccctcactgaaaaattattaagaatttcaagatggtgacagcagagcattaaaccatgtgactgcacagccccgcacctagctctccccctcagcaccctaggaagctgatctttgaacagtggcagttgaaatggtgtatggtgggttacatttttaaaatgtgctgggttgcctagcaactggcaagggcctgaatgggctgacgtgcaggtttagatacaccatcttgaaagtctacattcatggaaaccttctagtggactgataattttcaagaaaaagtaatatagtgggagatggaaatggggagggcaagaaaaaacacattttgctactcttataacccaagtggctagcttgtcattttccctgttcgatcttctaagaatagagctcttcatatgtgaaggaaaaatgaaagggaaattccagttttctcagaaatatacataaatttttagaggataatgaaactatgagttaatcaataaatatgtctgagcacattcctttagccattccagggtgtgayatgagaaaactgattcacacgcactgagcactcrataataagtacttactatgcagtagactacagagatgaataatgtagtttttattcttaaagaattacgctaatatgtaagaaacaattagacagcatcattacctttttaaagaacagtccataatctcctgtttttctctcctgggtattttacagggtccttgtgctgcagaatcagaaccagctcttttgatagggagcaagcagttcgggctttcaagaaacagtcacattgcaattgcatttgatgacaccaaagttaaaaaccggtatgtatcatcctgagacactgggaaagaaccgataaatgaagaactgagtatttgtgtttaatcaagttgaatctactacacttattaattaatgaagttagcttttcttttattcactgagtacaatagagaatagaattttatttgtctgagcctgaggagcccaatttaggaaatcagtagcctgataaagtcctcatctctgagaaggttttactctcctttatgaaaatgcagccacgatctgataccgctctattttagcatgagaatgctgttatttttctgtttgactttgcatgcttttgtttcacagtctcacaattgagttggaagtaagaaccgaagctgaatccggcttgcttttttacatggctcgcatcaatcatgctgattttgcaacagttcagctgagaaatggattgccctacttcagctatgacttggggagtggggacacccacaccatgatccccaccaaaatcaatgatggccagtggcacaaggtaatagtcccctggatattggcagtaccctaagggaattactgagtggcagccatcagcattctcctggtgccagtatattttgccagggcagacactgactctggcagaagctaaaaataaaataagtgccatatacaactaccacaatcttggaaaatgtgctcagacctgtgtaggtttgcatttgaccactggcatgcctcatcatggttccatcactgctatatggctgtggttttcaaacatctacccataaactgaggccaggtggctgaagacatttccactgctctaagtgagaaacgtagaacagagtgtgttcaccmtcaagctcgatgtattcaattttaaggaataatatttattctgagattatattatagcatttttatggtggctaaaaggcctttctattatgaaatagtatttgccaaaagcaaaagttggcaacactaaaatgggtcccaagactccccacctaaccacacagtggtctgtgaaaaccaggaatccaggaatctctggttgatcgtgtttaaagggctctaaggtatcatttctactgacagttatttggaacaactttaaaaacgttggccttacacccagaaactggtactattatgggcacagaaggctcatttgccagcttactgtcctctttggcatgactgcaaatagataatatactgcctgattaaaacaaaatctcaacatttgtctctgcacctgcgatagcctattaaagcaaagcttccctaggtagaccaataaaatttttaattttcagagtacgatattattagatgttagatttggttaatgttaacatactttgacttgtcatattctagaaagccaaagaaccttaaaaaacgcgaagccaaccaatttgttatcatggaaataagaaaaggaatcttcatttttgctgggagcttatgactagcaaatacagatccaaatgaaggagctctcattaagagttcttccatctctagctaatagaataataaatatgacatttgagaaaaagacatattgttgaaccacaatgaggctgggattaagaaagggaacttaaatactataattagtcaaattaataacggattttatttttgatggtttttaaaaattacttcccaaaccagaatagatatgtgtaaaatgaagtgtgaaattactctaatcctgacccagactcatttttaaaccatcatggtactttagcatttcacaggctttcatgctcctttacctaaattcagactcaaggtttttatactccagccagtctttacaccccttatttcattctgtctcagaagataattcactccaccgccctaaatttcagcctcagtcacttctctatcttactcccccactttgtactcatcaggttctgcagaaagtagtgcagcttatttgtgccactctttctttaattctgcacaagaagggcctgttaggcaaagggatgtagcgtatctgaaattgtgttgggagcccaggctctttsctcaatcaaactaatgcacttttaaaactgtgcatgaattttgctacccacttaatttatgaaagtgctattagtctgcagggttccttacaacattcctccctctccacacatatccacatttggcaatctaccgaggagacttcgacctaaaactgacccaggaaaatttggtattcttttggtgatagtagtcatggaaaagacagaatttgagatattctgtaaaatgggtttaactttcccatatataatgggcttagcgcatactaagcactgtgtacattgtttcaatttttcttggtaacatcgttagagtccttatgtcttatactctgcatatgtgaaatttgttcaggattggcattaatgactcctttcttttttgtagattaagataatgagaagtaagcaagaaggaattctttatgtagatggggcttccaacagaaccatcagtcccaaaaaagccgacatcctggatgtcgtgggaatgctgtatgttggtgggttacccatcaactacactacccgaagaattggtccagtaaatatctgatttcttctttattacttaaatatatggctgattcatttattgatatattttgacttattaggtcacatgggcccatgaaaactgataggtgaataggaagtcatcttttctgataagggacagaagggtttgttgtttatttgtttgtttgtttgttttgagacagagtctcgctctgtcgcccaggctggagtgcagtggtgcgatcttggctcactgcaagctctccctcccgggttcacgccattctcctgcctcagcctccctagtagctgggactacaggtgcctaccaccacgcctggctaattttttgtacttttaatagagacggggtgtacttttaatagagacggggggtttcactgtgttagccaggatggtctcaatctcctgacctcatgatccgcctgcctcggcctcccaaagtgctgggattacaggcctgagccacctcgcccagctgacagaaggttttttagatagattagattatgagagacaatgccatggaacactgagtggggaacctggagccaaactgtcttggtttgaatacctatttaactattgactagctgtgtgttttggagcaagttaatctcttttaacaaagatttctcttttgcaaaacagggtaatgataatactaaacaaaaaggattgcataaagattaaatgaggtaatttatttaaagtgattgggttgggcgtggtggctcacacctgtaatcccagcactttgggaggccaaggcaggcagatcacttgagaccaggagttcaagatgagcctggccatcatagcaaaaccctgtctctacaaaaatacaaaaagttagccaggtgtggtggtgtgtgtctgtagtcccagctactttggaggctgaggcaagagaatcacttgaacccgagggtcagaggttgcagtgagctgtaatagcaccactgcattccagcctgggcaacagagcgagaccctgtctcaaaaaaataaataaataaataaataaaaataaaaataaagtgattggaagagtagcaggcatataaaaagcactgaaagatgaaaatgatggtatgtattcatggtgtttcaggcatagagatttagcaaatattgagaggtgcagtagttacagtacagttatccaattttggattcagaatttaaagccctcacagttttgtaaatcaatattcacaaaataattttttattagaccgtgtatcctagtttgctttggaaagtgttactctgagagaagcacgggggattgattggtgcttttagagaacacactagatacaaatgtgatacatttctatactcaaattagaacacatgataatgtagatttgttcattcatcaaagacaatcacccattatagttgtaattctcagtatttggcttctcttgtggatgatcagtattacttttctttcataggtattggatatgctttttaggtctatcaaaaactaaagtctctgaagtgacactggtacaagcaattcacttgaatttctaaaaacagataaaatataatggaccagagtgtgattgagttacttctaaattccttgaacccccaatgtttcatgcaaactttcaagttttatgcatatttgcattttcttaggggagggtctgctgctttcattagatattcaaaaggaagaagcactgaaccaaacctaattaccttttcaaatagaaattgaacataggctatgacaaaatgggtatatagtaaggttaataaactattaatagaaacataaaatcaggaacgtaagagaccaattaaaacttatgataccaacatggggcccatagctctgtcaaaccaatggagacatagtgtgcagtatttagactatgagaacagtcatattccaggatagacacatccaagttgagaagcacaacacaggattttctgcatccatgccaggaggcctggtggtaacagagaacccaggcagctttgggggatatcccatcctaagacaactggataactacacacatagagcaccctgcaaatgactgtattctacataaaggcaaagttctgctaaaacctgacatttgtttcttctgatctgaatgtttaggtgacctatagcattgatggctgcgtcaggaatctccacatggcagaggcccctgccgatctggaacaacccacctccagcttccatgttgggacatgttttgcaaatgctcagaggggaacatattttgacggaaccggttttgccaaagcaggtaaggctctttcatttccttcctgttgattattaactagatacaaatactaacttcttgctagtaccaaataataaaagttcctagagtcctaaactagtatcctttatttaagccaaaaagaaacttatggaagtaatttcaaaaatgcctcttaaaaattcatgtatctgatcctgataagaattaatagaagaaataaagtaaaaggtctatttagagaatttattccatctccttcactggaggttaagaacagcaaaataaataattttgcaagaacactcatatgtttatactatgttgtttttctaccttccagtttctggagatgagatatgatttttttcttcttttcaattccctgcaaggctgtatttcataatctcctccccatcaacacacacccatacacacaatgcacacccatgtctgtttcttgttgatagtgacaatgactggcatctttcctggctttctccactccgtttctaatgaacatttccagtatggttttatatcactggtcatgaaggtacagttaggaaaaagaaataggaaataacctctacataataattttttaatcctttaattttwttgtgggtacacagtgggtgtatatatttatgggtgacctgagatattttgatgtargcatgcaatgcataataatcatatcagggtaaatggggtatccatcacctcaaacatgtatcctttatgtttcaaacaatctgattatactcttttagttatttttaaatgtacaattatttttttttttttactgtagttacccttgtgctagcraatactaaatcttattcaaactatttttgtatcattaaccatccctactcctccctgccactaaccttcccaacctctggtaactatccttctactttctatctatctccatgagttgaattgctttaatttttagctcccacagataagtgagaacatgtgatgtttgcctttgtgtgcctggcttatttcacttaacataatgacctcaagaaccacccatgttgttgcagatgataggatctcattcttttttatggcttattcatatccagtatgtatatgtaccacactttctttatccgttcatctgctgatggacacttaggtggcttccaaatctattgtaactagtgctgcaataaaygtgggagtgcagatatctcttcaatattcttttgggtatatatctaagagtggaattgatggatcatatggtagctctatttttggtgttttgaggaacctccaaactgttctgcatagcagttgcactagtttacgttcccaccaacagtgtacaagggttctcttttctccacatcctcgtcagcatttgttattgcctgtcttttggataaaagccattttaacttgggtgagatgatagctcattgtagttttgatttgcatttctctgatgatcagtgatgttgagccccttttgatatacctgtttttcatctgaatatcttcttttgagaaatgtctatccaaatcttgtacccatttttaaatagkattattagatttttttcctatagaattgtttgaattccttttatattctggttattaatcccttctcagatgggtagtttgcaaatattttatcccattctgtgggttgtcacttcactttgttgattgtttactttgctgtgcagaagctttttaacttgatgtgatcccatttgtctatttttactttggttgcctgtgcttgtgggtattactcaggaagtctttgcccatttcaatgtcctggagaatttccccaatgttttattgtaatagtttcatagttggatctcttagattcaagtctctaatccactttgatttgatttttgtatatggcgagagatagggatctagtttcattcttccgcatatgaatatccagttttccctgcaccatttattgaagagactgtcctttccctaatgtatgttcttagaacctttatggaaaatgagttcactgtagatgtatggatttatttctggcttctctatcctgttccactggtctatgtgcctatttttatgccagtactatgccgtttggcttactatagttctgtggtataatttgaagtccggtaatgtaattcttccaattttgttccttttgcataggatagctgtggctattctgggtttcatatgaattttaggaattttttctatttctgtgaagaatctcattggtattttaatagggattatattaaatctgcagattgctctgggtagtatggacattttaacaatattgattcttccaatccattaacatggaatatcttatttttgtgccctcttgaatttcttgcatcattgttttatagtttttattgtactttcctctaagatctggaacacgacaaggatgcccactctcaccactgttattcaacatagtattggaagtcctagctagagcagtcagacaagagaaaaaagtaaacggcatccaaggaagaagtcaaattatccttgtttgcaaatgatatgattttgtatttggaaaagcctaaagaccccaccaaaaaaccattagaactgataaattcagtaaagctgcaggatacaaagtcaacatacaaaaatcagtaacatttctatatgccaacagcaaacaatcagaaaaagaaatcaagaaagtaattccatttacagtagctacaaataaaataaaatactaaggaattaaccaaataagtgaaaggtctctacaatgaaaactgcataataatttttaaaatctgcaattaatgtactttaagatagaatattcagtcccgtggtatcatagaaatacgtgtatgttcattagaaataaactaataagcacataatatgtggagattatgatgggaaacagaaataagtaacatagttctttctatcaagaatrtattatcaactggtaagaaattgaaagaaggcaagtaaaaatgattaaagacaaaaaaagcacagttctgtagatacttagaaaaaaagattaattttgtttgggggatatcaggaaacgtttcatggaggaatcagcatttgagcaargcttcaggtgattttaacactcccatacaaagtagtgggtgatagaagagtaggaccctccaccaaaatataggtaggaaaccccacctacagggaagcagaaaacagaaaaacacaggatatgttaaatattgaaacgttacaggttatgctgaaccccgaattccatgtgctatgaaagtctaaaagcttcccccaagatttctgcaaattcacagatggctggcattctcttagtcaaattttatgacaagtttcagcttcagcttttgcacttaatggattgacttgccatcctgcctgggctcttataattctggatcaaacaaaaccagaaaattactcacttcctctgtttctaatgtcccttgccatcccctgaacacacagtgtaatacaatttacataagacttgggtggtcagaagagatcacttcactggaaaacatacaattcatcttaacctttgacatctttgttcttaaaagttttccagcgacccaatcactggggcttttttttggcctcttcattccttctgtcctcagccgaacttcctcatgtcattcctctcttctccttacttctccctttctgttttattttgcagagcaattcagcttcttctaccctttactttattttttcgtttatttccagaaggggtgtcactatgttgcccaggcgcaactggctagcttttattcataaaatctgctataaacccacctttgccaatccaaacccatcaaggttctcagtagaacaaaagtctttcatgtaacagctaccatccttcattgcagacagccgtggctacacatagcatttatttcttgcctaataaatagaagacttggagaaaattcccctgagtatttctctgatactcagttcagttggtgtggtctagacagatcttaacatatcactttgttcctaagtgatgtatctatcttaaatacttgctcaaagattaaaaaaaaaaatcaaagagtcaaatatggaaaatcatagaggaaagaattaattaactggatgaacaagataagtctatttatgtcccagaagcttcccatcaacattgtacttacagtttctctctttattaataaaatgtgtggcaacttttgaamcctttcagatgattgtggcaccatttagtgtgccccactaaaactttactgaaaaataactgaaatgtttttctttacccaacagagagacttctaagataataatacctgacagtgagattctttaagtcaatctcagtgtgtatccatttattcaaataatacatagtaaaccctcatgttgtgccagatactttggtaagcacagggataaaatggtgaaaaatatagacaatgcccctgatctcatagcacatacattctaaaagggaaggtagcccagaaaataagcaataactaactatggagtgtgttacatgatgcagtggtggaagataggccaggcaggatctgaaacttatagccctcattagaattagctagcatttgaattgaaatataataaaaagtcatgcattgtacacgtttgaattaacaatccccatcctctaatccaaaatattttaaaatcttcattttacagttggtggattcaaagtgggattggaccttcttgtagaatttgaattccgcacaactacaacgactggagttcttctggggatcagtagtcaaaaaatggatggaatgggtattgaaatgattgatgaaaaggtgagtgtcagcaatgcaaacatttctgatttcttcatgatattgttgatgtgtagatatcatccatgtgtgggaaactcgaatattttgaagcccggctgtattctttgttgggagaaagctaaattgtatgttttcatccttctggattacttcaatttgtgtatgttttcagcatgttgtaggccagtataaattttaaatgcattaattgtacagcaagccaatcgtgttgactaataatgaaccaaatagtttgagatctcgagttcttactgtgttgctataaacacactcttattctcctcttaaggaacacacagtctatgagactatggactccagtgggagaaaaggcagagaggtggatcatctaaaattagtctgcctcttttaacaggctaggcatctcttagaagccaaggtagccaactgacgcatcagtttctcaatttgtttaaaaaagcatccagctaccatttcaaaaaacagcaaatttataaaagtagtgtgtcagtttgataataattgataatcaaattctaaacacctctttcagccctgcaktaagacaactttgcactayaggcagcaggtaaacagagaagggaaaacaagaaatttcacaagttttctatttggttattaaataggaatcgtacttcaactcagttcacgtttccacccttagtgttgcctcccaagaagaaaaatcacacagtgacctaaaatagttttttcttgctttcttcctctttctgctcaattttcaaactgtcctccaacaaaggtaatataggaaaaaagatccaccagcttagaggtaaaaaggagtgaacaaataagtaacactcaatagttttaccaaattttcaaacatacttttactacatctttttcaagtaacatgctcttaagggcagttaccatcgatatgtcactatcatgtgcgtttctcaccaagctccttttacatgcaaaagcctgttatgcaaactccacccaatatagtaaacatttcattaataattacatcaatagagtttacaaacttttcacctatttacttgcatttttaatctttcttcttaagacttcatttcttttcttttaccttgtcgaatgtcttgccaaactgactaatgtttttagtgtttcaatatgtttcgtttcttcaccagcttcaaaagaattctgtcatctcaaatttcaggggcttttccacattactaaaaacagatttttctcatttagaccagaacttctagtctaagttcttcattgttaggaatttaactggccttctggctcaggtctttggcacctgtgacatgaaacgggctccaaaatgtaatttatgtaactctcaatcttgtatataaaatgaaatccatgaaggaaaaaaatataattaaaacatcaaaagtttaaaatttaaaaaatcctttactttgaatttgtaaaccaaattaatgagtcactttaaacaatatcttttaagaaaattttataaggttcagtcagaactctcacattctaaaaagacgtgaggtagaatttttccctgtgtacactaggtccttttcttgtcacctggcctcaaatttttctgaaagcagaattattaccagctttacgtatcttgcctattaactcccaacaatgccccaaagcaaagagcataatttgtggctcctggtgattagatttatactttaatttgtcaagtttwaaaatttttttcaatatgcccagttacatccatttcaaatgattctggctgatgtctttcctagagacctgatcatttgtatgtgtgaaccatcatgatacttctttaatgaaaccatctgtgactgttctatttcctactttccagttgatgtttcatgtggacaatggtgcrggcagattcactgctgtctatgatgctggggttccagggcatttgtgtgatggacaatggcataaagtcrctgccaacaagatcaaacaccgcattgagctcacagtygatgggaaccaggtggaagcccaaagcccaaacccagcatctacatcagctgacacaaatgaccctgtgtttgttggaggcttcccaggtgagtgttggctaccccagcaacmatttctttgctctcttatrttactggttttgaaaacatttatatttacrtgtgtctaagaatgtgtgcttatgtgtacttgcttcctagctttagaatctgcttagaatctgcaccttacctaaaatttccagtgtgtaaaatgaacatattacttatataaaccacatgggactgaacttttcatgagagcccccaaagtttccttcgtggagagattgaagctggaggaaatgaatttggcttataaaagatatgaggcatttaacagcaattggagccaaacttggtgttctttctgatttttttaaaattaatataccagaggaatchtaaaatgttatggaacttatttcctcaagttctggaaatcattgggttaaacatagctaatttcccccttatgttattatagagtttatatttatattacaaagaaacgcaagcaataaatcctcattcagaatccttctctagcacattaaatatagcatgtgaactgtagagatttacctaaagtgcccataaacaagagtggccaacttgatgagaagtaagccaagtgccycttaataagtactgtaataacatagcctcctggaatggtctttcatcattttgtcaagaggaacttttatccctgtttatataaagctcctttgctaaatgaaacaagcaaaatgtatattcagcaattgttgacagagcaatgttgatagaaatgcaatgggggcccaacgacagctcctctttccaaagtggcttctgtgttttaaaaagatcttttgcttcaatcaggataaattccaagatattatgaaggaggtaatgtacttctccattcagtctatgataatgggatcctaattaacacctagtaggcctactgaaacaagcacctctataataagaggaagattctacatgaatatccaacctacttaacctttagggatttatttttacaatgtaagaaagtgataaagtcaccttcaaaaagttctaagtaagtcagtacttaaaagtatttgatcaattgctttgtttcatgaagtaacattttacaattttaagtcacaactataaatttgttcatcccaaaccaagttatttcatgtcttaagatgtataattctagatgttttcatatgttataactattaaaaagttgaggctggacatggtggctcatgcctgtwatcccaacactttggaattacactttgggcatagatggggagatctcttgagcccaggagttggagagcagcctgggcaacacggcgaagggaggatcgcttgagcccaggaggttgaggctgcagtaagccttgattgcgccattgcactccagcctgggcaacagagcaagaacctgtctcaaaaaattttaagttgatctttctttctttctctacaattctattagtaaggctaaaaacaaaaccactaactttgcataaaacagcattccaatttaatctcaagctaacagttgactttgaaacatgctcttaatatttggtgcaggacatttcaaagctgagccctcttgcattgcctttttcagatgacctcaagcagtttggcctaacaaccagtattccgttcygaggttgcatcagatccctgaagctcaccaaaggcacaggcaagccactggaggttaattttgccaaggccctggaactgaggggcgttcaacctgtatcatgcccagccaactaataaaaataagtgtaaccccaggaagagtctgtcaaaacaagtatatcaagtaaaacmaacaaatatattttacctatatatgttaattaaactaatttgtgcatgtacatagaattcyttctgtattcagatggtgctaattcagactccagactgaattttaattcaagttctttctcaagtctataaataatattaaactgattatttcattctaaataattgcctgttttgtgtgattttaaggataaaaggtaactggccataaattgttgagtttgcaacatgccctccagtcatctcaaggaaagagttcagatgtaatttatggaggcaattttttttaacttattcctatcaatacttcttctttcttttatcatcctttaccatgtatgacagctttggccttctgtccaagccactgacagcaagtgaatttggcatgtgtgattgggaggaaatcagttcccttactctatttatgaaagaattattagcaaatcattgtcctgacccaagttcattattagagagtttaactagccgtatgagtgaatagctttttatgctgaaggtagagggtatagaccagattcaggccagaaagcttaattacttgattttcttatttgataatgatttatgggctttggggagatgccaaaaccaagcttatgaatgacaaccaagcacacatttgatactacagtactaagaaagatttggggctctctaagcctacagtgaatatcacaatttacacctaggtggagaggaataatgctgaaatgcatttgtacttatcaggaaacaataaaccagaaacttaaaaggcatacttcattgagtcttttggagctgtaatttgacctaacaaattcattttctataaacgttctgtgttttgttctcctttaacccatgatttcagtcatcttcaaagagctctgtgagaagactggccttgattttattcaccagcttaaaaaggaaacgtttcatttgccatctttagtagacaatggttgcagtctaataattcagaacatgtaaaagaacaggaaactcctttctcctatggaaattttagcaacaaagaataatcctctctgacaatgttgttatccactaggggaaggaaggtgctgtttccaattgaggtgatggctgacatactcactatttcaccaccgtcctgttgcttaatacaatttgtacacacaactttattctacagaagcaattctcaagcttagctcagtgtttttaaaaaactgcctatgctttagaaaagtgcctagggagtttttaaaaatctagtacctggtccagtgattctgattttgtctaggacatagccagagcataatgattttttttttttttgagacagggtctcatgttgtcacccaggcaggagtgcaatggcaccatcttggctcactgcagcctcaacctccccagttcaagtgatcctcctgcctcactccccaagtagctgggactacaggtgggcaccaccacacccagctaatttttatatttttagtagagatgggtttcaccatgttgcccaggctggtctcgaactcctgagctcaagaaatctgcctgcctcagcctcccaaagtgctaggattactggcatgaaccactgtgcccagtcaagcatgaggattcttaaaaacattcccaggcaattctaatgtgttgtcaaggatgaacctaagaaaaataagcaatagggaaaggattccctatttaataaatggtgctgggaaaactggcaagccataagtagaaagctgaaactggatcccttccttacaccttatacaaaaattaattcaagatggattaaagacttaaacgttagacctaaaaccatacaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccagcagagcgaacaggcaacctacagaatgggagaaaattttcgcaacctactcatctgacaaagggctaatatccagaatctacaatgaactcaaacaaatttacaagaaaaaaacaaccccatcaaaaagtgggcaaaggatatgaacagacacttctcagaaggagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggccattcctcagggatctagaactagaaataccatttgacccagccatcccattactgggtatatacccaaaggactataaatcatgctgctataaagacacatgcacatgtatgtttattgcggcactattcacaatagcaaagacttggaaccaacccaaatgtccaacaatgatagactggattaagcaaatgtggcacatatacaccatggaatagtatgcataaaaaatgaagagttcatgtcctttgtagggacatggatgaaactggaaatcatcattctcagtaaactatcgcaaggacaaaaaaccaaacaacgcatgttctcactcatagatgggaattgaacaatgagaacacatggacacaggaaggggaacatcacactctggggactgttttggggtggggggaggggggagggatagcattaggagatagatatacctaatgttaaatgatgagttaatgggtgcagcacaccagcatggcacatgtatacatatgtaactaaccggcacattgtgcacatgtacccttaaacttaaagtataataataataaaaaaaagaaaaaaaaaggatgagaagcactattctaaaaagaaacattatcctccatgccaacaaagagttttatagtcatttgagaattctactattagctttgtcttggcaatttccacacccattaaaaataataatattataggccaggtgcagtagttcacacctgtaatcccagcactttggtcgctcaggcaggaggatcagtggaacccaggagtttgagaccagcctgggcaacatagggagaccctgtctctaccaaaaatttaaaaattagccaggcatagtggcatgcacctatagtcctagctactccaggaggttgatgcaggaagattgcttgagcctgggaggtcaaagctccagtgagctgatgattataccactgcactccagcctgggcaacagagcaagaccctgtctcaaatgaaagaaatatctttttatatcaaatattgaatctagtgaatttaatatataaaacattgaatctagtgaatatcttttaaccaaactttaagaaataaaactttttgaaaaccaatgtgttttaaaagtggaaacatacatctgcactaaacgctgacatgactttttgggcttaatctggacactgagtgggataaacaggaataaagatgttgggttccttagattaaaagctaaagcctttctttcttgagtcctgcacagaaagatatgtaacaaaacggaaagcaaaggcagttaaattggcactcctatcagaataaagtcctgcctcagtcaatttgtaggtagatgccttagaatgatagaatgatagaactggaagtgaattgagatcagcgaatacagtgattctcaagtctagctagatgtttaaagtgctttgggtgcttaaaaaatctacatttgggctgggcacagcagctcacgcctgtaatcccaacactctgggaggccaaggcaggaggatcacttaagcccaggagtttgagaccagcctgagccacacagtgagaccttagctctaaaaaaaaaaaaaaaaaaaaaaaaaaaaaaaaaaaaaaaaaaattagcctggtgtgttggtggtgcatgcctgtgtggtcccgactatttgggaagctgaggtgggaggttcacttgagcagggtaggttaaggctgcagtgagccagtgatcgtgacactatgctacagcctgggcaacaaagcaatatcctgtctcaaaaaagaaaaaaaaaattgacatctgggtgtcaccccagcccaattaaactataatctctgggtagggcccaggcattggcattttttaaaaatccccacttgattcaaatgtgaaaccaagactgaaaacccctgggctcctgtcacctccacattttatggggaggaactagaaggaactcaaggatattttgataactgtgctcaaagtcccaccttagtaaagtttcccaatgtagtccagacagttgcatctggatccaagcagaattcactgaattaggtttggacaaaacttgtcccatgcaaaattcatactccagagtgacccatgaatttggataaccaaaaattgtccacattttaaggtcagaaataaggacattttggttgggcacggtggctcacgcctgtaatcccagcactttgggaggctgaagcaggtggaccacctgaggtcaggagttcaagaccagcctggccaacatggtgaaaccccatctctactaacaatacaaaaattaaccaggtgtggtggcaggcacctgtaatctcagctactcgggaggctgaggcaggagaatcgcttgaacccaagaggcggaggttgcagtgagccaagatcgtgccactgcactccagcctgggcgacagagtgacaatctgtctcaaaaataaataaataaataataaataaggacgttttatgaaagggaaaagtttcttctctagtattttttaattaatttctgacctcaaaaatcaaattagttcttatcccaaaacaagataaaatatttcctctacccaaccttgtcccctcaatgatttcctcacctcctgccacccacagcaattatgaagaaagcagaagacttttcacttattttccaaacacccactcctaccaggttgtcagccttcttctttaaaaaggtgctttgcactttagaagaaaaacatttgtgaggggacttttattgaagttaccatggtgaacaccactgactaaagaacagagcagatttcagccccaaagcaccagaacactggcagacacttaaggcttcaattagcgctttaaaaaaagtcatcactattttctcccactttgatttaacctattgtccccaactacagaactcttctaggtttcctacttaatgacagaggaaaagaggactttgacaaattgaaaatctcttgatgttatatgaattatttgctgaattattttgtgtataatataatctatgattaacatgaaaacaaaacacaatatcgtaatccatttttgcaaaccctgagtagtcttttttactaccacttgcaaagggtatgacttaactgctaatgccagtttttaatctcatttttaaagtcttttaatctcagttaaattaagagagatataaaaacatatgcacttttttcctttgctcaactgagattaatacatacctcacacccaaagtgaacctggagggaagcaatgccccaggctggaccctaagttccaacatgatttaggaatcttgtcatgcagggtggtggctcagactcattcttttggcctttgtgccagttacctaactgagcatgatgtttgtgccattattgatatgagggtgttatgggctgaactgtgtccccacaaaactcatgtgtcagagttcgaaaccccagtacttcaaaaagtgactctatttggagacaggacctttaaagaggtaattaaggtgaaatgaggtcacatggatgggctctgattcaatatgactgatgtaagaatttgagaagagattaggacacagataggcatagagagaaaaccacgtgaaggtgaagagagatgacggccatccacaagccaaagagagaagcctccagaagaaactgacctttccaacaccttgatctcatacttctagcctccggaattgtgaaaaaataaatctccattgtttatgccacccagtctgtgttgct

SEQ ID NO: 12318 - DNA, 165502 bp, Homo sapiens
tgagcagagggcaggtgagcattgccgcctgagctccgcctcgtgtcagaacaatggcagcattagattctgataggagctcgaatcctgtcgtgaactgtgcatacaagggatctaggttgcctgctccttatgagaatctaactgatgcctgaggatctgaggtggaacagtttcattctaaaaccatcaccacccatcccgtgttcgtggaaaaattgtcttctaccattggtccctggtgccaaaaaggttggggaccactgctgtggactatctcattaatcattttttttttaggattgattatatgtgggaattatttatttatttatttattttgagatggagtctcgctttgttacttaggctggagtgcgacgggatgatctcagttcactgcaacttccatctcctgggttcaagcgattctcctgcctcagcctcctgagtagctgggattacaggtgtgagccatggtacctggcccattcggcatattttagtacggagatggtggtcaggcacggtggctcacgcctgtaatcccagcactttgggaggccgaggtgggcggatcacctgaggtcagagttcgagaccagcctggccaacatgatgaaatcccatctctactaaaaatacaaaattagccaggtgtggtggcacacgcctgtaatcccagctactcgggaggctgaggcaggagaattgcttgaaccccagaagtggagtttgcagcaagccaagatcatgccactgcactccagcctgggcaacagagtaagactcaagtctcaattaaagaaaaaaaaaaaaagaaaaaagaaaatattagctgtcacttagcaccttcttcctcattgcctttttctacctgtacaaagagtggccattaaccaggtacccattatgaagaacttgaagcatccttcacgcccactcagagatgttaaaagccagcagaagtcctcgtgtctatttctgccttcatttctaacatcctctgggtattttctgtcccagtggtaaactgctctattgtctttcactaatagggacacatacggctttaatgaattaagagttagattcataggatatttaaaaagaaaagcaattcttgattgttccctacaattatagctgtttaatctttactcataacaactttagtgagacagaattcacatgacatacaattcacccattttaagtgtgcagttaggtggttttgaggacatttacagttgtgcaactgtgaccacagtcagttttagaatatttgcatcatcttcaaagaaaccctgtaccctctagctactactttccatcccccatttccctagctcttggcagccacgaatctattttctgtctctatggatttgcctctttcggatttttttgtatgaatggagtcagacaacatgtggccttctctgtttgacttcttttatggagaaggttcatacctgtaatcccagcactttgggaggccaagactggaggatcgcttgagttcaggagtttgagagcatcctgggcaacatagagagaccactatctctacaaaacaaatttaaattagctgggcatggtggtgcatgtctgtggttccagctatactggaggcataattttgttttgtttttgtttgtttgtttgtttttgtttttgtttcgtggggtttttttggttttgttttttgttttttgagatggagttttgctctgtcacccaggctggagtgcaaaggcacgatctcagctcactgcaacgtccgcctcctaggttcaagccattctcctgcctcagcctccgtagcagctgggattacaggcatgcgccaccccgcccagctaatttttgtatttttagtagagacagggtttcaccacgttggccaagctggtctccaactcccgacctcaggtgatccacctgcctcagcctcccaaagcgctgggattaaaggagtgagccactgtggctggccttttatttacatttatttatttatttatttagagacggagtctcactctttcatcaggctggagtgcagtggtgcaatcttggctcactgaaacctccaactctctggttcaagtgactcttctgccttagcttcccaagtagctgggactacaggcactcgccaccatgcccagctaattttttttgtatgtttagtagagatggggtttcaccatgttggccaggatggtctcaatctcctgacctcgtgatccgcccacctcggcctcccgcagtgctgggattacaggcgtgagccactgcggccagcctgtatttacttttgagacaagatattgctctgttgcccaggctggagtgcaggggtacaaacacagatcactgcagtcctgacctcctaggctcaagcgatcctcctgcctcagtctcccgtgtagctgggaccagagacacacaccagcattcctagctaatgttttaaatttttatagagatggagactcgctatgttgcccaggttggtcttgaactcttgggtttaagcaatccttccgtctctacctcccaaagtgctgggattacaggcgtgagccactgcactcagcctcagctattatgaataatgctgctatagacatttgtgtacacgtctttgtgtggacgtatagtatcatttctcttaggtagttacctaggagtggaattgccaggtcatatggcaattcttggtttaatattttgaggaactaccagagtgttttccacagtggctgcactgttttacatccccatcaggaatgcaaaaggataccagtttctctacattttattttttctttgagatggagtctcgctctgtcgcccaggctggagtgcagtgatcttggctcactgcaacctccacctcccaggttcaagtgattctcctgcctcagactcccaagtgtctggaactacatgcgcctgccaccacgcccagctagttgttttttgtatttttagtagagacggggtttctccgtgttggccaggctggtcttgaactcctgacctcaggtgatctgcctatcttggcttcccaaagaactgggattacaagtgtgagccacggtgcccggcccatttctttacattctttgcacttgtaattgtcactctttttggttttagctatcctagtggggataaagtggtatctcactgtggtttgaatttgtatttctctaatgtccaacagccagttaatctttcctttttttctgttttttttttgagacagagtcttgctccatcgcccaggctggagtgcagtggtgtgatctcggctcactgcaagctccgcctcccgggttcatgccattctcctgcctcggcctcccaaatagttgccactacgggtgcccgccaccacgcctggctaatttttttgtattttttagtagagacggagtttcaccgtgttaaccaggatggttttgatctcctgacctcgtgatcagcccatcttggcctcccaaagtgctgggattacagccatgagctggccaccacgcccagccgttgtgtttttttaatcgagacgaggtctcactctgttgcccaagctggagtgcagtggtgtgatcacagctcactgtaacctcctattcctggacccaagtgatcctcctgtctcagcctcccaagtagctggaattacaaccacatgccaccatgcctggatatttaattattattattattttttagagttggggtcttgctatgttgcccaggctgactttaaactcctggcttcaatcgatcctctcactgtggcctcccaaactgctgggattacaggcatgagccactgtgcccagccctagttaacctttgaatgcatattcatgtctgattttggttctgccatagcctggggaggatggcggccaagtgttctttctacctgcagtgtgtgtgtgtgtgtgtgtgtgtgtgtgtgtgtgtgagagagagagagagagagagagagaaatgaaatatagtgtgggactcagggttgagaagcccagggctatggccaaatctaagattaggatgccggccaggcatggtggtttatgcccgtaatcccagcaatttgggaggctgaggcgggtggatcacgaggtcaggagatcaggatcatcctggtcaacatggtgaaatcccgtctctactaaaaatacaaaaattagctgggcgtggtgttggacacttcttgggaggctgaagcaggaaaatcacttgaacccaggaggtggaggttgcagtgagccaagatcacggcactgcacttcagcctgggcaacagaacgagactccacatcaaaacaacaacaacaaaaaccccacaagaatttcatagaaacaatgagtaattttttttagggtaagttatgtcccaaacattacatgggatatacttatcctcaaaaaggtattattgcttatctgaaattcaaattcaactaggcattctgcatttttctttgctaagtctggcaaccctgccagtcactggtgagttgtgtgtccttgagtgatggtctttgcctcttggagcttcagttttctcatctatgggatggggacagaacttgctgggaggcaccaatggcacgcggggttctttgacatctctggatgtggaagctgttgatgtgactgactgggagcctcagactggggttgggtccctgactaggaggggtgggggggctgggactggcatccttgtcctcttgaagctgcctcccagcctgagcttggtccctgcagggttcctgcttggttcagaccccaggcagccagtgttgaggggagggtggagattaatccatagttgtgtactggggctttcctccaacttcctagcaagcaagtgtgtgtgtgtgtgtgtgtgtgtgtgtgtgtgtgtgttttctcgacttagcctaatccatttgctgcatggaatgtgatccaggatcactgctactttttttttcccatttgtttgcttttgctgtgttttgtcgttgttattgttttttctaatttgtgcttcttttgtgggtaattctcagggtggattttttttttttttagaggatttactattcttctttagaacaatctgttttcctcaaagatattggtggaaggtttagtgttttggaacaaaataagcaggggttgtatactgagccttatattctaggtgctgaggactgtggtgtgtgtgttggggaggcggtgtgtgtgtgtgtgtgtgtgtgggtgtgtgggtgtgttggcagagagaagccatctaaagacttcaattttgaaaaacgttaactcaggtgtaagggacacaaggaggagaaacacgcaaataggtgtgccaaggaaaggaaatcagggacggctgcctggaggaggaggcagcatttgaactggatatcttgaagcatgatgggctggatttagaaatagggagctaaggtacaaagcacttcgccagccaaaagatagactagcctagagatgactgttatatgtttgggggaataaacaacagcaagaagaacaacaacaacaaacaacaaaatagctgacattagtgcagcacttactatgtctcaggcactgtttgagtgcttgccctgagttgtttcacttcttcttccatataagccatgttacagaggaggataggagtcttggagttgtgcaagagttgtgggcaggcctgtttagtggtgtgcaggggatgtaggggcagaatcttgagggaagtgcaggatgatggggagccatggtgggcgttggggcctgggagggaccgccttcaggagaatgagaactcagggcatttgggcaatggagatcgggctccctgggaagccctcaccacacccaggtaaaaggtaattaggtcttgattgcaggtcaggagagcagtccgggaaggaaagtcagccagcgaggtgggaggattgacaaaacaaatacatttagctttccttgccccatttctgaccgcgggcacctttatccccgtaaattatctcctgaagatcttctatgttgacgcactggagacagttcccctttctccttctgcacctgccgcgttactcaatcccctgtaatcccattgtcccgactgcatcatttcagaggtggtgattttaaggattttaacagggcttgccaaaagaattattttcttggcgttttgaaagtaattacttaggcatgggtactttacagagaaagctactcatcccggctggctgcagagtttacagggcccgggatgaaaacacagggcccaggtttcctgtccatgaagccggctctgcccctgatccttcygatgcatccaccgtgcgtctgctcacytgtcttgctttctgttcattttctcttgtagtgtgtcccggcatggatatccggaacaacctcactaggttgcatgagctggagaattgctctgycatcgaargacacttgcagatactcttgatgttcaaaacgaggcccgaagatttccgagacctcagtttccccaaactcatcatgatcactgrttacytgcygctcttccgggtctatgggctcgagagcctgaaggacctgttccccaacctcacggtcatccggggatcaysactgttctttaactacgygctggtcatcttcgagatggttcacctcaaggaactcggcctctacaacctgatgaacatcacccggggttctgtccgcatsgagwagaacaatkagctctgttacttggccactatcgactrgtcccgtatcctggattccktggaggataatyacatcgtgttgaacaaagatgacaacgaggagtgtggagacatctgtccgggtaccgcgaagggcaagaccaactgccccgccaccgtcatcaacgggcagtttgtcgaacgatgttggactcatagtcactgccagaaaggtacgccgggsatacagggttctaagcagtgtctcgtgccttgttctakaaagcttaaaatgttttatggcttaaaaatgttaaatggtcattaggtaggggccggggaatagtgggtggtggcattcactagcccagggagtggcagacattttctgtaaagactcagatagtagatacttcagattttgcaggccatatggtctctgatgcaacgactcaattctgccactgtattggacaagcagccacaggcatgcataaatgtatgactgtggctgtgtttcaataaaactttatttacaaaaacaagtcgtgggccggattttgctcgagggcagcagtttgccaccgcctgtgctagtcagtgaatgttcttcttgcttgggagaggaaaaggagtggaaaactrtagattcggtttttttaaaaaaatagtttagttcttatctgattatagaagtgatattgcttatartagacatttggaaaaagacacttgtaaacgaaaaaaaagcaaaacattcatcttattccacaacgcatgtcrccgagagtagtttattgggggttgttccttctagtgatcttcaggaatctgtcgtgtctactgaaggtttccttaaccattcctgttattgggcattaagatgatttccaggccgggcacggtggctcaggcctgtaatcccagcacttggggaggctgaggcgggtggaccacttgaggtcaggagttcgagaccaacctgaccaacacggtgaaaccccatctctactaaaaatacaaaattagccgggcgtggcggtgcacgcctgtagtcccagctacttgggaggctgaggcaggagaatcacttgaacccgggaggcggaggttgcagtgagccgagattgtgccattgcactccaccctgggcaaccagagggaaactccttctcaaaaaaaaaaaaaaaaaaagataatttctagttttcacaaagagagtgatgaacattttagagtcaaagctttatctagcagttgtttctttaggcttgctttccagaagtgcaatttctgggtcagaggctcttggtgcagattgacaaatggtgttccggaaatgttgtgccaacggccactcctcctagctttggaggagagggaacaccttggccagctttgagtgttatttgaaaaatctttcataatttactgcgggagggaggagctgacgtgttgtcattgtttctatttgcatttctttgattgctatcggggttgaaccttttaaaacatgtttatttatcatttgagttttctcttcctgttcatatcctttgcccatttgtcttttagtacctcagtagcttttgcaaaattaatctgtatgtggttttcatcagtgaaggctactaaccctttgccaattgcattttgttgtttttgttgttcagtggtttaaatgctctgggaagtgttttgctggagaagcttaaaatgtttatggagttcagagctggatttcagtgtgccacttctgtactttacacttagaaagtcttcttctacccatgaaaggttttttttctctacattttatattttaattttttttttttttttgagatggagtttcactcttgttgttaagactggagtgcgatggtgcaatctcggctcactgcaacctctgcctcccgggttcaagcggttctcctgccccagcctcccaagtagctgggattacaggcacccaccaccaagcccagctaatttttgtattgttagtagagacgagatttcactacgttgaccaggctggtctcgaactctcaggtgatccacccacctcggcctcccaaagtgttgggattacaggcgtgagccaccgcgcccagcctatattttaattattattatctaaaaaaattcatcctcactacttgagatctgtttgtgtgtgtgactcaacgggcgtttcgtttctctcccaaatagctaactgggggcctcagacagctgttgattatagaaatctacctctttgccattgctttggggtctgtttctggtgtgtccatagatctgcctctccatgccacagagcggtgactgttctgatcatggtagtgactgttctgatcatggtagttttatcatgttttcatgctcaaggaggcaattccacattcacacattacttgtttgttgtttcatggacttcttttcacatttccctgggaagaactagggaacatgcgatggaggtgggaagaagttaagtgggtggcttgagggttgtatcacaaaagatagaagggaggggagaaaggaggatcttcttatctgagcccaacgctctggggaagccacccagagtgagtgagtccttaaatagacctaaatagaatccttggaattgtctgtgaggactcccttggarcccccagcatgagtccttccatgggacatgttggatggttggaaatcgggagtgggatagttgaaaaaggaagatgggttagtgaagggtggtgggagaggggaccgttattattgcactgtggaaaaatcctgagaatattgtaggtcaggggcaaggagaagctaaactatgaccagagaggttacttaacttgcccagagccacacagctaataaaagacagaactggggtttgtgccaaatttatgcaagacatacaccagaataaaagctatgattttttggaggagtgggaaggatgtcctctctgtttagaaacaagtgagctgcttctagctgggacaccaggggaaacagtgaacattcttttattctattactgagttttccaaatgtagtgcttgtttgaaaagctctaggcctacctatcttgagatataatttaagacattcctctatgaatttatttttgtatctgttttagacaaaatatccagaatggtgttatctgcaattgagtctcctgctccctgctgggtgttcagttgttgttgctgttgtttgtttgtttgtttgtttttgagacagagtctcgttctgtcacccaggctggagtacagtggcacaatctcggctcactgcaacctccacctcctaggttcaagcaattttcctgcctcagcctcccaagtagctgggattacaggtgtcaccacatccggctacttttttttttttttttttgagatggagtttcgcttttgttgcccaggctggagtgcaatggcatgatcttggctcaccgcaatttctgcctcctggcttcaagcgattctcctgcctcagcctcccgagtagctaggattacaggcatgcgccaccacacccagctaattttgtatttttagtagagatgggatttctccatgttggccaggctggtctcgaactcccgacctcaggtgatctgcccgccttggcctcccaaagtgctgggattacaggggtgagccaccgtgcctggccaacacctagctaagttttgtgtatgttgtagagacagggtttggccatgttggtcaggctggtctcaaatttctgagctcaagcacctcggcttcccaaagtgctgggattacatgcatcggccactgtgcctggctgtgcctggctgtgcctgatgttttgagtgaattaaaaattgctttgctattaagaaccaggcttttgtgtccaggaggtcgaagctgcactgagccctgttcatgccactgagctccagcctgggtgacaaactgagactctatctcaaaaacaaaagaaaacaaaaacaaaaatgaacacaaaacaaaacaataaaaagaaccgggcttgtttttccagtactgggggttttgttacccggagaaggtgcgactaacacttcccggggtaccgggttcctggcatgtggtatatatctcagccatccattagtagcagtatccccagggggccaaaaaatgattgttttttgaactgttgcccctgtctttgagagcaactcagcttcagctttctttcccctcttcaatttcttgtattgtgataaaatacacatagaataaatttttcatcttaactttttttttttttgagatggagtcttgctctgccacctaggctggggggcagtggtgtgatctcagctcactgcaacctccgcctcctggattcaaatgattctcctgcctcagccttccgagtgactgggacttataggcaccagccaccatgcccggctaagttttgtattttcrggacagagggggctttgccatgttggccaggatggtctcaaacccctggcctcgagcaatacacccacctcagcctcgcaaagtgctgggattacaggtgagtgccaccgcgcctggccccatcttaaccattttaagtccacagttttcagtggcattaagcacgttcacgtggttttgcaaccatcaccaccaccatctcccaaactttctcatcctcccaaactgaaactctgtccccatgaaacactcactccaccatctccctctcccagccccctggcacctaccatcctattttctgtctctatgaatgtgatgactgtagggacctcctgtgagtggaatcagacgggatttatccttttgtgcctggcttatttcactgagcgtgttgtcctcaaggttcatccacgtggtagcctgtgtcggaaattctttcctttttaaggctgaatcatgttccattgtatggagggagcacattttgcctgtgtattcatccatctacgggcacttggtcgctttcacatttctgccattgtgaatcagggccrctgctgttgacgcatctagcttttcaatgcctgcattaaccttgttgctgaggctttaggaaacttatttatttatttattttttgagacggagttttgctctcgtcgcccaggctggattgcaatggtgcgatctcagctcactgcaacctctgcctcccgggttcaagcgattctcctgcctcagcctcccgcgtggctcggattacgggcacctgccaccacgcccagttaatgttttggatttttagtagagatggggtttcaccatgttggccaggctggtcttgaactcctgacctcagataatccactggcctcggcctcccaaagtgctgggattacaggcgtgagctaccgcgcccagccttaggaggcttatttgatgtctgatgggatttttgaatacagaatagattgagccttcagaggatactcccctgtcttaggtgacagaaatgggctggagaaaactatccatcaacccctcttttcccccagagtcttttcagatacttctgtgaacatccgtagttgctatttttgtcttccacacttggcagcttctggaagcatcaggggaatgcatcaacatttaggatgaaggtgctggtttgtcctttggacctagtttaagcaattccgagcaacatccaccccttcttctacctgtcccttaagcactttttacagggagaccaaaaaaaggctttcaatggttaagggggccgggtgtggaggccccacacctgtaatcccagcactttgggaggccgaggtaggtggatcgcttgaggtcaggagttcgagaccagcctggctaacatagcaaaacgctgtctctactaaaaatatgaaaattagccaggcgtggtggtgggcgcctgtaatcccagctacttaggaggctgaggcaggagaatcactcgaacccgagaggcagaggttgcagtgagctgagatcgtgccattgcaccccagcctggccgacagagtgaaactccattttttaaaaaaagaaaaaaaaatggttaggggaattaaaagaaaaacaaaaaaacatggcatgtgctaatgatccatagcctggacaccctctctccattatcctgcaatggatttggggcraagataccaggagaggtccaatgcacgaagccttacatgggaagagtggagacggggtctatgcagttcgtttattgactgcctactaggtgtcatgttctggggcgctcagggcataggaagggagccagcctttgcctcctcagagcggccagtctagtggcaaatgcagatgttcacgatcaaaccaagtacactcagaagagggggagagttagagggagatctacattagttcagccagctggacgcggtggctcatgcttgtaatgccagcactttgggaggccgaggagggcagactgcttgagctcaggagttcgagaccagcctgggcaacatggagaaaccccgtctcgacaaaaaatacaaaaattagccaggcatggtggcaggtgcctgtaaccccagctacttggaaggctgaggtgggaggatcgcatgggccccgggggcggaggtcgcagtgagctgagatcacaccactgcactccagcctgggcgacagagtgagactcggtgagactctgtctttaaaaaaaaaaaaaagaagttctttgaggcaagcagcaccggcttccagtctcgttttaccattgactggtcacaagctggttcaagcctcagtttctccatctgaaaaatgggggtcattatgggacctgcttcttagggtggtggtgtgggggttgaatgagatggtgcagggggaggcacttaacctagcctcaggtgctccgtgagtgtcctggaagcttccagtaagtaagcaccatgggcccaccctatctgggcagactagcttccaggtgaatatctaccagggctcagcctcatttctgactttggttttgaggcaggcagaggaacatgtatcttgcgacctgctgatgagggatgggtgccacacctccagccccagagggaagaccaccctgatttttgggtgccaacagcatgggatgctctggaaattctcagctctgggcattttgaggggaccagaagccacagggcttgcctgaccagctgctttagccaaacccactggcattttctttctgggaggtcaccccrgctgctcactgccggccagaggggtgggtgaggccgggacatgctgggtgccaggggaaaccaacccragatgccacatatggacgtcggcaccaaagcaggagggggaggctgaaagcagcaaatccctcctccctgggtctgagattacagctccgagtcaaagtctctcaaagtgtggtattgtgcctaccacattaaatatcacgtatttaaatgcacgagtttaaatgcatgctcttggagggtttgatttttggcagaatttttagctgcctatggaaactctctgcttctttttcttcttccatttaaaaagtttgccttgatattttatttttttacatttttatttagtttttaatatttttttaaattgagatgggagtcttgctatgtggctcaggtcggtctcaaactcctggactctaaggaatccccccacctcagcctctcaaagtgctgagatttcacatgtgagccaccacgctggacttgacttgattttgttttctttttcttttttttttttttgagacagagtctcgctctgttgtccaggctggagtgcagtggcatgatctgagctcactgcaacctccgcctcctgggttcaagcgattcttctgcctcaacctcctgagtagctgggattacaggcacgtgccaccatgcctggctaatgtttgtatttttagtagagatggggtttcgccatgttgcctaggctggtcttgaactcctgrcctcaagtgatccgcctgccttggcctaccaaagtgctgggattacaggtgtgaaccactactctgggcttgccttggtattttaacaatcggaattgtctttgtggcaaatgctgatttcatgccagccgtggttctgggtgctttgattaggatattgcatcccatcttcccaacaatcttatttattgttgagaccactaaggcttcgagaggttaagcaacttctacttccaacactgccccgcccaccccttccgccgcgcaccccmcacacatgggtagtaagtagtggagatgggatttgaagctggggattctggctcagaatccaagctctttacctttgtgtcttatagatgtcattgcgggaagttggtgaaatgcaggaaactgtaaaaagaaaggaaggaaggagggaaggaaggaaggagggaagaaagaaaagaaaaggaaggaaaaaaggaaggagggaagaaataaaaggaaagaaaggaaggaaagaaggaaggaaggaaggagggaaggcgggaaggaaagaaggagggaaggagaaaggaaggaagaaagaaaggaaggaaggagggaaggaaaggagggaaggagaaatgaaagaaggagtgaaggaaggaaggaggaaagaaaaaaaggaaggagggaaggaaggaaggaagaaggaaaggaaggagggaaggaaggaaggaaagaaggaaaagaaactggagaggaaatctagaatttgcccctgccaacatgtgtgttgcctcttcttatcagccttctcattctgtcttgacttagggcctctcctatcagactaagctctcctgaaggcagggactttgttgtatctcaagcacctgtcatagtacctggctcacagttgacaatgacatccttaacactcatcaatagctagtgtttactgagcacttactatgtgctaagcaatgccttaggggatcccatcacagcctatgagggtttgttatcctcattttacagaagagggaactgaggcatggctaggaattatgagacttgctctaggagacctagctggggaatggtttgacttcagacttgtctgacgtaaggcctttgcccagtgatcagcaaactacgacctgtgggccaaatccagtccgccagctgctatttttgtatgacctatgagctaagaattttttattttatttttatttttagagatggggtctcactstgtcgcctgggctggagtgcagtggggtgatcataggccactgccacctcagtcagcctcctcagtagctggaaccacaggcaggcaccaccacgcccagctaatttctttttatttttttagtagagatggggtcttgctatgttgcccaggctggtctcaaacaattgggttcaagcaatcctcctttcttggcctcccaaagtgctgggactataggcgtgagccactgtgcttgcctggcttaagaatgctttttcacatttttggccgggcatggtggctcatgcctgtaatcccagcaccttgggaggccgaagcgggcagatcactcgaggccaggagttcaagaccaccctggccaacatggagaaaccccatctctactaaaaaatgtacaaacattagctgagcgtggtggcgggcacctgtaatcccagctactcaggaggctgaggcaggagaatcacttgaacctgggaggcggaagttgcaatgagtggagattgcgccactgcactccagcctgggtgacagggtgagactctgtctatatatgagctggacattcagcattcagggatagaggctgtttcagtgggacttgggagcaccacggcctgaggccatacagcccagctgccctttgctggtacttccttccttccttccctctttccttcctttctttccttttctttcttccctccttcctttcttccttccttccttactttttgagactctgtctcaaaaaagaaaaaaagaaaaaaaaatgtggggtagagcactgtactgaaaaaaattccacagtagttgtaattcatttttcactcagatgattagcattttttttttttttttttggagctctctgtttgggtggaggagggcagtatatgtacaaggcaaggcccccactccaccctcctccctcctcccaccccgcctttccccttcgagtgagtcatcgaacccgtgcttctagacgtgtttggagcagagcacctggaaatcatgatgttctctagataacagggaatattgataaattcccttgtggcgatgtcactgtcgtccatacagaagacaggaaagtgtaacgcctgcacacggggatccaacaaaaagaaaaagataaggtgggggaggccgggcacggtggctcaggcctgtaatcccagcactttgggaagccaaggtgggtggatcaactgaggtcaggagttcgagaccaccctgggccaacatagtgaaaccccgtctctactaaaaatacaaaaattagctgggtatggtggtgggcacctgtaatcccagctgcttgggagactgagacaggagaatcgcttgaacccaggaggcggaggttgcagtgagccgagattgtgccactgcactccagcctgggtgtcacagcgagactccatctcaaaaaaagaaaaaaaaaaaaaaaaaaaaaggtagggtagagcatgtaacgtgaatgatggcccacttgaatctctcattcgtctttcttcccttttatgttgtcaaagatctttaaaaaaaaaatctaggagagaaacaaacaaaaaaaactgtactgaaaaaaattccacagtagttgtaattcatttttcactcagatgattggcatttttttttcttgttttttctttttgagacaagggtctcaactctgttgtccaggctggggtgcagtggcgcaatcttggcttacttccgcctcctgagtagctggaattccaggcacgcaccaccatgctggctaatttttgtattttttgtagacatggggtttcaccacgttacccaggctggtcttgaactgctgggcccaagcaatccacctgcttcaacctcccaaactgttgcattatattataggtgtgagccactgtgccagccaggattggaattatttatttatttatttagtgagatggagtcttgctctgttgcccaggctgaagtgcagtggcgcaatctcggctcactgcaaccccygcctcccgggttcaagtgattctcctgcctcagcctcccaagtagctgggactacaggcgcccaccaccacacccggctaattgttgtgttttttttgtatttttagtagagacagggtttcactatgttggccagggtggtctcgaactcctgacctcaggtgatcctcccactttggcctcccaaagcgctgggattacaggcgtgagccgccatgcccagcccttatttattcatttttattttattttaaaataaaataaattttaaaaatttgattgaaattttttaaacaaacttttcactttggagatgattggattttgtagagcaggaaagaacaagtaccctagagagtatgtttctgggctcccggctcctcttccgggggttgaagatgaattgccgttggcctttgtaaaagaggagagattgttccagattggagtggcagagatgtgctttggtttgggtggcaaggatcacaaagaaagargatgaggttgggtgtggtgggtcatacctgtaaacccagcactttgggaggccgaggcaggaggatcacttgaacctagaattcgagctcagcctgggcaacatagcaagaccccatctctacaaaaaattttaaaaaattagccaagcatggtgctgtgtgcctatagtcccagctactcaggagtctgaggtgggaggatcgcttgagcctgggactttgaggctgcaatgagctatgattacaccactgtaccccagcctgggtaacagagtgagaccctgtctcaaaaacaaacaaacaaaaacagaaggaaggaaggaaggaaagaaagaaagaaagaaagagaaaagacaagacaagaaaaaaaaaaaaaaagaaaagacagggtgagagrraagggtattcgggtggatgaaatggcaaagagaaggccaagaggcgttttgtgggcaagagtgaagagggtgcctcatgccgggaagggaggcttggaccagtgcagggtccttatgggctccaatgccgtcatgaaggtcacacaggggctgtgtttaggaggggctgtttccaccaatactgagtggacagccttgctgagccaggctttttgttgcgtccccgaagtccttgctgagtcagggaggaagtcaaagtaactatcaggttagataagctgatgggtgggcagaaagtgttttggtgggttcaaggctgcgctgaaagatggtagaccagttgaccgtgtggtcacttggctgccccagagatgatgctgtctaaatcttgagtggtgaagataacgaatttacaattcccaccattgcctggcttcctggagcgggtgggtgcggggaccggggaggggggccgggggaggctgagggctatcagttgaaactgaccttttggcccaatccttttgggaagaaggcgggtagagttaaaatscatcgtaatggaaaggcggctttccctttggctgtctgctaacttggtgactggcctgacaagtttttcttttccttcctcctacctgatactcactgaccggttacttcccatgtcacccgaccctttgtcagaattaaaatctgttctttgtgactgaacacctgaaatgccccggggaggacccaaggaagtcagcgagygcctgtgcgtcaggctggcagcccaggtccttcwgtgatctgtttctctcaatgcgcctgtgtcagatagaaccgtgcatttcccagtaaaaggaggtgatgtgtgtgctggagtttcaagattgtaccccttatcctatctcccctttcctctgtcttccctctctacttttttattttgttgtttgtttgtttgtttttgagatggggtcttgctctgtcacccaggctgcagtgcagtggtgcgatcatagctcactgcagcctcagccttttgggctcaagcaatcctccagcctcagcctggccagtagctggaactatgggtgcatgccaccacgcccagctaattttatttayttatttacttatttattaaagagatggagtcttgctatgtttcccaggcagctcacaaattcctgtcctcaagtgaccctctcgcttcagcctcccccattagctaagactacaggtgcgcaccaccatccctggctaatttattttttaaatttttctttttgtagagatggggattttgctatgttgcccaggctggtcttgaactcttagactcaagcaatcctcccactttgggaagcccaaagtgttaggattacaggtgtcagccaccaggccgacctgtttgctcatttttccttttccttttttcttttcttttcttttttctttttttttttgagatggagtttcgctctgtcacccaggctggagcacagtgacacaatctcggctcactgcaacctctgcctcccaggttcaagcgattctcctacctcagcctcctgagtgctgggattacaggggcatgccaccacgcccggctgatttttgtattttttagtgaagacggggtttcaccaggttggccaggctagtctcaaactcctggcctcaaatgatccaccagcctcagcctcccaaagtgttgggatgacaggcgtgagccaccacactcggcccgtttgctcatttttaaacataaatgatgtcaagagtgggaagcaaacaagaaagtgttgaaagcattgctctcctctgctccctggttacctatcatcctggggcccgaggagtggctgcagattgggccaccttcctccaatcacaggtttgggaagtggaccaaagtctttcaacacactggacttagcatgatcatcaaatttgcactggaggggccaggcacacgcctgtaatcccagcactcggggaggctgaggcgggcagatcacttgaggtcaggagttcgagaccagcctggccaacgtggtgaaaccccgtctctactaaaaatacaaaaataagccgggctggtggttggaacctgtaatcccagctactcggggggctgaggcaggaggattgcttgaacccgggaggtggaggttgcagtgagtcgagatcacgtcactgcactccagcctgggtgacaaaagcaaaacctcgtatcaaataattaaataaataaataaacaaataaataaataaaaaattacactgtagggcatgtggtaggtgaagcccaccattgtyaagtacctacctagagggtttggggtagagggtcctgtggcttcttctattttttttttttggcggagtctcactctgtcaccaggctggagtgctgtggcacgatcttggctcgctgcaacctccgcctcccgggttcaagggattcccccgcctcagcctcctgagtagctgggactacaggcgcccgccaccacgcccggctaatttttttgtattttagtagagacagggtttcaccatgttggccaggatggtctcaatctcttgaccttgtgatctgcccgccttggcctcccagggtgctgggattacaggcgtgagccaccgcgcctggctgtggcttctttatcctagaagtttctttgcctctcgttttgtcccaggcgaggagggtcttggatctttaatgactccatggcttattragtgtagcccagaaagaatggttgtttaataggctttattaccgagtgtttccaagggcttacctggggaaggaaaacatttttactcggaggtctgataaggatgggctttaaagcgctggcagctagtcatgtccacacgcggtgtgcgaagcacggcgttgtttactgaccacctgcaaagcccgtcggctggtgaacaaggctcttgtcccaggctgcctcattggtggtgatgatgttaagagtttcctcatttgcaaataaattgactaacctagcagacgggtttgatccaaagtggtcaagattccttttctttaaatttgttttttttttgagatggagtcttgctctgtcacccaggctggagtgcagtggcgtgatctcagctcactgcaacctcctggattcaagcgattctcctgcctcagcctcctgagtaactgggattataggtgaacaccaccacgcctggctactttttttgtatttttagtagagatggggtttcgtcatgttggccagaatggtcttgaactcctgacctcaagtgatccacccacctcgacctcccaaagtgctgggattacaggcgtgcgccactacgcactggcaaatttttgtattttcagtagagacagggtttcgccatgttggccaggctggtcttgaactccggacctcaggtgatccacccacctcagccacccaaagtgctacaattacaggcgtgagccaycgcacctgggctattttcacttctttcgaagttatacctaggagtggaatcgctgggtcagttggtaattctatatttaattaatggaatcaagatttctttttcttttctttttttggttttactttaaaaaattctatcttattacataaaaaaaccacaggttcagaamagccacaccaaacaaatgaatagcctaatggttcactctaacgtcaacactcatataatccctaactctggttgagaaatagtactttgccagaacaccccctccaaaagccatgccacggaccacatcctagtcacaggcctcttcccccagagtagtcactgtcctgtcttttgtagacatcacttccttctttctgtatagttttatcacccaagtgtgaatctgtagacaaatatttagctttgcccatwaaaaaaaaaaattgatggccgggcatggtggctcatgcctgtaatctcagcactttgggaggctgaggcgggaggatcacttgaagccaagagttggagaccagcctggacaacatagtgagaccccatctctactaaaaataaaataaaaaattagccgagcatggtggtgcatgcctgtagtcccagctactcgggaggctgaggtgggaggatcgcttgagcacagaaggttgaggctgtaatgagccgagattgcatattgcactccagcctgcgtgacagagcaagaccctggctcaaaaattaacacaataaaataaattgatgtgtttgtttgggtctctagcagtggttttgaactgagggtgattttttttgtctcccaggggacatttggcaatgtctggagatattttttggttgtcayaactccagggaatgtgtgtgtactgctttcattgagcagatggaggccagggatgcygttcaacrtcctgcaatgcagagacagcccagccacaaagaatgatccagccccaaatgtcaatagtgctgaggggcagaaagcctggtccacaggttctccctccatccctttccttttaccttctctctgttgaagagctgggctttctggcttggggtgcagtccccagtctgagtgttgctgatcgtacgttcctgggacagttctgcttgcccctctgagctccagactcagagctagggtcacactcaggttctacctcttggactgactttatttaacaagtaccatttcagcactctctgcagtcagctgttttcaaaggcgaccatgcttgatgctgttcgtttgcacatggctctgagtggtggtgtgttctttgattttttttctttttcttttgttttaaagaaaaacacaccgttttttaaacacggttgcccgaactctcatcttcttcctccctgccctccctccctccctcctytccttccttccttccctccctccttccttcctttttctttatttcctcccttccttccttctctccctccctctcccttcctccctttatccttctctctttccttccttccttctctttctyttcttttcttctttcttccttgctttctttttatttcttacctcccttcctctctcccttcctctctccctcctccttcctctttccctttctccctcctctttctttttctctctcttcctttcatttttctcccctcccctccccttcttctcctcccctccttcccctctcctccttcccatcccctctcttcccttttcttcctttccttcttttccctccctctctctttcttttctcctttcctttcctttccctctcttttctttctttcttttctttcgacagggtcttgctctgtcacccaggctggagtgcagtagcatgatcatagctaacagcagtctggaactcctggtctcaagccatcctcccacctcagcctccagagtagttgggactacaggcccctgtcaccatgcccagttattttattttatttttttttgagacagagtctggctctgttgcccaggttggagtgcagtggtgcgatctcagctgtctgtaacctccacctcttgggctcaagtgattctcctgcctcagcctcctgagtagctgggactacaggcacctgccaccacgcccgactaattttttgtatttttagtagagacggggtttcaccctgttagccaggatggtctcgatctcctgacctcgtgatccgccctccttggcctcccaaagtgctgggattacaggcgtgagccaccgcgcccagccgctaatttttttttaatttattttttrtacagatggagtctcactatattgcccaggctggtcttgaactccagggctcaagcagttcyggcacactagcctcccccaattcaatgggattacargtgtacccattttttaaaaatgggccagactaaatatttgtctagagatccatacttgagtgataaagctatatggggttccatctgggaattcggttctgcggtaaaacggtgccgacgggcctccctttttttagtgtctgacaaacagggcacagaccgaacttcataacaaaactttgtgttcttgacgaaggcaagttttgctaagaaaattatttttataagcgagaaaggtatgaaggttatttgcaaaggaattttactggggtgagaaaaaaagcaagaggtttaccttaggattcctggtggtaaagaagatggaatgggcagaagatgtcatcacagatgtcacggggagagcgatagctgaacctctgaaaggaaagaggttcccagggaaggatgaatttgatgcaggaaaaaagttagaggatggtcttaaatttgtcaatgtagttcagaggaaagtgtaattcttcacagacttttagttttgaaaggatggcttcaaaagatactgggggacatgggcgcagtaactcacgcctgtaatcccagcattttgggaggccgaggtgggyggatcatctgaggtggggagttcgagaccagcctgatcaacatggagaaaccctgtctctactaaaartacttaattagctgggcgtggtggcgcatgcctgtagtcccagctacgtgggaggctgaggcaggagaccatcgcttgaacctgggaggcagagtttgcagtgagccaagatcacgccactgcactccagcctgggcaacagagtgagactccgtctcaaaaaaaaaaaaaaaaaaaaaaaaaattctggccaaccgggaatagtccaggataatccattcttcagaacttgttcttgctaactcagttaagtgtcgaatggcgtgggttgtctactgtattttagaggacattagaatatttatgaagggctttcccaggtttactcataacttcattttcctcatgctatttgtcccttaaagtctttctgaaatctttcagttgccacttcttctgggtgggtgggtatgtatgttgagggtcatgcttttttttttttttttttttttttgagatggggtctccctctgtcgcccaggctggagtgcagtgatgtaatcacacctcactgaagcctcaacctctcaggcttaagtgatcctcccacctcagcctcccaagtagctggcactacaggcatgaaccaccgtgcgactaatttttaaaaaatatttttgcaaaattagccaggtgcggtggtgcacgcctgtagtcccagctacctgggggactgaggtgggaggattgcttgagcctgggaggttgaggctgcagtgagccaagatcatgccactgcactctagcctgggtgacagagcgagaccctgtctccaaaaataaaaaaataaaaaataaaaaataaaagatggagtcttgctgtgttgcccaggttggtcttgaactcctgggctcaagtgatcctcctgccttggcttcccaaagttctggaattataggcatgagccactgcacctgtctgggtcctgcttttggtagtgatatagaaccaacttagtgaaattctagaatgacgctgtccactaaggtagctctgccagccacagccacatgtggcaatttaagtagaaattcattaaaattagatatttgtccctcagttgtactcaccatatttagacaatgcagacagacaatgttgctatcactgcaaaaacttgtattgggtacctctgccttagaacttttcattccatgatgaaagattgttctggagtcagacaggcctgcatttgaagcctatatctgttttgtgaccttgggcaaattgtctagcttttctgaatgtctgttttttcttctatcatgaggacatgataagggaaccagtctccaaggttttcctcagctttgaactggtatatcccctctttcgataaaaataaaaatccagttcctcttccctacttggagtttgttcttttttcctctaaatataaaatataccgttgaatgttttttcaacctctccaccccttgagagtccctggaatagagaggaaggagtggcttgggaaagttgatcacaacaaagaggctattataggtacatctaatcgagaagaggaacaaggaaggagtaggtgtgttgaccggggctcagagtgtcttgtctgtgggtcaccaagaatgaggaatgtgtcagctccttcctggcttctcctctctgggaacagagaacagtgcattgcagcttaagtggagtaaaatgggtgtgggtttggaggaagtggattaaggatggggaaggggccgtgggagagaaccccagcctgagtttgtcttcctggctcagcactgagtgtctcagtcaacacatgaatgccagtaatgggaatctatttggattcacttaagccatgaggtgggggcagtgtgttaactggggcaacacagggctctcagcttgaatcagctagcttttgctgtgtagcaaaccactctgaaacacagaccttggaatttatattcaagtttaatcatggagcttgtatcagctagcttttcctgtgtagcaaaccactctgaaacatagaactaggaacttgtatccaagttcattcatggagcttgtatcagctagcttttgctgtgtaacaaaccaccctgaaacatacaacttggaacttgttgtatccaagttcagtcatggagtttgtatcagctaatttttgctgtgtaacaaaccaccctgaaacatagaacttagaacttgttgtatccaagttcaatcatggagcttgtatcagctagttttgctgtgtaacaaaccaccctgaaacataaaactgggaacttgttgtatccacgttcaatcatggaacttttatcagctaacttttgctgtgtaacaaactactctgaaacgtaatggcttaatcaacaatcatgtacttagctcatgattctttgggtcgctgggcaagttttcttgtttagacccaccagctgaccacaaacacaggctcttttctctctcatgtctgggatcaaccagtgggttgtctggtagctggatggtctagcatggcctcactcacatgtctggtggttggtgctggctgtcagctgggaggccttggttttcttccctgtagctgctcatcctccagttggctagtttgggcttagattacatgatagtctcagcgttccgagagtggcaagagatcaatttccagtacacaagtgccttttgagtttctgtttgcatcttgtgtgctaacatcccattggctaaggtgagctgggagggaaagggagaatatagtctttacctgttgatggaagaggaagaatttgtggccctgtttgccatctgccaaagaaccctggagtgggaaacagtggggctcataaaacatttttttaaaaacctcttattttaggttcatgagtacaataacattttaatcagaatttggagctcaattggacatcaggactgtgtatggtgtgactgaggacattaaatgatttttttttgagtaggaatttaactttatgaattccacttgttgaataaccaattccttccccagtaattcttgatgttttcttcatcaggtattaaattcaaccaaaaccatgaatttgcttttgggatatcaattctatttcaagtcctctgtgtcttaatcttatcccagtaccatactgtttatagatttagaatatgtgtttttttagttttgtttttgttgtcgttttgtttttaaagaagtggggctcggctgggcgtggtggctcatgcctgcaatcccagcattttgggaggccgaggtggctggatcacttgaagtcaggagttcgagaccagcctggccaacacagtgaaaccccgctactataaatacaaaaattagccgggcatggtggcacatgcctgtagtcccagctacttgggaacctgagacaggagagttgcttgaacttgggaggtggaggttcaatgagccgagattgtgccactgcacttgagtctgggtgacagagcgagattctgtcttcaaaaaaagaatgggggctcactgtgttgcctaggctggactcaaactcctgggtgcaagtgatcctccttagcctccaagttgctgggactacaagctcatgcctggtaagaacatgctttataaagtggcaaatctagttttttccctattacaccttttagaagagtgtttccttttctggttgaactaaatatttccctcctctcactctcatataaaacccattgagggctgggcgcggtggctcacgcctgtaatcccagcacttggggaggccgaggcaggtggatcacgaggtcaggagatcgagaccatcctggctaacacggtaaaaccctgtctctactaaaaatacaaaaaaattagccgggcatggtggtgggcacctgtagtcccagctactcgggaggctgaggcaggagaatggcgtgaacttgggaggcggagcttgcagtgagccgagatcatgccactgcactccagcctgggcgacagagcgagactccatcttgaaaaaaaaaaaaaaaaaaaaagcaaaaacaaaaacaaaaaaacccattgagatattgatttaaaaatttaattaaaaacataacccatttcccagaggaaaaaaagtgcagctcgctgccagcactcctttaattttacataaacatgttctttgaggctgaagcaaatctgactgattttcaatatgagaaaatataaaacggttcttggagttatttctaaacagaacttgtctctaatcttaatgtaacagaaatgtctataatgttacattaggattagagaatagattattcttgggacaaatggaaaaatgggttaaaatccataaattaagaaatcaatactttcgtatttttcctttccgggcaggtatgggatctccttttccatttgctcaaatctttttttttctttttgagacagagtctcgccctgtcacccaggctggagagtagtggcacgatctcggctcactgcaacctctgcctcccaagttcaaacaattcttgtgcctcagcctcctgagtagctgggattataggcacacaccaccatgcccggctaatttttgtatttttagtagagacggggtttcaccatgttggccaggctggtctcgaattcctggcctcaagtcatstgcccacttcggcctcccaaagtgctgggatgacaggcatgagccacygcgcccagccaatttgttcaaatcttttatattgtcctktcttcatctttatcctgtattatttttgtgacgatggttcctgatttctgtatcacagagttttgttgtgttagttatggctactatgaatagcatatttaccctgaatccagatactttagtgaaattgattggtaggtttttaaattgttttattcattgtgtgcaatttcgtcctctacaaattatggtcatttaaaaaaattatgtctgctcagttctggaagcatgaaaaaaattatgtctaaaatcatacctcttgtttcggttttaaatcttattctattgaccagggcttctagactaacattaaatatttaacaatggtattatccgacatctatgtttaatagatttcctaatataaaatcatccttgctttcctgtggtaaaacctacttggttgtgatgaattattctttcagcataacgttgaattcgatttgctaggtttgctttgtttcgttttctgaattcttgccatctgtgttcatgagtgaaattgggctatgtttttggttggttttattttgcaatgtcttcatcagtttggattatttattgtgttctagccacataaaatgaaatagcaggtaactgagtattcattgacaaattttatggtgccataacttttggggggaagcaattctttgataacttaagaaaaaatttaggccaggtgcggtggctcatgcctgtaatcccagcactttgggaggctgaggcaggtagatcactggaggtcaggggttcgagaccagcctggccaacatggtgaaaccccgtctctactaaaaatacaaaaattagccaggtgtggtggcgcacgcctgtaatcccagctactcgggaagctgaggcaggagaatcacttgaacccaggaagcggaggttgcagtgagccgagatcgcaccactgcactccagcctgggcagtagagctagattgcatctcaaaaaaaaaaaaaaaaaaaaaaccaaaacagtgtgtgactggctgtgacgtaaggcagtcagacctctccttcgaaatgggccgtgattcatctttatttttgtagggctgtgtcacgttagaaccactacagcaaaagttttcattggaaatctaataatgtttttttagtctgccatctggagtctgtgctccttgtatgtctttattgttcaagactaagagtggtgtgtgtgtctgtgttggggggatggggtttggtaattttgctaacatggctctaagaatctgtcccgcttcccaaaacctcatttttctctgctttagcagtagcccaacactgaaaacagggtactgcttttttagaggagttctgatttggattccttttctttctttttttttaggccaaaattttcatttataaatagcttctgtggtacacaacatgcaaatatttttggtttcatgatattacaccagagttgcagagttgtagctgtttttttttttttttttttgaggcagtctcgctgtgtcacccaggctggagagcagtggtgcgatcttggctcactgtaacctccacctcccgggttcaagcaattctcttgtctcagcctcctgagtagctgggattacaggygcccacaccacacctggctaatttttgtgtttttagtagagacggggtttcaccatgttggccaggctggtctcgaactcctgacctcaagtgatctgccctcctcctcagcctttcaaatgctgggaatacaggcatgagccaccacacccggctgaacttttattattttaaaaacatttttatttatagtaaaagtcacacataaaatgaaatttgctgtttttagaaagaatgtttaaaaagatgtgtaccatgttgcccagtacagtggctattcagaaacagccatagtacaccacagcctcaaactcctgggctaaagggatcctcaagcttcagcctcccaagtagctggggctacaggaacacaccaccacatctggcttgcctccttctccttctctttctccttttccttctccttctcctcctccttcttctttttttttttttgagacaagagtctcactctgtcacccaggctagagtgcagtggcatgatcttggctcactgcaatttctgcctcctgagttcaaagcaattctcctgcctaagcctcctaagcagctgggattacaggtgcataccaccatacctggctaatttttgtacttttagtagagacggggtttcaccatgttggccagtcccgaactcctgacgtccagtgatcctcctactgcggccttccagagtgcacaggcatgagccactgtgcctggcttgttttcttcttttttaaatttaatgagtttaggcagggtttctcagcctcaacagtgttagcattctgggctgaacccctctccgtggtggggactgccctgtacattacaggaagcttagtagcatccctggcctccactcaataccagtagcaaccccaagtcatgacaaccaaaaatgtctccggatactgccaagtgctgggatcacaggcatgtgccaccatgcccagctgatttatttttattttattatttttgagacagtctcgctctgtcgcccaggctggagtgcactggcacgatctcagctcactgcaacctctgcctcccgggttcaagtgattctcctgcctcagcctcccaagtagctgggattataggtgcacgccactatgcctggcaaagttttgtatttttgtagagacggggtttcaccatgttggcaggctggtctcgaactcctgacctccagtgatccacccgcctgggcaatatagcaagaccccatctctaccaaaaatttaaaaaaatttagccgggggtggcggcatgttcttgtagttctggctactcacgaggctaaagtgggaggatcatttgagcccaggagttggaggctgcagtgagctacgatcacaccactgcactccagcctggacaacagggcaaggcctcatctcttaaaaaaaaaaaaacaaaataaaataaaaagtgaataagtgaaagtaataaaatgtaagatacagttggagttctctttgtcatcttcccttgctatattctcctcccttcttcccagaggtaacaactctcttaggtttggtacataaacttccagccctgcatgtattttgacacataaccttgtacacacgtcaatgccagatacaggttcagtatcccttattcaaaatgcttgggaccagaagtgtttcccacttgggattttagaatatgtgcgtatatgtaatgagatactgtggggctgagaacgaggtctaaacgttaaattcatttatgtttcatgtacatcttatacacatagcctggaggtaattctatacaatattttcagtaatattgtgcgggaaacaaggttttcaccgcmctgactgtgacctgtcacaagaggtcaggaatggaattttcttccactgctatcatgtcggcgctcaaaaagttgaattttggagcatttaggattttggattttcgggccaggaaattttggagcatttaagattttggattttgggttatcttcagttgttctttaaatctatttatttatttatttgtatttgacaacgagtttcactcttgtcaccctggctggagtgcaatggcgcaatcttggcttactgcaacctccgccttgcctcaagcgattctgctctctagtggctcagattacaggtgygcaccaccacgcctggctaatttatgtatttttgtagagatggggtttcaccatgttggccaggctggtctcaaactcccgacttcaggtaatccacctgcctcagcctcccaaagtgctgggattacaggcatgagccaccacgcctggcataaatctttctttaaatctttcgctgctgtaataaaatatacatcataaaatttgccatcttatttatttttcagtatacagttcactggtgttaaacactgccatttatattgtaatacacttttgagtattctaaatatctgcatatattgggaagctaagtagtactatcccttaggaagccattgtgtattttgcacgtaaagcacatttcagttctgactggccacacgtggctggtcctgctgtaatggatctagtctttaaaaatactccgcgagagcttgcagygagctgagatggcgccactgcactccagcctgggcgacagagtgagactccgtctcaaaaaaaaccaaaaaacaaaaaactctgcgatcttcctcaccatgcacacatatgatatttttgtgattgtgattccaattgctacacctgctgcatgagttcttaagccaaatgcttttttttttctctcagccactatgttctttaagtttatgcctcttgattcagtattgctagttcattcttttaagtgctacatagtatcttgtatgaataagccacatgctactcaccagctcccctagtgggaggcattgagattgtttccggtttgtttcttttataaacaatgctgcaatgaacatcttggtgtccatctcctcctacccatttgtgaatggttttctaggattgatgttcagaattgaagtcacagggaatggagtatgtgcatttttagatctagyatatactccccgaatggtctccaaggtggctgtgacagtttcaccagtgatgcattaaggtatatgtcaaatgtgggcaaggctgcaggaaaattatgttaattccagtgcatggaaattggtatcctatggtattcttttgcatctccctgattcctggtaagactgggaatctctctgtatgcttcttagccatgtcttcctacctcttcctcctctttccctgggagctgttttggggtggggggggctgggcctttttcttcagggactctgcattggcaacgtcacaaagaggtgcacaagggattgaagtgtcggaaatgctttgctgctgtcattgcatttctttacccagcatttcaattgtgctttgctttgcttttctcacttgaaattgtggccagatagaaacccagttagactaataagcatccatctttttaaatctctttgagatgctgatgtttggatatcttcagttgctcttctttaaatctgtaattttttttttgtagtaataataggacatgcatcataaaattgaccatcttaacctttttttttttttttttttttttttttgagaattcatctgttgatggacatttgggttgtttccgccttctggccattgtaactaacgctgggaaaaacacgggtctacaaatatctgtttgtggctgcccaagttttggggacacatagtggaagcccaccccttcctgattgaagcatggggcccattgagagacttagcccataggagcctctttccagtgaggaatatggagggaatggagggcagtacaaaagttctccggcctggacccttgtgattctttgaaggctgagacgagagatgagactcatggctgggttcactttttggttcactttccctttcctttttttttttttttttttttttgagatggagcactctgttgcccaggctggagtgcaatggcgtgatctcagctcattgcaacctctacctcctgggttcaagtgattctcctgcctcagcctctcgggtagctggaattacaggtgcatgccaccacgcccggctaatttttgtattttttagtagagatggggtttcaccatgttggccaggctggtcttgaactcatgacctcaagtgatctacgcacctcagcctctcaaagtactgggattacaggcgtragccactgagcctggcctctttttccattttctgttgcatcaatggaaagtccatctcctgcccgtggacgttttctatgttgatgtggaatgtggcatttgtccaggaacttggtgctttttttttccctctattatttcatttgcttttggattttgagagatggagaacttccttagtgtgggagggaaacagttatggatttactttatgattctacattcaatcctggtctcttcaaatgatttcagggcttgtttggccaggtcaagtctgttctaggaggattttctttccatccttcctctgggaaatgaatgagtataaaaacatgcccaagatggagggaaacctccccttcccttttttgcctttttcttcctggttttgtacataactgaacattttgattttgggatgagaggatattagttcattctcacattgctataaagaactatctgagactgggtattttttaaatttttaaaaatttaatttaatttaatttaattttattttatttatttatttttttgagatggagtctcgctctgtcacccaggctggagtccagtggcgccatcttcgctcactgtaagctccacctcccaggtttacgccattctcctgcctcagcctcccgagttgctgggactacaggcacccgccaccatgcctggctaattttttgtatttttaaatagagacgggatttcaccatgctagccaggatggtctcgatctcctgacctcatgatccacccgcctcggccttccaaagtgctgggattacaggcgtgagccaccacgcccagcctatttatttatttttttgagacagagtctccctgtgttgcccaggttggagtgcagtggcatggtctctgctcactgcaacctccacctccccggttcaagcgattcttctgcctcagcctcctgagtagctgggattacaggtgcctgccaccacgcccggctaatttttatagttttagtagagacggggtttcaccatattggccaggctggtctggaactcctgacctcatgatccacctgccttggcctcctaatgtgctgggattacaggygtgagccaccgcgtctggcctgtttttttgtttatttccataggttttgggggaacaggtggtatttggttatatgagtaaattatttcgtggtgatttgtaagttttggtggatccatcacccgagcagtatacactgaacccaatttgtagtcttttatccctcactcacttcctatcctttccccctgagtccccaaagtctattgtatctttttttttttttttttgagacagagtctcacgctgtcacccaggctggagtgcagtggcgcgatctcggctcactgcaagctctgtctcctgggttcatgccattctccttcctcagcctcccgagtagctgggactacaggcgcctgccaccatgcctggctaatttttttgtatttttagtagagacagggtttcaccgtgttagccaggatggtctcgatctcctgacctcatgatccgccygcctcggcctcccaaagtgttgagattacaggcatgagccaccgtgccgggccttgtatcattcttaagactttgcatcctcataggttagctcccacttatgagtgaaaacatagatgtttggttttccattcctgatttacttcacttaggataagagtgagactaagtaatttataaagygctgggattagaggcgtgagccatggtgcctggccaatgtctggcatcttttctttggtgtaatgttttgagattcatccatggttttgcatttatcaatagcgtatttcttttgtgttgttcagtagcattccattgtgtggagagacaacatttagtttcaccattttagctgttgagagacatttgggttgttttcaacttttggctattattcataaacctgcatgaacctgttatacacaattgtgtaggagtcttttatgtggaccaatgccttcatatctcttgaggttatatcctggagcagaatggatgagttgtgtagtagaagtgtgtataaggagtgggcaggccaggtgcggtggctcatgcttgtaatcctagcactttgggaggctgaggcgggtggatcacttgaggtcagcagttcaagaccagcctggccaacgtggtgaaaccccgtctctactcaaaatacaaaaattagccgggtgtggtggtgggcacctataatccaagctatggtgggagaattgcttgaatccagcaggtggaggttgcagtgagctgagatcgcaccactgcactccagcctgggtaacaaagcaagactctgtctttaaaaaaaaaaaaaaaaaaaaggaaaggccagattgttttcctaagtggttggagtctgttatatttccaccagcaatgtatgagagttctaattgctccacatccttagcagcacttaatatttattgtcaatctttattattattattgttattattatttttagagataggatcttactctgttgcccaggctggagttcactgcagccctgaactcctgggctcaagtaatcctcccacctcggcctcctgagtagcttggattacaagcacacatcactacacccagctaattttatttttgtaaagatgaggtctcactaccttgcccaggctggtcttgaacccctgggatctcaagcaatctccctcctcatccttccaaagtgttgggattacaggcgagagctgcagcgcctggcccctttcactttcttaacagtatctttgaaaagcagctgatttttcacagggtgttgtaattaatttaattagctccacactgtggctttgaaaatcttccgtaagctctagcgccagacacatggatakttgcagaatcttattttctagagtcctggaaattttctttcctgtgagagagttgagagcrataattttagggtggttattcatcttcagacacaaggagtaagaatgtagggagttcgtgactgtgtttggagaggggagagcatagcagtggtctaatgatcttctcagggttctcaaagggtggacgagctgcaggttgaaacttgccttgcttttagactgttgactgagtttgtagttaagcagataagtgccaaaggagaagtcagggctgactgattgcaagtgatgattgaatactggccctcacaaccatctgtgaaaagtctatttccagaaattttttttattttgttattattattattattattttttgagacggagtctttctctgtcgcccagtctggagtgcagtgatgcaatttcagctcactgcaagctccgcctcccgggttcacgccattctcctgcctcagcctcccaagtagctgggactacaggtgccctccaccacacctggctaattttttgtatttttcgtagagatggggtttcatcatgttagtcaggatggtgtcgatctcctgacctcgtgtccacccgcctcggcctcccaaagtgttgggattacaggcatgagccactgcgccgggcccagaaatatttttaagaagagatttttgaaaaacccttgttttcatgatgggaggatatgaaaagcagtgttttgaaatctcctccttagatcctgatactcggaactgtcgattctcccattttcattttctcctggatagattgtacacttgtgccttggtatcctcaatgattccaaaacccccctggggatccagtccctgacataaaayggcgtagtgtttgtacataacctacatacatcctcctgtatactttaaatcatcttggtctggcagtgtggctcacacttgtaatcccagcacgttgggaagcagaggtgggaggattacttgagcccaggasttcaagaccagcctgggcaacatggcgagacccccatctctacaaaaaatttaaaaattaattgggtgtagtggcatgtgcctgtagtcccagctactcaggaggctgagacgggaagattgcttgagccagggagttccaggctgcagtgagttatgatcgcaccactacactccagcctgggcaacaaagaaagaccccatttccatttaaaataataggggccagatgcagtgactcatgcctgtaatcccagccctttgggagcctgaggtgggcggatcatcacttgaggtcaggagtttgagaccagcctgcccaacatagtgaaaccccatctctactaaaaataaaaaaaattagctggacaccatagcgcgcctgtggtcccagctactagggaggctgaggcaggagaatcrcttgaacctgggaggtggaggttgcagtgagccgagattgcgccactgcaccactccagcctgtgtgacagaatgtgacagaatgcgggcacatcacgagatcaggagatcgagaccatcctggcgaacatggtgaaaccctgtctctactaaaaatacaaaaaaattagccgggtgtggtggcgggcgcctgtagtcccagctgctcaggaggctgaggcaggagaatggcgtgaacccagggggcggagcttgcagtgagcggagatcgtgccactgcactccagcctgggcaacacagcgagactgcgtctcaaaaaaaaaaaaaaaaaaaaaaaagacagaaaaagaaaaaacaaaagacgtttagctttcctgggtgacccagtgttgcagggattggccatccttggtrtaaggcataggatgtgcagggtagcaggacagcagagtgggcagtgtgtggggtttctttcattgatagggtggttcccagcactcggggtcagggcttgcttgtagaagtttctgaaaagttgcagtcatgtttcatttctttctccccctacctagcacatgccaggccacacagcatagtacgatggtttggaaccaggcttaacctgttagtagccgtggggctctgggcaagtccactggagttctccgggatctgtttcctcttttgtaaaatgggaaccaaaaggtatcacaggcygggcatggtggctcacgcctgtaatcccagcactttgggaggcygaggtgggtggatcacctgaggtcaggagtccaagaccagcctggccaacatggtgaaaccccrtctctattaaaaatacaaaaattagccaggtgtggtggctggtgcctgtaatcccagctactcaggaggctgaggcaggagaatcacttgaacccaggaagcggaggttgcagtgagccgagatggcgaggtggcgccactgcactttagcctgggtgacagagggagactgtctcaaaaaatcaacaccaaaaccaaacccaacatgtatcacaagctcgttgtgaggatcagagaagaggatacgggaatgataaacatggtagttacattgttgctagcattgtagttatattgcagctgtacattgtgacctattgtagctactgttatttctttgattaagtttagcaactgaaattttttttttttgagacggagtcttgcactgttgcccaggctggagtgcagtggcgggatctcggctcactgcaagctccgcctcccgggttcacgccattctcctgcctcagcctcccaagtagctgggactacaggtgcctgccaccacgcctggctgattttttgtagtttaagtagagacagggtttcatcttgttagccaggatggtctcgatctcctgacctcgtgatccaccctcagcctcccaaagtgctgagattacaggtgcgagccactgggcccggccaacaactgaaatatttaacatacaataaaatgcacatggccggggtgcagtggctcacgcctgtcatcccaacactttgacaggctgaggcaggcagatcacttgaggtcgggaatttgaaaccagcctggccaactactaaaaatacaaaaattagccagacgtgatggtgcgttcctgtaatcccagctactcaggaggctgaggcaggagaatcgcttaaacccaggaggcggaggttgcagtgatccaagatcaggccattgtactccagccggggtgacagaaggagactctgtctcaaaataaaataaaataaaataaaatgcacagatctgaagcattgagttcaatgaattttgacaaaaaatatatgcacctgtgtaaccaccactgaaaacaaaatggaggacattgcctcatcccagccctttccagtgaattcccagtacccccgggaatgaggtgttacaatgattactatcaccattgttgattattattgtttagtttggttttattgaagaagcgggtagagaaagaaatagttagcctcatgcaaaaagtagggcatatgagagcctgagatatggcttaagaagagtattgtttgagaagtttggctgagtgtggtggcttatgcctgtaatcccagcacttcgggaggctgaggtgggagaattgcttgagctcaggagttcaagaatagcctgggcaacatagtgagactctgtctctataattaaaaaaaaaaaaagagacagaaaagtttaaggtatgttggcaggtagtcctagatggggtttactgccaggagcagttaggattcaaagagcaaaaatttgagggtaaaaggatgtatggtaggttgttggtggtggatatatagccccaacatccagtcactttaaactcttatcaagacaacacagggccgggtgccgtggctcatgtctgtaatcccagcacaatgggaggccaaggtgggcagataactggtggtcagcagttcgagaccagcctgaccaacatggtgaaaccctgtctctactaaaaatacaaaaattagcagggcgtggtgttggggacctgtaatcccagctactcaggaggctgaggcaggacaatcacttgaacctgggagatggaggttgcagagagcagagatcacaccaccgcactagagcctgggcgaaagagagagactccatctcaaaaaaaaaaaaaaaacaaaaacaaaaaacaccaccaaaaacaagacaacacaaagcgtttgaacgaaaacagcatttgcagatgcaaattcaggatccgaaattaattcttcccccctctttgctgagctgccagaatgttccaaggagatccctcctttccagtttcctccgtggcgcacaggctgtgccgagtaagtgggcaattgtgagtttctggaaatcagcgagctggtgtggctcctggctcctggctctggccaagggagttggcttccctgtgtccatgccaggaggggaggctggaggcttctaaaggccgcagctccgctgtagacacgcgcctccttggcactggctttgttgaaatctgtccctagatagtctctcttctgcacagacctctgaggtttttccatactgcaaagggccttgctgcaggaggaacagtctgacctaatctctcctagaggaggccttgagctaatattttttttttttttttttttttgagatggagtctcactgtcacccaggctggagtgcagtggtgcaatctcagtccactgcaatctccgcctctcggattcaagcgattctccctgcctcagcctcccaagtagctgggattgcagatgcccgccaccacacccggctaatttttgtatttttagtcgagatggggtttcaccatgttggccaggctggtctcgaactcctgacctcaggtgatccacctgccttggcctcccaaagtgctgggatgacaggcatgaagcacctcacccagccaaggtaatatttctgaaaggtggagtaccatgctatgagctagacacttggtgtggtttatcctgtcatcgcctcagtgacctcaccaggtggacacggttaggattcctaatttgcagagggagaagttgaggctgacagaaaggtcagcactgtgctcaaagtgatccagctgctaccaagatgaactgcaggctttgctctgagctcacagcctgacctcagtctagagctgggaatctttctctccctcattgctacacctgatcaattactgagtcccatccctttaactgcttacatggccttcaaatccatcttccctacctaagctgcccattcattgacctgtgccttctgtccatctgctgagagccaggtgctgtgcgagcctctgagaatgtggccgagaacaatatggataaaagttctgagccgggtacgctgactcatgtctgtaaacccagtgttttgggaggttgaggcagaagacttccttgaagccaggagtttgaggccggcctggacaacatagcaagaccccatctttacaaaaacaaaaacaaacaaacaaaaaaaagaaaaagaaaaattagctgagcatggtggcactgacttgtggtctcagctacttgggaggctgaggtgggagcatcacttgactccaggagttcgaggctgcagtgagccatgactgtgccactgcactccagcctgggcaatagagcaagaccctgtctcaaaaaaaaaaaaaaaaaaaaaagactgtaaatgtatcctccagagtaattcttctttttcatttttcaaaagcatccttgctttgtttatgcttccaaaagtttaaaaactgtagccaagttccaagaaagaaaaagggaagcaaaggaaaaggaaaacacagacccagaggccctttatggggttgattgtatgtgaagtccatcaattgatggagagaaggagcaccttggcagtatttacttgtactctcctatgtcatggatttcctctccattttcccaagggttctttcctgttcttagaaatgttttgtgattttgcttcagacacagtttgtctacttcttgtaagcattgttcttagattgctggctttatatctatcactcccttgctcatctgcccatccatctatccatccatccatccatccatccatccatccatccatccatccatcatccctccatccacttgctcatctgcccatccatccatctatccattcatccagtccattcaccacccaccatctattatccatccatccatccatccattcatccactcacccattcatccatcatccatccactcacccatccattcattcagtcacccttcatccattcactcacccatccatccatccactcatccaatcacccatccatccatacatccactcatccattcatccatccatacatccactcatccattcatccatccatccacccacccagaccgtccatccatccatccatccatccatccttctatctactctgccaacaatccacacacctgtccctccatcccttccaaccactcacccagcaatcttctcatccatctatccacccatgcatacatccacttattcattcatccatccctccacccacccattcatccacccatccatgtgtccattcatctctccatctatccgtgtgtctatcatctaatataagggagatgttttgaagtattaaaagtgattattttgtagcataggggacagggattgtgttttctttacttactgctaccttattaaatgcttactagttctaaaagccctgcaattgattcccttcaattttccaactctataaytgcagcatctgcagataatgatgacttcttgccttttgccaataattagaccagttattgctgttaaccttgttatggcaggaacttccagaacagtgttcagtgacgcagctgaatatggtcagcccagtctcatttctgatttgagtggaatgcctcaattgttttactgcagaggataattatataattgttaatactcttgaccttcctgtctttagcctcactgagtaaatggggtgtgatcatgaaatcttgattgtctcatagatgcaagagacataaacgacatttgtctgtrtayaatgacagcagatttattttgctaagctgttaagctgttaaaataagcctttaagcccccgcctcaattttccagcagagtggaatgttattttgttgcttctggccaagtgtcgatattcattttagggcaggtcttcatggaaagtctgctggactataggtctggatacttgccrgaccctgtgtcatcactaaagttagggtgcgtttcagaaccaccctgtaccacagtgaagagggacaaatggccttagggagcaggacccatgggggccctctggggctgtttcttgtgccctgagagaggccctagatttgggacagtctgatttacctcccctcccttttttttttctgggtgatgctaccctggtttctgtgttgaaatatgaccctagtgtgaaggtcgcggtctcagaccatcttgtttctggtatgttaagaaacagaaaaacaccttttaggacacmatgttaaccattgaggatacatatcagtgttctggaaaaacaaaaacaaaaacaaaacaatctgtaccgcgactgtggttttcatcagggtgggctgcctttccgatccataaccctgtgtggcttgatggagaacatgttttgtaacttgcaagggcatctgcaatagccgggtcctcttggtgaaaggggaggacccacattaggtctaagctggctggagtcgatgcaaaactctcacatgctttggaaaaagcacgtgatctttcgacgagaatgcaaatgttgaccgggtgcagtggctcatgcctgtatttgcagcatttggggagactgaggcaagcggatcgcttgagtccagaagtttgagaccagcctgggcracttggtgaaaccccatctctacaaaaaatacaaaaattaaccaggtgtggtagtgcatgcctgtagtcccagctacttgagaggctgagttgagaggattgcttgagctcaggaggttgaggctgcggtgagctgtgatcacgccactgcactccagcctgggcaacagagccagaccctgtctttaaaaaaaaaaaagaatgcaaatgtttgcttgattattcagctggtatttgacacacagttctttgttccagagggactgtccagcaacaaatagtgaattcgttaatttttcacaccaaacctattgaaaataaccagaaaaggtatatgctggaaaactcagtgttctagaaacattcatgtttgccatcccaagagcaaaagtcatggaatgcctgatgcttagtgttaagaggaaggaattccacacagcctgtggctagcttttcttatttcattggtgtccaagacaagatttgaactgtttactaaaggaaattagcatcataagtctcctctggcatatatttccagcatccaagtggagctgctgagatcttgctcaagagtagcaaaattggcaggaggaggagggcattagtttttacatcagcttaaagaattttttttatcagccatttttgcaatttggaaacctgtttggagtaggggtatatggagatgaaattgggctgtttctaggattcacctcctccttcaggcatttttttttttttttttttttggaaacagggtctggctctgttgcccaggctggtgtgcagtggcgtgatcatggcttactgtagccttgacctcttgggctcaagcaatcctcccacttcagcttcccgagtagctgggaccacaggtgtacaccatcgcacctggctaatttttatatattttttgtagagatggggtctcactatgttgccagggatggtcttgacctctcaggctcaagcaactctcctgcctcggcctcccaagttgctgggattacaggcaggagccactgcagttggtacttacagttgttttttttttttttttttcccttgagacggagtctcactctgttgccaggctggagtgcagtggtgcgatcttggctcactgcaacctccacctcctaggttcaaaccattctcctgcctcagcctcctgagtagctgggactacaggcacacgccaccatgcccagctaatttttttttgtatttttagtagagatgtggtttcaccatgttggccaggatggtctcgatctcttgacctcgtgatcctcctgcctcggcctcccaaagtgctgggattacaggcgtgaggcaccacgctaggccgatcctcagacatttttaattttccttttttagtgttacagccagccatttgaaaaatgagacttccccctaaccttgtgtcaaactcagagacgttgtcatcttggctttgatgtggtggaggagaggggcttctcattccgggacggggtttctccacctggggcctgcggatactggggctggattgttctctggggtggggccgtcctgggcactgagggtgctagcagcatccctggcttccacccattccatgccaggagcgccgcccccgaggcatggcaaacacaaatgtctccagacactgccaggtgtctcctggtgggcagaatcgcctccatttgaggacccctggaccagggtgctggaatgggggtgaggggcactctgcaattattctctgctctttttttgagggggggggaaatggaaaccaagagcccatcatcagcctcgtggctctgtggtttgacactgccatgctaccgacaaaaaccacgtccctagacttgggggaccaaggaatctggaggaatatgatgatagtcatttaatgaaggtgggtttatgtattactcaagtgctgggctggggagtcaggacatagccacagggaagaaaacagaaaggtccttccctcttggaagcccctcttgaaacacctaattggtgacatggtacactggagaatcagagagtgtcactcaagcattttggcttggtggtggggcgggggtggcgggtcaggcactcaagcacccctaagctgatctggagaaagtgtcggggaaggggaacattagcgtttctccctgaggaatcatcttacacctataacggcaactggcccacagtaacattgatggagcaagtgtcttcttgtggctcggccgctcaatagctgtgtgaccatgggcaggttactgaacctctctgtgcctcagtcttctcctctgtaaaatgggaacatctaggattgttgggggaaataaatggttaataattggaatagtgctgggtgcataggaaactctaagtgttacacagcatgtggccacaacctcccctctcccctcctctctcctctttgctgctgccctgctgccttaatgggatactcccctctctgtctctgtctgtctgtctgtctgtctgtctctctctcatccccttttctttcctctgttcccccacccccacctctgatgcagtttggaccaagttttcttcagccagctaatttagagacaagaacctggatatttattgggcgtttgggggacttccttacagccctaggtctctgtgaaaagggccctggattatctctgcaaaagcccacctgctattggttagccaggactgtctccactttcagacaccagcttcatccaaacactctttgctgtatttataaccacggtgcatttcctcgggacgcacatcttacggcttcttggccccttcgcccagggtgcactgcctggaccatcgccctccggcagagacagtgtctttctttgtatgttctccttcctctggtcgagatgtggcttggtcacctggagtggggccgtcggcaagtcgcctgggcttcgtggaggctcgctgcccccatggcggaaagctcggccacacaccctgatgtctcgacacctttgagttgcccatgaatgggttttcagagcttcccgtgtttactttgctgcacgcctctgtttgtgctctggggaaattcttggcagaggaaaagccaattggaaaacagccctgcttggtgtcagggcttgaggttgagggagaaagactgaaacggagatttgcatgagctggtttgagcatgtcacaagactttgtctttaaaaaaaaaaaaaaaaaaaattggcctggtgtggtagctcactcctgtaatcccagcactttgggaggctgaggcaggcggatcacgaggtcaagagatcgagaccatcctggccaacgtggtgaaaccccgtctctactaaaaatacaaaaattagctgggtgtggtggtgtacgcctgtagtcccagctactggaggctgaggtgggagaacggcttgaacccaagagggagaggttgcagtgagccgagatcatgccactgcactccagcctgggtggcagagcgagactggtctcaaaaaaaaaaaaaatttttttttgttccagtctattctggtggcttagaggagggaagatgggaaattttgggtttaatagagtaatatccatcaggttgagggctttgaagcacctgggaatatccmtaagtcactactgagcaccagctgtatacagttattgagcatgtattgtctcccaggcacatrgtcctcacaacaatcttttcacagagctaggatttgaacccacagtctctctggcttcagaaccctagcttttcttgctatactctgccttacagaggaagggaacttttgtactgggttttgaagggtgaataggagttcaatgaagaagcagcacattctgtgctaaatttggcttcctgatmctcctagaattggccagaagccaatatctggaggccaaaattgggtcactagggtgaccaactcatcacagggccctggattatctctgcaaaagcccacctgctactggttagccaggaccatcacagtgtgcccaggtaaccctgcgtttcaccccaaagcagaattttacaccagagcctggacaccagttgaattttctttaactcatttctgtcaatggttacctccaaaaatgctcccttgtgtctttatgctgggcttctttctctagatacttccatttcttggtttgggtgaaaatcaaatgaggtaattaatgcttgtgacatgtaaagtgtagtgagtggcacatggtaacctctttagttttagccagttggttttttttgtttgtttgtctttgagacagagtctcactctgtcacccacgctggagtgcagtggcgcagtctcagctcactgcaacctctgcctcccaggttcaagcaattctcctgcctcagcctcccgagtagctgggattacaggtgcacgccaccacactgggctaatttttgtattgttagtagagatggtgttttgccatgctggccaggctggtctcaaactcctgacctcaggtgatccgccctccttagtctcccaaagtgctggcattacaggcatgagccacagtgcccagacagttttagccagtttttcactggcctccctctttgcctttttkgcaagggakctggcctccctgtccctggagtaagcaracttccttatacctatagcttcctctaaggaagcgtagttacctacagcctggccctccccaaggacacagctgtttcctccaccaagagcaaggagtggacataatcactgccaaatagggaagccaggctggacaccgtggctcatgcctgtaatcccagcactttgggaggccgaggtgggaggatcacttgaggccagggattcaagaccaacctgggcaatgtagcaagaccctgtctctaaacaaataaaaaaattagccagctgtggtggcccatggctgtagtcccagctactccagaggctgaagcaggaggattgcttgaccgcaggagtttgatgctgcagtgagctacggtcacaccactgaacaccagccaggacaacagagcaagaccctgtctcttaaaaaaacaaaaaaataaggaagccagatgggtgctgggtgtacgggacacatgtcaaaagtcagacctctatctgagtaaggaaacaggttcagagtcaggattaaagaccaagacagcttgaggtcatcagaggccaggaatttccatacaggctgcggtccaaagtgccaagctgggctagatrgatgttggggaagagtctctgtcgccctctttccttccccgttaatgctatcagctgagcatgggtcactcctgatttttttttttttttttttaccgaggacataggctcagagtgtcttctagctttcaacccaccccagactctgacttagcctttcccaaatggtgctgtgcagaaaaatgaaaaaattgctaggaggatcatgtgcctggtggatagtacatgcttgatagctgtaaacagttggtgctcaatatatcgtggcttgtggatcttcccagctgcttcagaaccccaagcctgctgtataattgtacttgatcccgacaacagccctgccagatgggtgttactctgattcctgtgtcctggtaagtggacggggggcctggagtagctgaattgcctagagaaggggacatagctagaaaggaaaagttgaaacccagtgtgatgccagagtccatgcaaactttatcctgaaaggagggatctctttttttttttttctgagatggaatctcactctgtagcccaggctggagtgcagtggtgtgatctcggctcactgcaacctccgcctctcaggttcaagcgattctcctgcctcagcgtcccaagtagctgggattacagacgtgtgccaccacaaccggctcatttttgtgtttttagtagggacggggtttcgccgtgctggccaggctggtctcgaactcctgacctcaggtgatccgcccgcctcggcctcccaaagtgctgggattacaggcgtggccactgcgcccagccttcttcttcttcttcttctttcctcctcctcctcctcctcctccttttttttgacagagtctcactctattgcccaggctcgagtgcagtggcacaatctcagctcactgcaacctctgcctcctgggttcaagagattctcccacttcagcctcccgagtagctgggattacaggtgcgcaacaccacagccggttaatttttgtgtttttggtagaaacggggtctcgccacgttggccaggttagtctcaaactcctcacctcaagtgatccgcccgcctcagcctcccaaagtgctgggattacaggcgtgagccactgcgctcggcctggtgaagaccttcttgccggtggggactctgcagagtcctgacagggagcagggcatcacatggcgagggagctgagagtgtcagctcaggtctctcttcctcttcttataaaaccaccagtcccactcctatgataaaccattaatccatgaatggattaatccacttatgaggacacagcccttttaatcacctctgaaaggccccacctctcaatgctgccacatgaggaattacatttcaacatgagttttggaggggacaaatattcaaatcatactattatgttaccagtaaaatttaaaatataggaataataattgccgatgtgtggcagacttaccaaatactagacmctgtgctaagtgttttatatctattattttatttaattttcttggtcactgcatracatatgctctgttagtcccagtttttcgaatgggcataacaagaccgaacctacctagagttggcacaagttgtaaaaataggatccgtggckgggcacagtggctcacacttgtaattccagcactttaggaggccaaggcgggaggatcacctgaggtcaggagttcgagaccagcctggccaacatggcgaaaccccgtctctacttaaaatacaaaaattagccaggcgtggtggcgcgcctgtagccccagctcctcgggaaactgaggyaggagactcgtttgaacccgggaggcggaggttgcagtgagccaagatcgcaccactgcactccaggctgggcgacagagcgagactccatctcaaaaataaaataaaacaaaaaaataggattcacttttgccaccaacttgaaaaggaggcaaacacaagattactcatctctggagaggaggcattcagatttgcctactcagcattcctggagatagaaccagattttgcatgggttagaatcatattttgcttgggaagccactcagacctcattgtgtggactctattcccagagccagcttcctttattccttcagactcttatgattggctcaggggaaggcacatgactcagactgggccaatcagctttcttaattcctccagcctccatgattggttcaggggtgggcatgtgaccccagaaggttccataagattcagttctgggactttagtgggagtgatagaaagagagatttttccttgctaaatcttccttgctgtgaagctataatccaggtgccaccatgtagagaccacgtgtctcagacttctgacaccatagaaggaagcaggactgcgaaaaggaaagggagagagatggggtccccatgacatcatttgacacctggatctagctgtacctgaaagtgtccttgtcctatgacttgttagttaaatgagccagcaatcgttcttttcttttttttcattttctttctttcccttccttccctccttccctccttcctttcctttcttttcctttccctccctccttccctccctcccttccttccttctctctctcttccctcccttccttccttccttctctctcccccttccctccctccctcccttccttccttccttctttccttcgttccctccctccctccttccttccctccctccctcccttttctctctctctctctcttctttctctctgtataactgagctttctattctcacaaactgaaagaggtcttgctaatccaaggcatgacaatcagagcaacatgtgaagcccaaagagctgcagagctcccctccatggcttccagccccgggggtggtcagtgaaagtaactggagcccggagcttcagaggccagtgtggaggttggaaaggttgtggtcaggagagagtaatatatctggtccctgcaacagacacccctgcagttttatcctgaatcctgggtaatttccccaggtcctgggaagcctaataaagcccctactcagatgttggattgcaagtcctttttgtttgtttgttttttaaatccactttaaatatgtctgaaaaccacacacagagtgactgctgcacagaagagcgaatggttcatgccttcttctttgctgccaccaacaagtcagttacctacttctctgacatgggacccttggctggagctcactggctgccttcctgccacctgtaagcctcggcacttgctgttccctctacctacatgcttttycctgtgatccttcctcatacgatttcctcagattatctttgctcaaacaacaggcaagggctgggccttaatctcacacctgtaatctcagcactttgggaggccaaggcaggtggatcacctggggtcaggagttggagaccagcctggccaacatggcgaaaccccatctgtacaaaaaatatacaaaaaattaaccagatgtggcagcgggtgcctctgatcccagggacttgggtggctgaggcaggagaatcacttaaacccaggaggcagaggttgcagtgagccgagatcatgccactgcactccagcctgggcaacagagcgagactccgtttcataaaaacaaagaaacaaacaaacagaaaaaaccaacaaaacaaacaaacagaaaaaaccaacaaaacaaaaaacaagaggcaagaagttcagtgtgcagaatctctgagaaaaacccatggttgttaaccccaggtctgccccttttgagcagggtgacattaggcaactgatttgatttctcttatatgaaatttcctcactccctgcctattcaaccacagtactgaggacatttggagctggattatctctctggtggcagctgtcctgggcattttagggtgtttactagcatccctggcctccccccactagataccagtagcactcccaccccacactggttgcaacaaccagaaatgtctccaagacacttccacgtgacccccggggggtcagaatttctccccttccccctgtgttttcctatggaggtggaacgtgtttatttctttgctcaccgttttgcaatctctcttcccccgccacaaggcagggactcttctatctccgtcaccatcccatcctcccacagtggagacagctctagggactctcctgagcagcagattcttgggtgccacattctgttccattcctggggaatttatctctttactgagtgatgggtacatgagaactttctgtgtcacccttgcatcttttctgttttgtttttacaaaagaaaaaaaagaaggctgggtgcggtggctcacgcctgtaatcccagcactttgggaggccaaggcgggtggatcacgaggtcaggagatcgagaccatcctggctaacacggtgaaaccccgtctctactaaaaatacaaaaaattagccaggtgtggtggcgggcgcctgtagtcccacctacttgggaggctgaggcaggagaatggcgtgaacctgggaggcggagcttgcggtgagccaagatcgtgcccactgcactccagcctggcagacagagygagactccgtctcaaaaaagaaaaaaagaaaaaagatatcactcgatgactgctaccgaaacattctgtggctgggagaggaaaataccagaaagggtgaatgtggtcggttgaatgatgcctctcccttcccccagagatgcccacatcgtaatccctgtcacctgtgaatttggtacctcacttggcacaaggctctttgcagatgtgattaagttgaggatcttgagacggggggatgatcctagattatctggtgcaccaaatgccatcgcagggatccttttcaaggaaagagggaggcaagagattgaaatgctacggccaagaaaaaggagctgccttaaaagctggattctctctggagcctccagaaggaaccaacctttgtaacatcttgattttagccctgtaagactcattttgggcttttcaccaccaaaactgtaagaaaataggcaggccatgatggttcatgcctgtaatgccagtactttgggaggccaaggtgggacgatttcttgaggctaggagtttgagaccagtctgggcaacatagcaagaccccatctctacaaaaaaaaaaaaaaagaagaagaagaagaaaaattagctgggcttggtggcacacatctatattcccagctacttgggaggttgaggtgggaggattgcttgagcccaggagtttgaggctgcagtgagccatgattgcaccattgcactccagcctaggcaacagagtaagatcccgatgcaggagaaaataataaatgtatgtcgttttacatttgtgggcgtttgtgacagcagcaatgggaaatggawacggtgagaaacccagcacctgggcctggaaaccccctctgggcgggtctctagccaggggccaacaggagtcagagcagggccttggtgagaggtggatacggggccccagcatcctgatggccttgctgtggcttctggggacacctgcagtggctccattacaccgtggcaatttgttccttcccagaccccctggatacaaggggcctgcattttcgaacccagagcccggggacatcccccgtggttccctgttaccctctggatgtctgtcctgctactatgcacctctccccaactcctggtacacagtgggagttcaggggccgtctcatttgtaccgcataacatcacggaggtccaagacgccatgtaatattctgtttaggatttcagaggcacagtcagttacatccatcttctttttgtctttgagacagagtcttgctctcttgcccaggctggagtgcaatggcacgatctcagctcactgcaacctctgcctcctgggtttaagcaattctcttgactcagcctcccaagtagctgggattacaggtgcatgccaccacacctggctaattttttgtacttttagtagagacggggtttcaccatgttggtcaggctgatctagaactcctgacctcaggtgatccactcaccttggcctcccaaagtgctgggattataggcgtgagccaccgtgcccagcctgcttccatcttcttagccacttttccctcaggtgagaccatgagattaggaacctgtttcaattcccgtcggaatttcccaacagagctggggctttgtgattcgaatatgttcagagaaggaagcagaaggaagcagaaatgaaggatgttatcagaaaaggagactcagggttgggtgtggtggctcacgcctgtaatcccagcactttgggaggccaaggtgagtggatcacctgaggtcaggagtttgagaccagccaggccaacatggtaaaaccctgtctctactaaaaattacaaaaattagctaggcgtggtggcatgcgcctgtaattcaagctactcgggagactgaggcaggagaatcacttgaacccgggaggcgaaggttgcagtgagccaagatcatgccactgcactccagcctgggtgacagagcaagactccatctcaaawaaataaataaataaataaataaataaatacaggaaaaggaagctcggtagttttcaggggctgctggcgtttccaagctttaggcattttgctttgagtctttttctgtctttcgagtcatcctgaagtggaaccgagagaggactgagtgggtggagggggtggtggtggggacggcctgtctgctctgctggaattgagagtctgggagatcattgtggtgtttttggagtgattcttaaccccagatatagacagtgacacaaggggcataaatacgaggaacagtgaccttccctggtgtccttgtttgaagcatttgaccatctgggcaaggcctgggagtgtctgaactggctggtgcttccatgaacaagcacagactcagagcccatggtcctgggttcgaatcctagttcttccacttctttgctgtatgacctttgtctacaaaaaataaaaatttagccaggcacagtggcgtgtgcctgtagccccagctactcgggaggctgaggcaggaagatccattgagcccaggggtcgaggctgtagtgagctatgattgcaccactgcactccagcctgggcaacagaagcagaccctgaagaaagaaagaagctgggaagacagggaagaaggaaggaagaaaggagggagggagaggggaaggaaggaaggaaaaaaaagggagggaacaaggaaggaaggaaggaggtggggacggagggaagaaggaaggaaggagggagggaaggaaggaaagggagggaggggagggaggagggagggagggaagaaaaaaagggaagggaaggaactttggaactactgaacatctctgtttcctcatctataaaaagagggataagttatcatcatatcttcctctatggtcattgagtggatgaaataagacagcatttgcaaatcccctaatgcatacctggcccctgattttgttccttgggctgcagcgatgatagaggtttaaaacctccaaacgctgtgttgaaatctctcacgtggacaaccagcccaccagcagagaatgtcatttttccatcctgggtaaacagggtagagaagaatgaggacctcaggccaggttagagagacctcgcttggtgaccttgggaaggcttttaacttttaactttaatgctaacatctggttccctccagttaggcagtcggcggcctagccgtcttgtcttgaagtttctcttgccttccatcatgggtttatttgttcagcaaatgtttatggagggccagcacaggggggaataagaactagagttctgggaggacrtgtgaagaaacaagttccgagccccagggaggaaagaggtcattgcctccctctggggaaaatgtctcttctcatacctggttcacttcttaaatggaatttcccccttcagatgagtaaggcgtttaatcacaaagagaaaacaccttcatcacatagccatccttaaaaggcatttattgtgaagctggttcatagacttctcgcccaggttgctaacagccaacctgtctgggttttgggaagttaaagtgtctgtatcccatttcctttttttttttgagacaaagtcttgccctgtcacctagcctggagtgcaatggcacaatctctgctcactgaaacctctgcctcccgggttcaagcgattctcctgcctcagccctcccgcgtagctgagattgcaggcgtgcaccaccacgcctggctaattttttgtatctttactagagatggggtttcaccatgttggtcaggcyggtctcgaactcctgacttcgtgactcaccagcctcagcctcccaaagggctgggatgacaggcgtgagccactgtgcccagccagttctgactttttaacttgtgatttgacttttcctgtctgaagtctttctctgctggacgtgagttgttgaaggtgttgcttttctttgtagacaattagaggcgctcatgcactgggctatggacaataatactttgaagatgtgcaaatgatttgcaacctttgttgcataaattatccctctgagatgctgtttggcttgataaataaaggacctgcaagagagaatttatcttgagcattccttgggggagagaagcaaaggggaagtgaatgctgcataataattctttgcatactttatggagggtgggttcctgcagtgccctgtagggttttttgtttgttttttttttttttttttttgagatggagtcgctctgtagcccaggctggagtgcaatggtgcgatcttggctcactgcaacctccgcctcccgggttcaagcgattctcctgcctcagcctgccaagtagctgggactacagacgtgctccaccacgcccagctaatttttgtatttttagtagagacagggtttcaccgtgttagccaggatggtctcgatctcctgacctcgtgatccgcccacttcggcctcccaaagtgctgggattacaggcgtgagccaccgcgcccggccccctgtagtggtttaaagcatcttcactgttattctaagcctcacattttaaacagagctgaaaaaggactctaattgctggcctgggatccttgtgtgctgtaggaattcactgagggggcggggctggagagggctgctagagggtggtacagaagcagatggaactttctctctggctggacacagtagctcacacctgtaatcccagcactttgggaggctgaggttggtggatcacctgaggtcaggagttcgagaccagcctggccaacatggtgaagccccgtctttactaaaaatacaaaaaattagcaggacgtgggggtgggtgcctgtagtcccaactacttgggaggctgaggcaggagaatcgcttgaacccgggaggtagagcttgcagtgagccgagatcatgccattgcactccagcctgggcaacaagagtgaaactccatctcaaaaaaacccaaaaataaatttaaagaaaaattttctctctgattctgcctgcctgcctgctagactggaagcaccatgaggtcaaggtccacgatgtcttgtcgctattgaagcgcctccaaaacatggcagaccctcagcaaatcttggacagatgaatgggcattcgattcaacatgtgtctgctaggtgggagctgagcgggaatcgcagggcttgggtcccggggatgatggrgaatggcagtgtgactgtggggaagccaggggaatggggtgctggagcccccaaagctataaatcagggcctgatgarcagacagacagatggaccaacttaaccatttcagccccatcsgctttgatgatttccctctggctctggcaagagtctcgctcaccaagtggttctcaccctagggtgggtctggatatttctggggacatctgtggttgtcacacgtcggggtggggggagatgctcctgacatggagtgggtggaggccagggatactgctcagcaccctgcaatgtacaagacggcccctccccagatgaagatccgactctgaataccaccagtcctgaggctgagaaaccctactttaagataacagtgatgggggaattatccaccccagagtctgagtctgtgacttgggaaacggccccggcattaccaggtgttgaattcgtgagaatacaaggagaaggcgtgtagcccgtgacccagtcctgccccagacaaaccgatattccctccaaagctctrtttggcagaagaagtgttttcgttscctcttgcctgtggtatctcccctgataagcgttgtggattgttccagaccgtgttgacggggacagcttccttctccgcggctgccggccctgaccctgcagctttcagtctgtgggagtagagtcagctgttgagcagtttactctgtccctgtgtcaatgggattgtgcatgttttggttcctgaggggtcattgatggtgcacttttcttttgttgttagtcaatttaatttgttamtaataataaaatctggaacttacctgaccccaaaggcccaggtcgttaagaatgcttggtggaatgcacgtccttttcaaataccggctcctttggaaaacacagaggatggagtgaaatccttacctggattgtactggcagtgggatgacagcgtcacctcctgaaaatggaatgtagcttattgctaaataagacagcgcagtgcctccctcgcacctgtcatcttggtgcttagagaggccaaggtgggaggaattctcgaggccaggagttcaaaaccagcctgggcaatacagaaagagcctatttctactacaaatataaaaattagctgggcatggtgacatgcacctgtagtcgcagctacatgggaggctgaggygggagaatcgcttaagcccaggaagtcgaggctgcagtgagctgtgacttgctactgcactccagcccatgcagctgagcgagatcctctttcaaacaaaccagccaactaacaagcaggccccaaggggacaatttttctggaattacctgattgtatcaagaacagtttgatcaacacctgtaatcccagtactttgggaggacggatcacttgaggtcaggagttagagaccagcctcgccaacatggtgaaaccctgtctctactaaaaatataataattagctgggcatggtggtgggtggctgtaatcccagctacttgggaggcagaggcaggagaattgcttgaaaccgcgaggcagaggctgcagtgagcygagactgyaccactgcactccagcctgggccacagagtaagactctgtctctctctgtctctctgtctctgtctctctctctccatatatacatatatatttatatatataacttatcttgaagacggttttggcacgccttaacttttatgccagaggccagtgccttgcttgtgtcaccctggttccaagaatctgcatagtttttcccagcccattctacagacagggaaactgaggaccaggcacactaggttcccctccaggagtcgcacagcgaggagaaagtggagccatgacttgatgccaaacactgagactccagaacccatattttctcagctcttaggtttttgtcaatttcctaaatttgtgtgtgttttagtggggctgagtttctcctgttaatttgtttatggagaggagacactcttgtttacttttttttttttttttttgagacagagtctctgttgaccaggctgcagtgcaatggctcaatctcggctcactgcaacctccacctcctgggttcaagcgattctcctgcctcagcctcccgagcaactgggattacagtcacacaccaccacacctgactaatttttgtatttttagtagagatggggttttcccatgttgatcaggctggtctcaaactcctgacctcaggtgatccacccgcctcggcctcctaaagtgctgagattacgggtgtgagccactgcgcctggctcttggcgttctcccttagtaatacttcttgggggtcattttgaatctctgtttcttctgtggtcacgttcatttggaatttacttattcaacccacaaccaatagacatttccagccctttgttagtataaacagaacttctctttgactttcacagcgtttttgttctggaggtgctatccttgattgctaagacacccacgacattgctcttggaattggagtagggtggatgaaatagtattcaaagatgggggtggtgcaaatgttctgtatttcaacctgtacattagtcaagtgttatttttaccctcatgtacatctattatggaataaaatacatgactttggccaggcgtcatggctcacacctgtaatcccagcactttgggaggctgagacgggaggatcgcttgaatccaggagttcgagaccagcctgggcagcatagcaagaccccttctctaaaaaaaaaaattagctgggcatggtggtgtgtgcctataatcccagttactcgagaggctgaggcaggaggatcagttaagcctgggaagtcgaggctgcagagagctgtgataggcagcctgggtgacagagaaagaccctgtctcaaaacaaaaaacaaaacaaaacatgacttttatggagttgagctcaacgtttgcatacacatgaggagcagaagctggaggtttcaaataaatatctggcttctgcaggctgcctggagagaggtgagagcgatgcattggtcacccagcctggagtgcagtggtgtgatcacagctcactgcagccttgaccttctgggcacaagcaatcctcctgcttcagcttcctgagtagctgggaccacaggtgtatgccactatgcccagctaattttatttatttatttagagatggaatcttgctctgtcgcccaggctggaatgcagtggcacaatcttggctcactgcaacctctgcctcctgggttcaagcagttcccatgcctcagcctcctgagtagctgggatcacaggcatgtgccactatgcccagctaatttttttttttaatggagtcttgctctgttgccaggctggaatgcagtggcgccatcttggctcactgcaacttccaactcccctgttcaagcgattctcctgcttctgcctctcgagtagctgggattacaggcacgcgccaccatgcccagctaatttttgtatttttagtagagagggggtttcaccatgttggccaggatggtctcgatttcctgacctcgtgatccgcccacttcggcctcccaaagtgctgggattacaggcgtgagccactgcgcccagcctaatttttgtacccctagccgagacagggttttgccatgttatctaagctggtctcgagctcctgggctgaagcgatccacccgcctgggcctcccaaagtgctgggattacaggtgtgagccactgcgcccggccacagctgttgttttctcactggcttgagaattgttctcttaagctggtcaaggttatgactgtttgtgtggcttgtgcacgtgtgtgtggtcaaatcccatttttctaaagcaaagtttctatttgggtatctgctgtttaatttttcagggattttttttttccggttgctaaggaaagtacattaaattttatctttgyatcctgtagaactctttgtgaataatacacggccagagggaagataggctgaggaaacagataggaaggaagttcaagggggggatttctatgtgagaaccaagaaacacctttgatctttagatttcaaagtgggaagttcaaggtgaggtgggcgtggaattaggagtaaacccaagaagagcgagtgggcggttcctcctggcagccacagaatagttacgtggcatgaggtcagtagcatctcagagggtgttgttgtctttgacttagatgagttccaagaagcagaagttcgtgagccaaacacgaggtggttttctggggggtacaagggctggaagaggggccagctcttaaccacaaatccctttccatgcccaaggccaagctccttgtaactcttttctttctttgcctccctccctccctccctccctccttcccttccttccttccttccttccttccttccttccttccttccttcctttccttccttccttctcaaacaaggtctcactctatcacccaggctagagtgcaatggcacagtcatagctcactgcagcctcaaacccctgtgctcaagtgatcctcctgcctcagtccctcaagtagtttttaaacttgtttgtagagatgggtcttgctatattgcccaggcttgtctcaaaattctggtcttaagcgatcctcctgcctcagcctcccaaagtgctgggattacaggtgtgagccactgccccggcccattctcctttctttagccaggctagggagacataagtggggaaactcatgttgttttttgagatggttgctttattctcgtgatattttccctctttccaacttccttgagccctccccagcctcctcttagtgtctgtgtgtgggtgagggggctttggtataccttctgctttgagtctcattcattttaattttttattttgttttgttttgttttgttttgagatggagtctcactctgttgcccaggctggagtgcagtggcaccatcttggctcactgcaacctctgcctcccgggttcaagcgattctcctgcctcagcctcccgagcagctggggattacaggtgcmtgccaccatgcctggctaatttttctatttttagcagagacaaggtttcaccatgttggccaggctggtctcgaactcccgacctcaggtgatctgcttgcctcagcctcccaaagtgctggggttacaggcgtgaaccaccgtgcctggccacgggtctcattcattttagttggagcccaaattcactggtggttcaagttcccaatcattctcggcattctataatcacaggcctcagagagtaatgctcccaatggccctcaaattatggtttccttaggaggctattaaatcttgatttctgagaggaaaattggggattttgtgttttcccttttagacttgagtgttctgttactgtggatgagctcttctagaaacttccaagcagtttcaaaggggatttagatgtcatcaggaagtgtggttgacaacgtgatatttgggctttagaaaaacagcgtgtcacccgttttatttattccttgatgactctttttttgcttgtttttgttgtggtcgttgttgttgagacagggtctcactctgccacccaggctggactgcactggtgcaatctctgttcactgaaacctcctcctcctgggttcttgcaaatagacagtcccatttggtggtgacgggagacagtgacagatcatcaagcattagattctcataaagagcgtgcaacccagatccctcgcatgcacagttcacaatagggttcacgctcctaggagaatctaatgctgctgctgatctgacaggaggcgcagctcagatggtcatgcaagcaatgaggagtgactgtaaatacagatgaagcttccatcgctcgcccgcccctcgtccactgctgtgcagcctggttcctaactggctggtttgaaactagactgggcaacatggccaaaccccgtctgctcaaaaaataccaaaattagctgagtgtggatcacaagtgtgtgcctgtagtcccagctacttgggaggctgaggtgggaagattgagtgagcccaagaggtagaagctgcagtgagctatgatcacacccactgcactccagcctgggttacagaatgagattctgtctctcaactccctgaggggtgggggacccctggtttaatccatccaaccctctcttcccatgaaataaaggaagttgtgagtgctattttgtgcgtcatcccctccagtattcaagtcagcccaaggtacttcgatggttcccgtctgcacatggggaaaccgaggcacagaaagcagactcatgtgaccaggaagtagctgtgtctgctcgaaactcaggtcgacctgataccataagtccttgcactccacgtgctggcgattgaagctgtggctcgcaggtctgatgggagagcctcagacagtgtctcactctgtcacccaggctggagtgctgtcatgcagtcataacccactgcagctttgacctcctgggctaattgatcctcccacctcagcctcccgaatagctgggactacaggtgtgcaccacaatgcccacctaatttttgtattatctgtagagatgggcgtggggggtgtgaggggtcttgccatgttgcccaggctggtcttgaactcctgacctcaggtgatcctccagcttcagcctcccaaagtatcgggattacaggcatgagagagccactgcaggaagccaagagagcagatttggacaatgtagaatttctccacgctcctcctactgtccccatcttaggcctggctactgcgggactgacaggcatggctggctgtccatccgttccttagtttgattgcatggcagacatgaggaaggaaggtgagaactgagctagaaagttggcatttggygctctggtttctcaatgcaagaaagtaacactttggcttttatagaataaccttctgaggaaattaacaacccgggcgtttcagccccctgtgaacttgattggagcatggtcacaatttgtaacgaaatgtgcttgcatgcccagtgctaaagatttctctctgtctaccctctaggctgtggaaaggtctgttctaaccattagcttgtatctggagctcagatggtgccggacactccgtaggagctcagatctgttgatagaagccactagagaatgggacaagcaacaggaggtgttttgctgcctagtaaactttttttgagatgaagtttcacttttgttgcccaagctggagtgcagtggtgccttctcggctcaccgcaacctctgcctcctggcttcaagcgattctcctgcctcagcctcccaagcagctgggatgacaggcacccgccaccatgcccggctaattttttttgtatatttagtagaaatgaggttttgccatgttggccaggctggtctcgagttcctgacctcaagtgctctgcccgcstcggcctcccaaagtgctgggattacaggcgtgagccactgcgcccggctctacccatctttcttacatgatgatgttcagcagccagcctgataggggagcattgtttgtcctttttttccttattgcattttccccgcataggtgccagggctcagtagcataaatccaggtagaactgggaagttccaggtatctgggctgtttgctctggtggacaaagagcagctgcaaggtgggkcttgattagccagtgaagtctgaggatccagagggaaacttattcctttcttttgttgaaatcaacatgagcaggaaatggatctttcccccaatcagagaacttcacatgtttttctaatagaatagcagtgtctgaggtatatacayggggagtggccccccgggaaaacgaggccatgaggctcctggcatggagatgacacacgaagactctcgtaacttmtagaggggaaaataaagcagtcattccaggctgggcatggtggctcacgtctgtaatcccagcactttgggaggccgaggcaggtggatcacctgaggtcaggagttcgagaccagcctggccaacatggtgaaaccccaactctactaaaaataaaaaattaaaaaaaaaaaattagttgggcatggtgctgggcacctgtaatcccagctactcaggaggctgaggcaggagaattgcttgaacccgggaggcagagattgcagtgagccgggagcctgtaatcccagctactcaggaggctgaggcaggagaattgcttgaacccgggaggcagagattgcagtgagccgggagcctgtaatcccagctactcaggaggctgaggcaggagaattccttgaacctgggaggcagagattgcagtgagccaagatcacaccactgcactccagcctgggtgacaagagtgaaactccatctgaaataaaataaaatataaaagttaaagcagtcatcctggcttttaggaacccgcagaatcaggargtaagctaaaagtcgtctcccttttgtcacgatggaatgtgaaataggtgcattttccttctgacttatgattctgtttcacggtgcctctgcagaaattcagtacgtccccatgggcacctgtgtccttcaggagttgaggaaattttctccattccttgtccctgtccctagactctgccagctcgtgcatgtagaagctcccgggaaaactgtcaacctgtgcacattcaagaccgccatatacttgttattgaaaagccatcagtcatgtgagcagaacttttttatggttgagattgtccccagggaaacccgccttgcaattcagaccttccacggagatcgattccaaactctcatcccgttcccacttcctcgttcccatggaggctgcggttctctctctctgtgccgcttacarattgtcatacctatttccaaaaatgacacagaaaacttcaacgtgtggctaaatttgaacagagaaaaataagcaaagaattcaaggcgcgaggcgttttcagggagagagggagagcttttgcatggtttgaagggatgatctttaatgagttgagggtcacctagaatagaattaaactgtagagagcaaattgttggaaatgcaaggagaaacttcggagaagactccaacacagcctggatctgggagatgagactcaggtaacaaaaagtttgaataacatggttaataagattgtggtaacagataggactgaactttgcactctgcaaacaatatacattttaaagtgctcttggaatagttagaaaaatcaatcatctgttaaatctgaaaaaaaaaacaaaaaaacaaaaaaacaaaaaaaaacccaccccaaaccaatacattccaaaaaagcagacattgtacgggttctaatctctggctgcaagtaagcataactggaattaatttttaaaagcttaactgaacaagcatgtaagagagactcctaccacttgataattaaaaagaaaatgaaaaccaaaaaaacaaaaacaaaaaaaccgaaaagggctgggcaccatggctcaygcctgtaatcccagcactttgggaggccgaggtgagcggatcacctgaggtcaggagttygagaccagcctggccaacatggtgaaaccccktctctactaaaagtacaaaaattagctgagggtggtggcgcatacctgtaatcctagctacttgggaggctgaggcaggagaaccgcttgaaccccgggggcagaggttgcagtgagccgagatggtgccattggactcttctagcctgggcaacaagagctaacctccatctcaaaaaaacaaaaaacacaaaacaaaacaaaaaaacaaccaacccctaagtcttaagttggaggatcgaaacactgcaaggatagactatttgaagatgacaatgatgtgaacatggagacaaaggcagaggtttaaatgattatagaggaaatttgcttgataatttattatatgaatatagagagaaatcacaaaaatgagatgatgaatattggaaataataagcacagacgaactgattagaaaacaaatagaactgacaaaatcaaaaagctggatcttttagagagatgctgctcagtarggtggccacaacccacgtgaaaattaaattaaaaattcattttctcagtcgcacgagccaagtttccactgcttaggggccatgtatggttagtgactactgaaatggatagaacagatacagaacttttccatagctgctgaacgtttgttggacagtgctgttttagarggaggaatcaataaaacagaaaaactaagacaaaggagggggagagaacaaatattgtagataaaattaagaatgaaggcctagcgcggtggctcacgcctgtaatcccaacactttgggaggccgaggcgggtggatcacgaggtcaggagatcgaaaccatcctggttaacacggtgaaaccccgtctctactaaaaatacaaaaaattagctaggcgtggtggccgcgcctgtagtcccagctacttgggaggctgaggcaggggaatggcgtgaacccgggagggggagcttgccgtgagccgagatcgcgccactgcactccagcctgggcgacagagtgagactccaactcaaaaaaaaaaaaagaatgaaaatagatgtaatttatttattattgattgattgattgagacagagtctcacttggtcgcccaggctggagtgcagtggtacaatctcagctcactgtaacctctgcctccagggttcaagcgattctcctgcctcagcctcccgagtagctgggattacaggcgcccgccaccgcacccagctaatttttgtatttttagtagagaagtgatttcaccctgttggccaggctggtcttgaactcctgacttcaggtgatacacccgcctcggcctcccaaagtgctgggattaaaaacagatgtcatttaaatccataaaaaattgtaaagacagctctactaacaattttggaaatattaaaaataacttcatttactgattcaagtgttacttttatttagcttaattgtttctctttaccagaaattgaggctctgaatttgccccagagaatgggtatgccattctctctcataagctgtactctcttattatcagtaatttctaaatagcctgtaaaatttatatggactcaaaatrcaggaaacatcrataggttgaaactcaacaacttgtaaaaagttactcctgtacttaattgcataaaatgtgtattgcctacatgaatgagaataaaaacttccaaaatgcccccaacaaacaggggtttttgcaccttrccatgagtagctttctggagcaagccggagtggttagagctgtgactcggcaaccacaaacacaaccatttttgtgtggaagtgtggctcttcagycttttttttttttttttttttttgagataaggtctcactctgttacccaggctggagtgcagtggcgtgatcctagctcactgcagcctcaacttcctggactcgagcaatccttctgcctcagcttcccaagtagctggaactacaatcatgtgtcatcatgcccagctaagttttattttttttaatctttaatttttttaagaaatagagatgaggtcttgctatgttgcccaggctggtcttgaactcctaggctcaagcaatcctcctgcctcagcctccccattagctggaactacacttgtgtatcatcatgcccagctaatttttaactttttatttattatttttttaaagagataaggtcttgctctgttgcccaggctggtcttgaactcctaggctccagcaatcctcccacctcagcctccaaagtgcagcctctatatcttgaactccacacctcaaacccagattgtccacatgtgagcacctgtctttttggtttgctgtttctctcgtgagttgtatccagttgcccaaggtggaaagttgggcgtcatccagcaggtaagtcctgacacctccacctccccgatggcttcagaagccagcctcttcttttctgtttcctctgcctctcaacttcctcatccatctaccataagccagaaaaatgacccccaaatgtgaatccgatggtgttctttctgcctgacatctttctttggcttctgctgtggggtaaagtccaagccccttggttccctgtctttcctctctggtctaatcttctattcctctcatcctgtactttgcccttcatcaactctgaactgtttatagttctctgaacatagcccgagtgattcacacatttgcatgtactgttcctctcctgctgtgataaagsgacagtcacctaatccccgcccctccgttgcattttttytttcctacaagatttattatgcacctactgtgtgtatggctctgggatgctgtaataagcaagacagacaccatctttcccttcacggggcgtatgtgtctcgtgcatactgggagggcagggacagggtctccatycatttctgcattccaatgccaagagggtgtcagatctgggtgggtcgaggtagggaacaggtaaacataactcacagtgtgatgccgtgttacagccaggctgggttcctcacgcctgtgatggcagcgctttggggagccaaagtgggaggattgcttgaagccaggagtttgagaccagcctaggcaacatagagagacccgctctcaaaaaaaaaaaaaaaaaaaaaaaaagctgtcgcagtggcactctcctgtagtcctagctcctygggaggctgaagcggaaggatcacttgagcccaggagtcctagactgcagtgagctatgatggctccattgcactccagcctgggccacagagtaagaccctgtttcaaacaaacaaacaaatttaaaaaatcaaacaaactcccactcccccaaactccataccacaccctctcctggtctctctgggagacctggattcgagttctggcagagctggttattggcaaagtagcccctctatgcctcggtttctccaattctaatggtgatgattgcttgaataattgagttaatatgayctcattgatggattggaccgtgtgtgctgcaaacagattacacactttaaagtgtattcatgcctgtaatcccaacactttggtagactgaggcaagaggatcacttgaggccaggagttctaaaccagcctgggcaacgagtccccatgtctacaaaaaaatagaaaaaattagccaggcatagtgatgcacgcctgtagtcccagctactcgggaggctgaggtgggaggatggcttgagcccaggagtttgaggctgcagtgggcgatgatcacaccactgcactccagcctgaggcgacagagtgagacccccccccaaaaaagtgtatttatgggggtgaatgttaaatgagaatgtccactcgctgccttggtttactggaactgcaaattcaatggggacacacaagttttcaaatgcatgcggaatactggctggaggttaccccaaaaacgtagcctgtggattttaagaatgtatttatgagtatggttctcgttttctgggtgagtggtgggtgagaatagagggtgcactggcccggcgagttcggagatgcggaccctccccccctgcaatgtgaggaattttgctgtgtgaccctagtgagccgctgcacctttctggacycctcccgagggaggcctggggtcagggggcccctcggcagtcccgggagctgccacgcggtgacccgatctcctcccgggcacacgcccagcgccgcgcgcagcctaagccaccccggtggatgcttgatgagcccttgcaagctcggtttctccttttccctagctttttccaaagttccatccgtggcagactcgacctgcggggtctgcagccacgaggggccctcccagggcgccctttcctctggccgggaccgcccggcggcggccactgcccgagcgccagtctggggagcggagcccggcgcacccggggggcggggccagcgcccctgcagcacgcccgcccattggctgagcgcgagggcggcgctgcggccgccgcaaccgccggggccggattccccggagcggagtgcgccccgggctttgtgctgcgctgaggcctccggctcgagggggcggagccttgagcgcctagggctccctccctcgcccccatgggcacacacgcagacacgggcacacacgcagacacacacacacgcccatcatggacacacacacacgctcgcccaccatggacacacacacactcccaccatggggacacacacacactcccaccatggggacacacacacacacacacacacacacacactctcactctggaaccgaccaatcctggggctgcacagacacacacgcgcacacactctctctcgttctctctctctctctctcgttctctctctctctcgctctctctcccactctggaaccgaccaatcctggggacacacacacacacacacacacactcccactctggaacctgccaatcacacacacacacacactcccactctggaacctgccaaacacacacacacactcccactctggaacctgccaaacacacacacacactcccactctggaacctgccaaacacacacacactcccactctggaatctgacacacacacacacacacacacccaaacacacacactcccactctggaacctgacacacacacacacacacacacacacacacccccactcccactctggaacctgccaatcctggggctgctctagcgaggagacccctgggaccccgcctccttccgggcctctgcgtgcgcagtatatctcctaagagatccgcagcatggagagggcccgcccccgtggacggactcactccctccccactcactcactcactcgcttactcactcactcactcactctctctccgaagagaagaagcctgcggctcccgaagcgggaaggccctctggtactctgttccctttctagcctctatatgcgccgtatgtctccaaagagctgcgcagttctattccaaaggcgtcatcgcgtgtggggcggtattgtcaggcaaggaaaaggggcgcttccccgcttcaaggacacgcgctcctgcggtcgtcgctgctgaccacgaagctgtcaaaagttcacctccttggctgcccccaacccctgcccctttgccattaaatcatttactagattccaactagaggaatttggctccggggactcgaacctctgaggtcagggtctggggccagtgtgggagagaaaggccttgaatggaaacaaaataaattactttaaggagtttataaaactcacacttatagggagagccgcggggccctgtggtcaatgtaccagcaggcccatgacgcaactgttccgtttggaaatttctggaaagcagtaatttttggaatcataaatcttgagtattttttttttaaactttggaaaggtttttaaactttttttttttaagttttttttaaacttcggaaagttttaagctttggaaagaatgtaacaaaatgttattaacatatgtggagctatcgaatcatttaatggtggkttctgtattttctgttttgttttttatcacataccttcttaattaagaaaaacccaaactaatttgaactttaaaagggaggcaaacaaaaaagtgtcaragtgactggatttttgtgcgcaagtcatttaacaatgcagcgctgcgtctcctatttctctggcttttaaccttgctttggacaaattggtcgctttttgttttgatgtcgtttcaagcttacggaaaaattgcaagattatatctagatcaatcaattgtttacgttttattctacttgttttattacctttctaatatatttatgcacacacattatatacatttttttcccctgaactatttgagagttagttgcaggcatgatacatackccttaattcttcagtggatatttcctaagaacaagaaagttctgaggccaggcgtggtggctcatgcctgtaatcccagcactttgggaagctgaggcgggcggatcacctgaggtcaggagttcgagaccagcctgaccaacttggagaagccccgtctctactaaaaatacaaaattagccaggcgtggtggcacatgcctgtaatcccagctactcgggaggctgaggcaggaggttcgcttgaacctgggaggcagaggttgcagtgagccgagatggtgccattgcactccagcctgggcaacaagagcgaaactccgtctcaaacaaaaaaaaaaaaaaaaagaaagaaaagaaagaaagttctcttacataatgatggtactggtgccgttgtcaaaatcaggaaattaacattgatacagtattttaatccaatgtcttctataatcttatctgttgtctcaatattgccctatatagattttttttcctaggcgaaggttccaatctaggatcacactttgcatttgaatgctgctgtctcttaagtccgcacaattcctcagttttctgtgtctttcccaacattggcttttatttatttatttatttatttatttttatttttttttgaggcggagtcttactctgtcacccaggctagagtgcagtggtgagatcttggctgactgcaacctctgtctcctgggttcaagtgattctcctgcctcagcccccaagtagctgggattacaggcatgcgccaccacacccagctaatttttgtgtttttagtagagaaagggtttcaccatgttggccaggctggtctcgaactcctgatctccagtgatcttcctgcctcagcctcccaaagtgctgggattacacgtgttagccaccacacctggccaacattggcagttttgaagagcacaggccagttattttatcgaatgacctcaagctagggttagtaatatatggaaagaaagctacacaaatattttgtctttttcattgcctcataatgggaagtacgtgttgttgccttgtcccactattgtgggcaatgttacttgaagtatttttaactagaatttttaagaagaaatacatttcccgtaaggctcagtacccaagacatgcatatacctgaatgaaaagtttcccacaacaagatttactcttgccattttctagtactgtgggattttttccttttcttttccccctgcaggaggggatgctgctgggggctgaggacaatgctaaacctggatgtctcgaggacaggggatggggtttctgtgtcatctatgttctgatgctttttcatttaatacragaacaggtttcctatgatttggcacactgggacattcgacatgtgtttgttgaatgaaaaaaagaaaaaagagaaatgctaacaatttgttgaatagtccataaaagagcaaagctggcctggcgcggtggctcacacctgtaccagcactttaagaggccaaggcagacggaggtcacgtgtttgagaccagcctggccaacatggtgaaaccgcttctccactaaaaaaaaaaaaaaaaaaaaaatcagttggtgtggtggcgtgtgcctgtaatcccagctactcaggaggctgaggcaggagaatcgcttgaacccaggacatgggggttacagtgagccaagattgcaccactgcactccagcctgggtgacagaaagagattttgtctcaaaaaaaaaaaaaaaaaaaaaagcaaagctattattaaaacacactccacacttcacccctgagccccatattgattttgtaataaggcaaagataattttttttttctttttttgagatgaagtctcattctgtcgtccaggctggagtgcagtggcacgatcttggctgactgcaacgactgcctcctgggttcaagcaattctcctgcctcagcctcccaagtagctgggattataggtgcctaccaccacgcccagctaatttttgtattttgaatagagagtgtttcaccatgttggccaggctggtctcgaactcctgacctcaagtgatcttcctgcatcagcctcccaaagtgctgggattacaggcgtgagccaccatgcccagccaacaaagatgattttaagagaacctttgtaaaagctctcaccgatgcctgtcattattagaatatttgggagtagaatcatgtaactgatcaataacattgtttactgtctagcagaggcttttgaaaaatgtatttcctggctgggcattgtggcttacgcctatagccaagcagtttgggagctcggggagagcggatctcttgagcctaggagttcaagaccagcctgggcaatattgtgagacctcatctctaccaaatgtatatatacatatacaaaaattagccaagcatggtggtgtacgcctgtagtcccagctactcaggaggctgaggtaggaggagcacttgaacctgggaggcggaggttacggtgaaccaagatcatgccactgcactccagcctgggcgacagagtgagacactgtctctaaataaataaatgaaagaagaagctacttgaaaaaaatatgtatttccaaatatatgtcagttttgacaggatagtacacatacatagtaaaaaataaaaataaaatagggcacttttttgtgtccctttcagagggacatatgtcccatgtgtcctcccccctcctgcccctaatttttttgtttgtttttttatgagatggagtctcactctgtcgccaggctggagtgcrgtagcgtgatctcagctcactgcaacttccgctccccaggttcaggtgattttcctgcctcagcytcccatgtagctgagactacaggtgcgygacaccatgctcagctaatttttatatttttcgtggagacggagtctcaccatgttggtcaggatggtttggctctcctgacctcgtgatccgctcaccttagcctcccaggcttagcctccttagcctgctgggattacaggcatgagcagaagaatctcttgaacccgggaggcggaggttgcagtgagctgagatcgtgccactgcactccagcctgagggacaagagtgagactccatctggggaaaaaaaaaaaaagaaaaaaaagaaatactgcatcaaattgcacttgcctcttggtgcaagattcgttcctttgctttgaactgcctccctgaagcaaattggtgtttctgtgactccctctgtctagggaaggggtcctttagtggggacattgtctttcttggggagggtccaccagaggactctgacacagcggtctcctttctcctccgtcaacttagttagattttagtccctgatcttctcagcagtgtatagtgaaaaagccaccgcagctgaaagtttcaggaagatgatagttgcttctgtgtgctcacccaggagcttttgggaggtttagggagaactgggggaaaattgggaccagcagctcaatgtggctttgaaggggagacagcggatggacacagaacttgcatttttggagaggggaggtctgggtagatgttccctacatacacagcagcacttgtgtgcaggtgtgagggagtgacagcccccggacggtttggcattttcctgcaagtctgccatcttgtctggcagacayagcctgggctgctgactgtccctaccccaaaccagaatttgggcaggaacggacacttgggctcattacgtgtcaatgagggggatcaggtcaggggcacagggagaggaaagtcaaccccgtcctccactggggctgtttctcatcttgcatgacacgtggctttcataatgtcttcactttgcggtctctctcaccagaagaagctgctgttttgtggctagttcatctgtgtcatgccctttccccagcctgggctgcctgtgatttttttcttttcttttcttttcttttcttttcttttcttttcttttcttccctccctcccttccttctttctctttcttttctttctcctttctttctttttctttcttttttcttttctttctctgtctttctttttctttctctttctctctctcttatctttcttctttctccctctttcttttcttttttctctttctgtattctttcttctttctctctttctttccttctttctttctccctcccttcctgcctctttctttctctttctttctccctcttctttctttctctctctctcccctccctccctccttccttccctccttctttctttttatctctctccttccttccttccttccctccttctttctgtctttctctttcttttctctctctctcccttcctccttccttccctccttctctcactctctctttcttttcaaagatagggtcttgctttattgcccaggctggagtgcagtggtgcagtcacagctcactgcagcctcaaacccctgggctgtagcaatcctcccacctcagtctcccgagtagctgggactattggtctacgggtgtgcaccatcacacctggctaatttttttatttttgtagagacaggggtctggctattttgcccaggctagtcttgaactactggactcaagagatcctcccgtgttagcctcccaaagtgccattacatgcacaagccactgcgcctggcagacttgtgattttcatgtggagcttttcacattctgtctaacaatccgagttcagaggaaccagtatggggagcaagagtatgtggaaacgtccagcaccagtttagaggactcccactcagctagggggtgcagtggccaccccgagtggcttttctttcttttctttccctccttccctccctccctccctcctttctttctttctttctttttcttttcttttctttctttttgagacagagtctcactctctcttccagcagtggcacaatctcggctcactgcaacccccgcctcccgggttcaagcaattctgctgtctcagcctcccaagtagctgggattacaggcacctgccaccaygcctgtataatttttgtatttttagtagagatggggtttcaccatgtcggccaggctggtctcgaactcctgacctcaggtgatccacctgccayggcctcccaaagtgctgggattacaggcgtgagccaccgttcccagcctctatttttttaaaattgacaaataataattgtatatgttacatatttatggggtaccatgtgatgttttgatatctgtttacattgtagaattactaagtcatgccaatttaaaagctatcacctcacatacttatcattgttttatggttaaaaatatctacatttttggcaattttgaaatgtccagtgcactattacttattatagcaaccattgtgtccaatacataactaaagcttatttctcctaagtgaaattttgtagtttgatcaacatctccctacagagttggaaacacctggaatgggcttatagtgttcgaaggatagtcttcaaagaattggttgggcgcggtggctcacgcctgtaatcccagcactttgggaggccaagatgggtggatcccgaggtcaggagttcaagaccagcctggccaacgtggtgaaaccccatctctactaaaaatacaaaaattagctgggcgtgatgacgggcgcctgtaatcccagctactcaggaggctgaggcagagaattgcttgaacccgggaggcggaggttgcagtgagctgagttctcaccattgcacttcagcctggacaacagagtgagactctgtctcaaaaaaaaaaaaaaaaaaaccaccaaagaacacaggtcagcatgtttatttaacccattagtgagggaacagcaggattataaagccaaaacatgtatagtcactgaaacaagaaggcagtgttagctgtgaggctgcttaatgtcccataggacaataaaactgtaatctttggggatgatttttttcttttttttttcggcaaggagagataggatctcactctgttacccaggctggtctcgaatgcttgggctcaagcaatcctcccgcctcagcctcccaaagtgctgggattacaggcatgagcctccatgcccagctgagagtatcttttctctgagatgaaaataatttgtagcatatctgtctgtaagttaactctaatttccttgagtctagttcctaatagaaatagtaaaatcggccaggcgtagtgggtcatgcctataatcccagcactttgggaggccaaggtgggcagatcacttgaggtcaggagttcaagaccagactggccaacatgctgaaacccagtctctactaaaaatacaaaaattatccaggcatggttgtgggtgcctgtaatcccagctactcaggaggctgaggcaggagaattgcttgaacctgggacacagagtttacagtgagcggagatggcaccgctgtacttcagcctggacaacagagcaagactcggtttcaaaaaaaaaaaaaaaaagtaatagtaaaatcaattacaggtacatttaactagtgcaggttgataaactatctggcccatcacttgcttttataaataaagttttattggacctagccatgcctcttcatgtacatatgtctgtggctgctatcatgccatcgtggcagagttgagtagtttcaaccaacaccatatgtcctgcaaagcctcaagtatttgcttgtggccctttacagaaaaagttgaccaactcctgtgctgacaaatgaaatagctcagataggcctgtcagctagggctccaacacaggattgcraagtctcgcagcctctggccttgtttgcaatggttggataatttttcttcccattgtctaggccggaaggacttatgtgtttgagaggtttgtgttaggccattgatgacgcctcttttgaatgaaagggctgaccctctgaagtggctccagcccaggaaacaagccccttcctcttgtgtgtgtgtccttgccagagtgctggaactccgtgggtcctggatcattgttgtctgccttgtatattgcttccttcaattgaatttcagccctcaggttcccacagacagatcagtgttaatgatgttgataattatgataattatagataccctctgtagttaatttctatcaagcctaaaaatgtctctatcaaagaatctgatgtgttacygacgtcatcctgtttatttcttgcaacagccttaagaaggaaggaagggactcttattaacaatcccccctccctttttttttttttttttttttttgagatagagtctcgctctgtcacctaggctggagttcagtggcacaatcttgactcactgcaaactcctcttgcgttcaagcgattctactgcctcagcctcccgagtagctgggattataggcaagcaccaccacacccgactaatttttgtatttttagtagagacgggtttcaccatgttggtcaggctggtcgtcttgaactcctgacctcaagtggtccacccacctcagcctctcaaagtgctgggattacaagcatcagccactgtgcttagccctattagaacttcctaatattcttgtttttttttttttttggacagagtctcactctgtcaaccagcctggagtgcagtggatctcagctcactgcaacctccacctcccaggttcaagtgattctcgtgcctcagccttctgagtagctgagtagctgggattacaggcgcccaccaccacgcccagctaatttctgtatttttagtagagtcggggttttaccatgttggccaggctggtcttgaactcctgacctcaaataatccacccacctcagcctcccaaagtgctgggattataggtgtgagcccccgcgcccagccccaagataattttcaagagtgatccatgccataaggaaaatgtaatgagataatgtgttagcttatgaatggagcaggaagggcgacttctgctggggaagtcagggaagatctgtgtaaggacctgaaggatgcaaaggagcaagtcacaaggggacaagggaccagggtgctccacccagaacagcttgtgcaaggtcctaaggtagggctgagcctgggtgtgtgtgggtgggaggtgcagaaaggaggccagcctgggagaagaatttagcaagactggcagggattagaccccccaaggcctgtagggagttggcttttattctgtatgcctgaactgtctcgtctgggagacggtagtcatctgtggctagtaaacattggaattgtgtcaggcacagtggctcatacytgtaatctcagcactttgggaggctgaggtgggaggatcgcttgagccaggagttcgagaccagcctgggcaacatagtgagaccccatttctacaaaaaattaaacacttagctgggcgtggtggcgcatgtccattattccagctacccaagaggccgaggtgggaggatcacctgagcccaggagattgaggctgcagtgaactgtcactgtgtcactgtaccccagaacctaagtgacagagccagaccccatcacacacccaaaaaagaaatcgttacacattttatccatatgacaaaatatcacaagtaccccataaatgtgtaaaatattctgtatcaatgtaaaactttttaaaaattttaaactgaaattaaaatgaaatgcagttaaaagttttgttccttggtaaaaattggagccctggtacactgttggtgggaatgtaaaatactgcagctaggctgggcacagtggctcacacctgtaattccagtactttggggggccagggtgagtggatcacttgaggtcaggagttcgagaccagcctggccaacacggtgaaaccccgtctctactaaaaatacaaaaaaattagcggggtgtggtggtgggcacctgtaatcccagctactcgaggctgaggcaggagaattccttgaacccaggaggtggaggttgcagtgagccgagatcgagtcactgcactccagcctgagtgacagagtgagactccatctcaaaataaattttttaaaaaagaataaatcctatattattccacttatatgaggttcctagagtcatcagagtcacagagacagaaagtaaaatgggatgtcgggcgcagtggctcacacctgtaatccctgcactttgggaggctgaggcaggaggatcacgaggttaggagttcaagaccagcccggccaacatggtgaaaccccatctctactaaaaatacaaaaattagctgggtgtggtggtgggcgtctgtaatcccagctaytctggaggctgaggcaggagaatcacttgaacccgggaggcagaggttacagtgagctgagatcgcgccactgcaccccagcctgggcaacaaagcaagactccatctcaaaaaataaaaataaaaaaaaagaaaagaaaaagaaagtaaaatggcaggtgccaggagttggggaggaggatgagtgtgactgtttcatgggggcagagtttcagtttggttaaggtgagaaagttctggagatgggtggtggtgatggttgcatagccacataaaagtatttaataccactgaactatacatttaaacatgattacaatggtgaattttatgctatgtgtattttaccacaattaaaaaaaaaattggatttcctagttgcactaagcacattcagaagccacaggggagaagtggctactatgttggatggcccagatagagaacatttccgtcatcgcagaaatttcgaccagatggtgctgttcatatatggatgtagcttctggggccacttctgttccctgagtttggccggtgggatccactgtgctgagaatcacagtctggggatttggggtgaagaacactccccaactttctttcttattttttgttttgtttcattttttgttttgagacagagtctccctctgtcaccaaggctggagtgcagtggcatgatctcggctccctgcaacctcccctcccaggttcaagcgattctcctgcctcagcctcctgagtagctgggattacagacgcccaccaccacacccggctaattgtttgtatcatcagtagagatggggtttcaccatgttggccaggctggtctgaaactcctgacctcaggtgatccgcccaccttggcctcccaaagtgctaggattacaggcatgagccaccacaaccagccttttttttttccttccttccttccttttctctctctctttgtctctctctctcttttttttttttttttttttttttttttgacagaattttgcacttgttgcccaggctggagtatagtggcacgatcatggctcactgcagcctccacctcccagattcaagtgattctcgtgcctcagcctcttgagcagctgggattacaggcatgcaccagcacacctagctaatttttgtatttttagtagagacagggtttcaccatgttgaccaggctggtctcaaactcctgacctcaggtgatccacccgcctcgacctcccaaattgctaggattacaggcrtgagccaccacaccragccacatttgcatgtttaagtaactaacatgtctcctccattagaccttgtgctcccaaaggcaggatctrcagccactttttccccacagtggccacagtatctagattagtgcaagcaaatgtctgttgaagcaatcagtggtttgggggcaagttacttaacctccctgtacctcagtttccccatttgtaaaacaaaaaaataaaggagctaacagtgtatctacttcacatgtggggtgcagcagcatgctggagttggcttsctggagcyagtggtgaaattttcaggcaatttgtgagccatttgttaaacatagatattcataaaaattacataaacctacagttaaacaaattacattaaaaacaaaagtttttaaattaacaaagctttttaaaagtaacaaatactcaaaactcaccacctcctaatatcatacgatgttttcctattatttgtgctgttgaggttatttactacttttgtgtcaatagtagatacattttgtgtatacttataaatactacttagaggaatgctactgtgtatcttttgtcagcttatgtttagtaacttcatgttggtggcctgaaatccaccactggtaggaatatttacaccatggaaatcggcaaatgctatataaatctgggcctccctgggcccctccctcaggcagctgttaaacatttacaagctcaccaatggtttggaggcttaaaccagttaatagatgtgtctgacatgtgggtaatgatgtagacgtrccgcttttactgttagtgtttggttggctttcactgtcygatccagaattgctgcatatgcagacaggaattggacaaarccwtttatttatttatttatttatttatwtatttatwtatttatyycctctctctctctctctctctccagtttgcccgaccatctgtaagtcacacggctgcaccgccgaaggcctctgttgccrcagcgagtgcctgggcaactgttctcagcccgacgaccccaccaagtgcgtggcctgccgcaacttctaccyggayggcaggtgtgtggagacctgcccgcccccgtactaccacttccaggactggcgctrtgtgaacttcagcttctgccaggacctgcaccacaaatgcaagaactcgcggaggcagggctrccaccagtacgtcattcacaacaacaagtgcatccctgagtgtccctccgggtacacgatgaattccagcaagtgagttctggatgtgggtctggggggcagccgagaggagaaggaacgtggrgttggttgtgacgatgccgcttgttaaaactgtgtgcaaacccagggttaattggctatgagtgaggtctctgctctcagatgctacttttgcaccctgttttggtcctgggcttgggagtgggagttgactacctttttctctaaaggaccagatagtatatacttctggcattgtgcccaccattctttttttttttttttgagatggagtcttgccgcaagactcccaagctggagtgcagtggcacgaacctggctcactgcaacctctgcctcctgggttcaagcgattttcctgcctcagcctcccaagcagctgggactgcaggtgcctgccaccatgcccrgctaatttttgtatttttaatagagacagggtttcgccatgttggtcaggctggtctcgaactcccaacctcaggtggtccacctgccttggcctctcaaagtgctgtgattgcaggtgtgagccaccrcacccagtctggcattgtggacctcagttctaagctttctgtggttggcttcagaacaagaaaatataataaggacagagtccttggttttccctaaaatcctccacgtggcctgtcctcactgatgtagcttcatcattgtcacataaaggatataccaaggtctttcgtgtcttccctgacctgtagcctggtggtgtgccaagattagcccagaacatactgtctccaggaggaagagactcrcttctgcattattctcagggctttgctgttctctgaaggacagtataatcaaaccatttcctgccgtttgggtgagaaatagcagggttttctctcttcgacagagtcagatttcctacgcacatcgcagactttctgttcgtactgtgagcttcttccatgagctattttggggccgtaactgagttgcaaaaatctgtttcctggtttttgtattgaggttttatgttttgttttaaaamacacacacacacacacacacacacacacacacaccacaaaacaacacaaaaacaaatcagaaacagacacacatcaagaggccttgagctgacctgcttacgtaaagtatcttcctcttcagacttgagaattagccaagcgagagtgttggggtgggaaattgtatttccctgggtggagagggcgggaaggaaaacaagctgtaatttcagttcttatgactctttctttgagtgtttgtgaaacctgcaagtacaatatgttttgttttgctcgttgttgataaaaacctaccaaaaaaaccttttggctttattgaccaaaagggtctataaatcacctttkcataccagacagacttttgttttaggtttttttttttttttttggccagtgtattcccaagattgaggaaatgaccatattccttttgattcatttctttctttttaaaatcacaattgaaataaaaaaaatgggttaatatcttctggcaagatgtttgtttaaaagacattggccttaaataaaaggcatttttccctcaccttaacwatggcctgagaaatatagcaacctcctttgattttctcactgatgatgcgggagatgctaaaacagaaaccctgagaaattgaccgcacatccttggtatctgggacctttcctgaacggaagaaaacaaaggagaggggggtgcattgtcaccgtattttattgcgtaggtttaaaaaaattaatatttttatttctgaagcttttwattaattwatttatttattttgagacagagcctcactctgtcacccaggctggagtgcagtggcatgatctcagctcactgcaacctctgccttccaggttcaagccattctcctgcctcagcctcccaagtagctgggattacaggtgtgaggcagcaagcctggccaatttttttttgtttgtgcttttgtttttttgagatggagtttcattcttgttgcccagactgaagtgcaatggtgcgatcttggctcactgcaactcagcctcccgggttcaagtgattctcctgccttagcctctaagtagctgggattacagacatctgtcaccatacccagctaaatttttcttgtatttttagtagagaccgggtttcatcatgttggccaggctggtcttgaactcctgacctcaagtgatccacccacctcggcctcccaaagtgctgggattacaggcatgagccaccgcacctggcctgaagcttttctttttatcttatgaaagacttaatcgtactgtggcattttctaatgtggtttgatatcaaatagggccagatgttttcttccattctggtggcttatctgggaaggagttcttgatgttttcagagcagagttctgggaacccatgttaaaaggccttggccaggcacagtggcttatgcctgtaatcccagcactttgggaggccgaagtggacggatcatctgagggcaggagttcaaggtcagcctggccaccacggtgaaaccccgtctttactaaaaatacaaaaacaaaaaaaaaattagctgggcatggtgatgcatacctgttatcccagctactcgggaggctgaggcatgagaattgcttgaacccaggaggcagaggttgcagtgagctgagatcacgccattgcacgttagcccccaggcaagtgtgacaagagtgaaactgcatctccaaaaaaaaaaaaaaaaaggtctcaccatctactgtcgttccaaagtacctgctgggatgtaatagcacagtgctgcttcctgagatgagaaggaccagatatttgtgatgaataaattttcaatgcgtatggggtatccactgggaaggggagaattacctaaaatccttgattcttcttggcctctctcacttcttcctattaagctgaggtctcaaatttgtctacacctccatctatttcaccatcatgtctggtctgacccagtccccttgaacaatctctttgctcctgcttccattctagtgacactggtaaaaagtggccacctgggccaggcgcggtggctcacgcctataaccccagcactttgggaggccgaggtgggtggatcacctgaggtcaggagttcgagaccagcctgaccaacatggtgaaaccccatctctactaaaaatacaaaaattagccaggcgtgggattacagtgggcgcctgtaatcccagctactcgggaggctgagacagcagaattgcttgaacccgggaggtggaggtcgcagtgagccgagagtgtgccactgcactgcagtctcggtgacagagtgagactctgtctcaaaagaaaaaataaaagtggtcatctgatcatatgccatgtccttccctaaaaccctccggtggcttcccaagaccaatggacagaatccaaactcctcatcgggagggctcggccagttctcattctcatttcattccggtgccccctggccgtggtggtcgttaccgcaggagcttttcctgcaacttgctacatccgctttcctctgtgcctttcaattagctgttccctcttcctataatgcttgtccctgcatttgagaatgatccactttttcccctcgtcatctagatggcagcttaaaagtcacctccttggcaaatccttcccgtctgagtcaatcatccgtgcactctctgtcacatcatttagttttaactcttcgatttgtcactagctgatatttttgtcttttttttttttttttgagacaaggtcttggtctgtcacccaggctagagtgcagtggcacccacatggctcactgtggtctcaaccccctgggctcaagagatcctcctgccacagcctcctgagtagctgggactatataggcacacaccaccacacctggctaaaaaaaaattctgtagtgttgggggtcttgctatattccccaggctcgtcttgaactcctgggtttaagtgatcctcccaccttggcttcccaaagtgctgagattacagggcctgagccactgtacctagcctttgttgtcaatttattcactctccccaaccagatgataagctttgtgagtgtatcagctagctcttgttgcgtaacaaaaccacctcagtgcttagtggcttaaaacactcctttaggagctctgatgatttcatgtgttgactgaaggtttgtctggcctgggcctgtttagctacrgctgatggtttaggggagcctcttgtgtctttgatggtcagtgggggtctctctccataagtctcttaccccagcagccaggaagggcagacctcaatgttcaagtgcttttcaagcctcagcttgtatcacgtttgcaaatatwccattggccaaagcaagccatatggccaagcccagattcaacaggtgggaacatagactccacttcttggtgggagaggctgcaaagaactcatggtcatttataatttcccactgggaaagcatattatctgctttgttcactcatgtataccggcagctgagaacgggggttggccaagggccagatagtaaatattttcagctctcagggccatatggtctctgttggagctacttaactctgcctttgcagcgtgaaagcagggttagacgatgtactaaccaataaatgtggccatattccaataggatattatttgcaaaaacaggtggcctactggatttggctcccagcccactgtttgccaactccaggcttagagcattgcctgccacataataagaatagaggcaataaaagaagtcaaacatttggtcagtattttgtttctgcctcagctgttctgccactacctgggtgtacttgcaacaccgttctgacaccatcctcctccaaagttagcatcagacgccacaagtttaaggctcagccctccatgagatttcccttgcttcagacactggcagcatcttggggatcccccagccacmcacacttctgactaactggctctaaattgggggattcccacaaactgtttgggtttcataatttactagaaggaactcacagaatgaaaataaacctggccaggtgtggtggctcatgcctgtaatcccagcactttgggaggccatggtgggaggctcacttgagcccagaggttcgagaccagcctggacaacatagtgagatcccatctctacaaaaatttaaaaacattagccaggtgagggggtgcatgcctgtagtcccaggtacttgaggggcttaagcaggaggatcgcttgagcccaggagttcgaggctgcagtgagctaagattgtgccagtgcaccccagcccgggtggcagagcaagatcttgtctcaaatttaaaaaccctgctatacaattacagttttattataaaggatacacatacggcaagatctgggagagttctagatgcagaatttccatattgcctcctcgtggcaacagcatgtatcaccctcttgacatactggtgtgtccaccagctgggaagtactactgagcttcagcgtccagagtttttgtttgtttgtttgtttgttttgagacggagtctcactctgtcacccaggctggagtgcagtggctcaatctcagctcactgcaacctccacatcccaggttcaaacaattctcctgcctcagccccccgagtagctgggactacaggcatgcaccatcacgcacggctaatttttgtatttttagtagagacagggtttcaccatgttggccaggctggtctcraactcctgamttcgtgattcacctgcctcagcctcccaaagtgctaggattacaggcgtgaggcactgcacccggcccagtatccagagttttaattggagtctcattccttaggcgtgattgattgaaatcattgaccatgtgattcaacactgccatttccagccccctcatctccctggaggtcctaaaagccccaaccctctgatcacagggttgttctttctggtgaccgccccccaccctcatgttatctaggcacccccccccccacaagtcaccccgacattcctaacactcctaacaaaagcattcctgtgactcagaaagttccaagggtttttgaagctctgtgccaagaaccgggatgaagaccagatacatactttatgatcctacagtcacaaaaatcactctgaagagttgaatacccaggagtgtgagaacaacagcagcagcaacaaggatgccaccaataaaaaatgacccttgtagcaacggataaaattgcgttctgtgtgcgaagtgcttttgtggtatgcttcattgagttcctcatcacaagctgtggcgttggtggtgttattttcagatgaagaaatggagactgtaacagttgggaatcttgtggtttcatgcaccagaaccccaactcaaattggcttaactggccgggcacggttgctcacacctgtaatcccagcactttgggaggccgaggcgggtggatcacctgaggttgggagttcgagaccagcctgaccaaaatggagaaaccctgtttctactaaaaaaaaaaaaaaaaaaaaaaaaatacaaaattagatggggcatggtggtgcatgcctgtaatcccagctactcgggaggctgaggcaggagaatcacttgaacctgggaggcggagcttgcagtgagccgagatcgtgccattgtactccagcctgggcaacaagagtgagactccatcttaaaaaaarcaaaaacaaaaacaaaacaaaaaaaccattgacttaaccaagattaaaggagtttgttggtacccataaccaaaaagttcagggagttggttcaggtatagctgtatcaagaagcttaagcgatgtacctgatcagtctccttcatctttattttcctctttgttggttttgttatcaggcagcttctccctcacccttcaccccatgctagcaagatggcaaaacccttagatactccagaaggaagacaatttccccttccagcaygttctagcaaaaccctcactgcactgacttaagttctgtacccaccacctctgagcccccacaggaatagaaggtggtgctcagcttggcttggatcttgtgcccatcctggatctagaagggctttggcaaccaagaactgatctcagagaccccgtgttggggaggactggttcccaaaggactcctgggggctgtgagtttgatggcatcaggctgcaggctggcaaaaccaaaggctgcccaagtcacttgccattaaacatggggtcatgttacagccgtagttgcatcacatcccacacagaacagcaaatgtcctgtctccttggagtagcaggttgaattctgccacgttggggtaactgtcagttctgccacatcaggcccatcatctcaaggtaacggcacattcttattaccacatgcattagtccatttctgcactgctataaagaatacatggaactgggtaatttataaagaaaagaggtttaattggctgacagttctgcaggctgtacgggaagcatagcagcttctgcttctggggagacctcaggaaacttacaatcgtggcggaaagcaaaggggaggtaggcacatcttacatgactgaaggaagagagaaagggggaaggtgctacatagttttgtttgtttgttttgagacagattctcactctgtcacccaggctgggctgcagtggcacaatctcggctcactgcagcctccacctcctgagttcaagcaattctcatgcctcagcctccccagtagctgggattacaggtgggcaccaccacacctggttaatttttgtatttttagtagagacggggtttcaccatgttggccaggctggtctcgaactcctggcctgaagtgatccgctcgccttggcctcccaaagtgccggaattacaggcatgagccaccatgcccggctggtgctacatacttttaaacaaccagatctcgtgagaactcactcactatacactgccaaggggtatggtgccagaccattcatgagaactccgcccaccatgatccagtcatctcccaccaggccccacctcccacattggggattacaatttgacatgagatttgggtggggacacagatccaaaacatatcgccacgataatgctatgagtcccattgctgtcacgcacagggtagatcatggtcctgcctccatgggatatggtgtgaatcccatcactgtggggtccagcaggagtcctgtcccatcactttggggtaaaatatgagtcttgtcactttggggtaaaagcaagaggacctgcaaccatagggtaatggcataattctctcacttaaggcagtggttcttttctggggacaatctggcatcctccctccccaggggacttttggcaatgttgggagactttttttttttttgagatggagtctgactgtgtctcccagctggagtgcagtggtgctatctcggctcactgcaacctctgcctcccaggttcaagcgattctcctacctcagcctcctgagtagctgagattataggcacgtgccaccacacccagctaatttttgtatttttagtagagacagggtttcaccatgttggccaggctggtcttgaactcctgacctcaggtgatctgcccgcctcggactcccaaagtgctgggattacaggcgtgagccactttgcctggcctggaggacatttttaattgccacaacttgtgggagggatgctactggcagctcgtgagtggagcctagggatgccgctcaatatcctccaatgcataggacgccacccccactaccacagtggagaattacttggccccaaatgtgaacaatgctgaggtcagaagaccttgccgtagcatgatggacttatgccatcacttgagaccctgcatagtgtgctgtcttcccaggctgatcttgaactcccaggctcaagcaaccctccctccttggcctctcaaagtgcaggaatgacaggcaggagccaccacgcccggctccagaatctacatttttaacaatcaagcgatatgtcctattgcagatcggcagactgtgttttcagaaatatcatctcaggcagaaagggccgggtgcagtggctcacacctgtaatcccagcactttgggaggccgaggcgggtggatcacttgaggtcaggagtttgagaccagcctggccaacatggtaaaaccccgtctctactcaaaaatacaaaaattagccaggcacggtggcgggcacctataatcccagctactgtggaggctgaggcaggagaatctcttgaacccagaaggcagaggttgcagtgagctgagatcgcaccactgcactccagcctgggcaacagagcgagactctgtcacacaaacacacacacacacacaaagaaataccatatcaggcagaaagatgcctgagatgtctgaaggaccttggataccgtgacacccccctcccctttctctttctctctctctctgctccgtccttagcttgctgtgcaccccatgcctgggtccctgtcccaaggtgtgccacctcctagaaggcgagaagaccatcgactyggtgacgtctgcccaggagctccgaggatgcaccgtcatcaacgggagtctgatcatcaacattcgaggaggcagtgagtgtctctgtgtgggcrtcgggggtgcctgttgggctccatgtccctctgagctgtgagcggggaagaaaagcagtgcagaccctgctgcgtgctcctacagcacttttaggatggtcgttcagtggctcccccatggatagaaccatgctgggagtctgcctcaaaacctgaaatgaacagctcagtcttggccttactaaccttgagattctcattttctactttgggagttggggcatcaggaatctgcatttacatttatttttatttttatttttatttttagagatggggtcttgctctattgcccaggctggagtacagtggggcaactctagctcactgtagcctcaaactcttgggctcatgcagtcctcctacctcagcctcccaagtagctgggagtacaggcaggtgtcactgtgccgggctaattttttttttttttaatttttttccagggccaggttctcactatgttgcccaggctggtctcaaactcctgggctcgagcaatcttcctgcctcagcctctcaaagtgcagggattacaggcatgagccaccccacctggctttggaatcgtcgtttttaacaatcaagcaatatgccctattgcagaactgcaggctgtgttttcagaaataaatctcagggccgggtgcagtggctcatgcctgtaatcccaacagtttgggaggccgaggcaggtggatcacgtgaggtgagaagtttaagaccagcctggccaacatggtgaaaccctgtctctactaaaaatacaaaaaaattagccaggcttggtgrtgcgtrcctgtaatcccagctacgcaggaggctgaggcaggagaatcgtttgaactcaggaagtggaggttgcaatgagctgggatcrcgccactgcactctagcctgggcgacagagtgagactccatctcaaaaaaaaaaaaaaaaaaaaaaaaagccaggcgctgtggctcatgcctgtaatcccagcactttgggaggctgaggtgggcggatcacttgaggtcagaagtttgagaccagccaacatggtgaaaccttgtctctcctaaaaatacaaaaattagctgggcacggtggcacatgcctgtagtcctagctacttgggaggctgaggcaggagaatcacttgaacctgggaggcagaggttgcagtgagccgagatcacaccactgcactccagcctgggccatagaccaagactccatttcaaaaaaaaagaaaagaaataccatgtcaggcaaaaaggcattcctttgtttatttctttagcgaacatgtactgaatactcacagtgagtaagggaaagtccttaccttgatggatttttgcgcataagtaaatcgacagatattgtaaggtcaggttgtggtctgtgctgtgaaggsaagtgcagcagggtaataggtggaatggaaatgggcaacttttccctataaagggctctttcatgaatatattcagcctggcaggccgggcagtctctgccgtaaccactcaactctgccgttgtaatatgaaaacagccatagacccatgtcagctagcaggcatggctttgttccaataaaactttatttacaaaacaggtagaatttggccagtgggctgtcatttgtcaacctctaaaatggagactaacaggggttgctatttttttttttttttgtagttttagtagagacagggtttcaccatgttggccagggtggtcttgaactcctgacctcaagtgatccacctgcctcgccctcccaaggtgctggtattacaggcatgagccaccagcaccaagctgggggttgctattttagagaagtctctggtatgggaaaggagggtttgagatgatgatggaacaagccaaggagatatatggtggaataatattctgagcaacagacgcagccagtgccaaggtcctggggcagaagtatgcttgacccatttaaggaatgctaaggacttcagattgtgttctaagcatgatgagttttgagctgggtatgtccagtcatttgcagcctgagggttatcttctcaccatggagaatcatgagaagattgaaatatgtctatagaaacccactggatattctctcctttccttagacaatctggcagctgagctagaagccaacctcggcctcattgaagaaatttcarggtatctaaaaatccgcygatcctacgctctggtgtcactttccttcktccggaagttacgtctgattcgaggagagaccttggaaattgggtacgtgggcctgattgtgtgtatggcctgagtgctaactaggaagttcgtgtattagaacaacttaaggatttttttggccaggtgtggtggctgatgcctgtaatcccagcattttaggaggccaacgtgggtgaatcacttgaggcggggagttcaagaccagcctggccaacatggtgaaaccctgtctctactaaaagtacaaaaattagccaagtgtgatagtgcatgcctgtaatcccagctacttgggaggctgaggcaggagaatagcttgaacctgggaggcagaggttgcagtgagccaagatcacactactgcactccagcctgggtgacagagtgagactctgtccaaaaaaaaaaaaagaaaagaaaaggaaaaacttaaggattttttaaaaatcaaataaaaacaaataaaaaacaaataaaagtatatctggcaaaacctcgggaaaaaagaacttggaatgtgcctaaaggtccatccagccaaaaattgtaaaagcttttttatagtcattcttgagaaacaaaagtgggagcagcccaaccttggtgcccatcctccaagggtacaggctggaatttttgctaaatttgctgtttgggctgcattgtgagtagagtttggcatgcataaaatgaacattccctcttagtccyggttgtccatcctaatttctgggatggactccatctcagtatattccagtatattccaaccttctccttgaggtcctagaaactctattagcaaaacagcagaaactcaaactagctagatcaagattgactcataggcaggaggtctgtggaagacccagattctttccatctttgtgctcctcatggtcacaagatggctgcctcagccccagcctcacatctgtagaacagacagcaaatggggaaagggacaaaaggacatgttaatcaacatgagctggtaagtgacttgagaaggtggtctaaacaatatagtttagactatattatctgtactccagcctaggcaccagagtgagaatccatctcaataaaacaaacaaacaaacaaacaaaaaccttcaatggctcctttctccttattaaggatggccacatgttcttggtcttggtctggcatgcaatatactagagggtctggtccattgcaactacagctatttcctgtcacctattggccaaaacaggctactttgctcttccctgaactcagcttaggtgcctctgtgttatcagtatttcccctatttgcagaaattggtttctgcaaaacctattcctcagtccatcacagactcaccacccctcttcaagactgagctgagcctccttcctggccatgaaaacttcytcaacttcctctgttatccacattcaacaaatatgtgttgagtatgtgccaarcaagtggagaggattaggcaygtagcactgaacaagatcaactccgagcatggccacaccatcttggagttgtagaagaccagccgttgaatgactagatgtgtgtgttttttccataggaactactccttctatgccttggacaaccagaacctaaggcagctctsggactggagcaaacacaacctcaccaycactcaggggaaactcttcttccactataaccccaaactctgcttgtcagaaatccacaagatggaagaagtttcaggaaccaaggggcgccaggagagaaacgacattgccctgaagaccartggggaccaggcatcctgtaagtcactggtccccaacctttttggcaygagggaccggtktagtggaagatggtttttccatggactggtggtgggtggggatggtttcagcatgattcaagtgcattacatttactatgcactttattcctattatgattacattgtaatatataatgaaagaattgtacaactcaccatcatgtagaatcaatgggaaccctgagcttgtgttcctgcaactagatggtcccagctgggggtgatgggagacagtgacagatcatcaggcattagattttcataaggagtgtgcagtctagrtacctcatgtacacagttcacaatagggttcacacccctgtgagaatctaatgccgccgctaatctgacaggaggcagaactcaggtggtcatgcaagcgatggggagtgactgtaaatacagatgaagcttcacttgctcacctatcactcacctcstgctgtacagccctgttcgtaacaggccatggataagtactggtctgtggcccaggggctggggacccctgctgtaagtggtccacaaaccagataatgtggctgtcctctctcatccatcacagtcacycccagggggtattacttccctctaacaactcactgtgtgataggctttcttactgagggcagattctgcacatttattaatattatcactatgcttactgtgccatatagtaccggatacgggatgaagtcatacaagcactgaatgaatggatgaatgaatgatggatgaatggatgacaccttcttatatgtgtatcaggctgatgctgaagacttcaaagttgagtaaaatacctatgtcagtctgcatctcctgggaagtgactgccaagttgaagttaggagtgcagaaaatgtattgagggtaatattcataaaatatgaaacagaggaagagcttcttttttttttttttttttttttgggacagagtcttgctctgtcacccagggctggagtgcagtggcgtgatcttgcctcactgcaacctccttcccctgggttcaggtaattatctcgcctcagcctccagaatagctgggattacaggcacatgccaccaagcccggctaatttttttttttgtatttttagtagagacagggttttgccatgttggccagggtggtcttgaactcctgacctcaggtgatcctcccgcctcggcctcccaaagtgctgagattacaggtgtgagtcaccacgctcagccatgaagagccttttgacaatagcgtgtgtctgacctctgtgaacagagagcgggaaggagggaggatagggctgggagagtctcagatggtgatgcatccctgagtcttggccaaacccagaaagagatcaaggccacggttgtctgcagggaagttctgcattgcaaagggacggccaggcatctaccaagctcagtcatagktgggggctgtccagggagagtcaggttttggctggaatgctacagcaggtcctgcagtttctgcagctgcaggctgcctgctgactgcacttccctgacagattctaaacagtgagctgccaagggcttctgggataccttcatggggagttagttacttaygtcaaaatgtagtgcaagggctgggcatggtggctcacgcctggaatcccagcactctgggaggccgaggcrggcagatcacttgaggtcaggagttcgagaccagcctggccaatgtggtgaaactccatctctactaaaaaaaaaaaatacaaaaactagctggacgtggtggtgggtgcctgtaatcccagctacttgagaggctgaggcatgagaattgcttaaacccggtaggtggactgcactccagccttggtgacagagcaagactgtctcaaaaaaaatgtagtgcaaggagagagagcgaggttggggtgaggtttaggagagggtttgtcttctaggcagagagaattacttagatgcgtctctccgatgtctaatgatctgcagggtctctaaactcacttggcataggtttatttgcactggagttgcacctccttccaggtcagtcttacaagtccatatgcgagacaacgttgtgtcaggacaaacatcacccttggaaatcccttcctccartaactattggccggttgtccttcttgcgygggtacagactgcgcttattcagttgactgtctggctgagtcaagtcattggcttacgtgagtgtgagtggccaagttgcaaaactggctcttacctttgaatcttcccccattcatactcagccaggcacatggggaggagacccttaagggaatagcagcstcacctctgccttctcacggtccctccaggaagtgtgggggtcccaggctttggtctgaaactacactgaaatagctcatttttgccttttgttttaacttttccaggtgaaaatgagttacttaaattttcttacattcggacatcttttgacaagatcttgctgagatgggagccgtactggccccccgacttccgagacctcttggggttcatgctgttctacaaagaggcgtaagtagaagagttagagagaygctgmggaggcgagggctggctggctctgtgcttgctacgtttgtgctccaatctgcccctcttgggttcctgtctatctccctcctcctcctggaataaatatcttaggttcctttttacaatctcaccagtcgatgkcatgcaaagtcaatagtgtctgcttttatcaaatgcctaaaatggaagcagacagctttcccatagaagcccggactggccagtttcctggggcaatattcyattttgccttgcctgtgtatgtctcatcagacatccttagtagtcaggagctcagtctactaagtggatgttatcaaatgtattgcttatctatttttcttttttatccccaattttttttttttttttgagacagagtcttgctctgttgcccagggtacagtgcagtggcagatcttggctcactgcaacctctgcctcccgggttcaagcagttctcctgcctcagtctcttgagtagctgagattatgggcatacaccatcacacgtagctaatttgtgtatttttgatagagacgggttttgccatgttggccaggctggtctcaaactcctgacctcaggtgatctgcccaccttggcctcccaaagtgctgggattacaggcatgagccaccgcacctgaccagtagtaatattaataatagttctagccctcaagatttaccttgtgccttgctgagcactgacacacagtctaatcttatcagtaacttgtgagggagctcctgctattactattattacagattgagtatccctaatctgaaaatctgaaatttataatgctccaaaatccaaagctttttgtgggccgacttgatactcaaaggagatgcttattggagcatttcagatttcagatttttagattagagatgctgaaccagtacaatgcaaattaactagtaaaatgcaaatatttcaaaaccccaaaatatccaaaatccaaaacacttctggtcccaagcatttatttatttatttatttatttatgtttttgaaacagagtctccctttgtcgcccaggctggagtgcagtggtgcgatctcagctgatgctacctctgcctcccgggttcaagcaattctcctgcctcaacctcctgaatagctgggattacaagcatctgccaccatgcccagataatttttgtatttttagtagagacggggtttcaccatgttggccaggctggtctcgaactcctgacttctggtgatccgccattctcggcctcccaaagtgctgggattacaggcgtgagccactgcacttggccaagtctcaagtgttttgaataagggatgcccaagctgtgttttttcattgagatgtcagggttgacagttcctttctctttggctgttcccgagttattttttcttgyggcattagattgttgggtgagtaacatgtgaccctatgggatgtaacttcccaggcctcatctgcacggcactcagtgtgacggtcttgtaagggtaactgccttctgctgttttgtcttgaaagcccttatcagaatgtgacggagttcgaygggcaggatgcrtgtggttccaacagttggacggtggtagacattgacccacccctgaggtccaacgaccccaaatcacagaaccacccagggtggctgatgcggggtctcaagccctggacccagtatgccatctttgtgaagaccctggtcaccttttcggatgaacgccggacctatggggccaagagtgacatcatttatgtccagacagatgccaccagtgagtgtgtcttgggaatgtgaattygtatgtgaatcagacctcttgcttttaayaggctgatgcagtgaggttgtataaaatgctccttgatatggttattggctttttttttttttttagacagggtcttactttgtcacccaggctagagtgcaatgcagtggggtgatcatggctcactgcagcctcaaactcctgggctcaagcaatccttctgcctcagcctcctaagtagaaggaactaccagagtataccaccatgtgtggcttttttttttttttttctttgagatgaagtctcactctgtcacccggactggagtgcaatggcatgatctcggctcactgcaacctccgcctcccaggttcaagtrattctcccacctcagcctcctgagtagctgggactacaggcatgcaccactatacccagctaatttttgtatttcttgtagagacagaacgttgctgtgttacycaggctggtcttgaacccctggcctcaagtgatcctcctgcctcggcctcccaaagtcctgggattagaagtgtgagccaccttgcccagtcagttattggcttttaaaggagctgggtattgaggcttatagtttcagacgaggcagtagcaacaagccacttgatgggaatatttatatttttcatcctattatgaaaaattgtcaaatattcacaacacagaacaaaaccccatagttagccgcctcccagcttcagcctttggtcatttttgtttcatctcgacgcctgttccctcttcccacttgttacttctttttgttttgttgtttgttttggcctggagtatttcacagcaatttaattatgtttgtttgtttgagatggagtctcactctgtcacccaggctggagtgcagtggcgccatctggactcactgcaacctccacctcccaggttcaagtgattctcctgcctcagcctcccaagttgctgggattacagcacacttggctaatttttgttttgttttgttttgttttgttttttgagacagagtctcactctgtcactgaggctggagtgcagtggtgtgatctcagctcactgtaacctccccgtcccagttcaagtgattctcctgcctcagtctcccaagtagctgcaactacaggcgtgccaccacgcccagctaatttttgtatttttagtagagatgggatttcaccatgttggccaggatggtctcartctcttgacctgcaatctgcccaccttggcctcccaaagtgctgggattacaggcatragccaccatgccagccttttttttttttttttttttttttgagatggagtttcgctcttgttgcctaggctggagtgcaatggccctatctcagctcactgcaacctctgcctcccgggttcaagcgattctcctgcctcagcctcccgagtaactgggattacatgcatgcaccaccacgattggcgaattttttttttttttttttttttgtagagacaaggtttctccatgttggtcaggctggtctcgaactccgagcctcaggtgatccgcctgcctcggcttcccaaagtgctgggattacaggcatgarccaccgcgcccagccatttttgtatttttaatagagayggggcttcaccatgttggccaggctgctctggaactcctgacctcaaatgatccrcccaccttggcctcccaaagtgctgggattacaggcatgagccactgggcccggcctaattatatttttgtaaaacctaagtgcttctcttatagcagtagttcccaaaggaggttaactgctctgccagggaacagctgccaatcaatgtctggagacatttttggttgttacagctgtggagatgaaaccactggcatttcgtgggcggaagccagagaggctgttccatgtcctgcaacacacaggatgcaccctccttcatgacaaagaattatccagtcctaaaagccaatagtactaagggtgagaaaccccgtcctgtaggctcaaattcaagcttttttttttttttttttttttttttaacggagtttcactcttgtctctcaggctggagttcaatggcgcattctcagctcactgcaacctctgcccaggttcaagattctcctgcctcagcctcccaggaagctgagattacaggcgcccaccaccatgtccagctaatttttttttttttttttttttttttttttttagtagagatagggtttcaccatgttggccaggtgtagtctcgaactcctgatctcaggtgattcagatgattcgcccacctcggccttctaaagtgctgggattacaggcatgagccactgtgcctggcctcgaattcaaactttataaatcaaccctatcttcttcagttaatccccgctcattcatcctgtatcttttagtgacaccaaaagacttacagttttcagaaacttctagctcccaggtgtttggactccctccccatccccagctccctcggccacctccgttactttgggttttttgggttttgtttggttggttggtggkggttttttttttcttttttgttttgttttgttttgagacggactcttgctctgtcacccaggctggagtgcagtggcgcaatctcggctcactgcaagctccgcctcccaggttcacgccattctcctgcctcagcctcccaagtagctgggactacaggcgcccaccaccacacctggctaattttttgtatttttagtagagacggggtttcactgtgttaaccaggatggtctcgatctcctgacctcgtgatccgcctgccttggccgcccaaartgctgggatgggtgccctcatgatgtctttaacttgtgtgtcccccgccatcctcccaccagctttctttgcacactgtttctcatgatggacccrtttcctttctccctgrcagacccctctgtgcccctggatccaatctcagtgtctaactcatcatcccagattattytgaagtggaaaccmccctccgaccccaatggcaacatcacccactacctggttttctgggagaggcaggcrgaagacagtgagctgttygagctggattattgcctcaaaggtgagtgcaggcagctgtgctaggatcggtggggtttgcacacgtgtgtctgatgcactttgcttcacctctagggaagcagctatctcttccygtgtctcagtgtcggaaggcacacacacacacactcmattctatctcatatgaaaacacacatacatgtttttatctatttatttatttattttattttttatttatttacttttttgagatggagtttcactcttgttgcccaggctggagtgcaatggcgcgaccttggctcatcgcaacctccacctctcgggttcaagtgattctcctgcatcagcctcccgagtagctgggattacaggcacgcgccaccacgcccggctaatttggtatttttagtagggacggggtttctccatgttggtcagcctggtctcaaactcccgacctcaggtgacctcaggtgatccacccaccttggcctcccaaagtgctgggattacaggcatgagccaccacacccggcctattttttttttttttttgagacagggtcttactctgttgcccaggctggagtgcagtggcatgatctctgctcactgcaacctccacctcccaggctcaagcaatcctcttgcctcagcctcatgagttgctggaacaccacaattgtctgcaggtgtgcaccagcatgcccaggtaatttttttttttttttttttttttgagacagggtctcactctgtcacccaggctggagtgcagtggcatgatctcggctcattgcaacttctgcctcccaggcgcaagcgattctcctgcctcaggctcctgagtagctgggactacaggcgcctgccaccacacccggctaatttttgtatttttagtagagatggggtttcaccatgttggccaggctggtcttgaactcctgacctcaaatgatccacccgcctcggcctcccaaagtgctgtgattacaggcatgagccaccacgcctggccctggctaatttttaaacttctttttgtagagatggagtctccttatattgcccaggctggtctcaaactcctggcttcaagcaattcacccccctcagcctcccaaagcgctgggattacaggcgtgagccactatgaccggctcatacatacacatttttaaacatcgtaacacaagcacgcactgaagacttgtgtcaaaaccasatttttcccatgtcttggcaccatttccctctgggattttctcctcttgtctctccttctttctccctccctgccttccttgttctcttcatccctcctcacactgatggggatgcagctgtgttaacccacgcaagacttctgtgcaaagctagaaacacaactaatggttattgacaaagtcagggaaggattttggccccactgagatcctttagttgtaaggatcgaaggcagcaagaattggttatctcatatcccccaccccatactttcaattaaaaatgtctgccaggcttggcgctcatgcctgtaatcccagcacattgggaggccaaggtgggaggatcactggaggccgggagtttgagaccagcctgggcaacatagcaagatcccatctctaaaaaaatttaaaaaaatggtggtgtacacctgtagtcccagttacttgggaggcccaggcgggaggatctcttgagcccaggagttcaagtctgcagtgagctatgattattccagtgcactccagcctgggtgacagagcgagaccctgtctctatatatataaaaaaaattatacaaaattaaaaaaaaaaggcattaagtgcattcacaatgttgtgcaatcattttattgtataaaaattataaataaaatttataaataattatataaataattttattataaaacttaatgacaaatttttcttaatcttgtttacttaatagacctccatccatctgaaggaaaatggaataatatttaaagtctcaaactagtgtgtatacattagtttaaaattattattattattattttctttttttttttttttgacacggagtctcactccgtcacccaggctggagtgcagtggcttgatcttggctcactgcaacctccgcctgctgggttcaagcgattcttgtgccttagcctcctgaatagctgggattacaggtgctgccactacaccggctaatttttgtatttttagtagagacggggtttcaccatgttggccagggtggtcttgaattcctgacctcaaatgatccacccgtctcagcctcccaaagtgctgggattacaggcgtgagccaccgcgcccagcctaaaattattttaacattgggtttttttagaacccaccaaactggagaagcatctgtcacttttttctttttctttttcttcttcttttttaagatggggtctcactctgttgtccaggctggagtgcagtggcacaatcatagctcactgcaggcttgaactcctgggctcaaacgatcttcccgcctcagcctcctgagtagctggactacacaggactacaggcctgagacactatacctggctaattatttaaaataattttttaggccgggcacagtggctcatgcctgtaatcccagcactttgggaggccgaggcgggtggatcaccaggggtcaggagtttgagaccaccctggccaatatggcaaaaccccgtctctactcaaaatacaaaaattagccaggcgtgggcctgtaatcccagctactcaggaggctgaggcagaagaatcgcttgaacccgggaggtggaggttgcaatgagccgagcttgcaccattgcactccagcctgggtaacaaaagcaaaactccatctaagaaaaataataataataaaaataataataattttttagaggtggggatcttgatatgttgcccagggtggtctcgaactcctgaccacaagcgatcctcctgcctcagcctcccaaagtgctggtattacagacctgagccactgcgctgggcccatttccttctttagttttggtttccttgtgcatcttgatgtatttttcttgagatattttctgttagtgatatcctcggtccatgaccctggaggagaaggccagggggccactggcgaggtgtggctgaggccaggagctcaacatttgctcttggctctggccctgacctgctgaagggctttggctaagttcccaagcaagtcaccgtctgcctcctttttgggagaaggggcgggaggacagatgatctctgggagctgtcccagctctaagctcatatgctatatgtatgtgtgtgacatcatccccgcctgagccgagggttgcaaacgtgatttatctgctctgatgctttatataactccagggcgagtccagtcatcagctccgctgtaagctgttggccctgcattcaagtaaccagaaccacccgtgagagctgccaccagtaatgtcactcgaagcttccttttttttttttttaattccgaaagtctaaatctgtaattaccaagggaccatttaaacatggttttatttgtaattgtcacaaagttaatatcattaaaaggaaactcactaaggacaaattctgtgtgatttcactcctaggaggtccctagagtcctcagattcatagagacagaaagtagaatggggagtgccagggactgcggaggggacgggttgaggacagagtttcagtttgggaagatgagaaagttccggagatgatggtggtgatgattgcacaacattgtgaatgcacttaataccacagaactgcacacttaaaatggttgagatttaccgggcacagtggctcacgcctgtaatcccagcacactgggaggccgaggtggggtggatcactttgaggccaggagttcgagaccagcctgggcaacatggtgaaaccccgtctctactaaaaatacaaaaattagttgggtgtggtggtgggtgcctgtaatcccagctactcaggaggctgaggcaggagaatcgcttgaatctgggaggcagaggttgcagtgagccgagatcacgccattgcactccagcctggcaacagagcaagactccaccaaaaacaaaacaaaacaaaaattgagatggtaaattggtatattttatgtgatgcttatttttccacaatttcaaacacacacacacacaaataaataagcttacaaacccttcctgttaatatcactagtgtatatgttgttaccacggtaaaatatacatcacatacaatttattattataaccatgtttaagagcacagttgagctgcattaagtgcattgccgtggttgtgcggccattaccaccatcatctccagaactttctcatcttctcaaactgaaactctgtccccatgaaacactcactccccttctccttcccccagccccagcacccaccatcctcctttctgtctctgtgaatctgattctagagacttcattatgctcatttttcttttcttttctttttatttttttgagacggagtctcgctctgtcacccaggctggagttcagtggcgtgatctcggctcactgcaagctccgcctcccgggttcacgccattctcctgcgtcagcctcccgagtagctgggactacaggcgcccgccaccacgcccggctaattttttgtattttttagtagagacggggtttcaccatgttagccaggatggtctcratctcctgacctcgtgatctgcccaccttggcctcccaacgtgctgggattacaggcgtgagtcaccgcgcctggcccattatgcttcatttttctaatctcaggaaaaccacagtgtaccatgtttcatgcagtggattctaggaagaggtagcaggtatcaggaatgatacctgtgcctgaacaaatatcccttcctctccaaataataataataataataataatagtaataataataataataccaggagcttcccttattcaggcagttctacatttttttttccatctgtaatgctgtaactagctcccatcagagttaacccaggcagggtattctmtgtctatttataaacttaagaagtattttccagtctctcataggcttttaaagctgtgtaaatacttgggtttccgagtggatactcaccattcacaggaaggtacttgatacacratttagagcttattgtctatcctcgaggcattaaggggaggagagaaaatggaatttcytttgctcagcagtcaccaggcaccaagcagggtggcagcaggggaggtggctctccagggactgttgcagattttgcttgtaaagagctgtgtccgtccatctcagtggctgtaccagaggcataactgtgcttgcaccgtgggtcacaagaaccctgggatttgacttcggggcttaagacatgaccagctgcggtacttaagtattgtaggctgggtgcgatggctcatgcctgtaatcccagcactttgggaggccaaggcgggcagatcgttcgagctcaggagtttgagatcagcctggccaacacagcaaaactctgtctctaccaaaaaaaaaaaaaaaaaaatacaaaaatcggctgggcgcagtggctcacgcctgtaatcccagcactttgggaggccaaggcgggtggatcacctgaggtcgggagatcaagaccagcctggccaacatggcaaaaccccgtctctaataaaaatacaaaaaaaatgccaggcgcagtggctcaagcctataatcccagcactttgggaggctgaggcgggtggaccacctgaggtcaggagttcagaccagcctggccaacatggccaaaccccgtctctactaaaaatacaaaattagccgggcatggtggtgcacgcctgtagtcccagctacttgggaggctgaggcaggagaatggcgtgaacccgggaggcagagcttgcagtgagccgagatagcgccactgcagtccggcctgggcaacaagagcgagactccatcccaaaaaaaacaaaaacaaaaaacaaacaaacaaacaaaaaattagccaggtgtgatggtgcatgcctgtaatcccagttacggggagtggagctgagacaggagaatcgcttgaacccaggaggcagaggttgcagtgagccaagattgcgccactgcactgcagcctgggcgacagagcaagaccccatctcaaaaaaaaaaaaaaaaaaaaaaaagagagaaatagtattgtattttgtatttttaggactgctacctttataagctactggtgttcttcttcatttattaatttttaaattcccttttctatgcatgtttgaaaagttccttcctctatctcctctcatgcctttaggtcagggtttctctgtcttggtgttttttctgtctggcgttggatcattctctggggtgggactgtcccgagcacttcagggtgctcagcagcatctctggtcttcacccattccatgctccaggaggacgccccagccaggtcctgacacctaaaaatatctccagatgttgcccaatgtccctagtaggagacaaaatcaccccctgggtgagaaccattcactgatcaagtctgatttctggactcatgaatggaccccttagaattccatgtggaggcccagtgtggtgacccaggcctgtaattccagcactttgggaggccgaggtgggcagatcacatgaggtcaggagttccagaccagcctggccaacatgatgaaactctgtctctgctaaaaatacaaaacattagccagggtggtggcaggcgcctgtaatcccagctacttgagaggctgaggcaggagactcacttgaatccaggaggcggaggctgcagtgagccaagatcacgccactgcactccagcctgggcgacagagcaagactgtctcaaaaaaaaaaaaaaaaaaaaaaaaaaaagaattccatatggmattctactctgccctcccatcttatttgtgtggttgattaattgattgattgatattttcatgcagctgtgacctggctccttctcctcctccttcttctccttcttctttctttttcttcttcttcaacatgatttcactctgttgcccaggctggagtgcagtggccccatctcagctcactgcagcctcgacttcccaggctcaagcaatcctcctacctcagcctcctgagtagctgggattacaggcgcacaccaccatgcctggctaatttttgtattttttggtagagacggagtttcatcttgttggccaggcttatcttgaactcctgggctcaagtgatccttccccctcagcctcccaaagttctggtattacaggcaagagccactgtacctggccccctttatctttttctaaccccctcccaccattctctctctcacccccttccagctatattggtttccagagatttttttttttttttttgagagatggaatgcttcctctgtcacccaggctggagtgcagtggcgcaatcttggctcaatgcaacctccgccttccaggttcaagtgattctcctgcctcagcctcccaagtagctgggactacaggcatgtgccaccacgtgcagctgatttttggattttttagtagagacagcgtttcactatatgttggccaggctggtctcgaactcctgacctcaagtgatcctcctgcctcggcttcccaaagtgctgggattacaggagagggccaccacgcctggccagacgttttttaatgtgccaagaaaattcctgtcctggggcctttctgctgggtttctgctatgtctgaattgctttacaccacgatatgtggatggtgctttcctttgctgaattcaggatgtctcagtggtgactttctttgagaccccttcatgaaaatggcacccgcagacacccactgttcttttaccccaacatctgacctgtgactgtgtatttatgagtttattgtagactgtaagtccactgaagacagaagcattgtctggttaccttataatcttcagtcctgtgattatggtgtcgggcagttgttgcctttttttgagacagagtctcgctgttgtcgcctaggctggagtgcaatggctcaatctcggctcactgcaacctctgcttcccgggttcaaacaatcctcctgcctcagcctcctgagtagctgggattacaggcacccaccaccacgcccggctaacttttgtattttgagtagagacggggtttcgccatgttggctaggatggtccggacctcctgacctcaggtgatctgcccgcctcggcctcccaaagtgctgggattacaggagtgagccaccgcgcccagccacctggcagtttctattaggttggtgcaaaagtaattgtgggccgggtgcagtggctcacgcctgtaatcccagcactttgggaggccaaggcgggcagatcacgaggtcaggagatcgagaccatcctggctaacacaatgaaaccccatctctactaaaaatacaacaaattagccgggcgtggcagcggccgcctgtagtcccagctactcaggaggctgaggcaggagaatgccatgaacccaagcggtggagcttgcagtgagccaagatcgcgccactgcactccagcctgggtaacagaacgagactccatctcaaaaaaaaaaaaaaaaaaaagtaattgtggttttttgccattacttttaatagcaaaagctgcaattacttatgcactaaactaataaaacatgttgacatgcacttctcagatgacactctagatacagatattttatttatttatttattatttttttgagacggagtctcgctctgtcacccaggctggagtgcagtggtgccatctcagctcactgcaacctccacctcccaggttcaagcgattctcctgcctcgacctcctgagtagctgggattacaggcatgcgccactacacctggctaatttttgtatttttagtaaagacggggtttcaccatgttggccaggctggtctcgaactcctgacctcaggtggtctgcctacctcagcctcccaaagtgctgggattacaggtgtgagctgcctggcctatttttattggttattttactttatttttagtagagacagggtttcaccacattgcccaggctggtcttgaactcctgggctcacgtgatcctcacacctcggcctccgaaagtgccaggattaagggtgtgagccactgtgctcggctatatttttaatcttttgagacagggttctactctgtcacccaggctgaagtgtaggggtgcaatcatagctcactgcagcctcgaactcctgggctcaagcgatcctctcacctgagcctcccaagtagctgggaccacaggcgtgaaccatagtgtctggcttttttccaaagcggagctcaaatctaggctctgtctcagctcagcctctctgagaaggcccccttcactgtgtgtgtgtgtggtgcgtgtgtggtgtgtggcgtgggtgtggtggtgtgtgtgatttgtgtggtgtgtggtgtgtgtgaagtgtgtatgtggtgtgtgtgtggtgcgtgtatggtgtgtgtgtatggtgtggtgtgtgtggttgtgtttgtggtgtgtgtatgtgtggtctgttgtgtgttgtgtgtgtggtgtgtgtgtgtggttgtgtgtgtggtgtgtgtggtatgtgtggtgtgtgtgtatggtgtgtgtggtgtgtggtgtgtgtatgtgtggtctgttgtgtggtgtgtgtggtgtgtgtgtatagtgtgtgtgtggtgtgtgtatgtgtggtgtgttgtgtggtgtgtgtggtgtgtggtgtgtgtgtgtggttgtgtgtttgtggtgtgtgtatgtgtggtgtgttgtgtgatgtgtgtggtgtgtgtgtgtgggggggtgtgtggtgtgtgtgtgtgtggtgtgtgtgtgtggtgtgtgtgtgtgtggggtgtgtgtgtgtgtgtatgtgtgttcagccgcagagacttgagccccccttttctgtttctttctccagggctgaagctgccctcgaggacctggtctccaccattcgagtctgaagattctcagaagcacaacyagagtgagtatgaggattcggccggcgaatgctgctcctgtccaaagacagactctcagatcctgaaggagctggaggagtcctcgtttaggaagacgtttgaggattacctgcacaacgtggttttcgtccccaggtcaggacttggcgctgggmtctcttagtgggtrccaattggcttggtgttggtggaaggtcattacttagggaccgagaggtagtgggacccagagacggcagaagggtgggtggagtctgaatggagccctttcctgggtggaggaagagatcttgcagtttcgaaatttcgaggggaattttatcaggaagagcaaataatcgcacaaaaggggaaaaatggacaaaactcagcatttgcctttcttacctctcctgagctggtctccacgtgagttccaaaacaaactccgttagacgattaacatttttttttytctctctctctctytttttttttttgacagagtctcactctatcgtccaggctggagtgcggtggtgcgatttcagctcaccctttccgggttcgagtgattcttgtgcctcagcctcccaagtagctgggactacaggtgcgcagcaccacgcccagctaatttttatatttttagtagagacggggttttgccatgttggccaggctggtctctaacccctgacctcaggtgatctgcctgcctcggcctcccagagtgctgggattataggtgtgagccaccgtgcctggccgtgattattgaggctttagctgagcgcagtggtgtaagcctgtggtcccagctagttgggaagccgaggtggtagggttgcttgaggccagcctgggcaacataatgagaccccatcgctaccaaaaaaaaaaaaaaacagtttaaaaattagtcaggcatggtaatgcatgtctgaactcctagcccatggggaggctgagaaagaaggatcacaagaggccaggagatggaggctacgataagcgatgatggcgccactgcgctccagcctgggtgacagagtgagaccctgtctctaaaaaaaaattaaaagtatctgttcagatgtttaccaatgctattcatccgagcagacttttctcccagaaccaccagtgtgtaagaatcctcttttttttttttcttttctttttctttttttgttgcatgtttcccctatgaccctgagtccaaaagaatgttcagggggacagccaaggcttcaaagtggttactgtttcacctgttacaaacaaaatgttggctaggcacagtggctcactcgtgtaatcccagcactttgggaggccgaagtgggagaatcagttgaggccaaaggtggagaccagcctgagcaacagagtgagaccctatctctactaaaaaaggaaaaaaaaaaaaaaaatagccagacatgttggtgcatgccttgtagtcccagctactccggaggctgaggcgggagaattgctggagcacaggagttggaggctgctgtgagctatgatggcaccattgcactccagcctgggcaacagagcaagaccctgtctcaaaaaggaaggaagggaaaaaaagaaagaaagaaaggaatggagggagggagggaaagaggaaggaaggaagagagaaagaaaaagaaagaaagaaagaaagaaagaaagaaagaaagaaagaaagaaagagaaagaaagaaaggaaagagagaaagaaaggacagagaaaggaagggggcaagggagggagagaggagggaaggaaggaaggaaaaaaggaaaagaaagaaaagaaagagaaagaaaatgaaaaaaagaaggaaggaaagagaaagaaagcaaatgaaggaaggaaagagggaaaaagagagaaagaaagtaaaagaggaaagaaggaaggaaggagagagagggagagagaaaaaagaaagagaaaagaaaaggagaaagaggaaagaaaccagaaagagagagagaaagaagaaagaagggaaagaaaagaaaaattctgccagacttggagaagtggctgagtcagttgtgatgtccacatgtagtcacgtttgacatcccagggccacctcagcaggccgtctctggggagaattttctctgatttcttccccttcccttgctggacccctgcacctgctggggaagatgtagctcactccgtctagcaagtgatgggagcgagtggtccagggtcaaagccagggtgcccttactcggacacatgtggcctccaagtgtcagagcccagtggtctgtctaatgaagttccctctgtcctcaaaggcgttggttttgtttccacagaaaaacctcttcaggcactggtgccgaggaccctaggtatgactcacctgtgygacccctggtgcctgctccgcgcagggccggcggcgtgccaggcagatgcctcggagaacccaggggtttctstggctttttgcatgcggcgggcagctgtgctggagagcagatgcttcaccaattcagaaatccaatgccttcactctgaaatgaaatctgggcatgaatgtggggagaaaccttcactaacacactcttgctaaaacatagaatcatgggagtgcttcctgggtaccccctccctgccttctgtttgcagccactgtttgctcactaaacatctctgcacctcccgcgtgcatttgcagaggtgggtgggggtccccggagtctgagctccccscggctgggtgccccgacccagcagctcctacaccatgaatggaggttgatctggaaacagaatattttcatgaaagggcgacagggtatgaacaaaagaacaccgtgtcgctcactgaattccacggaggagagtcagggatctcttccttccttccttccttccttctttctttttttccttctttctttccttctttcttttcttttctttcttccctccctctctccctccgtccgtccctccctcccttccttctttccttcttcttttttttttggatggaatttcactcttgttgcccaggctagagtgcagtggtgcgatctcggctctccacaacctccacctcccgggttcaagcaattctcctgcctcagcctcctgagtagctgggattacaggcatgcgccaccacgcccggctaatttttgtacttttagtagagacagggtttctccatgttggtcaggctggtctcgatctcccgacctcaggcgatccgcccgcctcggcctcccaaagtgctggaattacaggcgtgagccaccgcccctggccagggacgtttcttttcaacttgagtcttaagagaatgaagcagtatggtcctgggagagagaaaaagcttggagaacttgggagaaaggcaaggagatgtttacctgtcgtggcttttgggaggaacaggaggtgagactaaagaggcaagttgggaccacttggagagattttcttcctttagcagagtgtttatttatttattttttcccaggcacctgtgtggcctgatctgccctctagtggccatttgcaatactaactgtagccaagaagggtctaaaaatgtacgggcttggtccaaagcagatctcaatctcagtcctgctattaataatattcgggtggctcacgcctgtaatcccagcactttgggaggccgaggcgggcggatcatgagatcagaagatcgagaccatcctggctaacacggtgaaaccccgtcactactaaaaatacaagaaattagctgggcgtggtgacgcagctaccccaggcggggcaatcacttgaggccaggagttcgagaccagcctgaccaagatggtgaaaccccgttactacaagaaacataaaaattagccgggcgtggtgacacacgcctgtagtcccagctactcgggaggctgaggcaggagaatggcgtgaacctgggasgcggagcttgcagtgagccaagatcgtgccactgcactccagcctgggccacagagcgagactccgtctcaaaaaaaataaaaataaaataatatttggggccacagctggacttggtagctcacgcctgtaatcccaacactttgagaggcccaggcggggcaatcacttgaggccaggagttcgagaccagcctgaccaagatggtgaaaccccgttactacaagaaatataaaaattagccgggcatggtgacacacgcctgtagtcccagctacttgggaggccgaggcaggagaatcacttgatccctggaggcggaggttgcggtgagccgagatctcgccactgcattccagcctgggtgacagagcgagactctgtctcaaaaaaaaaaaaaaaaaaaaaagaataaatacataatastaataataataataaataatatttggggtcagattattctagggcactgtccaacaacactgagaagcatccctggcttccactcatctgatgccagtagtgtgtcttccccctaaagtagtaataaccaaaaatatcttcagacattgctaaatatccccctgggtgatggggtcagaaggacccttggttgagatgaccaggttagtgtgggattgctggataataaaatgctgcctaggccaggtgctgtggctcatgcctgatgcctgtaatcccagcactttgggaggcccaggcaggcagatcacctgaggtcaagagtttgaaaccagcctgggcaacatggcgaaaccccgtctctactaaaaatacaaaaattagccgggcatgatgatgcacgcctgtaatcccagctacttgggaggctgaggcaggagaatcgcttgaacccagaaattggaagttacagtgagccaagatcacaccactgcactccagcctgggcaacagagcaagactctgtctcaaaaaaaaaaatcagttgatgctttgtcttttgccacttcatggtctttttggttataatctttttggtrtataaactcatttggcctgtttgatgagcccattttacatctctggttgttgagataccaatttctcagtagttattcatgaagcaccaacgtcttggttattttcacgagacccatttgtgcctgtatagaaattatctgaatcttgctaatacggacatatctttggcttgataagtggtggagctgttttcttttccattctacaatgttgttagtcttttaatacaaaaagaccataaagagaatcttaagaaatgcccccaaagtaggatttgttttctgaccacacattttctgatgacgctgcaatagaaactaaaagttaatttcaaaagattaaacagaaaacttcasttcttggtggttaaaagttaaacacttacaggctgggcgcagtgactcacacctgtaatcgcagcactttgggaggcccaggcaggcggatcacctgaggtcaggagtttgagaccagcctggccaatatggtgaaaccccttctctactaaaaatacaaaaattagccagatgtggtaacgtgygcctgtagtcccagctactcaggagactgaggcagaagaatcacttgaacctgggaggtggaggttgcagtgagccgagatcacgccactgccctccagcctgggcaacagagcgagactctgtctaaaaaaaaaaaaagttaaaaagttaaacacttacatatctatcgggccaaagcagaaatggaaacttccattgaagtccttttggaaaataatgaaaatgtgaatatcacataccttaacttgtagaatattgtcaaagcttggctttgatgttacttagcagacttaaatggattgataaattaagaaataaactttaaactataaaactataaatgtgttaggaagggaaaagcaataacagctaagcctatggtaaacataatcaaagggaaaacacaaaccagaaggaaagaagatgacataaaactagcgtctgaagaaaattttaatgtgttaagttctttggacaatggtgcacttgctaaatttgaaagtttcagtaaggtgggaaaatttaacttgtctaaatggattcaaaaagaagcagaaaaattaagtggttatgaaccttggaaaaagatatgtgtcaaataatttcctcaaaaaagtcccttggcccagagagttttatagacacgttctttcaaattgtgagagagcaactatttcctataatagaaaaactattttagggcacagaaatctataaaagttatcccagttcattttatgaaatgaacataacacccttaaagaacttgacaaagaggttgagcatggtggctcatgcctgtaatcccagtactttgggaggctgaggtggggggcggatcacaaggtcaagagattgagaacattctggtcaacatggtgaaacactgtctctactaacaatacaaaaattagccagacatggtggcacacgcctgtaatcccagctacttgggaggctgagccaggagaatcgcttgaacctgggaggcagaggttgcagtgaaccgaggttgcgccattgcacactccagcctggcaacagagcgaaactctgtctcaaaaaaaaaaaaaaaaaaaaaggaacttgacaaagatactgcactgaacaaaagccacaggccaagctaatatgtgatgttagattcaaatgtcccaaataaaacactgcactggcaatattgtttatctccaaaatgcaaggatggtttaagatcagaagatttgataacatcatctagttcatcaagaggtgcaataaggaagatcatatctgtttcaataaccttaatttaaaattcctaacttagagaaaggggaggaaaaaaagaggcttcataaaactcataatagaatatttcttctacargataaatattacctaggttaaaccaacagccaagctaacatcattcttaaaattattcttagcagagttaggaacaaaacaaggaagccccatctcatcattactaattaacatttctctgggcatccagccaatgtaataagacaagaaacagaaatcagagttgtaaagaatggaatgtgggaaataaagtcattgctatttgcagagcgtctagctcaagggtaggcaaactatggcccatgggctagctgcctgtttttgtaaatgaactcttattggaatgcaaccccacccacttgtttacacatcatgtagggctgctttaagstacaatgacagagtagttgtgacagaggtcatttggcttgcaaaacccaaaatatttattatctagccctttacgggaaaattttgttgacccctcttctagtgtgtcattgaaaacccaggaaagccaattatgaaactttttaaatgagttagagtttgggaaagtaggtacatagaaataagcaaaaagactgtagatacacaagcaataattagaatataaaataagggaaaagatccctttcaaaattgccrtaaaaccttagcacaactcataataaccccatctagaatgacttataaaggaacacgttttaaartgttactgatatattaaattgtacaaataaacatgaaagcctgtttcaaatcatttaaagaaagcttactggcaaatggaaaagagtaagttgtatagcacgatacataaaaggttaatatccttaatgaataaacaacacaggagtaaggaaaacacaagaaattcatggaaaaacagacaaaagacaaggaggggacaattctttggagaatcacagagaaccaataaaggaaaaatgaagtcacactcagtaatataaagatccgcaaataacgtagtcgagtgatagcatatttttaatctcttgggttaaagatctagacaaacaaacatagaaagaaaaaaaaaaactattaaggcttaggggttgctgagattgtcctggaatgcagtctcatggcctgctggtgcaaccacaagtcaatatagagtttctggacaaccatttagctgtaggtattaagaagcttaaagagtttcttatctccctgaacctagtaatattttcctctaggaatctactttggggaagtaataagacaatcagacaatgatcaaaggaatatttataacagcaaaaaaaaaaaaaaagagccatgtgcggtggctcatgcctgtaatcctggcactttgggaggctgaggtgggcagatcacctgaggtcaggagtttgagaccagcctggccaacatggcgaaactccgtctctactaaaaatacaaaaattagctgggcatggtggcggactcctgtaatcccagctactcaggaggctgaggcaggagaatcgcatgaactcaggaggcggaggttgcagtgagccaagatcacgccgtcgcactccagcctgggcgacaagagtgaaactctgtctcaaaataaataaataaataaggaggatggttaagtgagtgacgactcacgtagcaaatggaatattttacagtcattcatcgttttccaagttttctgcagggaacacatgctacttttgtagatgatggaggaaaaccctaatattaaaaaggaaaagtcccaaaattctctcctaaaatgttatgttgaaaggaaaatatttagtaaatgcttccaatataataagtagacaaagtttacttataaaacaggcttgatcctcatcatgttcacacataatatttacagggaaaaaattgtccaaaggaagcagtgggctgtggatttatgagtgatttatattttcttttcttttttttttttttgagacagagtctcactctgtcgcccaggctggagtgcagtgacacgatctcagctcactgcaacctccgcctcccgggttcaagcaattctcttgcctcagcctcctgagtagctgggattaaagctgtgcaccatcaggctcggctaatttttgtatttttagtagagacggggtttccccatgttggccagactggtcttgaactcctaacctcaggttatctgcccgccttggcctcccaaagtactgggattataggcatgagccacctcgcccagcctacattttcttctttatccttttttctttgtattttaaaatttgttagctatcaacctttgttgtttaatatrtcttcttaagggatggggagaagtgtgccaattgcatagatgtttcttggagttaatcttcctgacctgagtgatgtgattccttttctaagaattgcagcttaatcactcaaattatacaggtgccctaagcagcaataagaaggaaaagatgtattttttcctatttaaactgatgatgtcgatcagtagcttgggccaatgagcaaatgccatttggcagggcttcctgaaaagctagactcttacgtgcttttggtgtcttatttttgtcactgaccctggctggcctatttatctgcaaaatgaaaaacctgaaatcgagcatgtcgaggggaatatcggtgtgtgtctaccattgacggtcttagaagcactcatccctcacgaggtgggcctgctctaatccttcagatgctcacaagggtatattgaaagctgctctgagtggtcattcctggcagtctgtattgtaatccatgttccccattgctgcaccctcctgcgctctgatctttcttcttaatcaagccttttattctccagtgtcacttttttaaaaaaaatgatggtgatggtgtcatcatacatgtcctactgtcgttccaggccatctcggaaacgcaggtcccttggcgatgttgggaatgtgacggtggccgtgcccacggtggcagctttccccaacacttcctcgaccagcgtgcccacragtccggaggagcacaggccttttgagaaggtggtgaacaaggagtcgctggtcatctccggcttgygacacttcacrggctatcgcatcgagctgcaggcttgcaaccaggacacccytgaggaacggtgcagtgtggcagcytacgtcagtgcsaggaccatgcctgaaggtagggctgctgctccggggtccgagtgtcatgggtgggacatcaaggctgaccaaggacagattctccaccctctaagcagtgcatatctgtattttaccttattggccttcatttttgtttgagacggagccttgctctgtcgcccaggctggagtacagtggtgcgacctcagctcactccagcctctgccacctatgtcaagtgattccctgcttcagcctcccaagtagctgggactacaggtgtctgccaccacgcccagctaatttttgtatttttagtagagatggggtttcaccatattgcccaggctggtcttgaactcctgggctcaagtgatccacccacatcggcctctcaaagtgctgggattacaggcatgagcaccgaacctggccttttttttttttttttttttttttgagatgaagtcttgctctgtcgcccaggctggagtacaatggcgcaatcttggctcactgcaatctccgcctccctggttcaagcaattctcctgcctcagcctcctgagtagctgggactacatgcgtgtgccaccacacctgtattttcagtagagatggttccaccatgttgcccaggctggtctccaatgcctgagctcaagtggtccgccaaccttgagctcccaaagtgctgggattacaggcatgagccaccatgccaggtcatattttaaaattatgagtcataggcaatcattatgtaaactttagaaaatacaccactgcactcccgcctgggtgacagagcaagactctgtctcaaaaaaaaaaaaaagttatacgcagaaagtaacccatttaatcttcctaacaatcttgtgggatgagttttagatgtccgttctctgacgaggaaaatgggttgtgggaaaatgacgtcaccagcccaaggttgcaccatggacaggtggcagaagtgggatctcatccaagagttacatccctgcctctcacttcctctccttacagccaaggctgatgacattgttggccctgtgacgcatgaaatctttgagaacaaygtcgtccacttgatgtggcaggagccgaaggagcccaatggtctgatygtgctgtatgaagtgagttatcggcgatatggtgatgaggtaaggcccttgactcttgggcatgcccctgcacacttcagcatgccccttcagagttgcacttggtacctccttcctctgctgaaattttgattccagtgcttctctcatcaggtactgtgctattagtacttaaagccttgatacctgacttcgcaggaagatgggtcagaaatgccaatctaccagcttgttacttttcttagtttctcacattgctttccagctgtgtcctctaagttgaatgatgtctgcctcccaccacaacaggagactcatttcactttagaaggagttatttgagtcttaaaaccttataaattgctgggtacagtggctcacacctgtaatccaagcactttgggaggccgaggcaggcagatcacttgaggccaggagtttgagaccagcctggccaacatggtgaaaccccatctctacaaaaatacaaaaattagccaggcgtggtggtgggtgcctgtaatcccagctactcaggaggccaaggtgggaagctgaggcaggagaatcacttgaagccaggaggtggaggttgcagtgagcagagattgcaccattgcgctccagcctgggtgacagagtgagactctgtctcaaaaacagcaacaacaaaaaccttataagttactttcattagatgcttccattgagccagacaccatgcaaggtgctgggtgagtgcagagatgcacaagacatagaatccaagacaaataacccaaaagaacccaaacagttgctaagctcttcccagggctcactgtatgtcccaaacacattcagcacgttacacagagtatctcattgatcacattttattacctctaggaaattttgagaggccccattatttttatggacagctaggcaaaaaaaaaaaaagggccgttaattctaattttatttttttcgtagaatatagatcctgagtactgttaagtgtttgtaaaatgcattgcttgtaagatgcattccaatttcagaaatgccaaaatgcaaaaataatatacctcttgggactgaggaagtacaatacgtcctcacattatcccagtgagctgggtactgaggcttccagagtttaagttgctgcacaaaacctggaagaatagaatcatgatccaaatgcatgactgatatttcaatccagaaactgccaaattttttttaccataaaggtctggatagtaaacatgtttgactccgtggccagatgatttctgttacaactactcaattccaccattctactgagaaagctgccatgggtgatatgtaaatgaatggatgtggttgtgtrccaataaaactttatttacaaaaacacgtggtggaccaggtttagttggtgggccagagtttgccaacaactaacagagattacagcaaaatgtctgatttcctggaactttgagagggagtcctcctataaccaggtggacctccctctacccctcctgggaccacatctactcttggcaaccaaagattttggctttgacaataatttacaattgagatctaattctaaattattgtggcttgtgggccaaatctggcttgcagagcattgtaaagaatgtgcaacagggttgaggtcaggagttcaagaccagcctggccaacatggcgaaactccgtctctgctaaaaatacagaamttagctggacgtaatggtgggcgcctataatcccagctgctcctcgggaggctgaagcagggagaattgcttgaacccgggaggcaaaggttgcagtgagccaagatcgtgccactgcactccagcctgggcgacagaacaagactctgtctcaaaaaaaaaaaaaaaaaaaaagaatacgcaacagagactatatgtggcccttcacagcttcacagaaaaagtaaactttcaaaaatagaaagtgtccttactgaacttgtcattctgggcctattttggggccctgtttgctaaatgaatggcttgatttgccttttttaacattcatttttaaaataaaattgctaaatgaatggcttgatttgccttttttaatattcatttttaaaataaaattccttatcatacagagctcagctagtttttaattggcagaaacgtgcatatgcctctaatccatattcatgagttactttcctctgccttttgatgtctctgtccacaatagcctttggaattatgatttgtagttgctagatagaatttaatctcatgattggggtatcatttatttttggggatttggattgcctctggtttttaccatgttaggtaatactaattttatctggaaaccattttagctttttggattgacagctttagttattgtttcagtcagttcttgctgcgtaacaaactgcccccaaaggtactggtttaaaacaaaggacatttattctttctctcaattctgcaggttcactgggtgattcctttgtcctgggccagtttggctggggctggatggcctcattcacatggctggggcctcagctgggggcacttggagctttgtcctcatgtgttctctcactgcccagtgagctagcccaggcaaggaaggacatgccccatatacaaacacttcttaggactctgtttgcatcacatttgctagtgtccctttggcaaagtgagcccatggctaagcccagaatgaggaagtacaatacatcctctgagtatctcagtgagctggatactgaggcttccagagtctcatagacacagaaagtcatgattccctgggggccataattgcaaagtttattaatatattatcctatatgtattaatcctgtaggtcctaaggaaataattcaaatttggggcagggaacaaagctctatgcataagattttcatcagtagcaaaatatgcaaaccactaagatgtccatycattggagaatggacacatggaagacggtgcatccatagaattggtggatgaagagccattgaaaatgatgtttgggggccaagcatggtggctcatgcctgtaattccagtgactcaggaagctgaggtgggaggattgcttgaggccaggagtttgagcctgggcaacacagccagaccccatctctgcaaaaaaaaaatttcaaaattagctaggtgtggtggtctatgcctgtagtcccatctacttgggaggctgaggagagaattgcttgagctcaggagctccaggttatagtgggctgtgactcactcactacactgcagactgggtgacagagcaagaagactctgtctccaaaaaaataagataaaatgtttgggatgacctttgttcagtgtaatgtagaagttaaaattacatgctctggagtttagttcgtttgtgttgttatcccccagcagttaagaatccccctgtatctgctgggtgcagtggctcacgcctgtaatcccagcactttgggaggctgaggcgggtggatcatgaggtcaggagatcgagaccatcctggctaacacggtgaaaccccgtctctactaaaaatacaaaaaaattagccgggcatggtggcgggcgcctgtagtcccaactacttgggaggctgaggcaggagaatggcgtgaacccaggaggtggagcttgcagtgagccgagatcgcgccactgcactccagcctgggcgacagagtgagactccatctcaaaaaaaaaaaaaaagaaaaagaaaaaagaagaaaaaggaatccccctgtatccagactagcttatgatagaggaaaagcttcttagctcccagagttgaacaactgaagagcttctcacatggctggatccaggattcctttgggtcggttgcatcttttttttttttttttttttttttttgagatggagtctcactcactctgtcatcctgtcatccgggctggagtgcagtggtgcagtctcagctcactgcaacctctgcctccctgtttaagcgattctcctgcctcagcctcctgagtagctgggattacaggcacccacgaccacacccagctaatatttgtatttttaatggagacgaggtttcaccatgttggcctggctggtctcgagctcttaacctcaggtaatccacccaccttggcatcccaaagtgctgggattacaggcgtgagccaccatgcctagcctgggtcagttgcatcttaacggctcctggcagtgagcccagtagcccctggttgtccaccggtggttgtagtggttccaaacctcatttctttgcagtgccaaacccagaggaagacagagtgcatcccagcattcccagctagactgaggtcatgtgacatccagtgcccaatcatgtgaccagaggaatgctgtatgctgattggcttgggcatgagggattttttttttttttttaatttagaaacagctttattgagctgtaacttacataccataatattcactcccaccacatgctagagagaattttgtaaatggagtaaaattacactccaacagtataaattgtgcacataaaaataaagttttaggccaggagcagtggctcacgcctgtaatcctagtaccttcagaggccatggtgggtggatcacctgaggtcagggttcaagaccagcctggccagcatggtgaaacttcgtatctactaaaaatacaaaaattagccgggcgtggtggtgcacgcctgtaatcccaactactcgggaggctaagacaagagaatcacttgaacccgggaggcagaggttgcagtgattccgagatcacaccactgcactccagcctgggtgacagagtgagacaccatctcaatatatatatatatatatatgtaaataaataaataaagttttacatcactttttttcttgatcaaagcaatgctaggtaattaaggacattgttggcaataacagaaatgtgtctatgaaaaggttcttaagaaggtgactgtaacctcacattctcctttcattttctcccccatctctgcttctctctagggtgaacacagttggtctgggtgggattggggttgtgctgtgtggggcagaggctgttggggattcgtgatgggaattcctaatagtgacccttgggtcccaggaacaggagacacgggccagtcaaaggcatgggaagaagctaggagaagttaggattcgagttaaatccagtgccracagggtgaccagttgtctaggtttagccaggactgagggctccctgggatgtgagattttcaatgtccayactcagaaagttctgggcaaatggggacaagttggacacagaagcagaaaaaaaatcaaggagggtctgcagtggaaacgggcattgttcactctgcagaatctgtattcttgctgtcaacaatgccccgaacttcctctggaatctgctcctcacccttgagtggctctcacctcccactctcaaccccagcctggtaccagggcaaaacacaaaactcagccccaaattagccatgacaaaaatgcaaatcaagaccacgatgcaataccacttcatgcccacgagcgtggcaaaaaacaaacagacggacaataacaagtgtcggtgaggatgaggagaaatcggaaccctcatacattgctggtgggaacataaaatggcacagctgctttaggaaagagtttggcatttctttcattctttcttttttttttttgagatggagtctatctctgtagcccaggctacggtgcattggtacgatcttggctcactgcaacctccgcttcctgggttcaagtgattctcctccctcagcctcttgagtatctgggactacaggaacccacgacctcgcccggctaatttttgtcttttagtagagacgaggtttcaccatgttggtcaggctggtctcaaactcctgacctcgtgatctgcccgcctcggccttccaaagtgctgggattataggcgtgaaccaccgtgcccagctggtggaaggtattttttttttcttttgctagtttcataaacaaagccacctctagctatttaattgcattttcagtatctcccgttaaaaaaattttttttttcagagacagagtcatggtgtgtcacccaggcccgccatccgccaccatgcccagataatttttttttttttttcaaacagagtcttgctttgttgcccaggcyggagtctcgctttgtggcacacgcctataatcccagttactcaggaggctgaggcaggagaatcgcttgaactcgggaggcggaggtcgcagtgagccaagatcatgccactgcactccagcctgggtgacaagagcgaaactccgtctccaaaaaaaaaaaaaaaaaaaaaaaaaaagaagatgcatttcccctttgtccyggatagcagctaccttgggtttctatatttgcttatttgtccctctctactcggtgactcattccacttggaagaaactttggactggagttccctgcccccacccctgccaccagactgatttgttttcttgctgttattgtcacacgataagcatggggttgttggcttttttttttttttttttttttaacatttctttctcttctccactctccacccccctcctaaatgttccagcccggttctctgcatgcactattagcttggaactgtgtcgaaaacttttcagagttttggctcgatgcttgcaggtttcatggtcttattcccaagagcctcctgtctcttctcataagttctggaattatctctagttacgtgcttatcacagggtatgtttcccactttgcaaatctccatttgggtggatcccaactgttttatttatttatttattattttattttatgtgtttatttttgaggcaaagtataccacattttctttttctttttgagacagtcttgctctgttgcccaggctggagtgcagtgtcacgatctcgactcactacaaactctgcctcccgggttcaagtgattctcctgcctcagcctctcgagtagctgggattacaggcgcacaccaccacaactggctaatttttgtatttttagtggagacggggtttcaccatgttggcaaggatggtctcaatctcttgacctcgtgatctgcccgccttggcccctgaaagtgctggaattacaggcatgagccaccgtgcccgggcttcaactgtttttataatgattaaaaaaaaaaaaaatcgaaaggcagcaccgtggcaaagaaagagcttttttatttgtccttagacattaagcccatttatccatttggttctgatgtgacagaggctgggagttgcagggaaaggcaggaaatctggcataggccctgcagatccttcatttccactcttttctaattttgctggatacatggcaawaatattctgcartggtcttaaggagaagttctagagccagacagttctctttttttagtttctttctttttatttatttattttttttgagatggagtcttgctctgtcacccaggctggacttmagtggcgcgatctcggctcactacaagctccgcctcccgggttcacgccattctcctgcctcagcctcccaagtagctgtagagccagacagttctgagttcaagagctggccctgccactttgcagctatgagatctcrgacaaaccatataatctcttaaaccaggggtcagtcagtaagctatatcccataggctaaatgtggcctgctgcctgrtttctaatgatttgtgagctaggagtcacttttgcattttatttatttatgtatttatttttgagatggagtcttgctctgtcacccaggctggagtgcagtggcacaatcttggctcactgcaacctccacctcctgggttcaagtaattctcctgtctcaccctccgagtagctgggattacaggcgtgtgccgccatgcccagctaatttttgtattttgggtagaggtgggggtttcaccatcttgaccaggctggtctcgaactcctgacctcaggtgatccgcccacctcggcctcccaaagtattgggattacaggcatgagccaccacgccctgcccacttttgcattttaaaatgattaaaggaaaaacaaggagagacgtgaaccaaagggtgcaaagtttcagatgggaggaatacgttctaggaatccactgctctgtagatgaatggtgactatagctaataacacatattgcaaaatggctagaagaatagattttaaatgttctcacaacaaagaaataagtacatgaagtgatgaggatttaattagcttgttttaatcattccacaatttatactgtaacataactttacactgtaccccatacgtgtacacaactattatttttatttttgtttatttattttagagacagggtctagctctgtcacccaggctggagtacggtggagccttcatagctcactgcacccttgacctcctgggctcaagtgattcttccrccttagcctcctgagtagctgggactacaggtgcgaaccatcgtgcccggctaattgttctattttctgtggaaatggggtctggctatgttgcccaggttggtctctaactcctgggctccagcaatcctcccttcacggcctcccatagggctgggattacaggcacgagccactgtgcctgacctataatactgttgtcaattaaaaataaaacaaatgatttttagaaagataatattatggaaattaatattaatagaaaatagataatagggctgggagctgtggctcacgcctgtaatctcagcactttgggaggccgaggtgggcggatcacttgaggtcaggagtttgagaccagcctggccaacatggtaaaaccctgtctttactgaaaatacaaaattaggcaggcgcggtggtgagcgcctgtaatcccagctactcgggaggctgaggcaggagaatcacttgaacccgggaggcagaggttgcagtgagccgagattaagccattgcgctccagcctgggcaacaagagtgaaactccgtctggaaaaaaaaaaaaaaggaaaagaaaagaaaccatcagggtttaatgctcrgcttctggcttaggaagtctggctcttaccgataatgataacctctgcatatatctttatccatagcactatggttataaaattctgcaattctcaaagtcgcttatgtgtcttagtctgtgctttgctgccttggcgtcatttctgagcaggatcctggctgtgagctccctgcgaggggtggacactcccagatgtgcaaagctcagccaccctccttctcctcctctcttcctyccaggagctgcatctctgcgtctcccgcaagcacttcgcyctggaacggggctgcaggctgcgtgggctgtcaccggggaactacagcgtgygaaycygggccacctcccttgcgggcaacggctcttggacggaacccacctatttctacgtgacagactattgtaagtctccatggcagcctcagctgactgggrctgtgcttagcactgagcatggtgggacattgcaggggatgacttggagaggccrcaggtgctggccctggccttgactctcaggcctatcagctgctgcggtgcttgccctctttgatcctgcactttttttttttttgagatggaggcttgctttggagtgcactggcacaatctcagctcactgtagcctccgcctcccgggttcaagtgattctcccacctcagcctcacagtagctgggactacaggtgcccaccaccacgcccggctaattcttgtatttttagtagagatggcatttcaccatgttggccaggctggtctcaaactcctgacctcaagtgatccgcccgcctcggcctcccaaagtgctggaattacaggcatgagccaccatgcctggcctgatcctgcacttaaaaaaaaaaaaaaaaagtttcagaggtacttgtgcagttcattatataagtaaattgtggctgggcacggtggctcacacctgtaatcccagcactttgggaggccgaggcgggcagatcacaaggtcaggagatcgagaccatcctggccaacatggtgaaaccccatctctactaaaaatacaaaaataaattagccaggcatggtggcgggcgcctgtagtcccagctactcaggaggctgaggcaggagcctcaggaacccgggaagcagagcttgcagtgaaccgagatcgtgccactgcactccagcctgggcaacacagtgagactctgtctcaaaaaataaaataaaataagtaaattgggtgttgttgggggtttgctgtacagataattttgtcacccatgtaatcagcatagtacctgataggtcgttttttgatcctttccctcttctcacccaccactctcaagtaggcacctgtgttagtctgtacttacactgcaataaagaaatacctggccgggcacagtggctcacacctgtaatcccagcactttgggaggccgaggtgggcggatcacttgaggtcaggagttcgagaccagcctgaccaacatggtgaaaccccatctctacccaaaaatacaaaaattagctgggcatagtggtgtgcacccgcagtcccagctactcaggaggctgaggcaggagaatcacttgaacccgggaggcggaggttgcagtgagccgacatcacgccactgcactccagcctgggtgacagagtgagactctgtctcaaaaaataaaaaagaaagaaagagtgaaagagagagagaagaaaaagaaaaagaaagaaaaggaaagaaagagagaaaaagagagataaaagaaagaaaaagaaagaagagaagagagagaggaagaggaagaggtctgagactgggactcagtaatttataaagaaaagaggtttaattggctcccagwtctgcaggcagtacaggaaccatgatgctggcatctgctcagcttctgaggaagcctcaagaaactttcaatcatggtggaaggtgaagtgggagcaaggtgttaagacggggagatggtgctacacacttcttaaacaaccagatcccatgagaacccacttattatacagtacccagtagggatgttgctaacccattagaaaccgcctccatgatccaatcacctcccacccggccactcctccaacattggggattacatttcaacaagagctttgggtggggacacagatccaaaccatagcagtcccggtgtctactgttcacttctttctgtccatgtgtggtcagtgtctcactctcacttatgggtgagaacatgaggtagttggttttctgtccctgtgttaattcaattaggataatcacctccagctccattcatgttgctgcaaagaacatgatctcattctttttcatggctgtgtagtattccatggtgtgtatgtataacattttctttatctggcaatcctgcacttcctcatctgtacatggagataataacagaaccacttcaggaggtggagggacattttaatgacacaaatgttaagtgcctggcacctgttgctagtgtctccatctttgttactagagtttttttggctagatgaggtggctcacacctgtaatcccagaactttgggaggctgaggcaacaggattgcttgaggacaggcattagagaccagcctgagcaacatagcgagactctgtctccacaaaaaaatacaaaaattagccagctatggtggtgcatgcttgtaatcccaggtacttgggaggctgagacagggggatcacttgggcccaggaatttgaggttgcggtgaactgtgattgtgccactrtactccagcctgggtgacagagtaagaccctgtctctaaaaaataaaaattaaaagaagtttacatctgtcaaaagtcatgctgggatcgggactagctatgtaatttgcaagacccagtgaacaatgaaaatgcagaactccttgctttaaaattattaagaatttggccgggcacgttggctcacgcctgtcatcccagtactttcggaggctgaggcgggaggatcacctgaggtcaggagtttgaggccagcctggccagcaaggtgaaaccctgtctctattaaaaatacaaaaattagccgggtgtggtggtgcatgcctgtagtcccagctacttgggaggctgaggcaggagaatcacttgaacccgaaaggaggaggttccagtgagccgagatcgtgccactgaactctagcctgggtgtcagagcaagactctgtcacaaaaataagtaaataaataaaaattaaaataaaatgaataagcatttcagaggggcaacagcagagcattaaactgacagaaaagggtcctgcatccactgcctgagatgtgggagggatggaaatgagcagtgatttggggcaggggtggggaagagtgtgcttccagaatactgacctctgagcccactgcctggtcccactgcacctacgggactgtttcgggactgctggaaaatcaggatgtggaagagcagcagagaggttyatggacaagggagggaaggaamagggtggcccacccattccaggagtggatgtgatttttgatgtgaactttgttggaaacacattgatatgaaacatatattttcttattctatttcagtagacgtcccgtcaaatattgcaaaaattatcatcggccccctcatctttgtctttctcttcagtgttgtgattggaagtatttatctattcctgagaaagaggtgagttcagtgagttcagtggtgtgctgggaacagttgrttctctgggggaaaacatgccttgatataggtataggcatatttaagtttattatgaattttgctgatataggatgtgtaacatgcaatttacagataattgtcataatatgatatacacaactctttattgtaaattccctctagacagttgattctcacagaatgtttttattgatttttttttttgcccaaacctttatatccgaagctaacctattattgcaattgataaacaagtaaagctccaatgtgaatgttgattaatttttcaaaatttacattaaggagtaggacttgactgggcacagtggctcacacctgtaatgctagcactttgggaggccaaggcgggtgaatcacctgaggtcaggagtttgagaccagcctggccaacatggtgaaacctcgtctctactaaaaatactaaaaaattaaccgggcatggtggtgggcgcctgtaatcccagctactcaggaggctgaggcaggagaattactgaaccctggtggcggaggttgcagtgagctgaaatcgcaccattgcattctagcctgggcgacagagggagactccgtctcgggaaaaaaaaaaaaagtaggacaaaactgaaataagacatatatgttcatcagtgatatgagtgacgtctttgctgagtcagatggtaatttttaaatatcagaagaacattttgtgccacatgcaacatcacagttgcagacatgacacgcttttaagtttaatctacatgattaaacatttttctcagctgggcacggtggctcacacctgtaatcccaacactttgggaggccgaggcgggcggatcatgaggtcaggagttcgagaccagcctgaccaacatggtgaaaccccgtctctactaaaaatacaaaaattagcaaggtgtggtgatgtgcgcctgtaatcccagcttctcaggaggctgaggcaggagaatcgcttgaacccaggaggcagaggttgcagtgagccgagatcgcaccattgcactccagcctgggcaacagagtgagactttgtctcaaaaacaaaacaaaacaaaaaaatatttttctcatcactttctcaagcctggacaaacaacagaacaacaaatccagtcctgagttatagcatttgccagtttctgtaatgtaaatattcccaggatgtctaaattcaagctgtagacataatattactgagtgcagtgttagaaagagatacataatagctccccattgaatccaccctatggatacaatatggtgtataaatgatataatgtaaataacctcaactgcattgatcatatttaaatgtagtatgagagttaggaagtgatgagttttgaacatgtattgtctttgcttttaggataatttatttaattgtaagcctctataatttatattttttgttctatttggaaggcattgtamaatttaatctttaatgatgcttgtatttaacaactggctcactagtttcctgaaaatttaataattgtttctcatcagtcrggatgagctcgctctagaacagtactgggtgagtggcttttaagtgttacatggatggccataaattatttaaaaagccagccagagccctgcatggtcgtgcatatctgtagtcccagccgctcgggaggatgaggcaggaggatcacttgagaccaagagttcaagaccagcctgggcaacatagtgagaccctgtctctatgaaattttacaaattagccaggtgtggtggtgagcacctgtattcccagctattcagaaagctgaagtgggaggatctctggagcccagaaggttaagactgcagtgagctatgattataccactgccctccagccacaacagagcaagactgcaactctgaaatgtaaaaacaaaaacaaaaacaaaacaaaaaaaaaaccacccagggagggatgagtgctcccatgttgatgcacttacatacctgtctgatgggcttccattcaaaacataaaggtcccccatccctgccctagactgcatctaggattatggggattctgctggtaagggctgccatttgccttggggagtcttgtatgaaacacctttctgcagagtcccatgagaatctcaagctaacgtgcctcgttttcctcctccaggcagccagatgggccgctgggaccgctttacgcttcttcaaaccctgagtatctcagtgccagtgatggtgagtaccatcccttccctgtgggtggccagaaccctactcatcagcttcctttgccttcaccattgagtgagagtgaaggatgggttccccagggaggccaagaaaagccctcttattcatttgagcttgccaaactgcccttgctgcagaaacctcattactgtgtgcatctggacacatggtatttggcacctgcctgaatgggctcatctagccggtctgggacccttgggcagggtcgaccacttgggctgggctcagctgggcrgttcttctggtcttgcctggcttcacccatgtagctacattttgctggtgtgtcagctagcactcggtagtcttagatgatttcactcacatgtctggtggtcagyaggctgggtggtcccaaggtgggggccctaagctgggggaggctgagcctcactctgtccatctagcctcttaggctccagcaggctggctcaggcttcattccatggtcctctgttggttcctagtagcaagctccagggcaagctccagggcaacagtccattccaaatctctgcttggacaattcttgttgattcccattgaccaaaataactcacaaggccatgcccagggccaaggggtggtgagatagactccaccttttcatgggaagagctccaagtatcctggctttttttttycccaacctattacarcctgtcttccatccccttggcactttgcagaaacagtagtctcaggtgggaagtagcatcattccatagcaagggtctgaaatcagacaagaaggatggggatgcaggtttgcctcaggacatattggccaggatcttggaccagttgtggctccttccttgagtctctgccatgccctctccatgggtgcagatgcctgtcctgttctcggccatatgcccagtgcccggcatgggtcctggatcacagaactcatttcatgagtgttttcgagggggtttgggtgagggcttgggtggaaggtggctgcagacccccaagggatcctccaaggatgctgtgtagataagtaagaagtagtgtttccatgctctgtgtayrtgccggacgagtgggaggtgtctcragagaagwtcaccctccttygagagctggggcagggctccttcgkcatggtgtatgagggcaatgccagggacatcatcaagggtgaggcagagacccgcgtggyggtgaagacggtcaacgagtcagccagtctccgagagcggattgagttcctcaatgaggcctcggtcatgaagggcttcacctgccatcaygtggtgagtccagtgggggtgggacatgggctggctttcctgacccttccctttctctgcctcctcctcctgcacagagcgacagaggacacagggtgtaacctcctacccacccctcactccactaagcttcccatcctagaggtgtgaggagggatcattcccttctcaaatcccatcctctcccacttcgcctggaaccagactctatcactgtctcatcactttctggaatgtttcattgctttccagaatctttcatcactttctggaatcttccatcattttctggaatcttccaccactttccrgaatcttccatcattttccacaatcttccattgctttttagactcttccatttcttgctttttcctggcacctttgtaacccaggaccacatagaggtccacctgataccacctgccctcgttcctactctcctttgaaggcagcaccaactcttcctgcctttctgctcctttgttcctctttgagtcctatgtgctttcatccttgccacacatatttatggggcatttaaagccctgctcttgtccctgtgatacagtggatacctgcccctgtagagcttccaaaacagcaggcggagacagactccaaaacctttatttttattttatttcatatatatatatatatatatatatatatatatatatatatatatatatatatattttttttttttttttttttttttttttttttttttttttttttttttcctgaaacggagtctcgctttgttgtgcaggctggagtgcagtggcacaatctcagctcactgcaagctccacctcctggattcacactattctcctgcctcagcctcccgagtagctgggactacaggcgcctgctaccacgcctggctgattgttttttttttttttttttgagatggagtctcactctgtcacccaggctggagtgcagtggcatgatctcagctcactgcaacctctgcctgctgggttcaagcaattctcctgcctcagcctcccgagtagctgggactgcaggtgcctgccaccacgcccagctaatgctttttatacttttttttattagagacggggtttcaccatgctggccaggctggtcttgaactcctgacctcgtgatccacccgccttggcctcccaaagtgctgggattacaggygtgagccaccacgcccastgcctggctaatttttttgtattttcagtagagacggggtttcactgtgttagccaggatggtctcgatctcctgacctcatgatccgcctgccttggcctcccaaagtgctgggattacaggcgtgagccaccacgcccagcctatttttatatatttttaagacagagtctctctctgtcgcccagagtggagtgcagtggcacaatctcggctcactgcaacctctgcctcccaggttcaagcaattctcctgccgcggcctcctgagtagctgggataacaggagcccaccaccacacccagctaatttttgtatttttagtagagatggggtttcgccatgttggccaggctggtctcgaactcctgaattcaggtgatccaccggcctcagcctcccaaagtgctgggattacaggcataagccaccacccccagctgactccaaaccctttatacattaggagcaaatgctatggaaacatgaagaaagggaggaaaggagggttggacaggggtgtatttgagcaaagacttagaggacatgaggagctgggccctgtggatgtggcagggaacagagagccaggcagagggaatgattaaaatacaaaggcctggctgggtgcagtggctataatcccagcactttgggaggctgaggcaggcggatcaccagaggtcaggagttcaagaccagcctgaccaacatggagaaatcctgtctctactaaaaatacaaaaattagccgggtgtggaggcgggcacctgtaaccccagctactcgggagactgaggcaggagaattgcttgaacccgggaggcaaaggttgcagtgagccgagatcacgccactgcactctagcctgggtaacagcaagattccgtctcgaaaattwaaaaaaaaaaaatacaaaggcctatctgtctgctgtccgggcaggtatgtctgctctcctagaccagggctgagcacgctgcatccaggccacagggtgctgtgtgtgacatagacaccagggagggaggagaaccctggtgagtcgaatcacggaccctcctccaagaaccctggttgcttgctctgcaggtgcgcctcctgggagtggtgtccaagggccagcccacgctggtggtgatggagctgatggctcacggagacctgaagagctacctccgttctctgyggccagaggctgaggtaagctgcttcgggggacccagcggggtactyrgtggagcacccgctcctggcctcctcggatcccagtgctgctgaaacaccaaccccgtgtttctgttttagaataatcctggccgccctccccctacccttcaagagatgattcagatggcggcagagaytgctgacgggatggcctacctgaacgccaagaagtttgtgcatyrggacctgrcagmgagaaactgcatggtcgcccatgattttactgtcaaaattggaggttcgtctggctttctgctttgaaaacataacgacccaggccaggtttgatttcagaaggaagttgtctataatgagccgttaagtcttttctgataatataaaggggcaagatacttcttttttttttgtggggttttttttgttttgttttgtctttttgtttttgagacggagtcttactctgtctgttgcccaggctggagtgcagtggtgtgatctcagctcactgcaacatccacctcccaggttcaagtgattcacctgcctcagccttccaagtagctgggactacaggtgtgcrccaccatgcctggctaatttttgtatttttagtggagatggggtttcatccatgttggccaggatagtcttgatctcctgacctcgtgatcctcctgcctcggcctcccaaagtgctgggattacaggcgtgagccactgcaccggctttttttttttttcttttttctgacatggagtcttgctctgtcgcccaggctggagtgcagtgacaggatctcggctcactgaacctccacctcttgggttcaagcgattctcctgcctcagcctcctgagtagctaggattacaggcgtgcgccaccacacccagctactttttgtatttttagtagagacggagtttcactgtgttggccaagatggtctcaaactcctgacctcatatgatccacctgtgttggcctcccaaagcactgggattacaggcatgagccactgtgcctggctgggcaagattttggatggggaccccccaccagctgtcatttaattgcatgtattgataaactcacttacccattcacttctttaaaagatatgtttgtaggaccgggggtcccgcctgtaatctcagtgctttggaagtccaatgtgtaaagactgcttgagtccaggagtttgagaccagcctgggcaacatagtgagactccatctccttgaaaagattttttaaaaagtggggtgtggtggtgcacacctgtggtcccagctactcaggagkctggggtgggaggattgcttgagcccaggaggtggaggctgcagtgagctgtgacagcatcactgcactccagcctgggtgacagtgagacgctatttcaaaaaacaaataaaaaaggaatatagaggggaccagagcagcgtgagatgtgaggatgaggagagaggcagaaaccagacccagaaggaccttgcgtgtcacagcaagtcatctcgacattatcttacattagcaaggggcagcaggaagtgatatgattctatttatgactcaaaaagacatctcctggccaggtgcggtggctcacccctgtaatcccagcactttgggaggctgaggtgggtagattacctgagatcaggagttcgagaccagcctggtcaacacggtgaaaccctgtctctrctcaaaatacaaaacattagctagacatggtggcagacagctgtaatcctagctactcaggaggctgaggcaagagwattgcttgaatcagggaggtagaggttgcagtgagccaagattgcaccrctgcactccagcctggaggacagagtgaggctccatatcaaagaaaaaaaaaaagaaaaatgtagcttctttgtgatttggtaccttcttttccctccctttaaacagtagcccatcttcccccttcacttccccatgcgtaccctcagaatccattcttactggatttggccaccacccaggtgagcgcagacgtgggccaggtgaacccctcttagggctctgtgagaggtggggcagtcaaggtggcagatgctaggaccaaggctgaaggttaagagcgtgtgaaccttttgtgttgtcagactttggaatraccagagacatctatgaaacggattactaccrgaaagggggcaagggtctgctccctgtayrgtggatggcacygrastccctgaaggatggggtcttcaccacttcttctgacatgtkgtgagttgtgtgtggatgggtggatggacgctgggcttgaattccaggtgctagtgagagccaagagcgggggaaggaagcctgccatcctcctggacgccccatcaaggaaaggaaggcagcgtcctgtcttaggatcttcccacggctactcttatgtcctgactaatcctgtaggcattgtgaaccccgaaaatctgagacaggtctcagttaatttaggaagtttattttgccaaggttgaggacgygtgcccgtggcacagcctcaggtggtcctgaggacaggtgcccaaggtggtcagagcacagtttggttttatacattttagggagacatgagacatcagtcaacatatataagatgaacattggttcggtctggaaagacgagacaactcgaagtggggagggagcttccaggttgtaggtagataagagacaaatggttgcattcttttgagtttctgatgcgcctctccaaaggagccaatcagatatgcaggtatctcagtgagcagagtggggactctgaatagaatgggaagcaggtttgtccaagcagttcctagctggactttttccttgagtttagtgatttgggagccccaaattgattttcctttcacagcatttatgaactgcagcatgaattgttttattaagtggctaaccatgttctagaaaccaagagatgtgtttgtgtgtgtgtttgtgtgtgtatgtgtgtgcatatgtgtgtttgtgtgtgtttgcatgtgtgtgcgtgtgtgtgtttgggtgtgtgtgtttgtgtgtgtatatgtgtttgtgtgtttgcatatttgtgtgtgcatgtgtgcgcatgcgtgtttgtgtgtatttgcatgtgtgtgcacgtgtatgtgcgtgtgtgtttgcatgtgtgtgtttgcatgtatgtgttggcatgtgtgtttgcgtgtgtgtgtgcgtttgcgtgtgtgtgtttgcgcgcgcgcgygtgtgtgtgtgtctaaatggcttctttgttactactatcaactgtcatcggcaggtcctttggcgtggtcctttsggaaatcaccagcttggcagaacagccttaccaaggcctgtctaatgaacaggtgttgaaatttgtcatggatggagggtatctggatcaacccgacaactgtccagagagagtgtaagtgtagaaagggtttaaggtgtgtgaggtgttcgttgaaagggtattgccctttacacgtgtgcttggttttgcctttcctatgtctacacgctcaccgtgtttgcatgctgtatgttacaggtgtgtttgtgtttgcatagcttgtctttacatgcatgcttgcatttgcatattgcattgtggtacacacacttgagttcccatatgtgctacatgtacgcttacgtttgcatattatatatttacataggtatttatgtttgcatattatatgtttctgtgtgcatcagcatatcatggcacatgtacacctcatttacatattataagcacacatgtttacatattatgtctttacctgcctgcttgtgttcacaaatcatatgattttcttgcatattgtatctttggaaggttgcacaaaacacctatagcggtagttatcttgggagaagggaactggagacctggggttgggggagagagacctgtttgcctgttaatttttttttttttttttttttttttgagacggaatcttgctctgtcacccaggctggagtgcagtggtgcgakctcggctgacttcaagctccgcctcccgggttcacaccattctcttgcctcagcctcccgagtagctrggactacaggcacccrccaccgcgcctggctaatttttttttttttttgtatttttagtagaaatggggtttcaccgtggtctcgatctcctgacctcgtgatccacccaccttggcttcccaaagtgctgggattacagccgcctgttaattctttatacacttaaaattttgtcaggtagctgggcatgggtggctcacgcctgtaatcccaagcaatttgggagaccgaggtgaacgatcacctaaggtcaggagttcaagaccagcctggccaacatggtgaaaccccgcctctattaaaaatataaaaattacccaggcgcggtcgtgggcgcctgtaatcccagctactcaggaggctgaggcaggagaattgcttgaatcggggaggcagaggttgcagtgagcagagactgcaccattgcactgcagcatgggtgacagagtgagattctgtctcaaaaacaaacacagacacacaaaaattttgtcaggcatacatattatatattcccccctccaaatatatatgcatatgtacatatatatatatttagatgaagtctcgctgtgtcacccaggctggtagagcgcagtggcacaatcacagctcactgcaaccttgaactcctggactcagcctcctggctcaacctcccaaagtgctgggattactcttgagccagttttgaaatgaggaatcccttttcaaaaccatctttcaggctggacaggatggctcatgcctggaacctcagcactttgggaggttgaggcaggaggatggcttgagcccaggagttcaaggctgcaatgagctatgattgcgccactgcactccatcctgggtgacaaagtgagaaaccctgtctcaaaaaaaaaaaaaagcggccaggcatggtggctaacacctgtaatcccagcaccttgggaggccaaggtgggtggatcatttgagcctaggagtttgaggccagcctgggcaacatagcaaaaccctgtctctgcaaaaaatacaaaaattagctaggcatggtggtgcacacctgtggtcccagctacttgggaggccaaggtgagaggattgctcgagcctaggaggcagaggctgcagtgagctatgatcatgccactgcactccagcctgggtgacagaatgagacgctgtgtccaaaataagaagaagaaaagcaaaaagaaaacaccatctctcagcacctctagcaatgctatttctgccttgacaattgtccacacacacagccagcatctgatgtgagcacatgtggtccgtgggtgtyggctgcagggacaagagtrggggtttgggaggatgcgtggcagggcccccagactcacccaggacgtgtccttctgccccgcagcactgacctcatgcgcatgtgctggcaattcaaccccaagatgaggccaaccttcctggagattgtcaacctgctcaaggacgacctgcaccccagctttccagaggtgtcgttcttccacagcgaggagaacaaggctcccgagagtgaggagctggagatggagtttgaggacatggagaatgtgcccctggaccgttcctcgcactgtcagagggaggaggcggggggccgggatggagggtcctcgctgggtttcaagcggagctacgaggaacacatcccttrcacacacatgaacggaggcaagaaaaacgggcggattctgaccttgcctcrgtccaatccttcctaacagtgcctaccgtggygggggcgggcaggggttcccattttcgctttcctctggtttgaaagcctctggaaaactcaggattctcacgactctaccatgtccartggagttcagagatcgttcctatacatttctgttcatcttaaggtggactcgtttggttaccaatttaactagtcctgcagaggatttaactgtgaacctggagggcaaggggtttccayagttgctgctcctttggggcaacgacggtttcaaaccaggattttgtgttttttcgttccccccacccgcccccagcagatggaaagaaagcacctgtttttacaaattctttttttttttttttttttttgctggtgtctgagcttcagtataaaagacaaaacttcctgtttgtggaacaaaakttcgaaagaaaaaacaaaacaaaaacacccagccctgttccaggagaatttcaagttttacaggttgagcttcaagatggtttttttggttttttttttttctctcatccaggctgaaggattttttttttctttacaaaatgagttcctcaaattgaccaatagctgctgctttcatattttggataagggtctgtggtcccggcgtgtgctcacgtgtgtatgcacgtgtgtgtgtccattagacacggctgatgtgtgtgcaaagtatccatgcggagttgatgctttgggaattggctcatgaaggttcttctcaagggtgcgagctcatccccctcwctccttccttcttattgactgggagactgtgstctcgacagattcttcttgtgtcagaagtctagcctcaggtttctaccctcccttcacattggtggccaagggaggagcatttcatttggagtgattatgaatcttttcaagaccaaaccaagctaggacattaaaaaaaaaaaaaagaaaaagaaagaaaaaacaaaatggaaaaaggaaaaaaaaaaagaactgagatgacagagttttgagaatatatttgtaccatatttaatttttaaagtctctggtattagcctcataagttattgactattccccggggttggcggggagtggggacatgagttggtctgcctgttgtggggccgggaaggggagggagtcaggcacaagtggcctctttgtttggtcttaaaggcatccatttctgggaatkaagccatgttcgctgctaacacttttggatgttgtgaggccacgtggagtgtgtgagagactaggttttatggatggtctggttcaggtaccaggtctgctggaaggttcctgttcggataagctggtagctacctagctctgagcctgccttcaagaacacctgtgttcatcctctgattctctgtgtgtacctcttgtggcgtttcctctcccgggtgtgaacatcctaaccgttattgtgcaaacccaagaacgtcagatcccaaagcacaacaacctggatggactttgggaacatctaagcaatrtaagagagaggtgcactgagagtacgtcttggtcccctccaccctgagagcatctgacggtcctcagtactgaactcccggaagctgctctgagcccggtgacctcatctgggccaggtgtggtgcctgagctgaatgctcaggtgcttacagtgttgcaatccctaagagagtagagtctggaggagaaaccgtgaaaaagaccttacacaccaccaagaacttccgaatgggcgtgaatccaccgtttcttctctttgcaaaaagaaccaccacagctgctcaaagaacacagtgaactcatcactttggttcatcaaaaaatcatcgcccatgcgttattcctgagtgcattttcttacaactttttgactgcttccttttcttcttctcttaagagttgtgggcttaagaatgggatagagtcataatggcaacctccaagccctctcaattcttgattaagaacacaggtagacatgaatcccaattgtctattgctatcttatttatatgattcgggaaaatacagcatgtaaaaatattgctgaggagcctcagtgattgggtacaasaagcaagagtacagaaattatttttgccaaatttattttgtaaatatgagggtctgtacctaaatttaaaaaaaaaaacacgtagaactaggtattttgttctcttcttagtaaatttgtagtggttgtatactacactagctgcaattttcacatttttctaattcagaaaggtttttcttatattaggggaaaaagtatttattttaatatataaaatcactctgaaaatcactctcataaaaaatggagcgcatgtaaatttttatcaaagaaaaataaacaggtgaatgggggatagtgattttcttttttcagcacagtctacctcagtgtattgttaagatgtgattcaatcatggacatctttgagatttcagaattctacctggaaccggtctgaatcagggaacgtgtgtatcagctgattcgaatgccagggaccagtaagaattttgagggagggagttgggatggagaaggtatggcctttatgcgagcatagatccttttcttcctggctggtaatattcttctctgaatttaatcttcctttaaaaaaaaatcctccatctattgtcactatgttccccaaacataaactaagttccaggctgtcatgatgtatctgatatatggggtaacccagcaaggtgtaccttcctttggtgagagatggctgccggggcaaagacgggctttgattcagagcaagcattcccacctgttccatggaatccccctgaagtgagcacaaaggtgccctgggctccctgatggtttatgcccactcctttcaggctggtgatgcaccttacacacaaacacctaatgcaatgtctttttaaattctccaagtgggatgggagcatgtgagggaaattccaatccaaaacccattaatgtgctgaacgctttttttttttttttttttttttttgcaacaacaccttggacctctgtgttggggtttgactgacctcaagctgatattattggaccttgtgcagctttgataacccatgtgagagtctaggcaggaccagtggggcccaaatcttgctgctcttgtacttttaggcactgcccttgcagactcacctttctccacctgccctggagaaaggtagggtgtgctgggcctgccccttgcaaatgggattcaccagtttcatttatttgactctactgccacagtgaaaagagcaaacagctattgggttgcaaacctcctttgacattaggaaatgttgactttgtaacaataaaactttggtcctagaaagacacggttgtcctgggagtttgtagtgttaagttgcaacaacaacaacaaaaagcaacaaaaccagcttaggataacactttttgttgcttgttcttaaagatgtctcactatgattaaaacccttttcattaatgtagtgaaagccacacaggagttccttcttccaggaggagaataccaagcacatcactttctctctgcatcagtgatgtcaaatacgcatcagaaaatgttcaggttttaggagctgtcctaggtgctgtttcatcattggaagcagtgagaaagagaagcactgctgcttgtctggatataggctgaggatgattgagagaagctgtgggaactgacacaagggtctgcataggtcatcctgtgaccctggggactatgttaccaactgacagacagatctttcactgtatcctagcagggcaggtagtccaccaagaaatgtgcttattggattgggaggtgtttatttgtagtctgctgtaacacgtgtgaaagagcaggagcgtcatcagcatatgacttgcgctggtcatccggtaaatggatgtgctgtagtcccagtgctaatcatttctctccttcacagtgggtggaagtttagggttaaatgtcctttgaatgtcacctggtgagtccttgacaccttaggctcttcagaaacaatggttttgttgaggatggggaacagggaatgccgattttatatacatggtacacagagaggggtgtcacttcagaaaatcttccagcatgttcttcagaatattaatttatatgcgaggtgaggttgggaatgaaaagaacaggtcagcacttttttttttcctagaacatacaaaagaacatggtggactttcagggagtgcaatggaaggtgaatatttccttaagggtccccgagaaatgggagtgaggggaggggacacaatggctttttgagcttacttttaccttctgatactagtcaaggtccagaaccagccaccagccaaatttctatctgggtgcgggccactgaaaatccttgttaaaaaccagatcacaaatctggggctcttggtcccattggagaaggaaggaagagcctcaaaataagtgtgcacccatgcacatattcaggaacagcttgtttagtctttacactttgcctgaaagttgcttctcctcgtccctttgtgtgcctgggtggcctcggccctgtgcgttggcaacgcaggatcaaatgtgctgcagcttttgcagaaaacaactcagaaacacaaaaccccccaacagctcaattattattttttcaatgttttcctacaagagccaagtagcaccatgtacagaagacgcctttttttttggaatattgaaatcgttctgcatgtaaaatatgggataatgacctgtttatattaaaattctgattaaattatctgagaatacgcttgtttttgtgtggtgtcccggtaaggacctgtcgtgtggtcgggggatgtggctatgagttgggctgtgttaaggaaaacctcttggaatatgtaggtgcctttttttagaggagaaaaacacctagattcttccacacatgaaaagggaggttaaatagttgctaccagcagagttgatgactcgtagggacatacttgtatggccaaactggtggtttaaatattgcactatttccataccatttggtaagtaagcgcttccccaagggctcccagacctccccatggtccaaccactaaagggttcactccgagaataccaatgaaccttcaagatcttgctctattctgacatgcgggaaactcatatgttaagtattttcaatgtcatcctgggagtggagacctgtcccaggttgggtggacaggtgagtgaccatgggttagaccatgggattgaaagccttttgaatagtctttcttgagtggcttaaaacagcaactgtttatttattttctttttttgtttgttkgtttttgtttttgttagtttgttttttgaaatggagtctcactctgtcacccaggctggaggacagtggtgcaatctcagctcactgcaacgctgtctccgggttcaagcaattctcctgcctcagcctcccaagtagctgggattacaggcatgtaccaccattcccagctaattttgtatttttagtttcatcatgttggccagactcgtctcaaactcctgacctcaggtgatccgcccgcctcagcctcccaaagtgctgagattacaggtgtgagccaccacacccagccttattattatcattatgatgattatttttgtatttttagtagagacgggttttcgccatgttgcccaggctggtctcgaactactgttctcaagcgatctgcccgcctcggcctcccaaagtgctgggattgcaggcatgagccacggtgcctggcctgtttcttacagttctatgtgttggttgggtggttcttccgggaacagcctcwctcctgtgctgaggcctctgctgggagagccaggattgcttgtcttctaggaggttcactcaggcttgttcatatggtggtggttgcagggatacccagtcggaaggaacaaaaagcccccaaatgtaaatattttccaaacttctgctcgtgtggtatttgctactgtcccattgcccaaagtaagtcccatggccaaacccagagtcagctttggagaggactgtccaaggatgcagataaaaggtgatgtgaaccaactagagtccaatcctgcaataatcttccactcctttaccctcctatcattattattatatttttttaataatataaaagtgggccgggcgcggtggctcatgcctgtaatcctagcactttaggaggctgaggcgggccgatcacaaggtcaggagatcgagaccttggccaggagatcacctggccaacatggtgaaaccccgtctctactaaaaacacaaaaattagctgggcgtggtggcgggcgcctgtagtcccagctactcgggaggctgaggcaggagaatcgcttgaacctgggaggcagaggttgcagtgatctgagatcatgccactgtactccagcctgggcaacagagtgagactctgtctcaaaaataaaaaaaaaaatactactactactactaataataataatataaaggtaaagttctcactttaccatcctattattattattattccttgtttttgagatgggagaaatagcagtatggatgatgacagggataatccagtcatcagagggaaaagagatgaaggcaggggatcactagctctatgtccttaagcaaacaagtgacgatgagatctacggcacaggtggaggggttgaccttagctaaagtgcaaagtatgtgggctgtggaatctctctccctcccaaaggcaatggaactcaatccccaacccctccaggcggtctctggatttctccagaccacctacctccagctggcagtgttctgagctgggccatcgaaagttgaggttattgaatgtgtgtgtttccccattatcctgggagctttccagaggctgcatgaaagttgcgtctgaattcttcacattcctccaaactctggcccagagttccgcagtatggggttgttaaattagcctgaagacacacaaagcaactaactggctaagtggctggttttacaaagggcggtggtcctaaccctgggctctggaatcccaatggtcattccagctctctcccctcctcctttctgctcccagttctctgccatccagctagcaggctgatcatggcccacagaggccctaccctcctattattgacgatagaccttaccttatatgaccatggcaaagattaaatgaggtaacattgatctctcatgctcccttcaggatggacattcccatatccccaagtccctccaagttccctgttctccaagaaattgatgctactgcttatcggctgtggtggcagcgtaaattctgcttccctgggtttgtgaaattcaatgtgagtctcttggaaaatggaaaatgtttttcttccaaggaaagctcatcaaggaaggcatcagtctcagggagggtggacggccgtgtggtctctgtgcagaggagccacttggattccttgaaagccctggccaagtgatcacagcaccttttagcagggtagctggcgccctggcctggagtggggagtgtctgcactgggttcctggagcttcctcctgggccttgggtgcttatcagaatcccacttattaaaaacaaaggtgtgtctgtctaagccacacccaggcctcctccatgagcatctatggggcagggcctgggaacttgcattttaacaacttccccttcccccactggactcagctgactcaggacaagaacacgggaactttgcttccattctgcctttgcctgtgtaagggatccaaatatgccactccaaagtatgccacttttggccgggcacagtggctcacacctgtaatcccagcactttgggaggccaaggcaggcggatcacctgcggtcaggagttcgagaccagccaggccaacatggtgaaaccctgtctctaataaaaatacaaatattagctgggtgtggtggtgcacacctgtaatcccagctacttgggaggctgaggcaggagaatcgcttgaactcaggaggaggcaggagaatcacttgaacccgggaggcggaggttgcagtgagccgagatcacgccactgcactcaagcctggatgacagagcgagactctgtctaaaaaaaaaaaaaacacttcacaacaacaaagtatgccactttggcacattggttattttgagttaaaggtgcttgaaaaatagcaaacaagaaggacactctgactttcctttttcttcctgaaagcaggagatgaaactaccatact

SEQ ID NO: 12319 - DNA, 73763 bp, Homo sapiens
  misc_feature (1)...(73763): n = A,T,C or G, or insertion/deletion polymorphism (see Tables 1-2)
tttttcctgccttttgtcctcgccattgcagtgtcttgatgggatgtctctctttggcaccctttgggatatgactctgaactctgccttctggctgcagtcccctcaactctggatggagctctattatttttgtgtgggggtgggggcttatctcctgagccagcctctgcttgtcagaacacactcttcctgcaagcatggtttccacgggcccctgctatggcagccacagcctcacatcgtgaagaacacactcttcctgcaagcacggtttccacgctcccctgctgtggcagccacagcctcacatcatgaggatgatacgcagccattcaagggataacctctaaggacagcctggcatgtctgaactcacttctcttcccactgccagttgagccttgccttctagctcagtcagcactgggagactaggctactcaatctggtggtcttttgtttccagctctccccaatatccctattgtgcattcctcatgccccatactctccttgacttcccctaattgaccccaacttgtgtcctacatccttcatctccccagacctgacctaatgattggagagaggaagcaggatgttgagcgagggaagctgaatttctcctgcactggagcctggctgcagaacctgaggaagtaggagggatgaagaagcaagaaagcttccagcaacctttagtcagcctcaagaagtctccggctaggaggcaatgctaaaccaggacaacctagagataccctggctggccagggcttcctraaaaagacgtgttgctgggtggttgcgttgccttaagaacacacccattacccagtgaatctgccgtgagtcagagagacgcccctgaagacacattacctggaggagataagctccccagcctcccccacagccattccccagtctcttctcttcagcttcttcatttctcctccttccagtctggccactggctcaggccacagcggacaccctgttcacagcctgcatcaccctcctgagacagaaccttctccaagtgtttgcctttgggcaggtcccaaggtaccacctggagctgctggaaagggtagtcctgacagcaaccccctggtgatccggtccttgctagctcctcccccggcctccctgtaatgctgggtgcagagggatgcaccagggagctgcgtgtaagtggtgaacaggagagcgtctgggtgactgaacggggagaagggaggggaaaggatgggagaggctgaagcaaacatctttgaggaaaacgggtaatgacggagctggtagacaatggtgagagaaggaagggtgacactgaaagtagtcatgctcctttttatttaattgagatcttctttttctctttttgccaattaataatatgttttggtctgggggatgcttgggaaggccccattgttcaaaatatctctttcaggaacctggaacaccaccatttgagactcacttctttaggtcttgagggctttttggtctttgagatgcttttgtgtaaagttaatgcacctccagtgccctctgaacaaaggccggtgaacgtggactaagcttccctggccatccttgtctcctgcagcttaccctcctccccgccccaacctgaaggagtagctccctccccgttgagagctccatggctacgcctaatttacatcaccctccccaagctggaggagtagttccctccccatcccagagctccatggctttgcctaatttacatgaccctccccacgctggaggagtagttccttccccgtcccagagctccatggctatgcctcacttgcctcactgggcccaagctgtcctggaagggaggaagctgcggatgtgtctgttcccttccttgggctgtgagcacctggatggcagggactacagagaccccagggggtggagggggtgaaaagcaagtttcacatgtcctgtttggcctgagaccaggcccctacctgacttatgctccaggtcgcagacagaccaattccacagcagaggaatctatttcaacgttgtatcagactccagtctaggaagcagaccacactgagtgagtatatcagtcagagttccccaaagaaacagaaccagtctatatacagtggtgtgtgtgtgtgtgtgtgtgtgtgtgtgtgtgtgtgtagagagagacagaaagagagagtttagaaattgtctcatacgactgtagaggctttgtcagaggcatttgaaccacagcaactccatcttgaataggggctgggtaaaataaggccaagacctactgggctgcattcccagatggttaggcattctaagtcacaggatgagataggaggtcacaagatacacgtcataaagaccttgctgataaaacaggttgcagtaaaggagccggctaaatcccaccaaaatcaaaatggccatgagagtgacctctggtggtcctcactggtacactcccaccaccgccatgacagtttacaaatgtcatggcaannnnnnnnnnnnnnnnnnnnaacctggaacaccacccatttgagactcacttctttaggtcttgagggctttttggtctttgagatgcttttgtgtaaagttaatgcacctccagtgccctctgaacaaaggccggtgaacgtggactaagcttccctggccatccttgtctcctgcagcttaccctcctccccgccccaacctgaaggagtagctccctccccgttgagagctccatggctacgcctaatttacatcaccctccccacgctggaggagtagttccttccccgtcccagagctccatggctatgcctcacttgcctcactgggcccaagctgtcctggaagggaggaagctgcggatgtgtctgttcccttccttgggctgtgagcacctggatggcagggactacagagaccccagggggtggagggggtgaaaagcaagtttcacatgtcctgtttggcctgagaccaggcccctacctgacttatgctccaggtcgcagacagaccaattccacagcagaggaatctatttcaacgttgtatcagactccagtctaggaagcagaccacactgagtgagtatatcagtcagagttccccaaagaaacagaaccagtctatatacagtggtgtgtgtgcgcgtgtgtgtgtgtgtgtgtgtgtgtgtgtgtgtgtgtggagagagagagacagaaagagagagtttagaaattgtctcatacgactgtagaggctttgtcagaggcatttgaaccacagcaactccatcttgaataggggctgggtaaaataaggccaagacctactgggctgcattcccagatggttaggcattctaagtcacaggatgagataggaggtcacaagatacacgtcataaagaccttgctgataaaacaggttgcagtaaaggagccggctaaatcccaccaaaatcaaaatggccatgagagtgacctctggtggtcctcactgctacactcccaccaccgccatgacagtttacaaatgtcatggcaacatcaggaagttaccctaaattgtctaaaaaggggaggcatgaatagtccacccctagtttagcatatcatcaagaaatagccaaaaaaaaaaaaaaaaaaaaaaggcaaccagcagccctcagggctgttctgcctatggggtagccatttttaaaaatcatttactttcctaatgaactagctttcattttactctatggacttaccttgagttcttccttgcatgatatccaagaacctgctcctggggtctggattgggacccctttcctgtaacagcatggtaagtccaaaatctgtagagtaggctaagaccctggagactcagggaggagttacagtttgaatctgaaggcagtctgcttgcagaatttcttcctttcctggggaagtcagtctttttccattaaggcctttagctgattggaagaaatccacccagattatagaggtaactgctttactcaaattccatcagtcaaatctcattcaaaaaacaccttcacaaaaacaaccagaataatgttttgaggtaggatttttgttcttggtcactttgcaagctggaaacccccagctggcgatgtcctgtccagacctccctcagccaggctggcatgccccagcttgcctgtgttataggttgtacctgcattcaatggttcccgagctcttgtaccacaccaagaagaatgaggatatactggacattgaagggtgatgggggtggagaagaattttattgagtgacggaatggctatcagcggagaggggacatagggggtggccccccagccccacagtcgggtggttctcacctccccaagtggctgggtctggggctttttatgggctcagaataggggaggggcaggccataggtagtattggaaaaggcaacattcaactggttaaaaggcattattcagaaagaatcaatcaggaaagggtgggcaaacaggaacagaagttctaagtctgagtcgtgggtttcgtctgggaccagcagtccagcctttcagctctgtttttggctggaaggtggggtttcaccagggacccacccccacctgccaatgcatttggctgcatcccgtggctatcagtttgaccaaatatctgggtactgagccgccatgaggaaagcagctgccaaggactgagcccctcctctgcataataaaacctttacagaaaaagaatttacaattttcactcctgccaagttgacatgtaaaattaatcatcaccagtctgctccttgtcaatctgggacccacacatctctccttaaatcatacttcaccttcaagtaaagacaataacaagatcgtagttctgtctaacatgacacaactatccttgctacaactgcatcctactgcactaatccttttcccagaagaggatacaaagtccttaggtgtgtgaaaggaaaataaatcttggggccccaaaatcactaagctaaagggaaaaatcaagctgggaactgcttaaggcaaacctgcctcccattctattcaaagtcacccctctgctcactgagataaatgcatattctgctggcccctttggagaagctaatcagcaactcaaaagaatgcaaccatttgtctcttatctacctatgacctggaagccccctccctgcttcaagttattctgcctttccggasggaaccaatgttcatcttacatatgttgattgatgtttcatgtctccctaaaatgtataaaagcaagctgtgctccaaccaccttgggcacacgtcgtcaggatttcctgaggctgtatcacaggagtgcgtccttagctttggtaaaataaacttcctaaattgattgagacttgtctcattttgagggttcacaggtgatatttacttatttgagatcctgtaacttaaacactatgatgtaaagttagcaatattaaattctatgagataaagtaatgcatcttatgttacacgataaatgaatacgaaagggaagaaaacaaaggtgctatacgcacactaacatattcataacaaaataaggaagaaacactcatgacaattacagttctggtttttatacctggtcatgtagttgtggctggtattgataactatcttatttcactactcattccatattccctttgccctcagcaagcacctgagtggccatggatcgttgcctggtgaggtgaccagaaccctcgttcctaaagggtctggggtcattagtagttctgcctggattgggttgttgtaattttccactgactttaatcacagggcatgggaatactgagagacgtcctatggtatctcctgtatttcagacatactcttccttacctccactgtgacattcaaggggtatggctttggccccaccttcttgaatctgccttcagattcaaactgtaactcctccctgagtctccagcctcttcttggaaatggccctatctaaaaaccacttggccattttgaaatctytctcaggtcctgattctgggttatgctcagggcagtctctgaagatttctcatcctgttcaggccggttccttgctaatttatgcccacacatacctggcagggagagctaaagatggagttggtgggagctgccctttggcatcattgatttttaatgtattcctaagcagcagcatctgtccttgatcctctgcttgtcagaaggccaaactcacagacattttaagcttaaaacaaacagttacaaagctgttgaactttgcctgtgcaaggacaaacacaaaaacatcccaaggcccaccccccgcygacccccactgtacttgtcacacatatgtgagaatttccattctcagctaaaggcaagcattgaaagaatacacagaaagcctggaaaaggtttccaggggtgtcaatacgccctgtcaactgagaattaagaggatccggctggtcacttgcctggagaggatcctgcatgctgatagtgctgaggcacctgccagctaaggtgagagacagctgaacttgaacatgtgggctgtcactgaragcggtcagcagaagaaaatttgagccatgggtaaggcctggtagaaagggaggaggttggggaggcgtgaataggcctttggaaagaggtgmtgttaacccaaaacagagaggcagcagctttgcaattagattttctttttgaaatagcaggctctgtccctggtagcaatagggataaataaaaagtaatatgtattcattgggaaaataattggaaaaagaattaggcaaaataagcatgtggttttgtatcttgttttttaaaacagcttgttgtaatrcattagatattctttgaaaaaaatagaatttgaagttcagaaaatcaaatcagttttagggattgagaatctcactacatattttgtctttcaaaattgtttgtttrtttatttatttagaaatggggtcttgctatgttgtccgggctggagtgtagtggtacaatcatacctcactgcagcctcaaactcgtgggctcaagggatcctcctgtctcagtctcctgagtagctgggactatagtcaggcacacctcaccttgttcccagaccaaactgagggtcgggctgcttattcttgcggcccagtaatgagatgcagatgaactgggaaagaagggagtttattgctgtaactgggtacagggaggtctggaaaatatcaccagaacaattcaaaattacaaagttttccagagcttatataccttctaagctatatgtctatgtgtacgtgtgcattcatctaaagacataagtaagtgattaacttcttctaatctataactaagatctgagtcctgaaggccttcctttggagccttygtaaattcatttaatctaaatgggtgaaggtgctggggtgattacccttatcttgtgtcctgctaaatcacagggttttggggagttcctttagtccccagtaaagcttgtttgtgaaggtctggggagttccttaagatccacaataaaacttgtttaatcctaaatgggtcctgttaagaattccttcattattttgtcatgctttaaggcccaggaaaggcctaggcaaaactcttggtgggcttttgttacattcaagsctttgtatagggcactgatgctatcagcttttaatatttaacctaaccactcagtcagtgctgaaacagttgttatggaggcctacctgttcagccattatggagacctggcctgccacaaccttgcctggctaacttttaaatttttgtagaaacaaggtcttgctgtttgcctaggctggtcttgaactcctagggtcaagtgatcctcccatcttgttctcccaaagtgttgagattayaggcatgaactactatgcttggccatctttcaaagtttatatgtgtattcatccatttccttattgctgataaaggcatacccaagaatgrgtaatttataaagaaaaagaggtttaatggactcacagttccacatggctggagaggcctcacaattatggcagaaggcaaaaggcacatcttacatggtggcaggcaagagagagaacgaaagccaagtgaaaggggtttccccttgtaaaaccattagatctcatgagacttattcactagcatgtgaaaactacggggggaaccacctcaacaattcaattatctcccactgggtcccttccacaacacatgggaattatggtagctataattcaagatgagatttgggtggggacagagtcaaaccatatcattccactcctggccccttccaaatctcatgtcttcacatttcaaaaccaatcatgccttcccaacagtttcccaaagtcttcactcatttcagcattaactcaaaagtccacagtccaaagtcttacccgagataaggcaagtctcttccacttatgagcctaaaaaacaaaaagcaagttagttacttcctagatacaatggaggtacaggcattggataaatatacccattccaaatgggagaaatgggtcaaaacgaaggggccaaaggttccatgaaagtccraaatccagcagggcagccaaatcttaaagctcctttgactccatgtctcacatccaggtcatgctgatgcaagaggtgggttcccatggtcttgggcagctctgcccctgtggctttgcagggtacaccctccctcctggctgctatcatgggctggcattgagtgtctgtgacttttccaggcacatggtgcaagctgtcagtggacctaccattctgggggctggaggacggtggccctcctctcacagccgcactaggcagtaacctagtggggactttgtgtggaggcttcaaccccacatttcccttcttcactgccctagcagaggttctctgtgagggtcccagccctgcaataaaattctgcctggacctccagttatttccatacctcctctgaaatctaggtggaggttcccaatcctcaattcttgacttctgtgcacccacaggctcaacaccacatggaagctgccaagtcttagagtttgcaccctctgaagccgcagcctgaggtgtaccttggcaccttttagccatggctagagcagctgggacgtagggtgccaagtccctaagatgcacacagcagggggcccctgggcccaggccacgcaaacattttctccttctaggcctayaggcctgtgatgggagggggctgccacaaaggtctttgacataccctggagacattttctctatcatcttggcaatctggctcttcattacttatgcaaatttctgmagccagcttgaatttctcctcagaaaatgygtttttcttttgtattgcgtcaggctgcaaattttccaaacttttatkttctgtttcccttttaaaactgaatgcttttaacagcacccaagtcacactttgaatgctttgctacttagaaatttcttctgccagatatcctaaaccatctcactcaagttcaaagttccacaaatctctagggcaggggcaaaatgctgccagtctctttgctaaaacataacaagagtcacctttactccagttcccaagtgcctcatctccatctaagaccacctcarcctggatttcattgtccatatcattgtcagaattttggccaaagccatttaacaagtctctaggaagttccaaactttttcacatttttcctgtcttcttctgagccctccaaactgttctaacctctgcctgttacccagttccaaagttgcttccacattttcaggtaccctgacagcagtgccccactctaccagtaccaatttactgtattagtctgttttcttgctgctgataaaggcatacccaagactgagtaatttataaagaaaaagaggtttaayggactcacagttccacatggctggggagkcctcacaatcatggcagaaggcaaaaggcacgtcttacatggtggcagacaagagagaggatgaaagccaagcaaaaggggtttccccttgtaaaaccatcagtttttattcactaccaagagagaagtatgggagaaacttattcactaccacgagaaaagtatgggggaaactaccctcatgattcaattttcccccaccaggtccctcccacaacacatgggaattatgggagctacagttcaagatgatatttgggtagggacacagccaaaacatatcaatataatcaaccagaacctataacttttcctcattgaagacatcagaaattgccayctgtattgtactaattgaatgaaatttctgtgtaacaaagccattccagcttctgttggattatccacatgaatgatgcccagctgattataaaaaattctgtactccatgctgagttcctgtaactctagaaaaaggaaaaaaaaaactgtactccaaatagcyacagaaactgggattttaaaaatccctttcttcaaagaaagaacctcagaacaattggtggtgtgcttaacccaaagcatttggagtaggacagacttgggtgggatctgtctttgccacttcctggttgtattgttgtgggmaagttatttgaacctgctaactgtcaatgtgttcagttgcaaatgggaataatcttaggctacttttagaattgttgcaaaagtaagtgaaataatgcatagagggcacttgtcacagtggctggtacatagaaatgaaccatttattgctaaattgtagtattattgcaaacagggagcctgcattgatttatgattccactctaagaatatagcacaatcagtgagatattataaggactcaatcagtgcaaactgaatgaatgaataaattgcatgggttgctgtagcttagggcaggatgggcagaggtgtttttttttttaatcaaatatcctcatattgttccctcttccaagatcctagttacctcaaaagaacattgcttaaatttacagacaacccatacccatgcacaaaatgcttgtgcttaaacaaacactcaattaatgaatacgtaagagttaagtgatagaaagtgggtggggatgcctgatactctccatctttttcccttgaggtcaagcacttgttttacttgctcattcactgcaaggaaaaggcagctcctccagttctcattcatccacagatttcagcattacagtcacgttaagatcagctgtcaaaggctcttttcaacacactagattctgagcaccacagcttcgttttagaagcagcatagaataatatactgggcttctttcctttgctgtcaattccagaaaaagctactcaatacctataaaattctacagattaagggtatgatttccagccaaaaaaaaaaamcccacaaaactttaataaaattcaattgcatcaaaacaaacagaagactgtggggtttggggcagtagacagtgtttttattccctatcrcccagcagaactcagcaaagcaggctgcacgctggctctgtgaggacttggaggtggctgcctaagggcaggatttaacctgcactgtcctgaattaacactgagcacttaatactgagggcagagaagaccaggggcattcagaccccgggcagggccagatccagcaagggaggggctgggaatgattaaattcagctggtattggaggagagtgtgagctagcaggcaaacagacaggagagaacaccatgatctctcaggtcaggggcctcttttagggtacttcattctgactgagaatctttcaggatactacctcttctacaaagcctatcctgaacccttattagaactctgatgacatttatttgtccctcttttagaagacttacaggacttctaatgattcatttagcttacatacatgcttcatttccctccatraacccccaaaatctcaggtgcctcatttccctccatgaacccccaaaatctcagacaggtctctcagttaattcagaaagtttattttgcgaaggttgaggatgtgcacctgtaacactgcctcaagcggtcctgacgacatrtgcccaaggtggtcagagcacagcttggttttatacattttagagagacatgagaagcaatcaacatatgtaaaatgaacattggtttggcccagaaaggtaggacaactggaggcaaaagcaggacagggagggggcttccaggtcacgggtagatgagagacaaacaattgcactcttttgagtttctgattagcctttccaaaggaggcaattagatatgcatttttstcagtgagcagagggatgactttgaacagaacgggaggcaggttggccctaagcagttcccagcttgactcttcccttagcttagtgattttgggaccccaagatttatcttcctttcacgtttccctccttttctttttaaaatcttttggagaaagcattttaggagaaaatgagtccctcgtcccaggtttcatctggtgtctcatggctaggatggtttattcctagataggtaggtcccaagttattaggaaagctcatatttagaaggttgtgaagtctcatgtcctttgaagagaaaacagggggaagaaggtagaaaaacaacaacaaacaaaagaacaatcctggaaaatcgatataggccacattactctgaagtttatacatcagtaggtaggtatgaaagtggctaatgtatgtaaataaggttgctattattttcttctgaaggttgtctagcttcagtttgtggggctttatgaaagcacagctcagttttcagtgactccaaattaggaaaaatgggaaaagaagaagaaaaaaattgaaaacaaagtaacaaaaattactttgaagacttggagccaagaaaaattagaattcagttcaaactttaaaaaataataaaaatcaagaaacgttaggcaagactagaatctaacaactgctgtactatagttttgaatcataatgtttctctcttcagtttcccgtttgtactaaagaaaaatcatggtaggactggtttgctttactatacttggcctaattatttgtatacaatgcagccagagtaattatttttttacataggcttttaaattggytttgatggaactttgttccatagaaggaatctcagataagacatttttttaaagctgagcccagctatggatttgtgccatcaggtacctatgagttgagtgatcctttcctcttgaggttccaagataaacttggggctcctgggcctgtcagaaagtgacattctttacttatgacacatcaggaaccctttacaatggctgtgtagacaaaggtatcacagcagtttatccaatgggcttttattgcctccataagtcaaktttgaatccttaaaggaaagcacaccattccagtcaaaactttagtaaaataaccagtttctccaattgtgtcctgttacaaatgaaaacagattcttattgcacttatgcaaataactgtattgtcataagaatactcacacatagttcccaaattttggagaaatcaggtwgacagaaacaaatatggtctaaattttgttcatagaagtatacttcactcaattgttaaaagctgtaaatagcttaaaagacgttttcttgtatctgaaaaacaaaacaaaggatcagcaacattttaagcaaaaagtttaaaagattactttagtcttttattagwtcagctcacgcagttagcttttgttctgacattcatgaacatttcagttctccatgagagtcctgaaagtttttttctctattctaatgttccaatctccaaagttatcagaaacttgcatctaggaacacctgttagagttctatagttgattataaaaccactttctaaggaggaccaaaacaagacaattgtttgtggatgacaaaaggttttaaggcagccacagtcaaagacacaactgacaaagaaacttatctctgtggcagcaacaatttaacataacaattataattattactgataatgtacattaagtcatatcaaaattataggagtttcccatgattttggaacacataccaataacatatttatataaatacagcccaaagaaagccaaacaccatttcatatttgacaaagtttcctgtatgatttttataccaaataagccaaattatgtcattttggacttcaggaaacctaatatcttaaaggattaattcaagcagaaaaagacataatttataatttgattttggaaaggttatcaaatatcaaaggtttagaacacttgatatcacaggttattgtaaaataagtcattcatttgaccaaagtgataactcaaggatttaaaaaaaaggcaaaaaccttctctttgagaaaagagagctaattttccaaacaataagccctagtaacaacagcaggaagctggctgggtgcggcggctcatggctgtaatcccagcactttgggaggccaaggcaggtgggtcacccgaggttgggagtttgagaccagcctgaccaacatggagaaaccctgtgtatactaaaaatacaaaattagccaggcgtggtggcacatgcctgtaatctcagctactagggaggctgaggcaggagaatcgcttgaacctyggaggtggaggttgcagtgagcggagattgcaccattgcaccctagcctgggcaacaagagcgaaactctatctcaaaaacaaaacaaaacaaaaaacaaaacacagcaggaagccaattaaatttgttctctaaaattttataaacaatctataaaattttaatcttgaccataagctataacttccataagcctttcataacctttataacctttacttaggagttggttaatatttcataaaaacmttgttaatttgacatgggctcatatgctggtcttgcatcagtgtgcctttracattaatgattaatttatagagaaactgaacttattttatctctcaacattggctcttacaatctcacatgcccctttcctgagaaagttgaatracttgaatttttggccctgtgtttcaggaatgcagtttattttgattggcattttctaccgagactaaagatgggattttaattgctgtcagtrtttaaactttagcaggacttggtatcttttttacacccaggagtcaaagccctgtaactaaatgtcacaagtactttaaaacctcatacagagagacatatgggtgtaataaccttaacttaaaaaaaaaatttaatctcagttttttccctaagcaaaccaaaacttaataataatatgacaacttgatcatataggtttttttaaaataaatcctcttattgtgacttacacagactgttcatgacatgcttggactttctggtttgtcctgaacatccctctttcttaagcaaccagtcattttactctaggactaaatttaccatacaagattctttcttatatgaaattatttatctttaagctttcttaccaaaaaaaacctctttatttttataactgtytttttttttttttttttttagatgaagtctggctgtcacccaggctagagtgcagtggcaagatctcagctcactgcaacctccgcttcctgggttcaagcaattctcctgcctcagctttccaagtagctgtgattacagtagcctaccaccacgcctggctaatttttgtatttttagtagagatgggattttaccatgttgaccaggctggtctcaaactcctgacctcaagtgatctgcctgcctcagcctcccaaagtgctgggattacaagtgtgagccactgctcccagccataactttctttacatctcttttattttcctggttccttttatattgttttaaacatgacctttaaataagctttgaattagacaaaaactattcatctttttaaaaatgacacactttttaaaaagaatgttttcttacaaatatatttttattggaaaatacccatataatgaaatatctattacttaatttaatataactttagattctaaattatgagtttgtctacaagtattacattcacctaattattttaattgttttagatgatttatgaaaactgtgatagtcatcatttaaagttatggaaccatcattgcaaaattataacagagacgtgaaaaagatttgcctaactgactccatcttgcttttaacctccaaactctccttgttcattcttcttttctctcctaggaaattgttgtttaaggatcctaattctagttcagagatgcattctaaagggtcttctttttcttcttgtcagctaatagtcttaaatttgcatattaaaggaaacaactcacrtaaaagtcagacagcaaaatttacctcgtaaggtacaaagtgaaagtctggtgagctggagggaaattaaaatgaatttaattaacaattggacataaaattatagacatctatcataaaggccttcaaatacatacatgtgtacatgtacatacacacatacacacatacagattctataacttttactccagtactttagccatgagataaatacaaatttgccagcttgcaagaaaaacccaaaaaactattagacccaaacagtggttttatctcagtggaaaaataacagcagacttaaagcatggcagaaaggaaaatagagaaaaacggactagraactctagaatttgcaggttgaccttagggctctttttcctyaatgtaaatttgcacaaagactgtattacttccattttactctggcaaatagaggtgccataaaaccaataaggtgctctaaagggggtcattctccttgttttctcctcattctcagattgtttcctgcttctttttttttttcttaaaaggaagaattgagctgtggcctagggtttttgtgcatggatcgatgtgagctgcttgtgggcaggactccacagtgtgtcatcactgagttgtttccagcctcttatgcatctcagcttctctctccagaggtctatgwcctctgagagggctcaaaatgccaggtgatcagcccttatatgcatttcctggatgacccatttttaaaattaaatttttctggggatttccctgcagggccactgcatgttgcagggggtcaactccccagacgctcccacgaggcccctggtcacccagggaygcctttcgctggaaagagcaaatgtcctttctctttggagctcagaaaaytcagtttctcatttgcctatgaaaacaacagttcagttcctcagamaaatgcacacagacaaacacaattgagattaattatgggagaaaaagcaatagataagaccctttagaatgcatctcygaactagaattaggatccttaaacaacaatttcctaggagagaagagaaaagaaaagaaaccagccaagaccacttcctgtaaactgtgctcagccacccgtaactttgtagttctcgtctgccattacatgctccaaggtcaaatcctctcacagtgcaaggtcatctctggttcccccaaagccaaagaggtcaggtcatgcaatacaggaaaacagagctttagatgtaagaagaatccgcccacgactcttgaaacttcacagagaaaacacaacactccaaaaggggtgagtggcccctttgttctgaattctttaaaggggttcaagtcattagaagccttctctagatttttttggtactgcagatggcaaagggggaaggaggtatagggtagaagaaaagtaaatgaaataaatatwttttttttaagacaggaagcaaacacagaaagcaagtgcatgtttttgttgttgttgttgttgttttgtttgtttgttttagctgtgagaaattttggccagattagaaaggctttgttacccgtaatttggaattctcactcagattggaccaagtctggaagagtaggtcaaatctgatgggaaagcaaccagaacaaacaacaacaacaacaaaaccccaacaatatgatcactgagcactctaatggtaaaggagaaattcagaccagctggttgttaaactttagccaagacaaaaacccaactcagctacttacctagggatgggtctcaggctgaagactgctttttgtcatcctaaaagcaggaaaaaactcgaattcatcttccctgctgggagtgagctcaagctccctgaaggagttgtctgccttctatcgtcatggaaagaggaaatcttgccttccttgttggaagcaaataaaactccaaaaaaaaggtgggggggagttgtacagaaaaataaactctagatcttgaccaaatttggggagatcaaggattctctggagggtgtgctcccagacctcagcaaattgtcctattggtttgagccgtaaggttagctcatgctgctaccaaggaccagtagatctgtcaaaggtcaggggcatctccactcagaatccctccatggttaccaaaatgtgaacccccccaaatctgagacaagtctcagttaatttagaaagtttacttttccaagattgaagatgcacacctgtgacacagcctcaggaggtcctgatgacatgtgccaaggtggtcatacgttttagggagacatgagacatcaatcaacatatgtaagatgaacattgatttggcccagaaaggtggacaacttgaagcaaaagtgggacagggaggtgggttccaggtcacaagtaggtgagagacaaatggttacattcttttgagtttctgattagcctttccaaagaaggcaatcagatacacatttatctcagtgagcagggggatractgaatagaatgggaggctgggttgccctaagctgttcccagcttgactttccctttagcttagtgatgtgggggccccaagatattttcctttcacacctgtttgaaatgcttgttccttggtgcagtaaagaaatagcacttgaacattgatttcctcagcaaggccatttttatactttctacagaaagggtacactcaccagcagttttgccgtgagcatacacagaacaaagcagacggggtcatttataacctgacacatccgccctactgctgtgtctggtttccattggctggaacaggacctcacattctgtatttgtcctgattggctagtaacttagaactttttaaaagaggcaaaggcagaggagaacaaaggaaggagaaagtaacttgtggaatgctgagaaaggtaaaaacaccttcaaataaggaagaggaacaggctatgacctaatgcttgcttggaccagtataagcacaccacggcaaatatttaggctaaattgtgggagctaagaacatatgatttctttattaaggctagcagattttaagaatgttagcacaggtctttgaataaattttgcttctaagagaagttactatttattcctaattagaggggaggaaagtctttgaagactyacctctactttacttttcacacctccttgaaggcagggactaaggactgtttccctcccaaaactaacgtgctaatttgcaaacagtacctccctgggttgaggagagtgtgctgagtgctgaataccctggcctgaggccttgtacctgaacagagaggaggtggttttacagtagggggagggagagagaatcttggtgcatgcagtgttgggagtgacctgatttccacagactgtctgtgttcaacctcacagccgaatgtttctccagttccaaagtcaacaaccagaacggtagaaggwggggaaaggttgaaggtggggctgagaatggctttgtctgaccccttaacccagtcccaactcctcagttggccctttctcctgggagtctcttgctactatctgtgtcagagttcactcgtgatgccctaaggggcagggcctttgggaaataaaggagaaaaagcacaaaccaaacaaataaattcttccttagcagggttgggaaagataagctgagatgtctcttttgggttaaccattggcttaatctgggttcccccaaatagcagagcctgagcaaggacttgtgtataggtagtttatttggggaatgaatctgttttgtatggttaaaataaggagaagatcaaagtatgagttcatgaatcacacagtttattgccatacaaagaggtctttctttttcacaattcttaaaaagggggagaataatgagaacaaatctcacaggggatacactcaacagacaaggtacattaatcacataatgaatgagttccaatttcatttagagtccaattattaaagttcagttgaagctgagcatggtggctcatgcctgtaatcccagcactttgggaggctgaggtgggcrgatcatctgaggtcaggagttcaagaccaccctggccaacatggtgaaaccccatctctactaaaaatacaaaaattagctgggcgtggtggcgggcacctgtcccagctacttgggaggctaaggcaggagaatcgcttgaaccctggaggcggaggttgcagtgagccgagatcgcaccattgcactccagcctgggtaacaagagtgagattccatctcaaaaaaaaaaaaaaaaaagttcaattgcccacttaggatggaaagcaggcttttgtggatgcaaagtccaatcagagtttgaggcactactttctaggagaggttctcgggagggacagcttgactaatacaatggagatccatgaagatacgtgaggtctcttgctgctagagagcggtgccagygttgtgagacaaggcttcaaaaacagcttcaaggcttccagagagtggcctcgccacatcctaagctctccaagcgtctgtcaaaatcctgggtttctatgtgtttggagtccagtggttgaggtcagtagctcccatgcggggtctgataaggtgtgacatgacattcccttggctagggagagttccctgcatgttctaatcacagtaaaacaatatcactctcacagaaaagtgaaagtgttcggaatcatttaaagctacataacaaaatcccaaggaattggaggggagggctgggaagagtcaaatagggaaggagggaaagagaatggcatccaagggtgtattcgtgagttgatcaagtcggtcactactatgggcaaacagaatgctatcattttaggagctgcatagaacatatctcagaattgcccactggaagactggaagagcagagtatttttcctgcagttcctgcctgccctttggtcaaagtttgtcctttgaggtgttcctttgcacttccaggtttactcatgtgtcagagtggacagcggattcctgcaagggtcccaggttgcagtgccagagacgcagaataccaggtgcagctgaggcaaggtgctctcaggttacacctgttcatacctggttgtcacagcaaagctgggctgggaagatgtaaggccagatgtgtaatacaacctcagaaaggtcaaatgtccttttctgtcttatgcaaataggactacaattcagtttaattctcagagtcaggatctatgttttttcccttggggtaaagaagaattcttcctttaactacttttctagcaaagcataatcctcaaggcgtaattttagtatagtgatttatttttaaccctgtggtactatatgcctaatgttctgaaacaccgtcactggagcaaatccaggcttgagtctatctgtgaaacgggaacagaaaactaagtgcatcctcccttcctgattctcccagtcttcaaggctgtatgtgccaggagctggggataaaggagatagccttagctctccagaagctcacagaatggacagacagagccaacagttttatttgtttgtttgttttttgagacagtctcccactgttgcccaggctggaatgcagtggcaccatctcagctcactgcaacctctgcctcccaggcttaagcaattcttctgcctcagcctcccacctagctgggattacaagcatccactacgaagggcagggtttcaccacattggccaggctggtctcaaactcctggcctaaagtgatccacccgcctcagcctcctacagtgctgggattataggcrtgagccaccgcacccggtctacagttttctttaaatcttcatcatgccagtacttccctcctcctgttttcatcttcctgtatttgcaagtttcattcattctcttcattctattcattccttctctgtactttacctaaacatagttgtgaacccccaaaatctgagccagatcaatttaggaagtttattttcccaaagttaagaatgcacgcaagtgaaatggcctcaggaagtcctgacatgtgcctaaggtggttgggacacagctcggttttatacattttagggagacatgagacatcaatcaacatatgtaagatgaacattggctcagtctggaaaggtgggacaactcgaagcaaggagggagcccccaggttataggtagatgagagacaaatggtcgcattctttcgagtttctgatgagcctctccaaagggggaatcagatatgcatttatctcagtgagcagggggtgattttgagtagaatgggggcaggttggccctaagccgttcccagcttgactttcccctttagcctagtgatttgggggccccaaggtttattttcctttcgcgtagcttcgccactaatgtgtcctggtgtcttctctcctcagcctgtttctcatcctggaaactgaggtgtgctggcgcagggcgatagcgcagtggggtggggttgggaggaaacccttatctgtggccgatggccctccgttgttctattattaaaactctgggaaactgctattcttaatttatttttaaagaccctgagaagcaaatctttaatttttttgtttttgtgagacggagcactctgtcgcccaggctagagtgcaatggtgcaatctcggctcactggaacctccgcctcctgggttcaagcgattctcctgcctcagcctcccgagtagctgggattacaggcgtgcgccaccgcgccctgctaacttttgtatttttagtagagactggttttcaccatgttggccaggctggtctcgaactcctgaccccaagtgatccacctgcctcagcctcccaaagtgctggaattacaggcgtgagccaccgcccccggcctttaaataaattcatctgatcaaaagaaatttaaaaaccaaccaaccctaatgagctctaaagacagcaacacgcacaggacctggaaagagcctcttcctcaccggagttttcctcacttcaaggagcggcgccttcaccctccggcctcagcccgcgaggctgcaaccctttccgcacctggctccatctccctggccctcgcccccgcccagcggtcggggagcgagaaggcggcgggggatctggcgcccggcttaggggcgagacggccgcaccgggagcctagcgatcagggcaccttgggcgggaggagcgccagccgggcacccagcgcggaggaggcggctcggcggccccccgacagccacgccgccgtgagccccgcccagcgtagccccagcgcgcgcttcgcgtgtagaagcgtccgggtggcggaggccgcaggccgcaggagtgctggtggaggggcttccagaaagaccctgcggcagcgccccccctcggctctccccgcaggagagcgggcacctgcgcggcgccgggygaaggcgagagcctcggcgagccctctgcagcggagccccctgcccatttggttttgggtaagaggaggggtccgcgtctctgcagctcgggcgggattccctggcgccctctactcggtttggttcggcctcacgtgttcctttagctccgaagccgggatacgggtggggaaggggggctcgcgccctacaggccgagccctgmggccgcrgcggggtaagggtaggatggccgatcgcgcccagaccccagggagtctccctctcggcttttctgccggcgtctccagcagcatgatctggcatttattattcggaataatgtgccaggcaggaggaggccctgggttaaacacgcggccctgcagctcccaggtgaaacgactcatcgtttcctgccggcgcatcttactgaaggggacccaggccccacgaagggaaggaaccgtcctcaaggtcacgtcgtagtcaaaggccgagcccagaccgaagccaggtgtcctgccttctagccccgggctctaggccctgtccccttcccgaccgaatctcccagtcccgtccgcgtccctcctcctcctcctcctccggggtcctccgcaaggctctgttcccggggtttggggagtcctccctccgcgccacagcgccctggggaagaatgctggacagcaggcaggccacagggccggggaaggaggaggagccgcggggacaggctggggatgccagagtggtggtgggcccgggactggccagggtgggagtccaggcggcgcacccgcgcgaggacaagggggctttggctgggcggtgctgtctcaaccaatgggaagcgtggctctggccgagccyccctctctccccgccctccggccggccgttggggagcgctgctctgggattggctgcgccgccgtctcgggcgttctcgcgctctgcttacgtgctgacgcgcgcctgatagataccctgtgggtttgagcgctccggtcggtccctagcggcccaggcgccttgggcgtgcgtcctgcgcgcggccgcctccaggctgcgcccttctggggaagtgtttggtgctgcgcgcggcgtcgaactccgcgttttttttttttcttttccagccagtcagcctggaaatctgcctgtagtcagctgatgcagagtcaccctgcagttcctactttgaggggttgcagaagcacatatttcactatggagggccgcctgcaggcctcgcgctgacaggatcttttgtgacgctgcaaatgtcctggtcagtgtccttctttctacaagaggcgttggagccgggctctgcatagggcgtatatatccctggccgccaaggaagctgacccttgaaatttktgaagctttcatattcactcaatacacatttacagagcctctacttcctgtcaggcgtcacacaataaatattcggaggagcaagaagagagtgattcaacatttgggtcttgtctgtagggtgctcacagtccgggtggggattggtggtaggatgggggcttgtgaatgtttataaacagaaatccctcgaatacgaccctggctaggtaggtgcagttacagaggcacagaagggaggagaytgggcgaaagatttttgaattaggggattagaaaaggctgctcgggagagttatctgaaccagctaggacttggtcagatgcagtcagtttggtataggatgagcaaggctcgaaaattggaaagtacagggcttgttgagggatggtgtagcaaacggttgaatgagtagaggagaaaagtatagttggagatacggtttggaggagccaggtgaggactcgggggctcagcttgtgtcctcgggtttgaaatgcagtaagcacttgtgaatagaaaggctgcttaatcatttgcactactgtcatttgttacacctagaccaaacatcttggaaatggctttgattcttccttctttcatatcctacactcaatctgttggtaaatggtagcggactctaccttcaatataaagccagacttaccaattctaatcagttccatggttttcaccaaggctggtgtacatttctaaggaacacgttttcacatctcactgcagtggtgcaatatacaaccctcatgactgcacatggtggccctggattactgccacagatcctaatgggtctccctkcttctgctctagtccatcctcaacwtattaacccagtgagagttacctttttaaaaatgtaagtctgataatggcactcctcttcttaaaactcttctttttttttttttttttttgagacagagtcttgctctgttgccaggctggagtgcagtggcgtgatctcggctcactgcaatctccacctcctgggttcaagtaattctcctgcctcagcctcccaagtagctgggactacaggcgcgagcgaccacacccagctaatttttgtatttttagtagagacggggtttcaccatgttggccaggatggtctcgatctcttgacctcgtgatctgcccacctcggcctcccaaagtgctgggattacaggcgtgagccaccacacccagccaaaactctcttaattcatttaattatgtaccagccaggcgtggtggcacacacctgtaatctcagcactttgggaggccgaggtgggcagatcatttgaggttaggagtttgagaccagccgggccaacatggtgaaactccgtctctactaaaaatacaaaaattagccaggcatggyggtgcatgcttgtaaccccagttacttgggaggctgaggcaggaggattgcttgaacctgagaggtggaggttgcagtgagccaagattgcacccctgcactccagcctgggtaacagaacgagattccatctcaatgaatcaatcaatcaatattgtgtgtctgttgtgtgcagggcactgctgtacatgttggagatacaacagtgaacaaaacagacaaaaattcctgttctcaaagagcttatattctaatgagactgaacaacaacaaacaagataaatatgtacaacatgtagaatgctataatgtaataaagtgccaaggaggaggaaaaaatggaagcagagaagggggatagtcagggttggggtgggatagatggggtggccagagaatgtcttagtaaacattttagtaaaggactgtggatattgagggaagagtgttctaggtagagggaacagtaaggacaaaggccctraagcaggagctggcttgctatgttccaaagacagcaagaaagccactgtgaccaaagtgcagtgaaccaggtaggaatgaggtcagagggacaatggagacccagaacatggagggccttgtaggcaaactctagattttggcttttactctggcaggagtttggtgaggcgtgacatgatctgatttatgttccgcaagatcctgcaggctgtgttgaccagaatctggaggaactacagtggaagcggagagtctagttgggaggctactgcaataatccaggcaagaagggatgaaggcttggactaggctggtagcggaggatcctagatatatgtgaaggtggcattgataggacttgccgagcactgggccgtggagtgtgcaggaaaggggagtcaagaatgaggaagatttagaggaacaggtctgcaggacaatagcacaggctcagttttgcacaggttgcatttgagatacgtagtaaacattcaagtggagatgttagatgcgcagttgtctgagttcaggggagaaggttgggttggagatcaaccttcgggagttggcggcatgtgaatcgtatttaaagctatgagtgctcgtcatggtgcggagaacagaccaagaacagagtcctgagactccgttgtttagtggcctgcctttaatttggtaggcaagccctgttctcctagtgaaaaaatgcccacttgatctggcagttgtaattatggcagttttgacagctcgggtaacactttgtcttggggaaggacagaagaggagtggaatgggggaagcacaggttccagtgtcgttataaggtcattataaatgaggcattctcagaataggggtcaaaactgagaattaatacacctcatatgctgttggtgggaatgtaaattagtacaaccactacagagaatagtttgtaggttcctccaaaaacaamaaatagagctaccataggatccagcagtgccactgctgggtatatacccaaaaggaaggaaatcagtatattgaagagatatctgcactcccatgttggttccagcactttttacaatagctaagatttggaagcaacctaactgtccatcagcagataaatggataaagaaaatgtggtacatatacacaatggagtagtattcagccagaaaaaaagaatgagatctgtcatttgcaacaacgtggatggaactggaggtcattatgttaagtgaaataagccaggcacagaaagacaagctttgcatgttctcacttatttgtaggagctaaaaattaaaacaattgaactcatggagatgtagtagaatgatggttaccagaggctgggacaggtagtgagggtctgtgcagtggggagaagatgggatggtcaatgggtaccaaaaagttaaagagaatgaataagaactagtatttgctagcataacacagcgactatagtcaatgatcatttaattgcacatataaaaataactaaaagagtataattggattgtttgtaacacaaaggagaaatgcttgagggggtggatactccattttccctcaggtgattattacacattgtatgcctatatcaaaatagtaccccgtaaatatatagaactacgacctacccataaaaataaaaagttaaaaataatagtgttctgccttcagttttagctactattgatttggtggcaagtggcagaaacgtccagcctgcttaaattacacagagactgtaaaggcacagcatggcttctggagctggggggcagatgggaggcggctgctgctgctgttgcttttctccctccctccctccacctccacccctgctgctttctgcatgagcatcttatccccccaccccctgcagatcggctttctccctctctctgtggcttcagggcccagtggagtgtagctgccgtcctccagcagcgccattgcatggccctgcgccacagagcatggttcgcattctctcacggtgccaggggacagaacaatgggctcaccttgggtctggtgtctcttcctggctcagtcctccgtgaccaaagcatagtctctgcagctgcagaggccaaatcctatgagggaggggcaggtctgagaggaggggacatcaggtgagcaggacagacccccgaaaggtagtcactgcagagtgtatgtggtgtgttatcggaggagaactggtcgccaccgaagcctaatctggtgactggaatgtctctcaggacgatcaaggtgtctgcattgggtgtgcctaatgttagacccttggcttttattgaaggtccctgtgaaacragccatgtgagtgtcatctctgcatgtatgatacagtggtggtgagaacactgtctactatatcacttgatgttcctgtgtaattatttctgacttttgtttgagaatggttacttctctaaggaatgttaggtgtctttttgaatgagggcttgagaacttgtcaggtttcccgtttgcatgacctcaaggaagctcccacgtatagctgagctgggttggaactttcaagcaagactctacgaaatgttcggaagaggaatggccaaatatatatataatagttatttgattatagtgcatatatagatatatatggtcaggaatctcaaaactcaaatgcccatagtgtccaggcaattaacaaagatgatatggatagttttaacatagtaagtacaaactgtttgtattgagttcaagcatagcttagctgcctagttacactgctttttaaaacagcaggctggccaaacaaatcagccaagtagaacatgtttaggtaggctgccagttgtaggatttgggaagctgacacagaaacttgctggtctgaagctcttcagtgtgaggtctctgcattggctgtttccctgcataaccccagcttgccctcctcgggggcaggacctttgcctcccacttgggagtggcaagggcccatgtaggcttcatgtccagaaacacctgagttctctttcctgccttgtgtgacccggtttgctgcggataccttgcctctgctgagaatgttagtactgggaatgcctgcccctttgaggggagcccctgctgctgcctcacaggaaagcccccagctgtgacctctgcaagatggtcatgttggaatggaacacagtgagcccagcagtgaggaaggatgcgcacgctgttttctttttttctggagtaggagtgctttccatgtgttataccttgacagtggagcgggcccttgagagaagccccaagtgtttctagcattaaaaaatgtctccaagattccaggttgatatgtgagcatcgtgattttgtgacagtatcttatgagtttggtccctgggagtcaagccccctgtgctcagtcacctcagggcaactaattacttgactttcaaggctgaggagactgagcacccgcctcccacagccatttctgttcccaaactaaaaggcaagaaagtggtgtgtgaagtttgagaacttaatatttacagagaataaggcctggcacaaaacatgaagatggcagacagctaccctgaagagtctttgggagccctgcagtggaaatagctgcatgtttaagaaacacgcatgcaacagactacattgagaacagtgcattgttcaagggactgagttttttgtgttttttttgtttttttttgttatttttgtttttgagacggagccttgctctgtcacccaggctggagtgcagtggcrtgatctcagctcactgcaacctcygcctcctgggttcaagcgattctcctgccccagcctcccgagtagctgggactgtgggcgcccgccaccacgcctggctattttttgtatttttagtagagacagggtttcaccatgtcagccaggctggtctcgaactcrtgacctcaggtgatccacctgcctcagcctcccaaagtgctgggattacaggcrtgagccaccacgcctggccaagggactgagtttttatgcacttttaattattttggctttagtacttttagatatggctgacttcaaggaaaacaaaatggaaagcagctgtctatttggagatcatattaaagcattttctgccacaggcattgagctaaggggtggaaaggactttaattatagatgactggatgggaagtttcccagtgatggtgacctcagactctggtcctgggtcttggagggaggaggtagagatgtgtgtgcttagccagctggtcagtacttagatggtgggagggggtgcctcatgaaaaagtctgagccaacgtgggcctgtrccttccataaaaccataaaaagccagtctgggctccattctgctgctctctgcaaggagctttccatggaaacttcttttgtggccacaggccgactttccacccccagactgccctgcgggagcccgctcagctcccatccactccccagggactcagagtgcctcctttgcgtcaggctcgttctaggcactgaggatttggtggtgaaccaggtggagaggattcctggtgtcactgagcttaggatctagtagaagataaagtaaataaacataattttgaattaaggtagctgctatgagagtgatcttacagagagcaacctgtgtgttgaatgggagccactttagtgagggagacagaggactcagcatccaggatgagggcagagcaggagccggtactctgaggcaggaacgccctcacrtgggcaaggagttcttggagtcagtggtggctgcgacgcagtgagcaaagaggagggtggcccagtgagctaggggcctccagggagggagaggccagcccccacgggcatggaaagttggctttaaacacggaagtcgcatagcttgaccggtgttaaaaaggtttcttgggctgctgtgctgagaatgggggtgtggcaaataggggcaggagtacaagcgagagtttactgtagttctggaaagrtaacaccagagaggtttctgcctgctttcctttcctgaggattaaacagattaaacgcctccacctgcttccagcagagtgcatggcagtggttgctcagttaacactgctgacctctgggcccaggtggctggttatcagtaaggtttggggtggcagcaaacaggcaggggaggagcctcccaggcagtaccttattaccaggaacagtatgacagactacagccaggtaggcaaaggagaggctggaacccatttaccagcccgcmttccttcccttaggcctggaggaatcactattaacagaacaggagggcaacgcatgcccgtgctgatcagcggtcaataatgctgaagagtcgtggtgcctagcagccttaaggtgttaccaagagattcttgttgcaataaggttgctttaacctcaaatggtgagggagcggggagggtgtgtgtgtgtgtgttaattacaagagtctcttatttggcagctccaaactctatgctataatgaattactgattaattcagcctcagagccagagcccccttgtttgttcgcatgggggaaagaggtggacggctgagtcagatgctatgtggcatgaggacaagctgcctgcaggggcaggtgggcacctcaggaatgaaggctgatgccctggggcaccacaggtgggtgtttcagcaggttagaggaataggacttaccgagtcagaatccctgaggggttaggtccccgagtctcccagtggttggcgggtttgaggatcactgatctgggccaacctgytcacattatgaatgggtgatgacttgcccagggttgcccagtgtgtttggtggcacagctagagccagaacccaggcttccargcaccctggctcctgactctttccattgtgaagctgcagcttgagagaggaaccagagtggactacctggtggtaccaggactggagctgggtggaacagatgcagcccagtttgactttcacaacctgaaaggaacatgactgctcctgattaaagcccggaaggcaacaaagtaatgctgagggtgcatttatgtttcagaaccaccgggaggaactgggccattctaacacccrttgctaccatgctggccacccgcctctccagacccctgtcacggctcccaggaaaaaccctaagtgcctgtgatagagaaaatggagcaaggtaagcaaccagaggtggtggtggccttgaggggacactttctgagcaggcagaggttttcacacatggacagtgtaggcggtgatgaggcctgattctcagagatgtctctcaatacctttgtctcccagcagaggaaactcagaggtgtcctgggaagacattttcccagggcacacagggcagaaaggaatatctttcataaccacttatttttttttctttttgatggagtctcactctgttgccaggctggagtgcagtggcgtgatctcggctcactgccacctccgcctcctgggttcaagtgattctcccacgtcagcctcctgagtagctgggattacaggcacctgccaccatgcccagctaatttttatatttttagtagagacggggtttcaccaggttggccaggctggtcttgaactcctgacctcaggtgatccacccgccttggcctcccaaagtgctaggtttacaggcatgagccactgtgcctggccataaccacttcttaaaaccctttttattttgaaataactttrgacttatacaaaagttgcaaaaatcgttggaaagggtttctggatccccttcagctaacttccctaaatgttaacatcttacaaaaccatactgcaatgatcaaaatcaggaaattaccattgatagaatactattaactagtctacagaccttattccagtgttgccaagtggctgctgatggacctttttctggtccaggatcgaatcccaaatcccacatggcwcggaggtgtcatgtgtttttagtttcttcctgccggggacaggtcttcagtctttttcgctcacgaccttgacactctsgctggttatgttgtacaatgtctctcagtttgggtttgtgtggcaagacgcctgcggcagtgaagcggtgcttttctcagcccgtcgtgccaggaggtacattattttgataactgctcttttaaaactttatgcatgaaatcagttagccgagatgtcccaaaccttcaccgcatcgtttgtgtgatttcgaggaagcattatataagtacaaattagacaagcagctgttcttctttgagagcttctggaattgccttttcccaggggattcagtgggctctgctgccacattttactcttttgcagtctgagcaaggaaaaaacaagaaatacctttttctttctgttatatttgaggggagtgaatttgaggggagtgaaattgaagattatgttaaattcaaagtcccaggatctagaacactgatatttctatgccaataatatgtttaatggaacatgcatttagactgagactctgttgcccaggcaatgtggcaacctcttggctcagagcaacctctgcctcccgggttcaagcaattctcccgcctcagcctcccaagtagctgggactacaggcatgtgccaccacacccggctaattttttgtatttttagtagagatggggttttgccatgttggccaggctggycttgaactcctgacttcaactgatccgcctgcctcggcctcccaaagtgctgggattcaccacgcccggcccggcttttagcagcatttgcttgaatttatttctgagagatacagaggcatggcttggagctggggctccacctacctgaggaccccacatgagaagagtttagaatgccccattggcacaggcggcaggaggcccctgccatcacagcggggacggcggaggcccctgccgtcagagcggggacggagctcggctttgttgaagggcttttgaaagaaggtgacttgctgcaattgttttttcagtgagtgattcataaagatggcaagatctgtctccaacatggcttttagagatttctggagtttttttatagaggagaagataatcccacatgaagttaaaatacttttacaaaggttttgttcttaaatgtaaggaaaatgaggcattagtcaagctcctggctcacttgaggggaaagaaagattgtcaaagggaatttggaatcttctggatggactgagaagtaacttggttaggttgaggggcctgggtggtggttgggcagccgcagagctgtcagagtagagtcaatgtcgtagggtgaaggtatgggcagcgtggagggggacccaggtacagaaggaggctggcatggtgggtaatcgccatgcctaggatcccacagtccctcagagggaaaactttggcctgatcattttgcttgagtctcagttggaaagggcctcatactccagtctgcacctgtgagtgaatcttgctgatagcatccttaccaagtgactttatcgcctctgtttgaatatgtccagtgatggagaggttagtacctctcatagcaggcctcctgtgtttggacatctccttattgaggagaaatcttttctcctgttaatgccactccttgttcttgggtctgcccctgcattcacactgagcgagttattcccttctcccmaggggcactgtgccacctcaatacccacccacttgtctactcttactccacccacatggtttctccttgtttatctctcatggtttccccactatcatccaggtctccccgctgaatggtctgcactttgcctgtgctccttcttaaggtgtggtgcctgaacaaaacacccaccactcttgacatgcccagagcaggcatcacccagtacacatggctccgtccagatgaaaaccttcccaggagtggctggataaggcccccaaccccaacacttgacaacctgctgtgcttactggctccccatggccctccgatttcagatttctcagatttctggctttgccagaagactctggcatccctggggcaggtgccttgctcacatctgggaccctgcctcctgggctgtgatcaccagtgctcagctctgccaggccaggtacagcacatagtgctcccagggtggcctgacccgggcagagtggagaagggctcttgcctcccctatcctagtttctttcctgtccagcctaggctcacatagcttcttttggctgccacatcacatgcgggattcatggtcaaacaggctaaatttttttcacagatgctgccgtgaggccatatttctcccgagctgcacctgtgccactgatatgtgttcctcctaagccccgtcttgttagattcaaatggactcatggctcctctcagcagaaagctgggttactggttattgttkctgattcctgatggggacaataaaaggcacagacacacagactggtaagatagagaagaagccagaatgaacgccctggccagcatagggagcgctctcaaatgcggccgggatgaccagggcgctgaggacagcaggctcttccacagggccttggggaggtgccagactgcaccacttcctccctctcattctgttcctgggttagggcaaaaatcaggaagctctcgtcttctgaacctcacagccacccctttgggctctcccttcagaaagtgtgttgaccggtgggggcgcggtggctcacacgtgtaatcccagcactttgggaggctgaggcgggcggatcacctgaggtcgggagtttgagaccamcctgtccaacatggagaagccccgtctctaataaaaatacaaaattagccgggcctgtggcgtgtgcctgtaatccyagctacttgggaggctgaggcgggagaatcgcttgaacccgggaggaagaggttgcggtgagccgagatcgtgccattgcactccagcctgggcgacaagagcaaaactccgtctcaaaaaaaaaaaaaaaaaaagcaagcaagaaagaaagcgtgttgaccatctcgagcttaacttgtgcctcccgagagactgagaccggcatagctgttggtgttagtggcttggttggccagcagcttgctgttactgcaggaccctcctgggcagaggagaccctccagggaaatacacactattttatgtgctggttttgggcctaacgcctcatgggcattcttagccctgggagaccagtgtatgagctgggattgcctcacactaagartagcaggaacccctagaagtctagggccattgtggctttggggagcccaggctccttgtttttttytgctgtgttattctgaaggcagctcaggatcccaggatactgtgatagtccttcacctccagcctcagtccaggcagggacaagcaacgcacctgcatcgggaaagcaaaactcagcaattgtggtcgacctccgcttgcagcctattggccagaggcaggtcacgtgaccactaggtgggtggtaatctggaaagcgttgggcgcactgctgtccctggacaaaatccagattcttgttartgaggcagatgagaagaacggatgctggcaggcaaagagcagtgtctgtcacagctcagctgggctgtggcctccagctgttcacagggatattggggctttggcattcaaggggctcaaaggggaaccccctggggataggtctttgtttttyttttcctgtagggcagtggtattgaaccttggttgtgggttagaatcacctagagaacagtgagggaaaaagtrtctgtgcctcacctctgggtcaggagtgagsctrggcaaaggaatactttaaagaacttccctgtgattaaaaagaaaaaaaaaatcattctatggagaatctcaaacatacgcaaaagtagaaagctgtatattgatccctggtgtacctgtcacctgggtttccataattatcagcacatggccaatcttgtttcagctacatctccattttcctccccctccccataccagattaattttcgaagcaattcctggacatggtatttcatttgcaaatattttaatatttatctctaaatgataagaactcgttttagtaatataaccacacgaccatgatcacatttccaagtgattctaataaacaggggcccagagaacaactgctgtggactagatgaaccagttcttcccccaggacctgttgcactggaatcccctgaggtgaatgacacaggcagatttctggggccaccccttcctactgaatcagaatgtcaacgggagggacctgggagtttgcattttaacaagctccccaagtgcttgttaactaacttttgagagctgaggcagtaaggtcttcctggtcccaaggccccttcaaattgagaagcagccctaagatggggatcccacagcgactgtaagagctgcaaattgagggaagaggaattagagtaggatgaggcaatcccagcagtggccaagaaggaaaggccgagaagtccagcagtgctcaggaggcactstcatgctagctggagctgcccgcccaggagtattcacagccccaccttacccaccttgtcagggtattgctgtggggggggcaggtgagtcgagatagaaccttctgctctctggaagagtagaaatgcgccattgactgttgggtataagtggtagagcctggtataatacacccagactcagttaattttaggtctgaatatatttgacaatggagagacagtttagagaaagacgggcagcaagtcaatctgaaataagctctcttgcctagacctttttgttacttgttttgttttgtttttgttttaagacaggtctcactctcgcccaggctggagtacagtggcacaatcttggctcactgcaacttctgcttcccgggctcaaatgattctcctgcctcagcctcctgagtagctgggattataggcgtgtgccaccacgccctgctaatttttgtatttttagtagagatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatttagcagggcgtggtggaacatgcctataataatcccagctacttgggagccagaggcacgagaattgcttgaacccgggaggcggaggttgcagtgagccaaggttgtgccacagcactccagtctgggtgaaagagagagacgctgtctaaaaaaaaaagtgctaagggtgtggcccttaaggagacaggaacaaatcatctagttccactagggatgtaactgcccaatggcttcaccttgctcactgcctagacagaaccggtttatcaagacagaggacttgcagtagacaaagagyaattcacgcagagccggctgtgcaagagaccagagttttattattactcaaatcagtctctccaaacattcaggaatcaagagtttttaaggataatttggtgggtgggggaaggccagtgacagagtgttgattggttgggccggagaggaaatcatgggaaattgaagctgtcttcttgcgctgagtcagttcctgggtcggggccacaagagcagatgagccagtttgtccacctgggtggtgccagctgatccatccagtgcagggtctgcaaagtatcccaagygctgatcttaggagcagtgtagggagggtcagaatcttgtagcctctagctgcatggctataaattatggtttataatttgtaatctggtgcctaatttgttagtcctacaaagacagtctgatccccaggcaagaaggaggtttgttttgggaaagggctgccatctttgttttaaactataaactatagtctgggcgtggtggctcacacctgtaatcccagcactttgggaggctgaggtgggyggaacacctgaggtcaggagttcgagaccagcctggccaacatggcaaaaccctgtctctactgaaaatacaaaacttagccaggcgtggtggtgggtgcctgtaatcccagccacttgggaagctgaagcaggagaattgcttgaacccaggttgcagcgagccaagatcgcgccactgcactctagcctgggtgacaagagtggaactttatctcaaaaaaatataactcatctcaaatataactccatctcaaaaaaacacaactrtaaactaagttcctcccaaagctagctcagcccacagccaggaatgaaaaaggacggcttggaggttagaagcaagatggagttggttaggtcagctctctttcactgtctcagtgttttgcaatggtggtttcaatgacaccttctcattctttctgcagagcaacactgggggtcatgggaatacagactgatgctctttggatggagtcattcacaagctttgggtgtaccgaccacactatcctgatcacttgagaccatccgtgcacaaggacttaaaatccagactcctctgtggcagtacaaaaggacagggggttaccttggcaggttttcctagtgaaccctcatttctgtctagtgaatttaatgttctttaagaacatattttaataattttttaaaagcttaatatgttgaataggtaatatatttacatggtacaaaatttgaatggcaggccgggcgccgtggctcatgcctgtgatcccagyactttgggaggccgaggcaggcggatcacctgaggtcaggagttcgagaccagygtggccaacatggtgaacccccgtctctactaaaaatacaaaaattggccaggtgtggtgatgcaagcctgtagtcccggctactcaggaggctgaggcaggagaatcgcttgaacccaggaggcggaggttgcagtgagctgagatcgtgtcactgcactccagcctgggcaacaagagtgaaactctgtctcaaaaacaaaacaaaacaaaacaaaaaacaaaatttgaatggcgtcaaatggtatacagaaaaggtaagtctatctcccatctcttttcccctgttaccacctgctcattcacccctacctccttcatttgtcattactgggttaatatcctttaaaaactaacaggacctccgcttctgggaagatggagtagatgtacttttctctattctttctgtcaagtacaactaaaaaccctggatattacataaattataaataatttagtaagtatgtaatatataaaaagcctcttaaaaggcagagagaagaaggcagaccagctaaggacctcaggacccaagaaatggtgcagtgatgagttctctaggttttctttttgtttcttatgtcccagacttggagttgaagcagccggcaacccagaaataccagtaagctcagacgcaaaaagccccaacaaaaatttgctctctctagccaaatgaccagtgcagtaggacagaacaagtgggtttgttccagggatataaggatggttcattatttgaaaattaatctcatccaccaaattaatgaactaaaagaagaaaacttacatgatgctctctatcaatgcagaagatgcaaaatttagcacacatttatgattttaaaaatctcaggaaaaatagacatagagggggattttcctgaacttgataaagggtaaacaccataagccttcagctaacatacttaagggtgagactgaatkctttgtccctaagatggggaacaaaccaaggatattagttctcaccgcttatccaacatagtgctgtaatttctagccagtgcaataaggtaagaaatggaagtaaaagtcatatagattggaaaagaaggaataagactccatatttgcagattacatgattgtgtacatagaagatcccaaggcatccacaaaaaaactcctagaactaataagtaagtttagcagggttacaagatacaagataacacacaaaaatcaattgcatttctgtatactagcaatgaacatatggatatcaaattttaaaacaatacagtttcgaccggatgtggtagttcatgcctgtaatcccagcactttgggaggatgaggtgggaggatcacttgagtccaggagttcaagatcagcctgggcaacatggtgagaccctgtctctgcaaaaaatacaaaaattagctgaacctggtggtgcatgcctgtagtcccagctactggggaggctgaggtggaaagattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggccgcatgtatggtttaaatgctgaaaacgacacaacactgatgaaagaaatcaaagatctatgtaaatggaaaccccatactgtactcaggaattggaagactcaacaaagtaaagatgccaactttccccaaattgatatacaggtttagcacactttctataaaaatcccagtcatattttttatagatgaagacaagattactctaaaatttatatggaaaggcaaaggaaatagaatagctaaaagaattttgaagaagaaaaataaagtagcagcacatatatcaatgaatcaraatagaaaatccagaaataggcccacccaaatatgcccaaccaatttttgacaaaagtgcaaaagcaattcaatagaggaaagataacgttttcaaaaaatggcgctggagcaaatggacacaaaacttagacctaagtctgacgtcttatacaaaaattaatggatcatagacttaagaagtaaaacataaaactataaaactttttttttttttgagacagggtctccctcagtcccccaggctggagtgcagtggtgcaatctcagctcattgcaacctctgcctcctgggctcagttgatcttcctgcctcagccttccaagtagctgggacttaaaggcgtgagccaccacacctgactaattttcrtattttttgtagagatggggtttcgccatgttgcccgggctgttctcgaactcctgagctcaagcaatctgcccacctcagcctcccaaagcgctgggattacaggcatgagccaccatcccagccaaaactataaaacttttagaaaagaacatagaagaaaatctttgggtcctgggggcaaagagctctgagacttgacatcaaaagcatgccrcataataggaaaatactagactttatttaggggttaagagtttagactctggactctctcagccttggtttcactagttagctctatcactaactacattgggcattgaaaattcctctgttgtcccacgtggtgcatggatgattgtagacgaggacactgagatcctgaaggcagaagtaatttctctaagcaacgttgttggttggtggcagagtctgggttacaacccctggtttcctgattccgagtccaagtgaaatacttttgcccctgcagtagaccctgctacagaggataaaaaggcacrtyataggctaggagaaaaawtttgcctaccacatatgtaaccaaggactagcagctaggacatctgaagaattctcaacattcaacggggtagaagaatgaacgattcaatagaatatgggcaaaagacatgaagaggcattttaccaaacatagggtgctatggtcygaatgtttgcattctcctcaaattcctgtgttgaaatcctaacccccaaggtattggtattaggaggcaggggccctgggaagtgattaggtcataaaggtggagycctcatggatgggattagtgtctttataaaagagacctttgccatgtgaggttacagtgagaagacatctgtctatgaagaaagtgggccctcaccaaacrcagtctgctggcactttgcacttcaactccccagcttccagaactgtaaggaatataagtctgttgttggtaagccacccggtctatgatattttkttatagcagcccaaacagactaagacaggtgacaaataaacatgaaaagatgttcaacatcattagccattagggaaatgcagattaaaaccacagcgaaatatcatgatacagttttcagcatggctaaactagaraatagtgacaccaccaaatgccgacaaggctgtggggaaactgggttgttcagacactgccactggggctgtagcrtactatagccactttcataaacagtttgtcagtttcttaaaaaactaaacctgcaactaccatatgacccagcaattacacccctgggcacctacccaagagaaatgaaaactcaacgtttgcgcaaaaacctgtgtaggaatgttcaagcagctttattcataatatgcccaaacaggaaacaactcagctgtccttcagtaggtaaatagttaagcaaattgtcatacccctgtgtcatggagcactacctagcaataacaaggagcaaattattgatacataacaatctggatgaatctccagagaattatgttgaatgaaaaaagccagcccctgaaggatacatactgtatgatgccatttacataacattcttgaaattctaaaattacagagatggggaacagatttgtggttaaagatggagccgggtgggaagaaagtaggtgtggctataaacgggtaacatgaaggatccttgtggtgatggaaatttctgtatttttattgtatccgtgtcagtatcctggttgtgatatggtaatacagttttgcaagatactacccttaggggaaatgaggtaagacctggcatctctctgtattatttcttaattgcatgtgaatctacaattatttcaaaataaaaagtatgattgaagtaactmtcaggaagcttagcctactgtggattaagacatcaaaattgcagcaggctttaacaaagctatactactacaaggatagttcacacttgaattagcttgaaacattacctatccatgtcatcttggaaagcagaaaatggaactttattggagtgggacactggatggccagggtttagcagagcctgcccaacaaaagtagcttcagaattggctttattctcaggaagsctcttcctggacagtggcaaacatagccatagcaaatactggctcactttctatcagccagcaaccctggtggaaagagggcctcttactcagttgtaccagcaagctgtctccaggagccggggctggagagacacccagtgctgctctaggccagtgtggctgagggtctgtctagtctgtccttgtactcacggcttccttttctcttgcagacgcccactattgcttggttctacttcctttatcccgattggcygtcggacttatgccagtgcggcggagccggtgagtggaagcccagctacccgggagccagttggatggtcagaaccctttcttytgggcccctaggccctgagctaccctcagagtggggccttagtgtttccaggacactgggagccactttctcacttaaccctcccccaaagcccctcatcagtaatgagctcacacacccccatccatgtggggaggaagcagtaatgaggcactccagcccctcccagccaggaaggtatcactggaggcctggggggggggcgagaactcccagccccacccagcaagttaggggttaagagtttagactccggaggcccagggcggtggctcccgcctgtaatcccagcactttgggaggccgaggtgggtggatcaactaaggtagggagttcaagaccagcctggccaacatggagaaaccccatctctactaaaaatasaaaattagccgggcgtggaggtgcatgcctgtaatcccagctacttgggaggctgaggcaggagaactgcttgaaccyggaaggtgaaggttttgcggtgagccgagacyggccattgccctccagcctgggcaacaagagccaaactccatctcaaaaaaaagaagaagagtttagactctggaatctctcagccctggtttcagttccagctctatcactagctacattgagcgttttaaaaagacctctgtttctcacatgtagcatgggggattgtagatgagatcctgaaggcagaagtaattttcccargcaacattgctggttggtagccgagtctgggttagaacctggcctttccactataccatggtgcttctccagacaacaagaacaaggtagggagggccaggcttgggccactcaggaagcactaactctcactgcacagagggtggagaggcctggtcactttgcccctgtaccaccggttcctaacatggaatctgaccttgtaaaacaggttggcagcaaagctgtcctggtcacaggctgtgactctggatttgggttctcattggccaagcatctgcattcaaaaggcttccttgtgtttgctggctgcttgatgaaggtaagagacgagttatcttcttcaccattgtcttttacacatagtcattgttttttagtcttttaaaaagtgctttcctaacaactggctcacctttgcttaaaccagcctgtccattttccatcggcttcagtcccacttgttcttcatagctttgtccatccatcatccatgcatccatccatccatccatcctctcatctatccatcattcgtcaaatgctatgatgtacctgacactttgctaggtgcagtagaagaatgagaccttgtccctgccctgaagttgctccctgtcgagtggtgaggagacagccatgcatagacacagctgaagaattcgagtgaagcagattctcaggggtgtgcgagaatgttcggcgagactgtgtaggaggaagggattgatgatggcatgccagaggaagtgacatttgttctgggccatggcgagtaaataacactgccacaggtggagactgggaggagttacctgctggatgggaggaatagcctgggcagaggcttgaaagcatgaggctccttcgggacacattaagtagaatttaaggtgcatgaagggaagcactgggacccgagactgcaaaagcaaacagtgggcagtgccccagttagaaagttgtgcgcccaccaccacaatccactttagaatacgtccatcactcagaattctctctcttgaccattggcagttaatctccacatatacctctagccctgagcagccactgatttctatttctttaggtttgcattttctggacttttcatctacatgaaatcatacaatacrtggccttttgtgccacacttcttgaacacttagtgtgatgtttttgagagtcatccatgttgcagaatgcatcagtagctcattcctttgtattgctgagtggtattctgttgtgtgcctatgctatatatatatacatatatgtatatatatatatacacayatatatatatatatatwtwttttaatttatgtttttgagacagagtcttactttgtctcccaggctggagtgcagtgggtgcaatcttggctcactgcaacctctgcctcccgggttcaagtgattcccctgcctcagcctcccgagtagctgggactacaggcatgagccaccatgcccacctaatttttgtatttttattagagayggggtttcaccatgttggccagactggtctcaaactcctgtcctcaggtgatccactcrccttggcctcccaaagtgctgggattacaggcgtgagccaccacgtctggcccaaagcactatttttaaaagctacttgtattaatttttgttttttctttatcgctgtattatttatttgaaatataatgccatttatttgtgatctgttttccttgttgttgattcttgttgatgtaatttaatttctgaatatrtaaactgttaacaaggctgtaaaggcaaaaattatacaaattggtaaaatcaaagtagcgttattccctcacccctatctgttccactccattccttcatttttccccatgttacacaagtgtttgcatattgcatatactctttggttttttaaaacatcaacaatataccttggaaatcaggttgtatgacctcacagagatctttttcactttgttcacagctttgaagcacccactgagtgggcggatcataatttacttcatcaaaatctcctgtaaatgagcatttaggtgttttcaatattttgcaattacaaataatgccacaatgaataactttgtatttttgttattattggggggttatcttttttttttttcttttttttgagatggagttttgctcttgttgcccaggctggagtgcaatggcccagtgtcggctcactgcaacctccacctcccgggttcaagaaattctcctgcctcagcctcccaagtagccgggattataggtgcctaccaccacatctggctaatttttgtatttttagtagagagggggcttcaccatgttggtcagactggttatctttagagtaaattccttgggagtgagattgctcttagatcagagtgtaaataaaatatattgtcattttaaagatattcccaaattttccatcctaggggtcatgtaattttacattccctccaggagtgcatgagtgcctatttccacacaatttcaccaacagagtatgcatcaagcttttggtttttgccagtctgataggtgggaaatgtacctcagtgttgtttttattgtatttctcttctgagtgcatacccctgttctttaaggacatgacccagaagcttcctctgcagatatcacctgtgctctcattctcttggccagaacttagtcacatggccttacctggctgcaaggaaggctggaaaatgtagtgagtattctgagacaatatgtacccggcctaaaatgtcaggcgttctactgctatagaagaaggatgaagggaagagtgggcattcaggacaacttgctttctctgctcggtgggtgagacatttttctttattttcaagscagtaggaacccaggggaggaatttcccatactatgttgatatctttgtaatatttgatacccaacgtaaaatttcaataatataaacaagtaaaagaaatcatttatattgccatgctctaaacatcattccatctggatcagagaaggttttgtttgtccttttaatctttacttctttgaattgtgaaagtaatactacatattcataataaattcaaataatacagaagtatattatgtaaaaaagtgaagtcttcccaatctcttgctccaaggcagcttaaatgcaggtgtatacattatttgtgagttttgctattacaggtcgagtatctcttatctgaaatgcttgggacyagatgtgttttggattttggatttttccagattttggaatatttgcattatacttgctcagcatctctgatctgaaaatccaaaatccaaagtgctccaatgagtatttccctggagcatcatgtcagcactcaaaattcagattttggaacatttcagatttgggattattggattagggatgctcaaccggtattaacaaagcctgggtgagccatcttgcacatatatctttgcctccttccactggcgattcttaggaacatttcgtagatgtgaaagtgcaagttgcaaaggtgtgcagattttaggttttgttcaaatccccaaactgctttcctgaaaggctgtcgctytcctgacagtgctcaagagaacccgtctggggagggttctggggaatgggtgtggcatccctggtgctggattcttctgcagaatgtggacctacctcagcgggtcccagcaagaaccatgatgccataaaaatgttgtaaagtcccttgtcctatgttaggcttctgtgccattgtgctggcttatccagtgacacagggagccacagtcagattccacagcacagggcagaggctgctcgatgctgcagaagactcttcaaaagggccttcggttctagtcctagactgaccactaaccccggaaggggacaaacatgtcccctccctgggcctcagtttcctcttacttaccctaataggattggactggtgatcttagrtccttccactcctgcaacagtgattctagaattggttgactggtattttgaagaaagtaccagacaagctcattggcaggttatatctgttggtatctaccycttgacccattccatctgctatctgagatcagtcaggcaagtcagaaagcagttagcaccaccagaggctttggataaggcaccgtgggggttgaaagggggaatttgcttctagcccgattctgtagtgttagccccatgatggattccggctacatctgtacctaaacactctctctgctcttgttcagaattagtgttcctcttatctctcatatctcattgcctttggccaactcagggacttagctccagcagatgtctgccacctcctacgtcactggctccacgctctctcctgggtcatttcagcacatgcacacacacacacacacacacacacacactyactcactcactcatacagacctacaccaccacaccctgtgtacattacctccccacggctctgctccttgttgcagaaaagcacccccagagggggtgcaacccacctggatcaggctttgccccatcacgatgtttatttacttgtttatttattcagcagatatttactgagcacctaagataagctgacagtgttccctgttggagatacagcatataacacctcagtgagaagttcttgcccttgcggagcttatattccaaggggggatgataggcaaggaataagataagtaaattgcttctctgcagggtggtaaaagcagtagagaaaaataaaacaggaaaagaagataaagcatggtggacggggtgtcagattttcaagagggaggaaagatcacaccaagaaggtaaattggagctccctcatccaaaggaggtgcgggagggagtgtcacagaaaccaaggaggtgcgggagggagtgtcacagaaactaaggaggtgcaggagggagtgtcacagaaaccaaggaggtgcgggagggagtgtcacagaaatccaggggaagaggggacagtgcagtacagagctccaggagggagtgtgcagggtgcayctgagaaacagcatgaagcctctgtggctgaagcagaatgaggggggagtagagtgaagtgaggggcacgggagcagatcttgtatcagcatagggaaggcttaatgagaggtggcgtctcaccaccatctggaaagatgaacgggggctccctgcgaaatgggggcaggtggcatatgaggcactgccagtagtttgaggtcgccaaagcccagtgccctggtgggctgggaaaagaaggcaggaccagaccaggaaggtccatgagtgcctctgacccagcttttatcaaggatatcaacagcccccattttcccaaatccattggccacttctcagaccacatcatgctcaacccagcagcagcttttgaccaaataaaccacccttgctcgtaacacttcgtttcttgactctatgctctcagggttcttccccatcttgcttgctagctcctcctcctgcccatcctgtgaacatcacagtgcccaggctcgctcctctctgaagtgtttctaacacatgtgataagatgctgacgtataacatgtgtcgagtgtcctcatgttcttccctgaggtgctaaaccacctgaacatatatgctagagacaaaaacctttctgccagaatcagctcattggctgcctcagtattataagaaatggaaatagaagaggttgagcgactggaaagagttgttagtgtgctgatattttccctctgatggcaagtaaaatgaggtgggcttcatatgaatgccttggagagcttctggacttctccaagttcttgaactccccggagagcttcttggcttaccatgtgtgccctggagtctggaggccacagagtgtgatgctaatgtccaccagaagaagtctaaaggcccgagattgagacaggagtggctcgtctgggagcggagcacggagagctggtcgggagagggctatccttctacctgggcaggaaacagttgcctggccctgtgtggacagtggagagagctgcttggagtcaccttaagggtaaccatccagtgagctggctgggaggatccatgtggccccagccagaagcgggtacatcactgaggccaggggctgagggagcagatgcccggctgggggaggcacgctgccctgcgtctggagtggcagtcggaggtctccgtggcagaatctttgtagactccacagaagcaccccaagaaggaagagctggcttttgtgcacctgctctctcaggggcagcaacagcagacattagccagcctcagacgactacagtcttgcccctaatttgctgccccggatccaaccttggaagggtcagaagttaagaataggaggsgagaggagctagaaaacagtgagaaagacaacytccaccagcacctacttcccacagccctcagggctgggcaggggaaagctttacctcgcatacaagtttgggagtttgggttctcaaaccaggctgggctggaattatttgcttaagagactgaacaggactcttcatgccaaaacaaagaggctctctgtccactgtctgagaatgagtggaaaagctatacaacttgcctgaagtttcatccagggctggaaaaaatagcttacaggtgaggttgaaagggacagtaagataaagaagtgggtttatcaataagccagttgcacacgcaccaacacagcggaactaaaagcttgtycctgagcagccagacagaggtggacagagactccagagacctgcagagggagcacggagaccagcagagggagcacacagacctgcagagggagcacggagacctgcagagggagcacagaaaccctgggtccagggaggtggtgtggcctgcggggcagtcttggcctgaggacaggtagaccctgagggggacaggccaccagagtctgcagccagcaggctgagggtggttggaaagatttctctgaataactgggggcaaattggtagtttctgtccctattggcgtggttgtcaggagcagggtgtggaggctgcccaaaggcaggtgagggttcctggggtgggtctgtcagtgaagataggagggtagcgttgctctcctcgggagcctgaagccgtgggcagtgagattaatcccctagtttcctctgaaagaagactcttcactgtcaaactgccaaattaagagtttactgacttggagtcgggggtttcccctgaggactgcagggaccttgtcgtgatgctgtgtaggggcaccagagaggtcttgtataggggtctgagaagagctgaatgatagcaacagggttaaccaagtcccaagaggaaggacatttagatacctcttgtgcatgtcagctagaatccacctttctgaggttcagatcatgtgagctccacgccaaggggcatttgaagggccaccaggtggaagactgcattaaagcaagacacgtgttttcctggtacctgtgtgccgcctgtggaagagaggggtctgcaggcaccacgtcatcacaccctagacctgaagatgcattagttctttcttggtggagtcctctgtgggaatgacagcctgagctccaggcccatctgtcccgtgcatctcatgcctgcgtcttgtttgggaaggtcggcgcacctaggggatttcagagccaaactttagaccatcgagcctccggcctggctgctgtgtccgaaggcatccctggtgcctctgcagagacttagcgggccacgccacagtgccttttcaaagggccactggggaggcttcctttccatggaaaaccaggcggtgaagacgacagtccaggaacggaagcggtgttaggtaggggagatcagcccgacctcctgtccaatgccgggattgtctctgtaccacctttcccacaccccatcctcaagcatccccccaacccccaaacatccctcctacctccaaacaaccccccaccccaactcattgcctcaacacctccaggcagctcatgccatctccagactgtgaagatcacgcctcattttgagctgagctggacttcttggtcctggctctgttctctgtggctgcatggaacaagctggctccctcagtcatgttccactcaagtcttctctccggggtgactacgtccagcacctcyggccccattgggcagtcccttcaccatttcctcctgtgccctctgaaattgcatgatgtgatttctccattcccrgggttggggttcttctggttgaaagcattcagaaggctcagcctaaccagcggaggactttccacccctgacaagtgctgaccgtcctgggctttccacccttgcccgcgcctgggatgtttgcttcagtagcagctgtgtgtgccatgggcaagcccttggctggcgagtgggcatttctctacccctttactcttggctgctagtccwgtcctcttacaagaggtgtcactatgccatgcaccattcaggaaaattgctgccaattaagtcatttatgaccaactatgtttaattttcacatcgagtgtagctcatccctattgtgaaagaaaccatgtttcatagaataggatgaaatgtgacaatgcagcctgcctggtgacacgagggtkcacgtgacaaagcacatcagcacttagcacagtgctcaggacagtggacactcgggaaatgctgtctacttagaggaaagccccccagcagctcggcagtgcccacaagcagacccctgccctcctctccagccctgcatccaccacctccttatgcgtctgcactgcctgcaaccaatggcttctggtggcgtcctcttatctcttcccacagtgccccgtccccatcggccccctcttgtgaatgtcctcagctgtcactgcctttggaaggtctcccctgcccgtccctcctgtgcccctcccacctcccgccaggttccatacagcacacagtcactgtgtcgcttacgtgctcacctgtctccttccctagaacacgactctgggaacaggggctgaatgattgatcttgacctccagttcctagcacagtgccggaacacgataggggcccaagaaatgtttgccgagcgagtgacgcctttctcctgtttagcagtacctgaatttgtgtggtgctttagactctttaacaggcttcttacaaatccatttccttactccattaatctgagcaggtcaggacaggtggtgatgttcctgttttacagccagaaaaaatggacccctgttcagggacacccctgagtgcacaaagcctactcagtgactgagctgggattagaggctggctctggcctcttaccaatttggagttgatgggcccttggcttagaacagaggtggcaaactggcagcctgctggtcctatgtggcctgtggacgtgctttggccttcacagtgtttttttgtttttttttttaaatgtgtgtaagttgccaacacttaaaagaatgaagagatttcccaattactagcttaaaaatgtaagcatctggcaaccctgggtttccatccccacgtggtaattcctgacatgtcctgtactccccagggcccccgcctgccccacataagtttgcaacccctgcttggagaaggaatcctgtcttgaggccttgggggccggctcttcatcctattcatggttgtgtctgtggcacatagcttgatgcttgataggtcatcagtgctcaggattaaaaagaaccgcatgctggtgggccaggcccatgggcagttgccagtatgcctgaggctttggctgggacttgaggccagctcctgccttgacaggagtcctcagggtctgcctcagggtrggaaggaaggaggtagaagcagctcttctctcctccccaggacaaaggccatgatggggtcaaggagctggacagcctaaacagtgaccgattgagaaccgtccagctcaatgtctgcagcagcgaagaggtggagaaagtggtggagattgtccgctcgagcctgaaggaccctgagaaaggtagggcgccccttcggacggcaggggttgtgtatggggccattccaaggggcacttgccgaacaccaccttccactggctggcatcctgccaccacactcccttccttattgtttaggctcttcctcctgcacagtaggaggaagaggattacactaaacatacacgtgcaatagggcaatggaaaaatacagtcaggaggtgatttcagagttcacggagtgctaggtggctacgcactgattcaggtcagttcagccaatgcccattgatgccccctctggcccaggagctgggttgggtgccagggacacaaagatggtcaaggcacattctgtccccaggacctcatagttcagccggaggactgagttcaaaatcagggagccgtgcattgagagaggcagagcagcacaggaaggaggggtcagtccagccatgggggcgcagtggaaataggccagttaaggcagattgtggcagagagcagatatggttgttccaagaggaggggagagcaggaaccacagcttcgaggagcacggggagggtagcgggggctgttggtcaagtggtgggattagccggcacctcaatatgagtcatgggtcaggtcacgcagagggggtggcagcaaaggakgttggggagggaggtcttggatcccaggcgagggaacatggctggtctcccaatggcactggggagccactgaaggggtcatcctgagggaatggcctggtcattgtgagacttgtgaatctccctctgaggatggcagtggcaatgtgaaggtggattcaaagcrggagttaaacatgggttctggactccggaactagggtggtaggtgttgggaaacaggaagggtcaggtgcgaggagtgttgagaaggcgaagctgcctggacttggtgacttggatgtggggatgaggtgaggcgcgaagtctctgtcctggacacctggtgccccgcactgcaggagcaggtggggagatagggagacactgaagcgcccaccctgagggaatgtccaggctagaagagcaggtgcccacggcaggtgacactgggagtcggggagatgcacagagggacccctgggaatgtgagtgttcggggatcagaggagggggagaggcagctgtcagagaggttggatacagttccccagaggctaaacaacagaaagtttggaggagagggcagtaccagtagccaacagggtcaaaagctacagaaagttccagtagcataaggactaaaatatccttccagttcagccagtggagggccttgtgggaggagctctgtctgcaacctcggggtgccattcatgtagaatacagcagtgggggatggagctccctggagccgggccgcccagcagcatctggagaagcgaatctatgaagtttacctttgagctccctgacagcccaggcagaaagggtgtgcgtcattcaggcctctgctttccctcagaatggggtggggcagctctcaggagcagctacttcagtggctggggaaggaggcggaaaaggcaggagtgaccagatcccatgcggggagctctgctgagcctgtatcagccagatggatgtgctgtctgtcacagcagctgcctcagaggctgcgtgtgtggctgtcggtgatgccgctcctctgcctgtctctgatgtgccacctcatcagcccactgtcgctcccatcctcccaacaggccattcacaggcctctctgttctctgttctcgctgaacatctgtttaataattaacaggcagagccagcccattaagaaaaggcaggatgggtcccgctggggtgattaccggctcagaacctgcagcctgcttcgcccttccctggcggtaaattctcctccctcccaccttccctgggcagctgctatattttccttcataaactactgggcaggaaaacagctgcatcggcaccataaagccacttgattatagcgtgggttttgtggtgatctaaaatgcccgtggaaaggcgtcatcaccggagacccaagcagagaacgcaccaggccggcttgctcaggctggcggtcctcgtcccctgcccccctgactctggggcagaatcacttccattgtctgtactggactggccaggcagcctaacctacaaggcagggtgggccccggcccacacagaggggaggcactcaccccctgcccggggatctgggctccaaccccagcaccagcctgacgcgcagacctttccctgctgcttttcccacgccgggcattccggagggctggatgaacctctcaccatcaacttccttaaccgatactgcattttttttttttggaaaaggatttgaagacttttaggtctgaagaaaacagtacatccgtcagatatgcagtggcgtgtcccccatctcctgctctcgctttcttcccgtctccctctcctccctctccctgcttcccctccacactctgccactctgccatgtcytggccttgccttggcaattccccctcaggcaatgccggctgtgaactccagggagcaccctcccagagcgttccgacccgcagtggccgccaccgacccacaccccaygcaggacatgtcagaagggtcctcttccccttctccaccgggggggcacatttggttggcgagtttgacgccctgcagcctggctctgtggaacagttgctgccaaagcccggggagccagccacgggggcgagatgaaggagattgtctggtgagagccacagagccatctgccaccggccccgacccccgcaggacgctgagggacrggacatctggagcctgggaccagccctccctgtccccaccccaggggacaccgagccagtgggcccgagagcaggccgtgggcatggcctgatcttggcacatcacttaccagtcagtcagtcaacattaattaattaattaattaatttttttgagacagagtcttactctgccgcccaggctggagtgcaatggtgcgatctcggctcactgaaacctccacatcccgggttcaagtgattctcctgtctcagcctcccgaggagctgggattacaggcgcctgccaccatgcccagctaattttttttttttttttagtaaagaaggggtttcacaaggttggccaggctggtctcaaactcctgacctcaggtgatccacctgccttggactcccaaagtgctgggattataggcctgagccaccacgcctgacctgggcttcacttattagaaatgtgatcttgggcttgcacctgccccctgtgtgggtctcagcttgcccatctgtgaagtgggagagtgctctgagccgtccagcactcatgcctggatcagaccactacaagagcatgggaagaatttcaacacaagctgctcgcaggctgacaggcagcagaacatatgtggaggagtaagggagaagcttggaaaaggcctggcctaccatgctgtgggatggagaccacagagcaggaagtgactgatggggggatccacctgaggaggggatggagaccatagagcaggaagtgactgatggggggtgcctgagcgggggatggagaccatagagcaggaagtgactgattggggggtcggcctgaggggggatggagaccatagagcaggaagtgactgagggggggatggagaccatagagcaggaagtgactgatggggcggggaggtcagcctgaggggggatggagaccatagagcaggaagtgactgatgagggggtcggcctgaggaggggatggagaccatagagcaggaagtgactgatggggggggtcggcctgaggaggggatggagtccatagagcaggaagtgactgatgggggggggtcggcctgaggggggatggagtccatagagcaggaagtgactgatggggggggtcagcctgaggggggatggagaccatagagcaggaagtgactgatggggggggtcggcctgaggggggatggagaccatagagcaggaagtgactgattgggggggtcagcctgagggggagatggagaccatagagcaggaagtgactgatcgggggggtcggcctgaggggggatggagaccatagagcaggaagtgactgatgggggggtcggcctgaagggggatggagaccatagagcaggaagtgactgatgggggggtcggcctgaggggggattgagaccatagagcaggaagtgactgatgggggggtcggcctgaagggggatggagaccatagagcaggaagtgactgatgggggggtcggcctgaggggggatggagaccatagagcaggaagtgactgatgggggggtcggcctgaagggggatggagaccatagagcaggaagtgactgattgggggggtcggcctgaggggggatggagaccatagagcaggaagtgactgatgggggggtcggcctgaagggggatggagaccatagagcaggaagtgactgatgggggggtcggcctgaagggggattgagaccatagagcaggaaatgactgatgagggggtcggcctgagggggggatggagaccatagagcaggaaatgactgatgcgggggtcggcctgaggggggatggagaccatagagcaggaagtgactgatgggtctgcctgaggggtggggtgaagacggaggtggaggagtgagtgagacaaasagacccaggaggcttctccagcagcccaggagacaggcagcgaggacccaagggaatgctagtggaaacaggaaggaagaactgacccagcagaggaaaccagcaacagcctggggcgtggggactttgtcctcagagagatctgggtccaaatcccaccctccctgcctgttagctgggtgacattgaccaaggtgcttaacctctctgagcttcagttgcctcaaccggatatgagacaatttaggatctattttccagggtggttgtgaggatcagggaagttaatgaatgtaaagggcttgattaggggtctgccagctgtcatgttgatcttgagctgtaatattagcagtactgggtgactcagtaggtrggggaggggtggaggagctggaggagtcacagacaaaagtaaaatcattaacaaagaggaggagcaggcttgggcagcttggaaacttgacgtgttggttgtggttagggtgagtcagggacccgtgggacattcaggtggaagcgagacaggagatgggatgaggagagagagccgtgactcccaaggagaactgaggggccactggtgcggaggcgatcttggggatgttacaggaaagttgctgtcacccaaccagcgggcatgcctccgtgagtttattcagaacattggctgaggattccagatggcaactaggtccaccactctcaacactcattaaagctgtaatccaggggctgtgcactttcacaggtcatgtttcattaaacttttttggatagtagcgtcaaatgtcattgttttatttttaggtagagaaagggctgtatgcattttaagtcatgggatattgtccgttatgaatcaaacacaaaacggctgcaaaattcacaaacatgaagaagatgaggacacctaagagttaagtgtactttgagaggagcaggattaggccaggacattgggggccacttgtatctgggggcaggtgaaagaaaggtgtcagggaagatgcaggagatgcctgggtatcactaatgctgagggagaggtgagcctcaaggagtactggcagtactcatatygtagcgagcctgaggagagtgaagactgggggtgaggtccttggtgtaccaccctggagaccctggagactgcgtggtcaggacagctgagggctgggacccagtgtggtatggaagggagatggagaggatagagcgcgcgcgcgygtgtgtgtgtgtgtgtgtgtgtgcgtgctctgtcacccaggctggagtgccgtggcatgatccggctcattgcaacctctgcctcctgggttcaagagattttcctgcctcagcctcccgagtagctgggactacaggtgcccgccaccacacccggctaatctttgtattacaggatagagtgtgttcttggaagcctggcgtggagggagggagagcaggtagcacagttacagaaggatcttcgggatatggaaatgcggtatttgtggacactcattcatctaacacacatttgttgagctcctaatgtgtatagaactgaagggatggagtcatgggcagtggaaaagctgaaattgtgtaaaagagagagaaggatcagtggctatggtctcgaagatgacgtggaagtgtcagccatgacgggtggggagtggcctgctgctcctcctgggaagagaagaaggtgaagactcagggcgcgtctgcagggagacagtgggagctgtggggtcgtggatgacgctgatcctgtcattagcatctgagcgaggtcacaggtgagacctagagcagggagacacccgcaaggctttggtggagagtgggagtgagctcttcatggacactctgttaaccagcaatttcctttccctaataaatgcccttaattctccataattgaaggagaaggcaccagagggcagtgaatgaagctttaatttgggtaacacggaaggaaagcagctagagaccaattactctgtcatttacacaaactcatttccatgattaacttggaaaatraagcagcgccgagttcccacaggcaggggagggccccaggatgggagctctgctctgaggctgtgccttgggaaggagcacggggctatcggcccgggagaccraacactgagggtttccacaacaaagaggcagggcccagctctgtcctgaggctctgacccatccagcctttgcaccccaacaaactgaactcagagaggtccctgcaaaacacagctgcctcctcgtgcccacctcccctgtgatttccctggcttctggcaagagaagagaagacgtgagcaaaagctcaagggcagagatgagtaaacaggaacggggcgtgaaactcaaactcagggtgtggggatgggatggggtggagtggagtggaagtgggaatttgaggtgaggtgagactgaaggccgggggacacggcaggctgggtcatgatgggcccagagactcgagccaggcagatgtgacgtgaggactggacattctagacgcaagggagggctgcagtcagcactttaggcctctttacctcctgtcgttcctgagtgactctagaaagtttcttgagagcactgggcgagaggctgggaagtcacaggaaagaagcagagaggaggctggcctgcaggctgatgggcaatgtctgggccaagcccatgtggtaaatgcacatctatccctctcctgtccaggsatgtggggcctcgttaacaatgcyggcatctcaacgttcggggaggtggagttcaccagcctggagacctacaagcaggtggcagaagtgaacctttggggcacagtgcggatgacgaaatcctttctccccctcatccgaagggccaaaggtgagtgrgaaagggagctccctcctgcccctgaacctgccccacgtgttcatctttgctcagaatggaaatacctgtcccagcagctccaatgtccacaactcagcagaggtgagctcgtgaatcccagggactatgctgggcctggggtgatggtgggcagaggggctgtggccgggtaggggaggaggaagcagagcaggtaagaggtcagtggtccatgcagcaaaagcttaaagagttgagcagccatccactctgcacacctaatctatagagagaatcaccctttgcacaaagctgtgtgtacacatctttgtatcagtcaggtgtggttagtaaaatctggcatattcattctatgggttatttatatcgtagtttaaaaaatgagatcattgtggtattagggaacratagtaaaaatcaagattagaaatttggaaaaccaacaaaacacccaaaccatgtgggtggccaaatgtgagcaaaccactttagaagtcattgacttggatttttttctctggcatagcaaacaattgtggcaaaaagggtaagatccatacatctatggtgaagtcctagcaacaacaagcatgaacacagactgcagctgtaggattttagatggaaaccccaacccttcagtgacttcaaatttagagctttctgaaaggtgcctcccccaggatgggctgagttccctcccggggacacacctggatgggctgagtgccctcccggggacacacctggatgggctgagtgccctcccgggggcacacctggatgggctgagtgccctcccgggggcacacctggatgggctgagggccctcccgggggcacacctggatgggctgagkgccctcccgggggcacacctggatgggctgagtgccctcccggggrcacacctggatgggctgagtgccctccccgggacacacctggatgggctgagttccctcccaggaaaactggtcccagatccgcctcggcttcccgggctgggccaaatgcaatccacttccaacccctctgttcccagggccaggaggagctgtgggaggcccctgatgcccccaggctgggcctgtggcctttggagggggatcaccacactctcccagtgcccaggactctctcctcatatcctagccctgaagtcaggttcagaaatcctgcccctgcccctgcctgctgctctgtttgccaggcggtcctggtctccacccaggctccaccctaccagggtggaatggagytgggsagttgggcctaacagcacrggtcctgtcctctttcagggctgtcccggggctccctcccagctgcagccccaggtacttcctcgtctgcactccaacccccatcgccagggctgctgtcagtggctagacacttggccctagtgtgctacttatctgcacgtcgtactactggagctggactttaagctccataaggggaaggggaagctttcaggctgtatttctccctcaccagcaccagaccttgcctatagtgaaagctcagatccacacagacagctgtctcgcctcccacttctcccctcgtgttttcaccccaaattatcaccgcatcgggcttgatctggtttttgagtcagttgcgtgttgcccattacactgtgccctgctgcttctcactcacttgtcctcccctgtcctgcctggcacagccaggttcccagggaagaccaggggtgccgatgctgatgcgtgggcctgagctggccttgcctattgactgagaaggctcctgggtggctcagaagtggttccagccaagcctctagagacatgccagacttctgcccgctgtgtcatagggcagtaacgscttagcaggtacctctgtctccctctgtaggccgcgtcgtcaatatcagcagcatgctgggccgcatggccaacccggcccgctccccgtactgcatcaccaagttcggggtagaggctttctcggactgcctgcgctatgagatgtaccccctgggcgtgaaggtcagcgtggtggagcccggcaacttcatcgctgccaccagcctttayagccctgagagcattcaggccatcgccaagaagatgtgggaggagctgcctgaggtcgtgcgcaaggactacggcaagaagtactttgatgaaaagatcgccaagatggagacctactgcagcagtggctccacagacacgtcccctgtcatcgatgctgtcacacacgccctgaccgccaccaccccctacacccgctaccaccccatggactactactggtggctgcgaatgcagatcatgacccacttgcctggagccatctccgacatgatctacatccgctgaagagtctcgctgtggcctctgtcagggatccctggtggaaggggaggggagggaggaacccatatagtcaactcttgattatccacgtgtggattatccaccatgccaggaagacccataactggttttaacactaactagagggaatgacttctttgcatagtgagtgacttgggccttcacaaacagggtgtggagtggmaggcagaggcctctaaatctcagrgcaaacatggtgaatctatctctccggagataatttcatacagagattttaaraaaacatctttatattaaaaacagatctcatttgatccttaagccagtctcatgaatgaaaaggacaggtttttttcttttgtaaatgaagcatttgcagcttaaagaggatgcatgaaataacccttttatcgcttataaatagtgccagtyatgtgttccygccacggctgtggaaatacttcacatttgcattccaggactgttttggatccatttgcccgagaatcttctgactaactctgtgtcctcatctgggcagcacacaccaagtgcccactggtacctctgcatgtccatggtgctgtgtgactggccagccagcagccagtgactcagagctggctgtatggagggggtgggaatgtttctggagatttttgtttttccagacacagtcttgctcagtcccctaggctggagtgcaatggcaccatctccgctcactgcaacctccgcctccctggttcaagcggttctcctgcctcagccttccaagtagctggggttataggcacccaccaccatgccgggctaatttttgtatttttagtagagatggggtttcaccatgttggctaggctggtcccgaactcccgacttcaagtgatccgcctgccttggcctcccaaagtgctgggattacaggcatgagatttttacttgagatttttccatcctcttttaggactcaggatagacttgtgtggaggtgctctctggctaaggggataagttgttactggtttgggtctgcttggttttgccttgggtggggccggtgtcgatggggcaggcttggcacgagcagtggtgccatggcagggcactgtggcatctcccctagcagtggatttggggtccctgcttgcctcacgtggtgcttacacacatgtacacacacacacacacacacacacacacacacacacacacacacacacacacacacacacacacacacacacacacacacacacacacacacacacacacacacacacacccctgttctgcagggcttcagcgtggccttcattcccgcctcgcctcggcctcttttcaattaagaagtgatgccacttgaggcagggtctgcatgatcacttcttgggtttcagtttgaaagctgccatccctgcgactgcccagggcctgtatgttgggaccgaagccaaacaccactgtcctccagggggctttcggcccggggcagggtccccagtgcccgccttcgaatcagactccgcgtttccgcctctccctgggcggacctgccgctagagggcgctcctcctccgcagccggcgccggcctccagcgccccagactcccgcgctgccgcccgagcctgaggtttctcacggcgttcgggattcgcgcttcggaaaccgggaacaaagaagcaagcagcacccttcagaaacagtgttctcgctctcctagcagctggcccgggcccggaggctggtgccaggagaaggcagaagagcccgggcagccggagtgggctacggggttcaggcagtgccaaggaagaagggcctcacaatgggcaattcagctgcctcccgggccgttgtccccgctgtcttcaaacaggggtcccctgtcccagctgccccaggaggaggggggaggcaggcagggccgaaaccctccagagcccagagggggacgcttggtggccgctgcagttacataaccataggatgcttttgtaccgtggaccttgttctagcaggatcctttcggaattgcacttttacatgttgggcgaatttgtgtccgtgctgaagtttattaaaggaaaatagatggagccttggagttgcacgtgtgcgtccctgcctgggaactagaggaaggagggccacatactctgggtccccatcagcagacccgaacgtcagagaagctgcatgtgcgtctactgggatcttctgagtaagctagaactgctgggccggcctgtgcaggttgttctggcttttaatcgtttccagtgattgaaaagcccaggctaccatccctccaaataactccagtgctaactcaaacctcatattcaccattcactttccggcagcttagaacctaccggggcgcaggacgtagttttcgtctttaccagagtgcgtggccgggcgcggtggctcacacctgtcatcccagcattttgggaggcccaggcggtcggatcgcctgaggtcaggagttcaagaccagcctggccaacgtggtgaaaccctgtctctactaaaagcacaaaaattagccaggcgtggtggtgggcgcctgtaaccccagctactcgggagggtgaggcagggagaatcgactgaacccagaggcagaggttgtagtgagccgagatcatgccactgcactccagcctgggcaacagagtgaggctctgtctcaaaaaacaaaacaacaacaacaaaacaaaaaaagagtgagaggacaaaacaggtgtatattcccattttatagatgacataactgaggcccaaagaaggaaagtgactcactcagtgtcacagtaaatccacggcaggaccagggccagaacaaaagtctcctgagtggcactcttcactatcacataacactgtggctcgcaacagccctggaagcaaagccagttggggtcaccaggcacctagaccctcactgcttgtctgctggcagagagccgctccttcttgtcagagtaagtaggaaggaggcctttgcctgtgtggacctatggtctggtgactccagccagcacaaacccatcccctgatggttggaggctgggcgagggcttcttgcaagatgcgcctgacagtgccttgttacasagcacctgctgtgcttagcattccacccggggccaagaggctgtgtgagcaggtgacagccagcctggccccgcctgtcacaagctgctaggtctgcacccttgccacccatggcagggggtctgacaaagactccccatttgtgaggtctgttcactgcctgtatttcgaacagggcctggctctgcaaacctgtgcaaactgtgttgatataggagccgacatgagcaagcagaggctcccctggctcaggcagccccaggttgggttggccagacagcaaccaggcacaggggccragtgcaggtcctgctacccagccaccacagcttcctctcacctgattctcacagcaacccaggcaggataggcagggtggggttatcttattttgcagaaacaggctttcccaagtctgtcaccaagygaggggtagagctgggtgtccagccagatctaacctccagcccagagctggtgatgcggaaaatcagggcagatggcagcaggatctaaaatagggagggaagaagtcctcagttacgtaacagcgaggagactcycagcctacgcacagtagcaaccatggggtcctgccactcgagccagaccctccttcccttcccgttttgggctctaagtgctgccgcctgtgagagaatgtgctggaggagcccccagtatccttccagcgggaagtcggctctgtcaaggccattcccgagagcaggctctaggaattcaaagaccaagcaggcagagctggattctggagctgccctcaaagggcttgagggttatatgagcaccgtgcttgagaagttagtgatgatttctgctcaaagagacagagcaagagggctgaggggctctggtgctctgggggagatgaaacaaccccacagtatatgaggcctctctggtgtgtgcgggcactaaggaagggtgacttgtgagtggcgcattcggaggcacggggtgggcagctgttgagcaagggaccagggctgggacaggctgccaggacccccacaaccccaggggaggaaaggggactcagccatcatcatgcctgactcccaggctcccggatgaggagcctgctagccagggcttgaagccctccagtgacagggggtgcattacttcctaagaagccatttccttggttcagaaacatttatccaaagactgagccgaaatctaccacctcacttaatgtttttggcacctggttatgacccagacctgcacagaataatttaactcttctgaaatagacttccagatatttggaagtggccaagtcaggtttaagagctcaggtctcccatttgacaagatttccatctcctcgctgtctgaacaggtttcagctgtggttatccaatccctcattcttgatgacacacaccaggctgaatggtctttagagttcccctcaagccgccaagcgctctgagacaggtttactagctttggtgagatgctgacactcctcacatgcacgtgcccctcccaactactcaagtgagttcgtggcaaatctctcatctgatctgcataaacggattatatcttaggcggtgccattgtctgcattttacaaataaggaaactgagcctcagggaggtgaagtcatttgcccaaaatcacagagccaggaaacgagagagccaagatccagaccccgcaagatccagaccccacaagatccagaccccgcaagatccagacccckcaagatatagaccctgcaagatccagacctcacaagatccagaccccacragatccagacctcggctatctggcttctcttttttttgcgacagagtctcaatctgtcacccaggctggagcgcagtggtgtgatctcagctcactgcaacctctgcctcccaggttcaagcaattctcctgcctcagcctcccgagtagctgggatcacaggtgtgcgccatgcctggctaaattttttttttttttttgtatttttagtagagatggggtttcgctatgttggccaagctggtctcgaacccctgacctcaggtgatccacctgcctcgacctctcagagtgctgggattacaggcgtgagccactgcacccagccccatctgacttctatacccgcagccccttcctttaccctcaggctgcctcagtctccacactggggcccagagctgggctggactcagcgcagtcagaacctcgccttgcacgtggcgaaggagcggcaggcaggcaggcaggcaagcaggacagccagcttcctcctagtccgcagtttcgcggagcagcctggaaagggaggcccaggcttccctgtctcgtcgcacgtgtgtctgcagtgtctgtgctatctcccaggggcctggatgtcgatggaatgcctgagggtggagagagctgtggctgaggcctaccctggtggcctcagcatctgtggagatgtgtagagacagggagagtgaatggggaccaacctcaggagatgctgggtcccagaagcaccatgtgcttctcctttggtgagacttaattactctctaaaatgtaaggctactcccacttatcaaattatagatgagtttaattacagcacactgagtaaccacactgggctccttcagaaatagcagcaggctggttgctcttctcagcttcagctgtagccaccccagtttcaggaggaagtgcccgtggttcctggggcctggaagtgccgctcaactctgctgccagacaagtgcgggcgtggtggactgcactgggtacactgctgtaccggccaccaccctccggccactctcagccggtgagtgctctgcggggccatctggccacgtgttctgtgactgggtcatttactctgctgcaacctctctttctcctacctacatcgtgttctggataaaggttttggctcataatgtccgaccagaggtggacaaagtggtgtgggacctgccgtaagaaacagggagcatggygcggggagagaagcctgtgccttatggagactcggggcaccttcaggaagcagggtcaacagcagcaggccactagggagtcgggagagctcggtgatgtcacgaggggcatcagactcttccctgcaggctggcgggactgatgggctctcgttccaatggaggtacaatgggacttccggggctgtgatgggaagggcggaggagctgccgatggtcccagtgccatattagtgtcacattctgaggggcagccctgtgccggacggcagctgctacctctccctctgcccctttattacttgaatctcttcgttgtgccctgtctaggcacggtcgtccgacagcaggcagcccactgccctcccagagctcactgtctagcccagggtgacacagggtaaccgtgggcatgacttgggccgggaagtgagaggctcgattccatcacatgtaaataaaaatactcattttcaatctaacacagtctgtcttcttccccgcacagccttggagcccctcatggacagctgatgcgagaggtgtgagtgggcaggggtctctccttacttagggagtcccatgactttgtcaaaggaataa

SEQ ID NO: 12320 - DNA, 31112 bp, Homo sapiens
aaatcaaatccagatgtataacgaacctaaaagtgaaaaataaagcaataaagcttttcaaagaaaacataagagaaagtttcatcacatttgggtcagcaaagatttatcaaacagaacataagcagcattaactgtaaaagaataaacagatgatttggacctcattaaaataatgaaccatgtttatcaaaagattccattaagagagtgaaaagataagtcacaaacttatattgcaatttattgatctggcaaatgattgttgaacttaccaattgacaagaaaaagacaatatgacagaaacaggcacttctcttcaatctaacttaaacagttacttctcaacagatgatatccaaatggtaaaaaacttaaaaggtaatcagtttcattagtcatcagagaaatgaggtataaaactattatgtgaaaccattacacacccaccagaatggataaaatgaaaaagatggacaacaccaacgatttgcaaggatgtggagcaattgtgcctctcatacaccattgtttggaaatacaaattggttcaattactttggaaaattgtctgacagtctctactaaagctaaatatatgacccagcaatttctttttaattatctgctgctatgtaataactcttccaaaatttaatggattaaaagaacaatcttggctgggcaaggtggcgcacacctataaatctcagcactttgggaggccaacacgtgaggatcacttgaggccagtagttcaagacctgcctgggcaacatagtgagacgccatctccacaaagaaaagcaaagaaaagaacaacaattccattattactcacagttttcaggttaggaattcaggcagggcatgcctgagtgattttttctgctccacacagcatcaactgggatcactcagaagtattcactaggtggctgggctgggctggactgatccaagacagctgcactcatgtgtggcacaatggtggggatagctaggaggcaggacttagctggttctttatctctccacatactgtctcagggtttttccacatagtctctctagcagagtgcttgtacatcgtacaaggtgactcagggctccaagagcccaagacagaagctgggagattacttatgaactagccttgaaaattccagcacatcacttctacgttctattagtcaagaaagccagtaaaacaagccaagattcacaagaagggagaaatagactctatctcttgatgatggtgcagcatactcacagagggaaagaaggaaggacggcagccatgtcggagaaaaaacactgcagtctaccctatggcctcaacaattcattttccctcacacatgaaaaatacacccacctcccctatgactcccaaagtctcatccaactgcaacacctccttgaaatccagataccytcacttaaatcagtcacggtacagaggagcrtccttaaacgtccttcctgaagtgtgtagtttctctcaatctgaagaagattgagagaagattgaagattgaagagagaagagagaagattgagagaagaagatgcgaagggaagagacaagttctctcctcccacttctccacacacaacataaaattgtgagacacacataatttaaaacaattggcactctcaatctgctcctggggataattcaccatggccccttgctgtgtcttttgagatcttgattctgcctgggtcacgcttccttttccataaaaatacctcatgtttgaggctcagcctctgtatcctgtttcctgcctgtagaaggttgaaagttcaaaggcctttcatcattttgcactgtcttgcccctttcagacaaagctaatttcttaattgtgaattttatatgaattaatttataatccactccactataataaaggccacaaccaccaatcttttcaagataagcttttctatatctttggctatctacaaacctcgtatggaacattgaccgtaaaatagcgttagagggccttatatctgatccaatggtctgctaaggcaacaccttagaactttctgaggtatttataaaggcttttacagttacaccctagatatatgtttgttttgaaattctttcttaattgggtaatcctggaaagactaagaaggagaaattatattatttttaacccaataagcgctggctcttttatatttaacaaaaatgttaagcttatctatatcctctcacattttactataagtatcgagaagtcagacaataacttcagagaccttcttagcttcagagaaatatcaccagctataccaccacttcatttgctatatattcaattttcatgttatcacaggtgacaatgttgctaaactttctaccactacatgtcaaggattctctttcctctagctatagcctgtttctcactttcctttaagccctaatcaacggcctccttgtgggtcatcacgtttccactcacaatctttataaggactttccgactctgatttgatcccaaagtcattgccacatgtttggctttcatatgcagctttccacttccaggtgccaaaatgtgttctaggtactatggctgcctcataaattatccaaaaatttaccagcttgagacaatcattttttatgcttttgggttcttgggacaggaattcagaaaagatacagtggggatggcttgtctctatttgatgatggctaggaacttgggtttagtgtttttagcaaagtattagtttatcaaactaaactaaacttggttttagtgtttttagtaaagagaaaccatcataagatcaaaaatataatgaatatattttaactcaatggaataaaactcaatcttttcaatgtaagtcagtaaaattcacaaaaaaaaaaacaaaaataagatatagcaaatgggaaatataaaataagataatatgtcaatcctaagacaattaaaataaatgtaaaaaggttaattttgccaattaacagacaaagaccctcctttggggataaaaagctaaatctaaaaagatgttttgtacatgagacgctcttaaaaaaagaaggcacaggccgggcgcggtagctcacgcctgtaatcccagcactttaggaggccgaggcaggtggatcattaggtcaggagattgagaccatgctggctgacaaggtgaaaccccatctctactaaaaatacaaaaaattagccaggcatggtggtgggcacctgtagtcccagctactcggggggctgaggcaggagaatggcgtgaacccaggaggtggagcctgcagtgagctgagcacgtgccactgcactccagcctgggcgacagaatgagactctatctcaaaaaaaaaaaaaaaaaaaaaagaaggcacagagactttggaaataaaaggatgaaaaatatcaggtaagagtgaaccaaaagaaaggaaagcaatcataacactgtataaaattaaatttaggacaaaagtatgctatacaaaaaaaagatacaagaaaaacaaatacaagaggacataattatcgaaagtatatgtgctttaatatacagtcttgaagtaagtcaagcaacaactgaccaagagaagtaagtgaacaattgctattggtgattttaacattccccaatgagaaactgaaagcttaaataaataatcaacataaatatgaagatttaaataaaataagctcaagttattacatatatacatatatgaatgtgtatatatacatatcaaacagatatccattattttttaaagaaaacatgaaatgtttattaaaataggccatatatgagctgggcacggtggctcacgcctgtaatcccagcactttgggaggccgaggcgggcggatcatgaggtcaggagattgagaccatcctggctaacacggtgaagccctgtctctactaaaaataaaaaatattagctgggcatggtggctcacgcctgcagtcccaactactcgggaggctgaggcaggagaatcccttgaacccaggagacggaggttgcagtgagccgagatcacgccaccgtactccagactggatgacaaaggaagactccgtctcgaaaaaaaaaaaaaaaaaaagaccatatatggctattacaaacctcaaaacattccaaatgttcaatatcataatggacaatattctttgaccatagtgaaataaaattggaagtgaataacaagagaatagcctaaaattctaaataaactcagtgacatattactaaactacactctggttttaaaggaaaccagaaaagaaattttaaaatacttagaaaaaaattacaatgaaaatagtaattatcaaaaatgcgtgggacatagctcactcagtatttagatgaaaacttgtaaccttaaatacatttatgtggagactggaaatattaaaatgtaagaaagctaagcatttatctcaagaaaatagaaaaaagcacaacagaccaaaacccagagaatttaaaggggtgattaaaaaataaagatataaacagaaatcaatgaaatatcaattttttaaaaaaccagtaacaaaactaaaaggtggatctttggaaagattaattagctatatagatctctgtaacaggacttatcaaagggagaaaagacataaacaaaatacagaacaaaaaaagaaaaaagaattactgatataaaataataatgtaaaaataataatggagaggcctaatgaataactgtagtatttaatttgaaaatctagatgaaatagataaattcctagatataaagttcaaacttgccttataggataggaaacttgaaaagaccaataaacatctacaaaactaaggtgtctccaaaactgcagacccatttgtaggctctactctcctcttttcccctgggaagagattccctcatctctggatggaagcaatgatgctgtcaacccaacagagagcaaagaaccctagcgaggcattcacaatgcctcatccttctccacactgtgatcaatcagtcctaaggggggcaaccacgccatagacttttggggggaactgttatgaacattgagaaaaatgagaatttctctccttctgatatcaactaaccagttagaactaaataacccagagctactgtggccacatttgtccccaatgcagacagaataaagtagaagaaagcagagctaggaaggaataaaaaaaaaaaaaagacagagagagagagagaaggagagatctgatgcctgatttagaactccgtagatccatgcctgaagtcctttccacccttggacctctcgttcattcctttttgctttaaagcagttcaaatttgatgtctgtcacctgtaatccaaagaaaactgatgaaaaataaaatgtggggaaaggggaaggtgctagactttagaattgaatggccttggatttgaatctcaagggcgtttaacttaacttccatgcagctcagtttcctatctaaagaggagtgacaatggtacccacttcacagagtcattgtgaagatttcgtgagataatccagaggaagcgcttggcagatattattccatgtctgtctctcccaccagactaagaccactggaaggcaggaccttgcccaagtcatccccaattggagctaaacacctatttttctttttacaagtatctgcaccttggtgctaattaagggcacctaagacatctctgccaactgacacagggcaaccacattgatgcaactccagccacattttggtattaaaaaaagacttcatagaattgaacgcagrgcaaagttaatttgcagcatttctgtgtttactcagctmtcctgacaaagcctcccattggytaatgactcgggggagaggactaccaagcggtgaaggccactggcccctctaaccattaaccacccaggaagctggcaaacaaaatttaacaggcagcayccaccgcaggcttactgtacacatgctagggtccaggacagcaggaccaagccagcagaaacagcctgagcccaccgcagactgtgagtaacacctgagaaccctctgtccctccccctgcccagcctccagagcaaagccatggctgcagctcgcttgtttggtttgttgagatgctttgtttttttaaasggcacattgaacattagggcagccagcagtgttatgaggcaatctggttaggattttccagaccccggagtctgtgagtcatccacaggggttccgatgtcccctgggttcctgccatgcagggggctgacacagagggctgtagctaagaaccattctcgtccactgccatgattgatgctcctaagcccagccagatagccacaacagccacaacagccacagagtcgcagcctgcaagctacaatgcatctgctccagtcggcaccaccgatgaaggatgctggccgcgggtcagggcckgggagggctcagctggcccagtgcaggggtattcttctgagtcacgcagacctgtctccaccatggctcctcacycagtgacctggggcagagataatgcacagagaacagaactgtctgcactgtaccacatgtcatgaggtttcactacagaaggtcaagaactgtgcctggctcatagggcatttgtgaaaacagagaacacagtgaatatttactaagtgagtctcttcagagatgaggaacaaagagggcatacttgacatgaaatgcatgaataatattgatactctgcatttttatatggctgggtacttttttgtttgtttgtttgtttgttttttaagatggaatttcactcttgttgcccaagctggagtgcaatggtgcgatctcggctcactgcaacctctgcctcctgggttcaagctattctccagcctcagcctcccgagtagctggaattacaggcacacrccatcacacccagctaatgtttttgtatttttagtagaaatgggtttcgccatgttagcaaggctagtctcgaactcctgacctcagatgatctgcccacctcagcttccaaaagtgctgggattacaggcatgagccaccacacctgaccatggctgggtactcttaagagctgctttactcatcattttgctctctgtagagataggcagaatggcatggcacaagctccgatgtcagacatctaggcttagaattccagctcagggggagttactctgtctccctggatctcagttttctcatctgtaaaatgggccccaggatgacccattaagtgaggtcacataagccaagcactgataacagccacrtctggtattcacaacaatattgtggggtggrtggagttttcaccctcatcttagagaattaacgcaggagaaggtgagacatgcaatctccccagagctggcaggggagcccatcctaccattggcatcataccgcacagggcctgtgcctgagaggagatcccagataggtatggcagtgaccaaagctaagcaaagatttcactgcctgtcatggggcaaggccatagagaagcacagatacaaggcttcctggaggcggtgacctgggacctgagtctcaaaggacaagatggagtgagccagatgaggcagggagatgagggacctacagactggagccacataggcaggactgaggcagatccatctttgttccctgctcccagtccagagctgggctcagcaaacatggaaaaatcaaaatgacctgccctggggaactgcagtgacctgtcttgctgtaacctgccctatagtgatgtgacatgccctgccctgccccacagtgggagaaaaggctgatgtgtgctggaagaacccctggcacccagtgttgctgtggctgagaccccaaagggccagatttgaggctggaggcagaactgtcaccagggactgggtcacaaagaccccctgggctacattagtgagaatcagccctgtsgtgggcaatggggagtccctgaaaacttcaaagcagaaccgatcagcttgaatttttgagaatttaaaaagatgcagctgcagatgggtaaaagggctggagggagttgaacaggaggcagggagacgaggtaggggctactgctgagtcctgagagagatgaggaggctgtgcagaggcactggagaatagacaaacaccagaaaaatgggtaaggctagaggtgttattatcagctctattttatactgtggaaactgaggcagagtttaagtagcctgtcccacatcacctaattcatacatggcagtgctagggccccaatccagcttgatctgccacgaaacccaggatcttttctgggtttcgcgacaaaagaattgtcrcgaggacccagaaatccaagtcagaaacccgatggagaattcaataaagcccatcatttgggtgcggggagtggggagcaggtcacacctgcctctattatctaaagcagagaactaggggctagagcagccaacaggggttgttttccaccctggtgagataagggagacaygcaaggagggttttgggagactcaggagaactaagggttttgsggggggagttcccacctgtcattcttgagattctgcttttggaacacaccagggaaggggcctctagggaattccagagcagaacagtggttcccacgctcggagcgcacctgttaaaagaaaactttagacaaattaaacgtagcagagtttatttgagcaaagaaacaattcatgaatcacacagcaccctaaaccagtaaaggttcagagagtgccacccagcaacgtaggcagtatttacaggcagaagaaggaagtgacatacacacataggctgataggttacagctctgtgtttgccttgtttgaacatgtctgagcagttggcaggctgtgattgactgaaagttcagctgctatgattggctgagacttggttacttgttacaaacatatactctcaagttaggtgcagtttgtttacatattaagctaggttacagtttgctacatgaggaggcagctttagcccatctttaatttaatttaacacaacacaacctcctggagcactggtttaaatgakggttcccagcccctcacccagaatggctggttcaacagtgggtggtgcagtaagacctgcttctcctgtaagcatcctgtatttattgtgatacaggtagctccacacagcacagggcctgaaaccactaaccttgcaggcaggcagtgtccaccgactgattccaaccttgggtggattttttttaattgctcttatggaactctttttaaatcatttatatttaattttttccttaaatttgtattgtgggaaaatataatacctaacgttttaactacaagcatacagttcataaaagtacattcacattgttgtgccaccatcaccaccttccatgtccggaactttttcatcatcccagactgaaactctatacccactcaacaataactccccaatctcccgttgccccggcccctggtaaccacaattttacttctgtccctaggtattcggctactctaggtgtagaattagactctatttgtccttttgtgtctggcttatttcacataacataatgtcttccaggttcatccatgttgtaggaaatgtcagaatttcattcctttttaaagttgaatagtattccattgtatgtttataccagactttgtttattcattcatccattgatagacatttgggttgttttcatcttttggctatggtgaataatgctgctgtgactttggtctacaattatcttttcaagttccttgactagctgcttgcagttctttggtgtatatactcgaagcaaaattgttgggtcaaatgacaatttgtttaatttttraagaactgtcatattgttttccacacattgtagcactttatattcctaccagcaatgcataagggttccaatttccccacatgcaatgctaacatttaaattaaaaaaaaawtttttttaaaggaaatcttgctatgttacctaggctggtctcaaactcctggcctcaagcattcctcctgcctcagctttcagagtagctgggattacaggcacgggccatcatgcctggtgtgccaacttattgttttctgttttgtttgtctgttagtagccatccctgtggatacraagtggtatctcattgcggttttgatattcctaatgattagtgatgctgagcatcttttcatgtgcttactggccatttgtatgttgtctctgaaaagatgtccactcaagtcctttgcccatttctaactgggtttatttgttttgttgttgttcttgggttttaggagttctttatatatcctggatatcaattccttatcagatatgaaatttgcaaatgttttcccattctgtgagttgcatttttactttattgatagtatcctttgatgaacaaagttttcaattttgatgaagtccaatttgtttattttttattttgttgcccatggctttggtgtgatattcaagaaatcattgccaaagccaacatcatgaagtttttcccccatgtttttttctaagatttttataattttaactcatctttaggtcattgatctattttgaattaatttttgtatatggtgttaaaggtccaatttcattattttgcatgtaaatatccaaattttcagcaccacttgttgaaaaggctgtcttttccccattgaatggtctggcatccttgtcaaaatcattttactacatatgaaaggcttatttctgggttctgtattctattccattggtctctatgtatgtctttatgccagtaccacactgttttgattattatagttttgtagtaaattttgaaatcagaaagtgcaagactttcaactttgttcttcttcagtattgttttggctatccaggtcccttgagatttttatataaattttaggataaatttttctatttctgtgaaatacagaactggaattttgataggaattgcattgaatctatagactgcattggatagtattatcatcttagcaatttcttccaatccatgaatgcaggatgtctttccatttatttatgtcctctttaattgccttcagcactgttttgtacttttcagtgtatgtctcttacctccctgattaatccctattttattctttatcatactattgtaaatggaattgttttctcaatttccttttcaaattgttttctttgttagtggtgggaaatgcaattgatgttagtgttttgattttatatcttgcaactttgctaaatgtgtttatgagttctatagaatttttagggttttgaacatataagatcatgtcatctgtgaacacagacaattttacttcttcttttcaaatatggataccttttctttccttgcccaattgctctggctagaaattccagtgctatattaggtaaaagtagtgagaacaagcatccttgttttgttcctgatcttcggggaaaagctttcagtctttcactattgagtataaaaggttttataaatacgtagtcttgattatgttgaggtagttttcttctattactaattttgttgtaggactttctacttagtccagctaaacacggggtccttgtcacatggccatgaaagattaggctcacagacactttgaggtgtgaataaaatggaatttattgggtgaaaaggaaaacaactcagcaaagcaagagagagtcctgttaacaggccctcatctgactgactgaatccccagattaccacatcggatcaggagagagaggccaagctcctcccygctgcaaagggcacaaacttcccacagctccaccccattctcccagtgtgcaggccaactgaatgttctccaggcacctctttacacttgactgtctcaatctgctgtgtgtttttatcatgcgagggtgtgttgaattatgtcaaatacttttttctgcaccaattaagatgatcatgtgattttttcttttattttgttaatatgatgtattacactgatcaatttttgtatgttgaaacatccttgcattacagaaataaatccaaattgggtatggcatataatcctattagtaggctctcaaaattaatttaatccattatattagtcagggttctccagagaaacagaatctataggatatatagaaatatatataagaggaggcattatgggaattgccttatgtaattacagaagctgagaagtcccacaatctgccatctgcaagctggagacccaggaaagccagccatgtaattcagtctgagtctgaaggcctgacaaccggaggagccaatggtgcagctccacaataggaaaagggcctaataaggctgctggtttaagtcccagagtttaaaggtccaagaagcaggaggcccagtgttcagggcyggtaaacacagatgtccagctcagggacagaagagagaatttgcccttctcctacctctttgttccattcagcctttaatagattaaaaatgcccacccatattggtaaaggtggctgtctttaactcaatccactgattcatatgccaatttcttccagaaatactgccacaggcctcttttatgtaggcactaattccttttatgagggtagagcccccatgaataggtttccacatatgaatttgtggggacacaaacattcaaaccttagcagctggtaaaacattatttttgagtgtgtctgggacaaaataaattgagcaaaaatggacataattgaagggtgaaatcgttctacagcaatttagacacttcaatatctcattctcaataatggatagaacaaccagacataaaataagtaagaaaatagagaacttgaatatcacactaaaagctagatgtatcagacctatacagaacaccctacaacaacagaatacacattcttctcaagtgcaaataggacattctccaagatagaccctatgttaggccacagatcaagagtcaatagattttaaaagacagatatcatactaagtatcttcttcaatcacaatgagatgcagttagaaatcaataacagaaggaaaactggaaattttacaaattgtggaaaaaacaacacactctttatcaaccagaggatcaaaaaagataccaccaggggaattagaaaatacttaaagacaaacgaaaatggaaacacaacataccaaaacttatggaatgagtgaaagcagtgtgatgatagaaatgtaaagctgtaaacacattaaaaacaagaagatctcaaataaacaatggcatatattcaaattcaggtgttaactttaggatgctaatgtaatccccataataaccacaaagggatgagaatagaattattaaagtgtttcaatacaaaaaagcatttcagtacaaaaactaaatacaaaaaaggacagtwatataggaaatgaagaaccaaaaatgttatatcttcttgctgtactgaaaactttattaatatgtcattgccctgtcttttggaacttttttaattcaaaatctattttgtctaatattagtgtagtcacccctgctctcttttgattactatttgcatggggtaacttttccatcctttcactttcagtcagtctatttacatttttggatctaaaatgagtctcttgtagacagcatatatttggatcatattttagaaggctaatgtgtaaaaataatttttagtctttgtttataatttagagactagaaaaagagcaaactaaactgaaaaatagcagaaggaaggaaataataaagattagagcagagataaataaaatcaagaatagaaaaacaatagagaaaataaattaaaccaaaatgtaatatgtatgctcataatacatttagtccatagtatatttgatataaccagctttacttcaatagcatacaaaagctctgcttccttatagctctgttcctacctgtttccagttactgatgtaacaaattatatctacacatcatgtgcccaaaaacataacttataattgcccacgcatctacctttaccagaggtcttttatttcttcattcagcttaaagttactgtccagtgtcctttcatttcaatccgaaataaaatgcctctyatttcttgcagggtaggtattgtggaaaaaagcttactcagcttttgtttttctgggaatgctttaattgtgttttgcttttcttccagcattttgaacatatcctttgggtgggttttaacctttctgagcacctatttctgcctgcctaaaatcatgttaataatacttgctttaggagtgttttggtaatggttagatgactgaatatagccagactacctagatcagtgttgggtacctgtcaggcactggataaatcataacggctgttattcatatctccagatgaggaaactgaagtccagcgccctctgtgatgtgctccaggtcacacagccagtgtggaggaaggaactggggcttgaatggggtcttttgcctgcctcctcttgcactacgccccattgactcagagactgccacagcatctaacaagcttttctgatttggcagggcctggctatactggacaatgccactcctcctgtacacctgtcttctctggctgcccaccagcggcctctggaccgtccaggccatggatcctaacgctgcttatgtgaacatgagtaaccatcaccggggcctggcttcagccaacgttgactttgccttcagcctgtataagcacctagtggccttgagtcccaaaaagaacattttcatctcccctgtgagcatctccatggccttagctatgctgtccctgggcacctgtggccacacacgggcccagcttctccagggcctgggtttcaacctcactgagaggtctgagactgagatccaccagggtttccagcacctgcaccaactctttgcaaagtcagacaccagcttagaaatgacyatgggcaatgccttgtttcttgatggcagcctggagttgctggagtcattctcagcagacatcaagcactactatgagtcagaggtcttggctatgaatttccaggactgggcaacagccagcagacagatcaacagctatgtcaagaataagacacaggggaaaattgtcgacttgttttcagggctggatagcccagccatcctcgtcctggtcaactatatcttcttcaaaggtattcccacccatccccatctgaaggcccatccactatggccaggaataacagccgctaaaatccagggcacactcttgggcaaagtctttgattctgtaaagcacatacacatctgggaatctccatcttcaccacaatcctgctgggtaggtggaattatattattttacaaaagatcaaaatgacacccagaagggttgaacaatgtgcctacattctggcaggttggtttgaggcccacacctgtaaccatgaacagtctggctgcttcatgctccacaaatgctgactgtcaagcactgggccagggactggaaaaatggcctagaactagacagaaccccacccagccccttgggaactcccagatgcccccaaagccatcctgcacacactgctctgaccaggtcctgcttcagtttttcaatcttcctgttcataaaaacctggaagctctaggggggaatgcacttccaggctttttccagcttctagaagccacatggcctgtgggcctctcttattttcaaagccagtaattgcaaattcccacctctgcttccctcatcacatctctctgattctgactttcctgccttcctctttgacttacaagaaccctcaggattacactggataatggcccacctgggtgatccagaataggctgcccatctcaaggccagccgattagcaattatgattccctctacaactttaattccccctggacatgaaagctaacatattctcaagttctggggattagaatgtggacattttggagggctgttattctgcctgccacaaagcccaggcctcttctgtctcatgagccctcttgcaacttatctgactgcctaaaacatcttccctcacttcaaatcttagctcaaaagtcacctcctctgtgaagcctccccagagtcacccaggaaagactttgccctcatatgcatgctcaacagtttgcccatgccttgtttgggcaatcatcttgccataacatgttgtttagcacccaggtggttgagtttcagttaagcaatcatattcaaaggaatgcaggtaaaacagccaaaataagcaaactaagccagtatctctactgaacatgtgtctctcgacaagatcatcagatcagaggagatgtgatccccagccaggacccctcatgcccccttcccctcctccccagctctctctcaggacctcccatcagactgtgcccacctcccctcccatcccgcacctccttactgcctggactgccttagcatctctacgagtccttcttctctacctgcctctgggtctttcctgctctccagcacaaggctgggaactcccaggagaggccgccctcttcgcaggatggtgaggctgagaggctgaccaggcaaaggcagccttcctaacacctgactatgggagggccagggaggctgggaacatttgcccagaaactcttctgtgtgctcccacaaattccatagaccatctcccccacgagactgtgcactcttgtgcagggtatctttgtctctttgggagattccagtgcccttgtttaatgcttggtgcatggaacaagctcagcagtggttgcacagaggttcaggcaacacaacctggggaaaaggcacagtaaacccaggtgcrgggagggccctcctgagcctgagagatgcctgagcacatgtggtggaatgggtgytggtggaacgggtgctggcctggtgtcattctgtacgaggtttcacagtgtcctcaggaccacagtggggctaagtggataggagatcacagctttaggttacaaaatcagagaaacttggaacacctgaatgcaggaccagacattgatggagatgaaatgcctcattgtacacagattttctataatacaacaaaacgaatccgtgagtgtttggttaaaacttttggcaaaatactctgaaatatttctagcaagccaggataataaacagaaatcaagattagtgtaggtattatcactaaatgtagaatatgtaaaatggccctgatgtgttatttatttmtttatttatttttattttttttgagacggagtcttgctcagttgcccaggctggagtgcagtggcagaatcttggctcactgcaagctccgcctcccgggttcatgccattctcctgcctcagcctcctgagtagctgggactacaggcacctgccatgacacccggctaatttttttatttttttgtatttttagtacagacagggtttcaccacgttagccaggacggtctcgatctcctgacctcatgatccacccgcctcggcctcccaaagtgctgggattacaggtgtgagccaccgcacccagcacctgatgtgttatttatcggactttcttgacagtttttttttaataacattaaaaatattgttaaaagattttccagaggagccatccttgctctctcagatcgtccccaataaattctttctctaccaccaattctcctagaactttttgagaatagatcccttaaagtagaggctgaaccccattttgtattttgttttgtgtcaaactatatacattatgcttactcctagaaaagaaatactccataaaaagcaagcagcaaaatgttaaggwcgaaaaaaacctaacaatgaaaaatattttacccactttgtttttttgctgtaagttagccacaaaatacaactgccctctggttctgaggattttagacctcctttggaggatgatttgagaaccctcaaataatctcatttgccgtgagacagacggacggtgagtttactaccattggccagtgtctgcagacatcaaggttagtgaggtcattmagaagggaccagcatagctctggtgtctctagactccgcagccatggctgatttctctacatccatcagcctctccctgttgtctccataagtrgctattacaaaaggtttgtggctggcttagaaccaagaattttggctgagcaatccatagatcccacagacagtaggatggagaaagggctacctggagtgatgttctggccacctttagggagcctgggctgggaaatggtggcctggcaagggcttcagggcttgtggtcaatggcagccaggacacctgggatctgctggactcaagggcctcagtcatcactttaagactggggagacgtcacctagagcagagagaccctgtgacactcagcccaggtaagtttcctgcaggtggactcagttgtctggaataagttcagaagaacagaagaggtcctgctggtggcggacaatcaggcaggctttggctcagtctgaggagcaattttcttcccatcagagctgacgagtaccgccaagtcccatctgtgaaggtagtgagctctccatctcaaggcaaaaaaacaagctggatggtggcaccctggaacatggtagatgggacttgagggcctgctgggggtgggagtctgtgaccctgaaggagtcttctcaccctgactcttcattaggacaacgtggcctagaaggaaggaccattcagcagggtcaggagcctcagctgggccggccaggctggcaggggtggagatggccccctcgcttcccaccagggactctgagtttgagacttgaggtctagcaccacttccagagccctcagaactgggacccactctaggcatggggagccaaggcacagtctgayctacccccaaatccaaggaccagtaccctcttggtctctccctacttccttgtttagaagccagtctcagaaacagagctcatcctcaacccattccaagaagtagaggatgaaacaggatttaaatttctgggaatttttatatcttacctaaaaacccttgaggcttgaatggggacattccaagcatkcagaaggccactgtgtcacttggatagtaggcccgtgagrtcacctggaactgygttttcctctctgccctacagacctgtctcctcctcttcctaggcacatggacacagccctttgacctggcaagcaccagggaggagaacttctatgtggacgagacaactgtggtgaaggtgcccatgatgttgcagtcgagcaccatcagttaccttcatgackcrgagctcccctgccagctggtgcagatgaactacgtgggcaatgggactgtcttcttcatccttccggacaaggggaagatgaacacagtcatcgctgcactgagccgggacacgattaacaggtggtccgcaggcctgaccagcaggtaagtcctccagccatcatgttgatttctgcaatgcacgtgtccccagaaagtggggcacgtggaaagggagtatgctggggcatccttccttccctggactcaccctccagggctcagttttcctgtctgctgggcccccaaaggctgtaagtttccctaatctagagctcacgcttatttattgatctgtccatcaacactgaaatactttggggcatttcacagagtgaggttccctttccctgtgaggttcatacataccctctgcattgtcatatttttgtagcattttcttaaagtaagttcaccaaccacccagctacacacttatctgttttgttatcttgcttacctgaaaccacgccctgctaaagattcttggaagaccccatagaaatataatgaaaatgataatgaaatgtatacatcatggagccaatgcaaaatctatgaatggttcttaagttactcagggcatctaactcttcaatcaatcaatcatcagtaaacaactaagaaagcaaggctaaagtaggtaataagcgagtaagtagaaagaaagcaagggctgcatatcctgaagaggcagtagccaggaggagaagcggccaatggattccctctatctctgacctcaggcccaagcaaggggctggtgcagggttgacactcaggcaaggtcagctgaggatgtgagtcagcaatgaatgaatgaatgcctgaatgaatggatgggtgagtgaatggatggaagaatgaatgagtgagtgaattaatggatgaataagtgagtgagtgcatagaatggtgagtgagtgcatagaatggtgagtgagtgaatggatgggtgagtgagtgaatggagaatgagtaaatgaatggatgaatgaataagtaaatggatgcatgagtgagcggatggatgggtggatggttggatggatggacagatgcacaaacaaatgagattttccccctaagcacccctgagctagacagtaattgaaattattgtcatgcaagtgcgcagccctgctcctcaccttaaaggaggaaggaggtgttcttagaacatggtcctcactctcagggagattcaagttccatctgtgcagaagggtcagaaaatgccaaccagcatgaaacctggtggcaggggggctgatgcagactcagaagcaggggggatgctgaggagagagtgggaatgtagatctggagtagctcaggaaggctggtggatcaggcagcatttcattcactcactcactcattcattcattcaatgtgcatttcattcgctcattcattcaatgcacataaacggaagcacttgctatgtaccatgccctagctaagcacaggggatggagtggtgaataggacaaaacagagcccttaaagacatgcactctagagcagaaaacagattctggtggaattaatagtggtacgacaatgtgagttctgagagagacagacagagatatgtaacatgccactggttgggaggtgggaatgcctgactctgcccgggaatggggaagggctgcagagcaggttgttttcccttgaaactgctttgagtgtgaatggaagttcagccagggggaagtggcctccagacccgacatgaagtcaggggaccatgcccagagtgccaacaatgcagggccagcagtaatgaagacaaatttggcttggacaaatgttgtggtctaaaaattttgcagtagataatctaggaggaagctcctctactttattaayakgtaggttttgtggtttatggtttcagattgttttcattttgaatgataccttcagagatctatttgatgctgggtgcttctagagaagttcatccagttctgtgartgcacatggaagtgtctgggaatttgacttctctcctgtagggaagtcatgtagtcagccctgtgtttctgagcaatcccctatagctatgtggaggacacagttcttaaaccatccataactacgcttgagtgtgtacacatatatatgcgtgggtgtgaacctgtgtctgggmgatgctagggatccatttgccatctcttcctcctttctacccaccaaagaaaacctgtaatttaggtgtaayaccacaagggggtgataacgcaccatgatgcaaacaatgcattccagctcatactccactgaaaatgacgggaaggactatctatctttctttacaccaaaaataatcttttcatgaaaatacttcaatgtgagcaacattaatcaataatacatamcttaaagccccatcaccttgctctcagagagctgtcaacaacgcagcaggcggcagatggcaaaactagtcctggccttttcagttctgttgcctcccagttgtgtgactttgggggaattcctcaacctctcttaagtgttggtctctcaacytggaaattaaagatgttgattccgacttcataggtgcgtatgtgtgtgtgtgcacatgcatgtgtgagagagacagagagaggagaaaaaaaaagtaaagaacatagaccaggtgtttgggataaattggtctcccttcctttctttctgttactatttccgcacctggagaaggtacacaccractcgcctctggttcttctccctctcctttagaaaaggrcggcttccacttcacgcaggatggttgccagcctccgggmctcactcagggctgcttttgctcagtgaggagagggtctcgtgccttccctcccatctgccaagagagccggtgcgagttcactgacacccctcagtttcagtgttttagacatctgctctccctctgrggagaaggcacaagaagaatttaaaaataacactaaggccttgacatgttaaaaagcgtagatgcccgtgctgcccctagtgtgaccccacttacctttctagaaaccccacctgcttcayctggtagaaactgccagctgaatcagattcttgcagaatcacagagatttcgcacccacctgccctgggagagcctgtgttcaaccacctttgtgtgcaggtgaggacattagcacagagaggggctggacttggcaaaggccacacagcattagtggcacagctggagccagggaccactgctcccagctgggcactccctccagtcctctgcttctagcaggggttctcctgggactaaaaaggcttcattatggactattgtcttaaatgctccatggtccagctgcatcccaggtggaatcagctcgaaggaattgcagagaagaaaagaatgtgcaattcagaggccccgtgggaaagctgcctgtgtcatggaggcagagacagatcctgcctcctgctctgtcccttctcctacccacaaagagcaagtcaggctggagggcaggagctggagggagcgcatgaggaaataagagtctggccaggagaagaggtgctgctctcccctctgccaggcccagccctggaatgtctaactctgtctgcttaccccgagcagccaggtggacctgtacattccaaaggtcaccatctctggagtctatgacctyggagatgtgctggaggaaatgggcattgcagacttgttcaccaaccaggcaaatttctcacgcatcacccaggaygcccagctgaagtcatcaaaggtaaatgtcatgggaacccaccttktcttccccctccaaaattcacaatataaatataatactaggaagtggcactgagttcgttcatgaatgagcctctaggtccctggctgagaaccccaggttgagtcaaagccccttgtctcaccatgaggtaaatggaggctcagcaagaaaacatgacatccccaagatcacacaggaagctgtcgacacaggagggccacaggccaggcacctacccatcccaycagaccacacagaggggaactgtgaaaaccaagttgtcatggcagagctgtgagtggcccctggcaaaaagaaacaggaaaagtggtaaatgtctaattgggatcatattgagccttctacccaattacatccattcaattacataaatccttcagctttatgttctgttattcatgcattcagaaaatgtttactgaacacctactatatatcccaaactgtgtaggccctgtgtatgcccccgttactcagatgtgtggcccctgacctcaagacacaggactttgtggcctccgtggtacctggcacgtaatatgtgctcagtaaaatgcgtgctgtgtgagtggattgagtcaacacagctgccttctcagaaggcaggtattatcccaatttctcagatgaggaatctcctgctcagggagggtatgcagcttccccacagtcacagagctagtaaataacagtttgatgttmgatctcaggcctgttgactcaaaacctcatctgctcaagacacactgcaggggttccaatcccagctcagcttcttcctagccatgggtgccactcacagagccaccagagcctgagtgtgcttgctggaaagagtcrctggaagttcccaccccttagggtgttgtgagctcaccaatatcacctgttacttatttagccaggttatgagttaccagagtcttttgatacaagctaggcagacgttttgctgacttcagaactcctcctaattttgatcacaacaaggacatatcaacagtcaaagatttacatttttagattctgcctcagctttcccaaacagaacagacataggcactttgcataacttgaaccctagcatttacccagcagagtggaaagggagcaagatctccctccgctaccccaggatggtaagaagcgcccaacatggacagtgaagcccagttcaagccatgagacttctaatctccatgtgatgggcccaatctgccctttgaataggaagtgtaggtgcggcccaggttctggaggtggacagacttgggctgtgtaatcctggggctgccacttggataagaatccagcaagtgaccttctctgaccctggatttaccttcctaaaaccaaggatgtgaagggtcccagcaatgagtcaggaaagygagaacgcacagcaggtctcactacccatcttcattctgtacctaacaggtggtccataaagctgtgctgcaactcaatgaggagggtgtggacacagctggctccactggggtcaccctaaacctgacgtccaagcctatcatcttgcgtttcaaccagcccttcatcatcatgatcttcgaccacttcacctggagcagccttttcctrgcgagggttatgaacccagtgtaagagaccacccacccagagcctcagcactgtctgactttgggaaccagggatcccacagaaatgttttggagagcgggaggtttcccccaatctcctccaagttcttctcccyccaaccagagttgtgtctaactttaggcatcttttaataaatgtcattgcgactctgatgaccggtgtggttaaagagaagggcaggggcgttctggaggttactgtgttaaagtggtgtttgcaaatccccaggcctggcatcttcatccatgtgggctgccataacaaagcaccacaggctcatgaacaacagaaatgcatttttcacagttctggaggctggaagtctgagatcagaagccagccttgttgggttttggggaaggtcgcttcctggttcaggggtggcatcttctggctgtgtcctcacaaggcagaaagagcagagaaagctctctggggcctcttttataagggtcctaatcgcattcatgagagttttacccatgacctaatcacctcccagaagctctaactctaacaccatcaactttgggatttggttttaatgtatcaatctggggagacacaaacattcaggtcataacacctggtactgccacaggaggagcaactcctctggccaacaaaccctcccctcttccctaataaaagacaaacttcagctgaactaaatctaaagtataaatgaggaatgaatgattcgcaaatcggacagcctcctcagctgtgagactccagtgcagccacgtggtggaagaagatttacagacagaaaaaggaaagtgatgtacagaaaacagaagagaggaacagaaacagccggattggtyataggttgatgtttgtcttatttggctacttttgatcagccaaaactcggtgactggcacaagtgtaggctatggtctgttcgtccctccacttgttatagttcatgatgtactgagaaatctttaggccaaatttaaaatatgtaaggaggccgcattaggctaaacttgatttaacagccctgacaactgcagacgaatgtggcatctttaatttgtcatgggtcttaggggtcagggcggtgcagggaggtatgtgggaaagggacagaatcccagccaggtccatgagagctaagatactgaaggtcttttaaggtttctagtctttaaagtttcctggggcggggggggcggggcaggggttggacatttctgggcccccaccagagcagctgacgctggaagcctgttgtgggtgaacagtggagtcttactctagaaagataggaggagactcagcagatgtgtgtgatatggtttggctctgtgtccccacccaaatttcatctcaaattataatcctcatatgtggagggagaagcctgtaatccccatgtgtccagggagggaggtgattggatcatgggggtagtttcccccatgctgttctcatgatagtgagttctcatgagatctgatggttttataattgtttgacatttcctcctgtacacactgtccctctcatctgctgccagtaaaatgtgtctgcttccccttccgccatgattgtaagtttcctgaggcctccccagccatgtggaaccattagtcaattaaacctcctttgtttataaattacttggtcttaggtagtatcttcatggcagtgtgaaaagagagtaacacagaatcagttccaacattcattggttttcctttcttattgcaaaagcaacatgcactgaagcaaaaccccaggtagaggctggggttgggccatcttatggcagttgccctaacactgcgctaatatgatactaccccctacagcgccaggaacactgtttctgtttggtgaatgattgaattcgtcttattcattttttcttttttttttagctttttcttttcttttttttaattatacttcaagttctagggtacatgtgcacaacatgcaggtttgttacatatgtatacatgtgccatgttggtgtgctgcacccattaactcgtcatttacattaggtatatctcctaatgctttccctccccccaccccacaacaggccccagtgtgtgatgttcctcttcctgtgtccaagtgttctcattgttcaattcccacctatgagtgagaacatgcggtgtttgtttttttgttcttgtgatagtttgctgagaatgatggtttccagcttcatccatgtccctacaaaggacacgaactcatccttttttatggctgcatagtattccatggtatatatgtgccacattttcttaatccagtctatcattgatggacatttgggttggttccaagtctttgctattgtgaatagtgccgcaataaacatagtgtgcatgtgcctttatagcagcatgatttacagtcctttgggtatatacccagtaatgggatggctgggtcaaatggtattgctagttctagatccttgaggaatcgccacactgtcttccacaatggttgaactagtttacagtcccaccaacagtgtacaagtgttcctatttctccacatcttctccagcacctgttgtttcctgactttttaatgattgccattctaactggtgtgagatggtatctcattgtggttttgatttgcatttctctgatggccagtgatgatgagcattttttcatgtgtctgttggctgcataaatgtcttcttttgagaagtgtctgttcatatctttcgcccactttttgatggggttgtttgtttttttcttgtaaatttgtttgagttctttgtagattctggatattagccctttgtcagatgagtagattgcaaaaattttcccccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctcggttttcttctagggtttgtatggttttagttctaacatttaagtctttaatccatcttgaattaatttttgtataaggtgtaaggaagggatccagtttcagctttctatatatggctagccagttttcccagcaccatttattaaatagggaatcctttccccatttcttgtttttgtcaggtttgtcaaagatcagatggttgtagatgcgtcttactcatttttttgtttttgtttctgtttttgtttttttagtatgctttttacatcattgacttttataagctaaccaatacagttttaaaattttcatttttaaacgaaaagtggcatttcaggccaggcacagtggttcacacctgtaatcccagcactttgggaggccaaggcaggtggatcagttgacgtccggagtttgagaccaacctagccaacatggtgaaaccccgtctctactaaaaatacaaaaaattagccacgcatgatggcacacgcctgtagccccagctactcagcaggctgaygcatgaaaattgcttgagcccaggagcagagcttgaaatgagctgagatcacgccactgcactccagcctgggcaccagaatgagacttctcttaaaaaaaaaaaaaacgcatctcaaataaatggggcaaacaaactgtgttaaaacatttatttaaaatgtttggggacaatcgggtagccagctgaaagacagtgtaaattagaatcactgtcatccttacaccaggatcaattcctgatagatcaaagatttatataaaaaattgaaatcctaaaataaaaagtatataatgaatgttttaaaaataatctcataatgagaaagacttatctaagaatgctataaatccagaaatgactaaagaaaagatagatacattcaaccacacaaacatttttaaaagtataatcaaatttaaaaggcaaataacaaagtgccaaaaatcttgccattcatatccttaaatagctaatttattctataagtcataaaattctggttgactgtaggataatggtagctgcatgaatatttcttacacatcaccccaacaagctataaaatcagcagtagtgcacataaaactacacatgacctaagccctcaccattacatcaccacatgaaattggagccccagaagggggcagtttaggggacaggaaaatattttaagaaataatggttaaattattttctaaacatgatgaaaactataaattcacagttccaagaaattcaacaagcccaaagcaggagaaagaacaccagccaaggtgctcttttaataatcaataattaaaaatcaattttaataatcaaattccttaaaactaaagataaagagaaaatcttaaaagcagctagaaaaaaggatatattacatacagggcacaaagatcaaaataaggattgatttctcatcagaaattatgccagccagctgaaatgatacacaaagaaaggcatattacctctgccatatttgtgcccaacgcgtacaacctaaagttgacatgtaaaatatcagaaaattccaaattgaaagacgttctacaaaatatctagccagtattcttcaaaaggtcataggtcaagaaagacaaaacctgagaagctgtgccatactcaaggagaatgaagaaatgtgacaacccaatgcaacattgggttcctggattggaccctgtacaagaaaaaaggatattggtaggacaactgaaaaaaagcttgaataatgacaatatacagaatcactgcaatttcctggttttgaccattatactatgtgatatggtttggttctgtgtccccacccaaatctcatcttaaattgtactcccataattcccacatgttgtgggaggaacctggtgagagataatttgaatcacaggggcagtttcctccatactgttcccatgatagtgaataagtctcacaagatctgacggatttatcaggggtttccgcttttgcattttcctcattttctcttgccaccactatgtaagaagtgtctttcacctcccaccatgattctgaggcctccccagtcatgtggaactgtaagtccaattaaaagccaattaaaccactttttcttcccagtctcaggtttgtctttatcagcagcgtgaaaacagactaatgcagtaaattggtaccagtagagtggtgcactgcctaaaagatacccaaaaatgtggaagcgactttggaactgggtaacaggcaaagtttcaacagtttggagggttcaggagaagataggaaaatgtgggaaagtttggaacttcctagagacttgttgaatggctttgaccaaaagcttgatagcgatatggacaataaggtccaggctgaggtggtctcatatcgagatgaggaacttgttgggaactggagcaaaggtgactcttgttatgttttagcaaagagattggtggcacttttcccctgccctagagatttctggaactttgaacttgagagagatgatttagggtacctggcagaagaaatttctaagcagcaaagcactcaagatatgacttgggtgctgtcaaagcattcagttttataagggaagcagagcaaaaaagtttggaaaatttgcagcctgacaatgtggtagaaaagaaaaacccattttccgaggagaaatttaagctggctgcagaaatttgcgtaagtaatgaggagcagaatgttaatccccaagacaatggggaaaatgtctccagggcatgtcagaggtctgcatggcagcccctcccatcataggcccagaggtctaggagaaaatggttttgtaggctgggctcatggtccccgtactgtgtgcagcctagggacgtggtgccccgtgtcctagccattccagccatggctgaaagaagccaacgtcgagtcaggccgtggcttcagagcgtgcaagccccaagccttggcagttgccacgtggtagagcctgcgagtgcacagaagtcaagaattagggtttgggaacctccgcctcaatttcagaacatgtacagaaatgattggatgcccaggcagaagtttgctacaggggcggggtgctcatggagaacctctgctagggcaatgcagaaggaaaat

SEQ ID NO: 12321 - DNA, 142768 bp, Homo sapiens
agatttgaagctcacaaaagtgcagcaggtcattccagtagaatgtgggcttcacatgttcccaagaattacagaaacccccgcaaagcccttctcgccggagctttcaaccatcacaaacagcttcctcgtgtgcttccttaagaagtagaggtgggcaggttcactgacagactgaaacggctagggctagggagtgtttctcaaagcatgttcttggaacccctgatctgagtcaccagggactggtggccaaggagcttgctaagctgcaccaggacccctgagggctgggcaggtgccacaccctacaagcctgctgggcacaycgatatctcaggaccctcggcccacccaggccccaagactccacaattcttacacagaacgtaaagcactacgcagccaacctatgcagggcaaccaacaaggctaagccccagcccgcagttcacgggtgtccccagaaatgccccccattaaggcaggaaatggaagaatgcgccgttgaaatcgtctctaaaggggcggacgaaagagggtgctgctggcagttgcggttaagcagcaaagcggcttcgtctacgcccgccagccccggagccaccctgtgccctcaccttccttttcctcctttcacggtcaaatctctccagagccattggcggcaaagtccaaaggtcaccagggtgggactctggcttggggtcctggctcctgcgcctagtagcttggaggccttagggaagccactttgactttcagtgtttctgcctcagtcagatgggtataagttggttggcgagtgcttggaagctggtggtgctgaatctggggtcctgcgccccctcgctgctcctgggagcccagctctgcttcccctctcaacagaggctgcctccttggcagcagctggcccacyggatgcagcagatacctgcctcatcctctattttcctctcctccccgggctctggaagaatccagggttccctactgtctgtcttgaccttcatcttccctctcaaacccgtacccttggcgacccttggcactacccccaggtgacactgtcagggctgtgaccagtaggtaggtggcagtcacctccaggtcccacctctcctgtgaaccccagccctaccttctcaatgtcagtgggcactgctgtccaagacacagacctcgaaacccaaggtcaaccgagcccagtcctccccatccagaggccccgattctggctctgcctctttcagtctgtgcagcccaggtggacccagccagaaaagcttggggggctccagggctctcctcttccctccctccccatcactgtccagcccatggtggccttggccctgatgccctcccctagttatcctattcacccatattcatgccctagcctgtgaccgcactgggcctctggccatcatccagcctgcctggtcctccctctgtgaccttgcccatgcagagcccttttccagaccatcctttcctagctctgcctatcacaacctgcctgtctttcaaggtccaggtcaaatgtccccactgcccccgtctctccttccctatcagcagggttttctctgaccattccaggcatgtggtcactgcatccctttcctgggtctcagccctagaggagggaggtgggtcttgctcattcttggtccttcaaatgtctgctgctaagaccttcgcccttcactggcatgtataggttttaagcaatgttttaaatttaaatttgttttataatgaatagatcgagctgaatctccttgcccatgcattctagttattccttaccctcctgcatctgggaggggtggcaagaatatcactttcagagagcccctgccacggctgagtgtttgggatcacagggctccgaggcagaattctagagtcttctgtcctaggctgcattgagagcctgtggataccagggcctgagattgcaatgaaagatcatgaagctgcccgggggtggaaaatgaaaacacattcatggtgaaggagggggagcatgctcagagcatggctctgcaacccactcggtgcccaggggctgctggaatcagacagacaggtgggcaggtgtgcagtgggggtctggcaggcttgcaggccctccacgaggcccaaggtcagggagaatagggcaaggagtgtccctccctcagagggaggctattccctgcagaccagggcaacgggctctcccctcctgccctctcttccccttccttccctccatccttctccactgtgaaatcactcagcagggctctccagctgagagactgccaagaggtcccaggaaaccacgcagaaggaaagccaggttcctctgctccggttttcctgggggctccgttgggctgcccaggaaccacctgagctccaggcaggatggtggctggggcgcctcgtccgactggaagagggggaactgacagttatccagcacccactgtgtgccagggaagccccaggctcctaccattgaggcaccagttcacccattcagatagagggagacacgaatgatccgtgtggcttagcaggccagagagccagagactcagagagctaagtctctggcagggaaacagcccaggctggtgactcaggacccctgcggaccagacctcaggggtctacaggacccaggaagttgctccagaaaactggcccacgtggaatgggttgaatctggtgcggggtctgagaagaaacctgtgcccagctcccagccatggagttggatgatagatctcggctgctcggcagtcagggctcaagatcacagccaggaaagccttctcactgggtccaggtaaaggcggacggccaggaaggtggtccccaccatttctccacttttccccttttcccaatcctgttttgtctacaaccagcatggcgtcaaagcagttagctctgtgggtacctgtgtgctggagaagtggaggaggctgcctgcaaggagacaggtgccggggaagccggcagggtgggcatggggttgctctgtcactgaagacacgcagaacctgggtctctggggctaaccatgtggtcactgcgcagagcagggagtagcctcctgagacgctggccagcaggggtctgagtggaaacctgggtgtggcagtggcagggcaccctcaggcagggaggggcctgagcccagggctcatcccatggtgggtgtgcaggaagagggaggctggccttcatctgagttccccaggatgtggcagaggacaagagggcccagcatctgctcaggcccatgagacagggagtctcacgcatctsccaagcccaggcaggcaggaaagcctcgagccagtgggcagtgacaggacgaagcccaggtgtgccaccccatctcccccagtgtgctctctcctggggaagagggtcctgttccctttgcctcctcgggactggctgagcggagatggtgtatcccttaatagactcacccgaagatagaccaggaggggcctgaacatggcgggtcacccgtcaccaaggaaagagcagtgtggggcttcccacgccacgacaaaggagtgcttccatatcccccagggtctgggcctgggcctccagggcctcttgggagactcactcctgcagaggtgaggatttcaggcattcgatggagctcaggtgatggcggagggggcacctctcacagagttctggcagggcaggaacagaatcaaggtttcctcactagctgggaggccaggatcagtttcactgctgctctgtgcctcagtttccctatccagcctccctcacagggttgtttacaagtgccggaggcgaactgaggtcatgagtgtagttccagtgtggggagggtccctcctttccttcatcccaccacggacctggtgccctcactcttctctaactatggggccatctctttgaaggccacgaacaacagtacccttgcaccagggcctgcatgccaggcaggactgagtcgctgagaaatctccatggtagtggcacctcccagtcccaaaagcccctccagtgacctggacacacccaagggcactggctgcgcccatgaatgtcagcaatgcctccaagtggccttctgaagggacagccggtcatgtcctcggggtgctggcttcccccagctcggacagccaaggcatgaactgggctcaaataagtaggaagtagggggtccaacccagctccgtcactgcctctgttgaccctggagaagcctgtccttccgtttagtcctctgagagcaaggatgaccggctgctgggtgccaagacccaagtcctcctggtggtgggagggggactggcgggaacatggggtctatggccctagacacctctggcatcaatccttctcgaattgccgccccgagctgcccactgtcctgcctccttattcagggacgccaggaaaacattcactctgggacctctggcggcgtgaatatcactgagaacttagccgaggaccagacacataccgcacctggccagagtccctggaaacagaagcacggtcccctggttctcgcgagggagcaggctctccttccacacagatgatgtgttcccagttaccacggcagagcaccaacacacaggaaggtctaggggaggcccctccctccaagcccaggccggaaactgccaaatcaaaactgtgtggcactcgcttcctcctgaaccatttgggtcttagaagatgactgaaaaatgaaagcgaggaagccttctctagctggccagcccatggcaccctcggcctttccagctctctagcgccatggcccacgtcccacctcccgggtgcaatggcttctgtgcacactgcttcccatccaggctccaaatccagacccaagacggttctcaaccaagaaacacacgaaaagggtttcacactttttcacgacaccccccaactccagtgcctggctcagcccccaggtgttgactagcacctmcaaagcatttgctgactggcgcagggaaaaaaaaaatggccctgggtgtcaacagggaagcccctaccatgctgctctcgagggatgtgctgcggcccgaacactgtcagtgccactgaggccgagtgtggccgtggagacaatgacaggacctggaggaccaagtgcactcttagggccccacactgcgagagcacagggccaggagctgcacagggctctgcagcagacacggccgccaggcgagaatcaggtgggcagatgtgactctccacacgtaggtccccaaaccctgcaacctgcaacgcggggcctgaatgcggcttccttagcagagcaggagcttactcttggcactgggggaaaggggaggggtgaggctggggtttttgtcggggaggagaagttgcagagaaagaaaaaatcctgaaacgacagacagtgggacagctgtggcctgaacttggtgttcttgctcctcggatgtggatgtattaatttccataaatgctaatagcccacttccccaagagctattacttatgtcatctccccttggacacagttcarcacagggcagacaaatgaaagggaggaaaagacaacccccagtggcggtccccagctcctcagccccctcccaaccaggcagctcaggtctggttcctaaggtggccctgctaaccgcagggtcaagacccctgccttcagctccgtagccaggtccctatcacgacaggaagcaagaaagttaccaaccccaaaaatgctgaatcacaaagtgaggctgagcaggaaagtgggggtggggagggaaggagacggtggccagggaggaaaggtgctaaggggctttccacctggagcaccccgggatgctgcgggcaaagcacagtccctgtaagagcccccaggacaaatgccaggaggagggacaccaggatgcggctggttggcggggtgggaaggtgggcaggtaccccggctgctgctamtgccgcaggacgcggtgcagcagtggggtctttgcatcctgggagcagcagcaggtagggaggtgcggaagtgctttgygccaaggcctggcaggagggagaagcttaagataggagtaggggctcagggtcagaagtggcggtgtgtgtgctgtaaacagcccgaggaactggtgcaggaagcagggtcacagtcttggggagcagggtaaggtggtgagagcgtgcccgcggggagaggtcggaggggctgggggcagaatgggagggtggggaaagggaccggagcgacacagggacaggcagcgagaacgacggatgagccttgagaagcgatcaggaggagagatggggaggaccgggaacagcagcgccccggtggggctgcgcagaggccgggagaggggatgagaggaggatggaggaaaggggagggcgaggctgctaggaccggagcgggcagagatggggaagaggtgcaccgggaagagggacggcggcaggggcaggggtcagggatgcgagctgaagggtcgggcgggcgggaggacagggaaggaaagacagaaagggatgggggaagggagacgatggagaaggaggtgaggaggctggagaggaggtgagacagcggcggaggcagggacgcagggccggggaagaagagatggagacgggaccgcggcgcctgccgcagcgcgggcctcgcggatacccgccgccgccgtcccggagcagcttggtggaaagcgcgccccgccggggtctccccggtactcacctgggggctccagctccggatcctgtgccccgcgccggatcttccttcccgccctgcccctgcgactttagcgcccccgaatcccgctagctcctgcaggttccgccagcagcatcttcacctcgtgggacgcccggggccacgcctcttccagcttctgattggctattgttcacgccagtcacattaccattggttgaggggtcgtcggacatgcaaatcaggatgggcccgccgccgcaccgattggctggcgctcgcaaagcgyagccctcgacttgggctctgattggctccgcggccctgacggcgacagtgacgcgaggcgggttcttggactgagtgtgcggcgcggtgcgccgccttccgaggctcctcccgcgggtggcagcggacggggcgcgcccctcggccagtcctcggtcctcaggcttgtggctccgttgagcaccggccgccgggcctctgggtccgtcgagtggagactctctgaaaagcgtgggctccgtggcctccggcgcggccgcggcgggtcggtctcctaggtaacgcggcccgcggcgggcggaaccatgtgggccggcgccgcgggggaggttggacgcggcctcgaggcacagggggcctcagtgttggccagagcctcggggttcgggggtagggtggtccacgccgtccctgcgtgggggcccggtgcctggggtgcggcggtggcgcgcggcgggggctgtccccgcgttagtcgcaggcgtcccccstcgtcgggacacttggggtcggggccgctgggtgccgtttggctacgtgggttcctttctgcccttgccctttgccccctgccccctgccccctgccccctgccccctggcctctctgcagcccctcggctgaagggagcgcggtaccgatgttctgggccttggctscccgcgccctagtccgcgcgcatccttcccaggccggagtccgcggaccccgcctggccgcgcccctccgcccctcctccccgccccccggctccagctccggctccggctgtcagttccccgcggtggctctgcggccttcgggcgtccctgcgaggctttgtacccggcgccgtcccggccttctgcgcccctttcctgccttggaacctcccggccgacccggcccggaaggcgccacccgctcccgcgtgcccttccccacgcgtgcaggctgctcccgcccgcccccgggcttgcaggcacctcgctgcccgagattcctcgtgtctaacttcttaggagaccgctgctttctgcctccgtgtgtcgcgatgtgtggctttggtggacgtctgtgaaggaaatccagcctctcgcgtgtgtagttggcaaaaggaggagtatttctgttgatggtgggcagcgcctcccggtcctaacccagggctccgttcgttgcacctcctctgtgcagtttccgtaggtcacacttgtgtctttttgtatgctaatttgtgccccgtttctttacattctatgggggtagcgagcttgtctgctgtgttcaagaccgtttctcccgggcgcagggtaggtgctgaaagaatgctcatsaatgagggaattccaggcagtgcttaatcagacctctgcttccccaaaagctccccaaggcatctgggtctcaggcattacacattttccattccgggaaggaggcttcccggaccctgacagcgcctcccaccccctgcatcttccttcagccctgctcacctctgcaccctcccgggggcctgttgctgctcacagtcactttcttgtctttctcccccactggctttctagatgcttgaagacagcacatttgacagccttcttatgcactggaacacaagtgctcgggaaatagttgctgaatagatcagcagaagcagagatctcaaggagatttcacagctctcattttggaggttggaaacaggtggggaggctgcgaatctgtcctgaagttaaagaggagacagcattagccctgggttcctttggtgctcttactttttccctctgggcctctcttctcccttggcctctcctggcctccttgattgaggtagtgggaggtagttataatagcttacagtattatatctataatactattataatagctagttataatagctagctgtgtgaccttggattggctgtttatcctttctgagtctcagtgttctcatctgtaagatggcgataatgatgattctcatttggcagagttgttggaatagtaaccatagawtgtgagttcctgtcttgcatcaggggctcattaaaagygggtgtattttcttcttcttctttttttttttcccctggagagcccactgtacccttttyttgggttcaagacctggagccttctcgattttctcttttattgttgatttggccccaaaggcccctctgcacttcctccagggcatttgtatttcatccttaaaagacttttgctgaagacccagcctggtgtcatggagctcacagtctcgcaggactacagcacagccctggtgaagcgtggtggctcttctgtcacctgccctgtgtgggagcagccggaggtgggggatggggctctcgctctgaggagggagcatttggtttgactcctagaggccagagcagaggtggaaaggagcaaggagcaggtggaagggcacccggagaggtttgtgaggtgctgrgatggcagtgagagctgctgcgggcgcttgggctcccacctgcagagtctcaggtgtcacctcggcctccgtggcccctcagactaggactgccctgcctccacatcccgagcctcaggacttccgtgtgggtggcaggtgctttcggaatggatgcccttcygcctagtgtctgccctcctagtacagcagggggccggcatgcttcatgctccctgtgagggtcgactggcgtatgcacgtccttcagcagtgtccttgggccaagtgtggcactgagtcctgcagacacccagggagagggcaggaggcaccgggtcagaaatctgggrcaggtgaggagcatgggcatctgcgtcaggagagacttcctctctgaaatccccacctggggccatcacggcctgcattgtgtgtgaatacatttctgaatgttataaaacatcagtgggaaagaaaagcttgagggtagctttgctaaagcttctgtttggttccgtgaccatttactgagttgtgacggtaccaagaacacaggaggaatgaggcttctttcttcaagaacttggccagcgagcaattcaacacaagataggtgacgaatgatgtgaccaagggaagcacaggggccatgtgagcctggggcctggaccctgggagcacctgggaagccctcctgggggagatggcccttgagctggtattggtcaggtgtcttctgcttataagtcgtggacagctgtatgatttcctgtggctcctgtaagaaagtcccacagacttggttgcttaaaagtagcacaaatttgttcttttccagttaggccggtcagaagtccaaagtcggctctccctgtggtggctcctggggctctgggctggcatggtgtgggcagttgtgggcattggaggagagacatcctgggctcaagtctcccggggaagactgatggctcagtgtgggccatgtgttcctccttgaagcaatcactgcagtctctggctggaatcggggagcagctctccccatacatggaattgggtcagggtcctccacaaaacaagggaagttgarcgacaaaaatagcccacagagaacaaaaaggaacaaaccagcatgtgtgcctgctggattcacacaggaccagactgagtctggtcctcaggaatacctggcccacatgcagcatctgcgtgcactgtgggtggaggcgggacgctgggccaaggatgcagcgtctgggtgcactgtgggtggaggcgggaccctgggccaaggatgcagcgtctggrtgcactgtgggtggaggcgggaccctgggccaaggcccctctcaggctgcctggtcatgtcctctcggttcccacacrtgccgggagcatgcagggggtgaaccattagcacaacccttctcaaactttttggtctcagatccctttaccctttaaaagattattgaggaccccaaagaacttttgtttatgtgagttatatctaccaatgtttactgccatagaagttaaaactgagaaatgttaaaaatattaatttatttaaaaataaggctgtgacatgttaacataaaaacattttttacaaaaaccaactatattatccaaaacaaaaaaaaatttagaagagtgggattcttttgcattcttgcaaatatctttacagtctccttaagagaggacagctgaaggctcctgtttgcttctgtactcagtctgttgccttgtgttgccttggttgaagtatgtgaaggaaatccatcccgatctagttagggaggagtctcttgggtcattgtggatattctttgctgctgcattgaaaccctacgagcagaagtttcttaaggatttgttctaaagcagagtctccaccatgtgaatgaactcttcgtgctctgacattaaactcctttggtctgtcttgcactttgggtggatgttttcttcttgcaggattttgtaccattacgcattgttcagaaaatattggttcacggagtcatgcagaccttccaactattgacacatttaatggtgtaaccttagaagatcacgttatatcactgcccctctcatcaggaaagtcttgaagaagtgtgaagctagtaggctcatggtagaggatacaaatgttcttaattctcatttttgcttggaaactccatttttgttgcagttgttttcccggaagtgacatgctaactttgttcacgtttgagaagatgtctgccaagtacccatgtttgtctctcagtcattcttcttagtgaaaatggtgttgaataataaaagcggtgtgttcagcatgcagcccagtcacagccaggcttccccggggatgactgttgcctttcagtttgcagcagaaatgcttgttgtgtattttccatttcgtctcacaaaattaagaacgtgtgtactcaaaggtcaagaagtaataagattaatagtttttccggcttcaccaaggatgttcttacttgaagctgccttgttcttttctgtgagaggttgggaggacctcactcaacccaaccagccttgggttgagtgaggccccagtggctttccctgctgctgcctctgccccaccatgccaccatggtgaaagagataacacctgggtgtcatgaaaatagttttgaccttgtagagcccctgacaggatcctgttgaaccttgggtttggggaatgtacttagagagctgctgtcttagaaggccaaacccacttctttttctccttactcgccattttagtttacggaattcaacctcttcttgaggttcagatctttggattctgtgttggctagagaagatttagatcccggtctggctggacaggatcagataacactcaaaacgggccaagacccaccaagaagctggtaacacctgaaacctgtccccaaatggctttagcaacaagagactttgtycatgtagctgaagtgtcgtggggtgaccaactgaggtctctaataatgacatggggacccagtggccctcactcctaccttttcctctctgcttgtttttatgtgtgtcctaaggtggccccgggcagtttcaggctgaccacctcttggcccaagggctgtattccctctctcatgctccctgggtcccctacaagacagtcttaacgctaggactgtatttcagcagccacccacccctggtgtccttgtgtggtatccaacttacacagctgaataaaacatcccttcatgtccccatccggaaccagccacagaggtcaggagagtcgtgccctgagtctggcccacgggggtaggggtggggcggagggttctctggaggtagattttatttctccattttatttttatttctgaaaaggtaattcgcatagttcaaagttgacaaggatacacaggaaaagtgaatcatcccatgttgaccccaggtacctggtgtatcaccctagatacagtgtgttattgtacagctttcataaattctaagcaaatacaaataaatatatctacgtttatttttcctttttgaaatgcaaatggtacttcctagaggaggcagcatgggtgccagccagcaacaaagtccactcttctggggtttgcagagtgtgggtttgggggatggaggttcctctgggatttagtgggaggcagaagccttcaggattgctgtgaccactstagccctcacagctcttctctttatttgaatacgactggcacagatcatccgggaagcccacgggaccctcaggcgggcaggatgaacgactggcacaggatcttcacccaaaacgtgcttgtccctccccacccacagagagcgcgccagccttggaaggaatccacggcattccagtgtgtcctcaagtggctggacggaccggtaattaggcaggtaacaaaatgtgctgttagcaaatgcgtgttattgctcttagctgacatgaggcttccagttaacagatggatggtccctggcttacgatgctttgatttttgattttgctactttatggtggtacccatatagccattctgtttttcactttcagtgctgttttcaatatattacaggagatacccaacattttatttaaaaataggatttgtgttagatgactttgcccagttgtaggaacatgcaagtgttctgaccatgttgaagctgggccacgctaagctctgatgtacagtaggttaagggtattaaatgcatttgaacttatgacattttcaacttaaacaggatagagtcccatcataggtcaaagagcatctgtattgattttcacttactcgtttgagtcttataccaccatacccattaccttgggccttggcagtattcggatgcaaagtggcccatcagcaaagagaatctatgattcaatgacatggtcagcacttttgactctgggtagggtttctttctgcccacagtggagcaatttaaaaacccaagtactctgatttcctgggttatttgtgagccaggtggccttgtgcatggctcagcatggcccgctttcagcctggcagtgaggactgcaggggctgagctacgggcattctggcagctctgtgcgtggctggatgtaccacggccttgggcacactcaggcccaggccctgatggcggcacatccatctgtgcccttcagctggcggggaacctgctggacaagctggtgcttctgtgctgctgcccacgggacacccacacgattggattgtcctygtgaggcccagtggccggtgggaatgcgtgagaaggatcagtcttgccattgtcaaccctttttacaggatttggcttggcaaggccgttttcctctgcagctgggagagtgatattcacatatattcagttgttggagccccgggtctgtgactaatttactattattaaatcactgatgttctatatcgttcaattccaagcccttggattgagcacctgctgtgtctttgccactgtggtaggtactgtggtggctgctgcttttgtagctttacttctagcacttcactgtgttcattcacttaatcctcagagcagctctatgaggctgccaccaccttactccygttttatagacgagcagcagcacctgctaattaagagtgaagccagctgcccagggcgacggctttagctgggatgccaccctcctggtctggctcagccgccttccagaagctcacaggatagttgatagcccttccctctttcctaggagttttgcaaaggaaattttatttccccatttcattttatttttatttgtgaaaaggtaatgcacgtagttcaaagttgacaaggatgcagaggaaaagtgaatcatcccatggcatccccaggcacctggtgtatcaccctagatacagtgtgttttcgtacaactttcttaaattctaagcaaatacaagtaaatatacctacatttatttttcctttttaaaatgcaaatggtacttcctgtattccgttctgtaccattctttctttttttttgagatgaagtctcactctgtcacccaggctgtagtgcagtggtgtgatctcagctcactgtaaacctcctccccctgagctcaagtgatcctccttcctcagcctcccaagtagctgggaccacagatgtgcgccaccatgcccggctaagtttttgtatttttggtagagtcggggtttcaccatgttggccaggctggtttcaaactcctgagctcaggtgatctgcccgcctctacctcccaaagtgctgggattacaggtgtagccacatgcccggcactgtaccttgcttttcaaaaaaattcaggcagtatgtcttatcgatcattcatgttattacatgaagaaaattttattgttcttaagaccgcaaggtgtttctttatatgaatgagccatcatttattgagtgaggccgtgattgatgaacatttagacttttcccagtcatttgctattataggcactgctacagtgaataacctcatttttttcatgtacagatatgtctgtagaataattcctagaagtggaattcctgatccaaagtcgtatgttaaaagttatttaaaacccaattacatgttgtttacaaaaaagtgcactctaagcataaagaygtaaacaggttgcaggtagaagggtggaaaaatataaaccatgtacatactaagcaaagaaagctttgcatctatactagtatcagaaaaagtagatttcaaggtgaagagtattcccagaaataaaggggcacctcataaagacagtgatcatcaaggaaaygtaacaatctctaaatgtgtatgcacttgtgttaggggcctccaagaccacctcccaggtttgaagagtctctaagaggactcacatgactcagcatgtagtcatactctcagctaaggttgatccagcagaaggatacagagcaagatcagcaaagggaggaggcatatgggggatgtctgagggaagagggtacaagcttccaagagtcctctctcagttgagtcacacaggatgcgtttgattcctccagcaatgaattgtaacaacacacgtgaaatgttgtgtagcatgtccaaaattccagactctcagaagggaaacacgtgtttagcataagccacagtacataaacagtttaggcacagtgagctcctcttaccagttaggtggtaggaactctcttgaaatctaagttcccagactccagcaaaagggcagacttctaagctggtctttcaaagcataacagtaaggtctgttctgataactcttttgtacaaaagagcaaaattggacagaactaaagggaactatattcagattcataatcatggttggagacttttaactcttcttctctcaattattgaaaaaacagatagatcagaacactcatagggatttggaagctctgaagaataccgtcaatcaccttgtcatctcttaacgctactcccaagaaagctagagtacacattcttcccaagtgtaccatcaatcaccctgtcatctcttaaacaccactcccaacaaagctagagaacacgttcttcccaagttcatatggaacagtcaccaagatagaccgtatgctgggccattaaaatgtcccaataagcttcaaaggacccaaattatagagtatgtttatygactactgtgcttttaagttagaaataaataatatgagatctagaaaatcctcaaataggaaattaacatactggatcaaagaagaattaatagggaaattagaaaataatttgaactgagtaatggaagaaaatatacagatttataggatataactaatacagttctttgagggaaatgtatagctttacatgactatattagaaaagaagaaggtataaaatcagtgacgtctgtttcctccttaacaacctaaataaaggaacaaattagatacaaacctaaataaaggaacaaattagatacaaagtaactagaaggaaggaaatggtaaatacagttatgcatggttccttgacagtgccgacacattctgagaaatggtgttaggtgattttgtcattgtgcaaacatcataggatgtacttacgtaaacctagagggtagagcctgcctcacacctaggctccatggtatagcctgttgcttctaggctacaaacctgtatggcacattactgtactgaataccattggcaattgtaacacaacggtatatcaaacatagaaaaaacagtaaaaatataatattacaatcttaaggggccagtcatatatacagtctgttgctgatcgaaatgtcattatgttacacatgactgtatatgagcagaaatcaataaaggacaaataatagagaaaatcagcaaagcyagaagttgattctctgaaaagattgataaaattgatcaagacaaaaaaaaaagaaaacacagactaccagtattaaaatgaaagaagcatcatgataacgtacgctacagaggttaaaaatacaatgttgaattttatcagatactaaaggaagaaataagacraattctagacaaactcagaaaatagaggaggagggaacacttcccagctcattttttgaggccaccataattctgatacccagtcaagggcactacaaaaaaaagtacagacttgtatccctcatgaatattaacacagcagccctgaaaatattaagacagcaaagccagcaatatgtataaaagatggggtattaggatcaagtggggcttactgcaggaatgcaacgttgttttatttacaaagatcaatcaaaatacagtatttaaaagaagataaatagaattcatataaattctataaatagagtttggaaatagatgatggtttggtatagatagtcttataagtttgtataattttagttgttttgagaattgatagctttagataatggccaaagcttgcttccctgtgaaaggtgttggctgaagaatattacatgcttgttttgaattcagggcactttattaatgattttagtatatttcttttactgtcccatttactttttttgtttaattttaccatgatcattgcttatatttctttattttgggatgagtatttcarttcagcttgatatgtattgggcaccacgatatgttaggaaccgtgcagatgacacagagttgactctgccctatactgtgtcttcaggaagctctcagtggattcttatttgartagactggatgtgaagtagcatagaggtggtgggagggtggttaggatctggcattctggaaagaagcccaagccagcgacggttctgggagccacgggatcctgcctgagaatggcctcctgagagtgcaggagaggaggaggaggaggtggcggtgctgggggaacccaggcagtcccgggtgaggaggggcacgtgcagaagctttgcctaggccccagggacagagcagggaacagactatttcaggcttgtgtcctcagagagctcacgttgtagatgggggcagcagacagtcaacatggaaaagccagggggttgctctggggagagatgaggcaggctcagagggcaggtctggatgcgggaggagctgaggaggaagagagactgaggggaagagggaggaggacagggaggtagcgtggtaatgggagctgggggccaggccccggtgcgtggtgatgggagctgggcttggagtcttcagacctgctctgcccaccttccctgtcctcatggataacaccacctccctccacgttgcttcacttgagatgcgagattcagtactgggcctgggagggctgggccgacctaggcagctggcccttcccacttttctcccttcatgaccacgcagccactcctgcaaagcagcagagcccagcggtgcctgcttcctgtcaccctccctgcccctccctgtctcgcctcctcctaattggcccctgcttccactcccgcccccacatggcagctgcgggaattttcttaaatccygaaccagattgtgtcatttctgcttagaatctctccctggcctccctgcatgattggagtgagaacccagcttctcctcgcgccgtgaggcctgcctgaacgctcttgcgcctggcgctcattccttctctcctccctggcccagcctgctgcagtccggtgggctttctgcttagaatgtacctgggactggtttccatttaggggtggtgaggccagcggatcaggagacaactcagctgagaccctgtctgttactcagggctcccaagacgaggggtaggccatgtcccacaggccacctggggaagcgcagggttggtcaggaggcaggagggtggaagggaggcatgggcagagacttgattatggttttgtgggaggactgggccagggagggtgggcagctggacgggcttgcgttggccaaggagagtcatgtcgtggtctctgaggtgcagggatggcccgaggtgtctggtcactgaccctgagagaccakggcagagggtgggactcctggggtgtgtgagccagacagaggtagtggggcatgtggtctctggacgggttggttttcatgtcagacacattctgataggcctgccatttgccaccctaggaattaaccggctctgggggacagtcttatctcgtcactgaggccccagatgccagagcatcagtaatacagaaaattagaaaatacaggccgggcatggtggcttacccctgtaaccccagcactttgggaggccgagacgggcgggtcacttgaggacaggagatcaagaccagcctggcaaaacccactctctacaaaaagtacaaaaattagccgggtgtggtggagtgcacctgtggtcccagctacttgacaggatgaggcaggaggattgcttgagcctgggaggtggaggctgcagtggccagacctccagcctgggtgasagacgagacccttttcttaaaaacaaaaacaaaacacaggtactatagctaaatatagttcctgcacttctcgctggctcctggagcacgtgtgctctcttcctctcaggacctttgagtttgctgctcctcctgcctggctccctctccccaaactccctgtggttcttctcatgccccccttgttctcagctcaaggatcatctcagagagcctgccctgccctgccctgccccgccccacccacctctctccccgttcttcaccatgtaagccctgtaagggcagagattttgtctgttccttgttgtttccctagtgcctggaaatgtgcctggcagagagtcaatgcgcagaatagatgtgtaagtaacgtttgctaagtgaataggtgaaagaaaggtggaggactcttgtctcaggtaagaacctgtcacagaagagaaaaggctaaagcaatacttgctgtaagtggtaaagctccggggcagggtcctgcctgtctacactctggctgccgctctgggcagggtcctgcctgtctacactctggctgctttgttctgtatttgtagccatgatttctcaattctcaaagatctgctttttgctttgccaatgtcaccccaaaatctgggaagttgaggatttagtttctggttatatcaggaagggctcatttggttggaaatgattaacaaacccatccaaaatgatttamgtgagaggcgatttgttgactcacagcaaatccacagccagcataagcttcaggtgtggcttgagcgaggtctcaggtgatgtcccctggacttgttctctctcacctgttggctgctgggagccctgggcctcatcctggcaggcgcatgtgtctcctgtggtcatgtcctcttgtgcgtcctgggctctggctgagtcagaagcctgtgtctgttccaagggactgcagtctttcgttggccaggggagggccaaatgctttggtttataaccccaccaagaccagtagctgtgggagagaggtagcctcccaataaggaaaccagsgtgctgatatctgagcgaggtggccccatatgcacccacatggcctgccagtgacctcctggctcatggtgctcagactcttgagggtcaattccccgttgtctcctagggcgtgctggaggtactgtcagaggttgaatgccatctgcgagtgtctttctttgatgtcacctaccggcacttctttgggaggacgtggaaaaccacagtgaagccgacgaagagaccgccgtccaggatcgtctttaatgaggtgggccctggtgatggtggcaggggctgctccaaggcggagggtgtgtgtgcgggtggtcctgggtggcagcccagagactggggccttgcsgagacctcacagcgcgtctcagacttgtgggtccaggcagcacagagcttagtctagcggcaagcgctttgttaccaaacaaaatcttatgtggaagccagttgtcttaaacagatgagagagctctgctctgctctggttgaagggtcaggggaatgggggtcttgtcaccttcaaggaatcttggagttcttgggaataagttgggaaatgattgacctcatctatggctgctgccactactgctccctctcctcctctcccctcccctctccttccccctcccctccccctccctttccctttcaccgtccccttccttcctttcttccctccctcctgtatagacaaactaagatttagtaaagtgacttgcccaggtagcaggtatcagagcctggactcacacctgtgccttctgtcttgagaccggcaggtggatgggcactggttgagcagcgtgttttcgctcaggtggtcttgyggctggccaccctgcgggccggcgtgctctgtctctgtggttcactgcacagcatgcattccattcagcacctgctctctgcagggcatcatgctaggctcagggtgatgatggcgctcacctaacagaactgcagactgtttcggagaygcactgagcaggtaacagagtaattgcaagttgtgttaaattctcaggaggagaccrataggagaacgtggagaccaataggagaaygtggagacctgctttaggtgggtgacgagggaggcctctctgcgaagctgctgattaagctgggacttacaggatgagaaagaaactgactccgtgacaagcagggacgaggctgcttcaagcagagcagggagacccaggggtgttaggaygagaggagagcccaggtttgctgacgggtggggttggcagggtggccccgtcgtgccttctggctgggtcctacagggtcttcttagggacgctgacgtttgactcttaacagccggcgatgtcatggaggcctttcccatgcctggctgctgcttcacagctgaactcgagtggggggagtttgagagggatggtgtctgagcacgacgggtgtgcagcagggacagtgtggaggcaacagaggtgatgagagggtctcagctgtcttggtttgatcttaggtatatagaaggaggccccaagaggcctggtattgggacagtttgtatgatgagtaacagtggcggtgacagtggccgtcctttgagacgttactctaggtaaccactgcccaggtgtgcctttcccatgggggcctgctctggccagtcagcacccccacctrgggccacgagctcgttgctctccgtaccccaccatcacccagcgcttggattatgtgtgtcttgacatggatgggtcctgactcttgcccttcctcccatgggtagtagagggagagaatgaccccagaggtcacgaagcttcaataaaaagccttgctagagtgtatgtctggacagctaaggatgtgtctgacattaaggttgtcaaacagctaatgcaaatacctctcagaggtctctctggccagccgtgtcaggaaaggtttcatgagtgtgactgcggatgaacccttagagtgctgtttcagcgcgggcagggggtcccctcgggcctgcgctgtggcaggaggctcgccatgagttcccggtgctggcaatgccagaccaactgctggggatagagctgtttagctttagctttctcagatgtgcacagtgagccccccgaaacctggtgttgtgacagccatgcggcgggtggtgaagttagccatccttcaccgggaggcgcttcccgtggccaggcatcggctcagaagcatgccgtcatttcatgcctgtcatcctcctgtggakgtcagtatcctgtgtacccattttaaagaggaggacactgaggtgcatggagatggaataactccaccagcttattcccatgtggcgggtgggggtgggagcgayggccctgtgcatctgacggcwccacctgctgtggcctccgtgacctcctgcttctgaggagccctgcattttgttctgaagtgttctgtagaatgctgagggatggagtatgctctgaaaccagggatgccttgcagtcaccgaggtgctggggccagttccctcctcctccctcaacccctctgacttcagctctccctttagagaggcttcggaccttcctaaggatccgtgctgcgcaggccagaagcgggggcttccatctccctactctctgggctgtagaatcctgatccctgtagaattccagtcacatggtaggacgatctttggaatggatgcctctctctgcccttctcgggattatgttcatgcactccgagggcttccgttgcggcggaagttgggcagcacttgcatttcaccacatcctggcagctgcgtgtcatgctgcctgtgcagttcacaattcagatgtgttagggagactaggagctggtggcttttcggagtctggaatacctgtgctggtggctccaagggcagccgactgtgggagccacgtggctcagccttggcctgtcatctgggtgcgtctcctgttgaggctggggatgggcccgggggactagtggaacatagtccttaaaacctctggaaaaatctgcacccttggacttggaatcgctgaagaagggaatgcagcaaggacagtgtggtgtrgccagggcactttcagctgtgagggtgatgctgaagcccccgtgctattcatggagcctgctgtctgcagctgctatgccccgtgtgggcagcagaggccagtggtgccccaggaatgaatccctcctgccaagctgttgagcagcgtgttctgtaccaggcagtttcctccatgtgcttggcattctcatacagagcaaaggttttgttccagcttagttaactagttatttaactgtgtgtgcaaacatgtgtgcacatccatgtacacatgtatgtgctcccaagtgtggatgaagcaccgagtgctcccaggagtgggcattcttaggcatgagggtgtggcagcatgttcgcaccctgtctgctaattgctctgtctacacccctgtggaaatagaggttcgtaaaacaccctttgccctttttaggggtgattctgagacttggcagagatctttctctggctttactaattgcctgtgtttttctggtctttgcctatcagcattggtttggggggatctgctttggggttggtgagctgccggtagcaggggaccgcatttggagcgcccgtggctgtccagcccccacgtggtagcgcatggaccctgcatgctcaggttttgtggagtgcccatgtcacacatgaccccgagagagggggctgtggcatgattttgcaaacaacgatgtcctgaaagagacttggaacacagaaggcttgtcttgatccagagctgggtggtttttttttttttttctgcaaatgatgaattatttgcactgggcccatatgcaggagagcagtccccagacacgtctcagctctgagctcagaattctgtgttctctgagacctttcctggtggggaggaattgcctccacttcctctgagccagcgaatcattcattcaacttctaaaaaagtgtcttttaaaaaataatgctggaggccacggtcctgtgcagtttctcagttttctttttgaggtggacatacttttcccttggattctttccttaatgactgtgtgtggccggtgtagtgtgactggcttcttttccctcctttatttatttggggggagttactgggcaggaatcctcgtgattctccagcaacagcttaaacccccatcaagggaatctttcctcccagagcgcaccagccccagtgtcgccaaagcagcggggcagtcacctgccctggtagagggatgcaggtgattgggttgtgtctcttcccgtcatcacagccatgagaaagcccctcttgagcggctcttactcgtcagagcaatgagygtgctataatttcccattgaaaagtggatgctgtcaaggagtatcagcataacccacgtgaaactcctgcgagcccttccagggcctggattcttgggcctggctctggagcttgcaggaagccctggctgcagagcccgatggctgctcctgtgctcttgctgttgctcggcagagggcaggcatgtcctgaacatyrtcacaacaaaagcaagaagctggcttcrtgtcccagcgagctgcttccacagagggaggctctatggctctaggaggccaactcgggccctgtgtgcctgtctgtttgcagctggggagggctgatttcctctctggcacaatggaaaccactgccgtagtcttggaacctgaaatgagaggatgaaagaaaatggttttcagaaggagaaatgattggtctctgtgacgtttccagtgtttaattgtacagtgattgaactgtcagtcayctggggacaatggaaagctgtaagtttgtcaattttgttgttgtgtgttcacagcagcatagtgtgggatctttcttttctaagagatggggtctcactatgttgcccaggctggagtgcaatggtgcgatcatagctcattgcagccttggactcctgggctcaagtgatcctccctcctcagcctcccaagtagctgggactacaggcatgcatcaccagacccagctaaatgtttttattttggtagagctggggttagatatttcttgctttgggttataatcatgtctgctcacttacttttctaagtaagccaaggagttgctctttaggccagagggagaactggctttcgccatgggcgtcggagttgaggtaggatgggctagtgtcctrctccatcactgatcccagtgggacttcagacaagtgctttaaactccttgatcctagagggtgagggataaaagactacaaattgaggccgggtgcagtggctcatgcctgtaatcccagcactttgggaggcccaggtggatggatcacttgagatcaggaatttgagaccagcctggccaacatggtgaaaccctgtctctactaaaaatttaaagattagctgggcgtggtggcacacacgcgtaatcccagctacttgggaggctgaggctagagaatcacctgagctcggcgggtggaggttgcagtgagctgagattcacgccactgcactccagcstgggtgatagagcaagactctgtcaaaaaaaagaaaaaccaaacaaaaaaaaaccctacaaattaggttcagtggatactgctcgggtgatgggtgcaccgtaatctcacagatcaccactaaagagcttcctcatgtaaccaaataccacctgttccccaaaaacctatgaaaaaaaagaaagaaagaaattaaattaatttgcaagaaaaaaataarctcctcctgacttgattcatttgctcatgagagataaagagtgtgcatcccctaagtgctgctggagtatttagtcatgtgcttttccataagcagggacccagtgggcagtagtttttattcaagaaatgttggttaagggtcttctgtgtgccaggctgtgtttaggagctggaagtgcagagatggataagatgttgtattatcctttcagccaggattaaagtttacatttttactccaaatgagagtttctcaaccttggcactgctgacattgtgggctggataattcgtggggcagggggctgtccctgtccctgtcatgatgctttgctgtggaaatcgatgggctcccccgatccctgctgtctttgaggggtagtgtctgggaagccctccgaacccgcagtgtgagtctgagccagagggtaggaactgcatgaagtctytgcattgtttgcctggctgaagatatcctgttaaaggcttattaaaacagttctttggaagggactcattctgttcctgctcagctcctctctggccttgctgcccagcgttgtctgaggagcccatgtcatgcaggtgccaggtcaygtggccgtgccatggggggtgcccggctgcggcctcttcatccaggcacatcggcagaggcccaattccacttccatcactgcgggtgaaaaatggaaactgggccccgaggcaaaatggtgtccgtgtttttgaagatgaaggcattaagacaggagcatttaaatgatttattaatctgtttatgctgtcaaggaggaaacttgaccagtgcagataagtgagctkcgaggcaggggtgacagagagcccgtctccctctgtctccagtgaccttgccctgcaggcgatttgatgggcttgacttaaccttttaatmgtgcagtttcagttgatgtagagaatgttcctttccaaatgtatggcagtggcgctcgttaagtttccctagactgaaggatgtgtgtacaggtattcctcagctgggtgctgcctggctgagtgaggcgggaattgggtggtcaggcaccggtgacctggtcgaatatgactttgctggggtgacccgaggggtgcagcmatgtggctctgttgctcgcagttttgtgcctgcctcatctgtcgtttatgaagccttcgaggctcgagcttcttgaaagctgacttgtgttttccaggttcgttataaattctttagcttggggctgttcccacactggagggtcaataaatgatttttggaaaagaacatatgtccttatcaatcagtaattgtactggtacaaccatctgaacttttcaaacatgctgcacttggagcggctgactcttctgattaaagatggattctttagattctaaggttggatcagctgagacaagcagctctggggctctgttgctgttgttgttgtttttggcctcagagtgattatttttagtggtaaacagaagggagaggcatagccataaacttgtatttgggacatgcccgtagcggcaggttccacccggttcaggtagagtaatttcagggtgacctctaggctggcagattgttgttgctgggtatcagagttgaaaatgtttattgccaatagaaaaagtgagtagtgttcgtaagactgataagcacaggtataaatagaaaaggtgagttaatgaccaactcgactttgcagtggggctttttaaaagcggttctggagtcttggaaacaaacataattctctcttagtccaaccacctgtcagctgtaagtggtcattatttcatcatattgcaataaaagataatagaataacgatttatatctcatggctgatgttttaatgcatctctctgttatcctgggctgacagtctgtgattacagtaaacgttttctcggtgacaccatggtaatgactcgttaataggaggattattccaagtttaagtcatagagcggaagaccagcctcggctctccttacctctttgtgccttatgggggcggtctctgtgctcagctggtgacctgtgctttgccccccagctggggtgttggggtatgggctcagcaccactcctgatgcctggggatgcgcattccctgttgattagcaaactcagtcagtgtcttcatctctgtctactgtgctacggcattccttctttctttctttttattagacaaagttgcactctgctgcccaggctggagtgcggtggcgtgatctcggcttactgcaacctctgcttcccaggctcaagtgatcctcctgtctcagcctcctaagtagctgggaccacaggtgtgcaccaccatgcctggctaatttttgtatttttcatagggatggtgtttggctatgttgccaggtgatcttgaactcctgagctcaagtgatcctcctgccttgacctcccaaaagtgctgggattacaggtgcgagccacsaccccaggccccttaattattttaaataaaaacaactgcattgaatttaacgcaatagaaaagcagcagcagagtgaaggtgctttcattcccaagtgggagcgcccgtatgagatgcagagaggggtttgagtctcctgtgctgtcttcccaggcctcctctccctgggcctggcaggaaggcggaggcagaggctggccatttgcatgttgggaatgggaaggtgtgagtggaaaaccttttaagatcaatttgaatatcatctacttggcttacatcttgagaaatcttttaataaaatgatctcaaggtgattttcggcataaaaagactttagtcttttgggctctgaaycggggataattacttagcacctaaagaaattcaaggattcttcttgttaatagtttaaatacagttcagatggaactcaaaatggttacgcacgaagcagcactgggaaggtgtgatcgaagttgtctgtgttgagtgtcaggcgatactaggagcatgaattgatcagcacgtgcgtgtctttttagtggtggatgtgttacgtcttgggctgatctaaccatggtcctacctggtgtgtccccctgcagggttgggtgcatagctgctctagccccattctgcwctagtgggcctgggatctgttggtgtttcttgtggtggaattcctagggaatggaaagttcctggagcggaagcagacatctgatgccctggttgttgggtgctctggaataaagrgctccgacaccaacatttcagtctgagggagttacctcagtgtgcctgcttccctggcatcctgcagagatgtggtacaccacatgagggcatggtagagggttccggatgctgtggcacgtgtaggaaggcggtctcgggggtggggacagcgcccatgtcctctttgtgtgtgtcctgaacactcagaccatcctctggcttctgttctgcagcccttgtattttcacacatccctaaaccaccctcatatcgtggctgtggtggaagtggtcgctgagggcaagaaacgggatgggagcctccagacattgtcctgtgggtttggaattcttcggatcttcagcaaccagccggactctcctatctctgcttcccaggacaaaaggtacctgccttgtttctacaaccctggggttttccagcgtctgtctttttttttttttttgagacagattctcactctgtcaaccaggctagagtgcagtggtgtaatgtcggctcactgcaacctccgcttcctgggttcgagcgattctcgtgcctcagcctcccaagtaggtgggattacaggtgccacgcccagctgatttttgtatttttagtagagacggggttttgccatgttggccaggctagtctcgaactcctgacctcaagtgatgcacctgctaccatgtctggctaatttttgtatttttagtagagatggggttttgcgcctggccagattccagcatctttctatggtggtttaactgctcgtcttatggtggcagtagaaggctgtacatttgtcatctaaagttgtgtgtccataatagcatagtgtgggatgtgtcttgcttgggggtttgcctttttttttttcttcgagacagggtcttgctctgtcacccaggctgtagtgcagtggtgcaacrttggctcactgccacctccgcctccagcctcaagcgattcctgtgtgtcatcctcccacgtagctgggattacaggtctgtgccaccatgcctggctaatttttgtgtttttagtagagacgggatctccctatgttgcccaggctggtcttgaactcctgggctcaagagatctgctcgcctcagccacccaaagtgttgggattacagacgtgagccgctgtgtccggctgggtttgccatttctaagtgacttaaggaattgttctttaggccgsagtaagggctggctttgaccaccagtgatggatttgaggtagtatggatatgggccaaagttgtactctagcactgattctctgtgggacttcaggtaagtgatttgagctcttggaccctgaatttattcatctgtatatgaggagtaatgataatgcatatctcgtaagttctgcttgaatattgagcgatgtgtttttcacaggtgcctggcaggcagtaggtgttcattcagcacacgctggctgagtgtctgtcgcgtgccaggctctgtgtaggagccgggcatacgggtggataggctggcgcatcatcctttcagcyagggttaaagcctacatgtttactccaagtcagggtttctcaagcttgacaccactgacttgcgaatggataattgtttgctgtcgcggggctgtcgtctgtgctgtaggatgtttatcagcatccctggcaaygcactagatgccagggcactgcctccctgctccctggccctgttgtgacaaacgaaaaaaaatgtctccagacattgccaaatgtgccttagggagcagaatcatcgctggttgagaaccactgctccagatatacagctgtggaaattcctcagatgttgtcttgagacatttcagagttttgtaaatttccatggtgttttccaggaaagctcctcaattctcaggctgccttggttggggctgcgtgtgtgccagacatgcttggccacaagcaccaacggcttggggagctgctgctggcctcagctgcctctgccttccgcagaggatgggactggtggagtttagaaagctctagtgggcgtggtggtggctgaggcctccatgtgctttccttctgagaagtgcgcacgtggctgacgactgttctctgggtcctgtcttccaggttgcggctgtaccatggcacccccagagccctcctgcacccgcttctccaggaccccgcagagcgtaagagccagacctggccttggcagcactcactgctctcgtgccttccctgagtgttccccacctttagctctgaatgggatctttctcagtgtaaactgctatcygcttagctaatttatctaagaggttttggcagatgtttcgtggccttggacttttggcagaaagtaaagaactgaaacacaccakccctgagggagggcattggtttgtggggatgagcacgggagcgcctgtgagagccacctggagggaggggaacagctctgctcaccagatgaagtagtagctctctgtcaccagccaccggctgtctcaaacctctgaccgcacagccgtcggttatctccagcatggcaaggccccatggctgagaggccgccttagagcagagcaggggtcggcggggagcttcctgctgttcctcagtgaccagccgttcccaggcagccagagggagccatttgggaaggatggggatgacggtctgctctgctgctgcctgcctggaggatgacaggaagggcgtgtggtgggaggggtgggagtgggctagaaggacatcagggaggctcagagcacagaggctgtgcttgcctagcagttgggggagtgtgggtggggaagagtggccggaggtggatctgttggggagggtgacttttctgtctcttcgaggtgagatgctgcccagattcctcgaaggggatgtcatgtgtgcctcgtggcttgtgttaaaagtcaaacctggccagacacggtggctcaggcttgtaatctcagcactttggtggctgaggcaggtggatcacttgagctctcaggagttcgaaaccagcctgggcaacatagtaagacctgtctctataaaaaatacaaaaatttagccaggtgtagtggtgtgtgcctgtagttccagctactcaggaggctgaggtgggagaatcacttcaccccaggaggcagagattacagtgtggtgagattgcaccactgcactccagcctgggtgacacagtgagaccctgtctcaaacaaaacaaaacaaaacgtcaaacccactccctttgcccctcactggtcttggtgacaatctygtgataggagatgtcagctgaagagtgatgaggttcctgagactggaaaggagagattcatttctcataaagggctgcagcctgcaggtggcctttctgacaggctgggaagtgtagcctccagccagaagccagaaacagacccttcgagagaggggcagagggaagaggaatttctgctgagtgggggctgagcctgcttattttaataagcccaggaggagtcctgcgtgtttatgagagaagcgtgcacgtgcgcagctgagtcccatgccgcttcatgggacacagtgttcaaaacgtggtggcactggcaggacccgaggggaagttctcggcctctgatgtcaaaaggtgaagcaggggacacgaaagccctccctgcatgccctccgtagactatccagaagagggagagcggtgggtgatcgctggrcagcagcagcgatggagtctctagaagggctggttccagtcctgagggaagaaaggctaacggtggttagcatgggccggggcatgtggaggcctgtctggtcccctcctgtcactcctggaactcagttttcaaggctgctctggagtcctctaggccaagaggaggtcccttcagtccactgggggctcaggattttatttttagtttactgagaacaaccagtcaggaacttcatttcgttgctgaagattggcttttaggttatttttcaactgaatctaattagtcatatgctgggattttctgtccagaagtatcctgagaacaaagtagacagccaccacattcgctccacgtccacagtccacatgtccatgcgtctgtgtggaagctgttggccctgagtggaggctgtgaggaggaacctgctgcggggcccttcactcatccttgcagtgggcttttcccaaaatttgctggtaatggcaatacactcacatgattcagaatccaaaagtataaaaaagtgccgggtgcagtggctcacacctgtaatcccaacactttgagaggctgaggtgggcagattgcttaaggccaggagtttgagaccatcgtgggcaacatagtgagaccccatctctacaaaaaatacaaacattaactgggtatggcggtgcgcccctgtggtcatagctacttgggaggctgaggtgggaggattgctgagcccaggagttttaggctgcagtgagccatgattgcaccactgcactccagcctgggcgacggtgagaccctgcctcaaaaaaaaaaaaaaaaatatatatatatatatatatatataatatatatgtattatatattttatatatagtatatttatatgtgtgttatatatatataaaatatatacatataaaaagttgagagtgaggtctcctttccccaycccctcacctgctaccaggtaacctctctctttgggttcttgtggatctgtcactggagaaccgagttcttttcccactttgtgtcggctgcaaagaaagaatatccaattggaaaaggtagtcaggttttactcactggccagggagtggagaagggagccctcactttaaaggcaccttctccctggacagtgggaggcatggagatgaaggactgggtacaggccgggagggtgggactccaggcacattgacgcagatcataacatgcttctccaggcatggcttgtacagaacacgcggtggtcttctcttggagaatggtctttagcattataatgatatgctaatggtctaaaggcaactggggctcacctgttctagtttgcagcagtttcgtggggctccatctctctctggtatttggtcaggggtcaagaagctctggtggcatccctgccatctggttcctttaaagcagctgtacccatagataaagggactgaaggaaaacagtgagaaaaaggaacttttgctgttatttcatcagggctgccctggtaacagacccttccggggtcgttttacggacacagaagctaatgcgcttgtccagtattgcatctgattcttgacctcttcttactcactgttccacaccttgctttcttcccttacaatttgtctagaagaatgtttcctatcagtacacagaaagcactcactctttttacagctctgtggtgtttcgtggaattgatgtttcrtgattgattgaatagacctgcataccgacccttaggggtttctgtaagaagaggttgggccaggagcggtggttcacgcctgtaatcccagcactttgggaggccaaggcaggcrgatcacctgagatcaggagttcgagaccagcctggtcaacatggtgaaaccctgtctctactaaaaacacaaaaattagccaggtgtgagggcaggtgcctgtaatcctagcaactggggaggctgaggcaggagaattgcttgaactcgggaggcggaggttgcagtgagccgagatcatgccactgcactgcagcctgggtgacagcaagattctgtctcaaaaaaaaaaaaaaaaaagaaaagaaaaggttggaaaccccgttgcagtgggcgtccgcccttcccctgagcatgtgcgtgaattcttagggcaaaatcctgaagctggtggctgggtctgaggtctgagcatttggagtcttttcctatttctcctgtgtgccccgcccccagagaggttgtgactcctgactagccactcaggtcaaatacctttagcagtattttaaattttaaagtaagcagattccatgtttgaagtggttaggtactaaaaaaaatacagtgtttcaccaatttctttttttttttattttgagatggaatctccgtcacccaggctggattgcagtggtgcaatctcggctcactgcaacctctgcctcccgggttcaagcgattctcctgcctcagcgtcccaagtcactgggattacaggcatgcaccaccacgcctgggtaatttttgtatttttagtagagatggggtctcaccatgttgatcaggctggtctcaaactcctggcctcaggtgatccacctgtgctggaattatgggcgtgagcccccatggcggacctagtttttcacaaatttctttttctgataatacagtagttcatatttagctctttctttatgaaatcagaacatgaatgagctgaacttgtgactctcagcagctgtccctggcccggccacagctgggacttgagccgcctgagaccacgtgcatgccctgtgcctcgggatgtggtggacttcctgtcactggagaaaatcaggcccgagcaagattggccgtttggtgggaatgtgaagagggcagcccaggccctgtgtttcgggggtgtgcctctccccgcactcccgtttctgggaatgctgttccttctaccttcagggcctgcccgccctgcggtgtagccgcactcctcccgggtgtcatttctccagagtctttccttcatgccctttttcctcctcacgttccccctcgtgctttacccacatctgtcccgtggttcggatccagttctcccgtgcgttatgggtatccacgtgtttggtcttagccatcactccaggaaagtggctcctccctgaggacagggctctgtctctgatgctgctggcctccctccagtgctgccctcctccktttggggcttggtggatrcaagtgctgacacacaaaggcaggcaggcaggcctcgggccagggtgtcctccaggcccctctgatggcagggaccagcgagacctggggaaactgcacagtctgtgcctgtctgtgctctcaggagactgagggaaktagtgggtgggagagattttatgttggattaaaaactgcacctccaggccgggcatggtgtctcatgcctgtaatcccagcactttgggaggccaaggtgggaggatcacttgagcccyggagtttgaggcttcaggaagctatgattacaccactgctctccagcctgggcaaacagagtggcaccctgtctctaaaaacaaacaaacaaacaaacaaaaaagaaaaattaaaacattttttaaattgtaactttaccagagaaggttattaaagatcaatgcctttcacttgaggcrgaacagagcaccacttcactctccctagaaaagtccttttcctgtttgtggtgtttctaacattctctgttaattggctggtttgactggaagcacctttgctttcagctrtcagttgatcacattgtgttttcttcaccagaaaacagacacatgaccctcattgagaactgcagcctgcagtacacgctgaagccacacccggccctggagcctgcgttccaccttcttcctgagaaccttctggtgtctggtctgcagcagatacctggcctgcttccagctcatggagaatccggtaagggcgtctttgattctctccacttggtgaggtragtctgtcctagttcacagtgaaaccttgaaggcactgggctcttctgggggcagcgtgggccgagcgcccctctgcagctcagcagcacggcctggcgggggttgtgggggrcagtggaggaggatggaatggcagtctagtttccgtttccctcctaaatagtgtctcacatccttcgagtcatttctggctgctttggttgggaaaatgctttcgtgagagacagagttcaagtctctgtgaccatagctaggaagaccactggctggatctcagccatgtggcatcatatcagtgacctgatgatcatgatgatgatttttaaattaaggtaaaataaggataacataaaattgaccgtcttagcccttttaaaatgtacagttcagtggcaataagtacattcacattgtagtgcagccagcagcaccatccatccctgagctctttcctcttccccggctgaagctccgtccccttccacactgactccctattccctactcccccagcccctggcagccacccttccgctttctgtcttcatggtttcagtgactctagggacctcataggactgggatcatgcagtccttgtccttcagtggccggcattctttaggaagagaggggaattgctctgttagttcatcctaagagtgaaatgtcttcaaagttctgagtggagtgttttcgaggttcatccatgttatagtgtgtgtcccagtttccttccttttcatcttaaggctggatgatattccagtctatggatggaccatgttctgctgattgtttcatcagttaacacttgagccttccrccttctggctgctgtgaacatgggtgtgcagtgacctgaggatttttggaaactgaaattcgtgttaaaggacaagggctctgtcttggtgtggttttcagaagttgattctctggtggtggaattgggtcgaccccagcagccatgggagtgttgggggtgtgctctgctgtaggaatcttctgggtggtcctcatggcctgggctgcatgcttcttccaggcacttctggagacttttgtgtggctttcttgaggactccakgagaagggacacaccagcctccttctacctgtcatgtgatggagatgtcctggcaccaccagaacctygggtgtcttgggtgactgactccctgctgggttccaggaagagcaggatttgaccttgtgtgtgaggggcggggaccgagagcagtgctgtgctgagagtttggctcattctggaccctgaagaaaaggatgcagctcggctccggcgcaggtccctggttgttggcaatgacagccctgtgcatcgtacaggcattctggttggtgctggggtgtagatgttattatctgagttaattaatttcttggataggtctatggtggacatcatcattgtgaagtcactgtttttccagcattccagggaggagagggtgagaaatgagaagggaggaatgaactctgaacaagagcaagcgtggggtcgcagtctgggtctgtcctgctcactgagctataagtgctctccacgcccacttcggggtgtcttaccctgtaatctgcctgcaatcctctgaaaggaagaaggagacagagggaaggcctcattgtcactgctgttgagttgagcaaagagaacatgaaaacctgtgtctggctctgagacctggtccgtggcttgtccttctggcccctgttctgctggccagggagggccctgtaggcgccgctgtgagatgtcgcctgcttgatactgatcatcaggactaactgtgagttgccgcctggttgatattgatcttggaactagctgtgtgctgctgcctagttgatactgatcttcagaactagctttcagatgtcacccggttgatactaatcttgggactagctgtgagatgttgcctrttagatactgatcttcaggactagctgtgagatgtcrcctggtggatactgatcttgggactagctgtgagatgtcacctggtggatactgatcttgggactagctgtgagatgtcgcctggtggatactgatcttgggactagctgtgtgctgctttcaagtcagctgtgtcagtcttactacctgggagtcttggagccggaggggtagtcatcactttgtgacttgcccgtgggtgtcagtagaactgcagaccaacagaattacctgcaggtcactggactggctcagcctcatgactaggactgcaaatgagaagccgtggtgccccaagaggacaggcctggttttgttcctagtgtcttgtgtcaagctggggccaaggggaccacaagatgggagacagagttttggattaaagagcttgagcctggggtgcatgattcctgctcctcattcttaaaagccatgcttcggaagaggtctggcccgttggcctcaagtcggccttccaggtgtggagcagccggcccgtcaccaaggtgccaaacgaatgctggcagtgcctagaacattgcaaaattaatgacgttttatgctgctggtgttgaaaatcgagtgagcaggggatctgagggcagggtgagcacacgccatggtgtccggagggagggagggggactgactgactccaccaggtaagggtcgtatgcgcctttcggagagaaaggataggtatctcagyaacacctgccgcccccccgccccccgcccccactytcagagttgttttgggagagaaacacaatttgcccagcctttctgttgtgtttggggtgccagtgccgtgtgggccctgaggttactttctttttattttactttttaaactttttaaattatgtatgtaatgacagccagattcttctctaattctttttttttttttttttttttttgagacagggtctggctcttcttcaggctggagtgtagtggcacaatcttggctcactgcaaactctgcctcccatgctcaagtcaatctcccacctcagcctcctgagtagtaaggactataggcatgtgccaccatgcctggctaatttttttttttttttttgagacagtcttgctctgtcgcccaggcaagagtgaagtggcacaatctcggctcactacaacctccgccttccgggttcaagtgatcctcctccctcagcctcccgagtagctgggattacaagtgttcacgaccatgcccagctaatttttgtattttcagttgagacggggtttcaccacgttggccaggcaggtctcgaactcctgacctcaggtgatccacctacctcggcctcccaaaatgctgggattacaggtgtgagccatggcgcctggcctccagctaatttttgtatgttttgtagagacagggtttctccgtgttgcccaggctggtctcaaactcctgagctccagcatcaaggaatgcacctgccttggcctcccaaagtgctgggattacagacatgcgccactgtgcctggccttgaggctgctttctgacggctgttcctggccagtgccaatgcagcttgtcagttgtttgccccttttatacaatatgctaaagagcgttttaaaaccacgaagttcatgtgtgttcagtacatttagtgaaaactgaaagtcttcccttctagtctaactccgtggagaaaaccactgatcatagtttggtgtatactttttacgtattcactaattcattcatttattcactgatttattcaacaaatatttattgagtagacactgtgaagcaggccctgggctgggtgctgaggatgtcacattgcactcttaggagggaggtcataggtctctcttgaatggattttggtaagggcagacctcaaatctaaccacagtcaccaaaggcaataggtgttttagaataaacctggactagctcaaagtcattttcattcctgcttaaatcattcctaaatgtagttttcattctgctgtcgctgttgcagcgttcttgtttttgaggtgcattctggtgaattaaatatcccactgttgcagcggtcttgtttttgaggtgcattctgctgaattaaatatcccactgttgcagcagtcttgtttttgaggtgcattctgctgaattaaatatcccactgttgcagcggtcttgtttttgaggtgcattctgctgaattaaatatcccactgttgcagcggtcttgtttttgaggtgcattctgctgaattaaatatcccactgttgcagcggtcttgtttttgaggtgcattttgctgaattaaatatcccactgttgcagtggtcttgtttctgaggtgcattctgctgaattaaatatccctagcagaagagctgtgtccccaagaggctgtgggctgtgggagcccgttagggcctaggggaatctcaggggctctccactgtatgtcagtgggaagggggttcttgcttgtgaagggtttgctggcaatccctgttttctctgtagtgtgcttatgggggtcccagaataaaatggattgttgtagagtggggtgtgtttttccataggagcaatgctgttattgggaattcctttcctagccagagacttggcaacagataaattaaaggtaggccaagctacagagcatgaagggcagaacgcctctgctgcagtgggggtcacttctgccacggtggggttcatgtctgccgtggttgctgctgttggttggttagttgaatgagtgagtgaaagagtgaatgatttcaggtagtaaaaggatgcttgttgggttatgctggaggctgacagacctgtggcggttgtctgctccacgtctagccacgatgtgagctgggggcaggtttcccagcctctccaagtctttgcttttgtttttcctttataaattggggacaataatagggcctgctcataaagatgtatttggggagaaaatgagatggattggtaaagcactagcgtcttcatcatgaaagttgtgtcttaaattcagcccagatccaagcctcctasagtagagcgtcctgggaggtctgatctgtttgccctttgctagctagcccttcagatgtgcgaaggcaacactcagcaccgggcccagctgtgtttttgtccaggcctggcctctcgaaggtcacagagtaacttggtggctgagccaggcttgggctcasgtgctttactccagagcccatgatgcttgcaagatgtggcctgccaagccggctgaatgaggatacccaggcttctstggcttccctgggccctccaggatctggaagtttctactcactgcagatgtagctcctcagtctggctgtcctggtgggaacccatctttcctcccttgatgacttcctgtgcgtgggacttgcatcttcagctctctgtgcagaccagggtcacaactattggaatggcttttgctcctgggggtgcgtgtgcaccctggtcatgaggtggccacacagaacctctttccttcccagcctgggccacttccaggagcactgacttctgccccctcccagatgcctggtgaccctgatccctccactgagttgctgcctcttgagatggggcacccatggcacacaagtgatctttcctaaaggaagtcggtctgggaaatggcctttgtcctccgttattttagtttatgtcatccctccctgcaccccccccccccagctttttgaaacrttctgttaaaatgtttcttggcttactgtaattgtatatatttatggggaacagtgtgatgtttcagtacacgtatgtgttgtagagtagatcaaatgagagtactagcgtgactgtaatctcccacactcatcatttctgtgtggtcaggacattsagaagcygctcttctagctgctcttctagctcttttgtattttacgggaacttactggtaaccgtcattaccctgctgtgcaggaacagcagaatttagactgtaacttgtaccatgaccccttgacaacctctccctcccctcctcagtctctgataaccactgttctgtgctccgcttctatggtaccaactcttctttttgagrtcccacatatgagtaagatcatgtggtatttgtctttctgtgcttggcttattccacttaaccttgatgtctgctaggtccattcatgttgtgttgtcgcaagcgacaggacttcattctttgatcgtggttgcgtaagtactccattgtgtagatacactacttttctttatgcattcatccattgatgaacacctaggttgattctgtgtctccactgttgtgaatagtgctgcaataaacatgggagtggcgatatctctttgacatactgatttcatttcctttggatattatatactcagtagtaggattgctgaattatatgggaattctattttcaactttttgaggaacctctgtctagttttccatagtggctgttgtaatttgcagtcccacccgtattgtataggtgttcccttttctccacgtcctcaccaatgcttattttcttttatctttttgatggtggccattctcactgaagtgaggtggtatctcattgtggttttaattttcacttccctgatgactagtgaggctgagcatcgtttcctgtgcctacaggtattcgaacgtcttcttttgagaaatgtctgttaaggccttttgcccattttaaaatcaagctactagtttttttttttttctgttgagttgcttaaattccttatgtattctggatattaaccccttgttagatatatagtttacaaatattttctcccattgtgcaggttatctcttcactcggttaattgtttactttattgtgtaagacctttttattttgatataatccatttgtttctttttgcttttgttgcctgtgcttttacggttttatttaaaaaaatcctttcacagcccaatgttacttwaaaaaatccttactcagcccagtgttacgaagcacttcttccgttttcttctagtagtttcatagtttcaggttttacatttaagtcttcaatctattttgagttgacttttatatatggagagaggtagggcgtctcatctyattcttctgcatgtgggtgtccagtttgtccagcaccatttattgaagagactgccttttccccagtgcgtgttcttggcacctytttaaaaatcagtcagctgtaggtggcatgaatttatttctggaatctctattctgttccattgggcaaacctaatgtgagtttgtgatggggacaatatagaaaactataaagaagaaaataatctacagttcctgcctgcagatccacatgtatacatgtaagtgcacatgcttttaaataccrtcgctatcagatggaatcgtaatagtttcatatgttactattcttttcacttacaatattacgattatttctcaatttattaaatctttgacagtatgattttttttgttcttattcagcaggatgaataatagtttagtgaacattcccctattgaacatttggttgcttcgatttttctctattataataaagtttcaatgaatattcttgcacataaatctttgcttctgtctttgattattttcactgaataggttcaaaaagtggaattactggggcagaaagtgatattttaaagcttttgacatactcaaaggcaaaggcgatactgactcataatcttcagcaggatagtagagtgctcttttgacggcagtttcatcagcatggagtgttacctcagtgttttcttttttttcaactttgaaattagcttttaaaaatctacatatctacataagtaaaagatcattaaaatataggaagagatggagctaggaccagaagaagatgacgatggtggagaaagaaggggcagagtccacaggtgtgtgtaggttgggaaacggttggctcatccttcctcctcctggatgagcctttgctctagagcaagtggagaaggctccccaggcagcccagggtccttccctctctcagccaaggtttttcatgggcctgctttgcacgagaccgtgagctgggtccctggggccactgtcctctggatgggacccttttctcgtggtgccgttcaggctgtattttgctggttgccttgacaggctcatgcctgctcagtgtgtttgcagatggttcaaggtaacacagtaaagtaaggagcggcgtggctggccgtgttcctgctggagagaggaaggaagccatgccgggcagcaggctgcagggccgcacgtgtcactttgccttctccaatctgtgttctttgagttgtcgaattataaaaactgttcctgggccaggtgtggtggctcacgcctgtaatctcagcactttgggaggccgaggtaggcggatcacaaggttaggagttcgagaccagccyggccaatatggtgaaaccccgcctctactaaaaatacaaaaattagctgggcgtcatggtagtcacctgtaatcgcagctacttgggaggctgaggcagaagaatggcttgaacctggaggcggaggttgcagtgagctgagatcacaccactgcactccagcctgggcgacagaacgagactccgtctcaaagcaaacaaacaaacaaacaagcagaaaaacaaaaaaatgaaaaacaaaacaayagaaaaactgttcctggaggaggtttggggtagattttggactgccaatgaaatctgtatttgcttaattgttgtggaggcttggcttgggccttgtgctctgtctgggagtcccgagcacccttcgttgctgcaggccccggctgaggctggggtgggtagggaccctcggtggctgccagtgggtgttttattcccaaggatgacccttttcgcaccctcactgtttcaggcgacgctctccgaaagcctcgcctccagaagcccatcacggggcacttggatgacttattcttcaccctgtacccctccctggagaagtttgaggaagagctgctggagctccacgtccaggaccacttccaggaggtgtggagtcagaagcgtgatggggggcagggtggggccaggcaggggtgggacccgggtagggcagggaggaggtggggcagggtaggggtgggtggggcagggtaggggtgggtggggcagggtaggggtgggtggggcaggggagaccccgcatctgatgctgctgaggagggccctgtggccctaaggatgtagttctgtcttttcccctctttctggaggtgaattggatctttagggacccctttcctccacagccaaggcccccacagagcctccagttgttttaacttcaacagtgatgaaggtgctgttggcctgagatgttaactaaagttaattctggtagatcatgaaatagtcctcatttaaagtaaactaaatcaccagatgagcatagggaaacccatagaacccttcccatgttcagaggacgtcggcggggacatggggctcgtttccggaggtggctggaagcctcggtcatctcacccaccttgggcccctgggaaggcgcccccagactcactgtcccctcggcctgcccgtgtcacaggtcattgtgttctggtcactgagagcctgttcacactccctgctgttcctgtctgttgcttttcagtgtatgggtttgtccaggtgcccaggcagggcgtctggagggcttgtccatctgttaggcagaggcttttgagcctgtttgcctgtggcccctgggagggatgtctgcgtcgtgcaggtgcgtggagctcagcctgcctagtacgcagcatgcgctggggtttcctctccggctccgtcccagcgatgctctggcttgcgagctgtaaaacaccagggccagggaggttgtttctagagctcctgtcacctctgacagcaaaagttgtcttggattttctgtgtagaagcttgtttgtatgccagacaagacttggaaaagcctttgcaggtttggggactgcttatgttttctaggcgataatctgtccttggtctrgaaaaattgggcctgatgaactgtcacaaatagtgttggaatgaggtctgtccgccctggctcttctgtcgccagcagcagggggaacaggcatgtgggacggagattgcctggttctgctggagccctgggctcagcccccttgcctgcgccttygctgatgatcaccagatggagtagggagaagaggggtcagccctggctgctctcaactctggaaggaggggccctcagacctgggttgtgggcaaaccactccttgttccccctcctagaatgagagagtcttcactttcaacttcagaaacaaagagaaagaaactttaattgcagagagccaagagactggtgtgggtaacatcttgctgttgcgtcgagtcctcttcacgtcacacccttttcgtgatgagtcccgcagaagcgcacagaatgcaattgtgtgactgcgcgacacgaggaaggacggcagagggaggccttgggcccggcacccacagaggcaccctcagagcctcgcgggtctcctccggctgcaccttcctccccgcccattccctcgggcctttgtgctaaycacatcttggctttctgttctggttctaccgcctatcgatgcatctctaaacartataggcttgcctgcttttgacctatctttaaatgaagtcgtacttttttcttctgttttgttttgctgcttttgctcaagaccatgctcccgtgggaggctgtctgcagtggctgtggctccatttgctcactttttttgctggatggtcgtccgtgtgagggcaccaggatttataaatccattctactgttgatggacttttgggctattttcaggttggggctgagcattcttccatgtgtatcctgacttttagtagaatctcgagcaggaagtaaaagggacttttttggaaaatcttcatgggcctgcaatgagttggctggtccgctgggggctgctggtctaggatgactttggttggggtggcgtggctcctgtggcctctcctgtggcagccagtctgggcttgctctcgtggaggcagatgtttaagagaggagttggaaatgtgcagacattttcaaacctctttttggattaaatttgttactctcccactggccaaagcaggtcactggccaagtccagagtcagagaggtaggggactccaggttacaggacaaagggtatggctttaaagatcccttacctggagctgcagatgaatcctttaccatgagggtttggtggaattcccaggattttgccaactcggccatagctcctgggggtggaggcggagttgggcatggtgcctgccctcctccctttgagcttcaaggcttgggtcctgccttggtgccaggtcctgaaggctggtgcggtctgttatgctgccatccttgattggtggcatattttgctccttaggtattgggggaaggaaattctctgaggaagtgtccctcaygttcacttgaaagtcccagagaacatttttttcactcagtagtcaaagaggtcttttaaaaacataaattcattgcttctcggccttttgggtaagatgaagtgtaattggacttttagggaccctctcttaaactcctctcttaaacatctgcctccatgagagcaagcccagactggctgccacaggagaggccacataaattcagccatttttcttctgtgtttaaaacctgctgctggcttctcattgcccttggactgacacctaggctcctggtcctccaagatgcacgtggtttggtctttgccggtttcccctgcctcactatgtgctgcctcctggtcatggtttggtctttgctggtttccctacttcactgtgtgctgcttcctgggcctgttttgtggtccyggattcaggcatgcctctgcctaggtggcctcggactcatgcttgtccctgcatgggtcctggagcatgtagctgactttcctgaatgttcttcctgcacatctctgcttgtttcccctcaggcttcaggtctggacggggtccyctgactgtcctgcgggggtgctgttccccgcccttgccaccgtgtctccagctgtcaccccgcgttcctcccgggtgctcagcccttcctgggagcagctggccttcttatctgttattgtcggtctcctgtggtgagtgtcaccaggacagggactttgttttgtttacaatgacacgtgatgtgcatgaacggtgtttggcacataggagggctgtactatttagttgtgagaatgaatgattcaggtgctcatcctagtagtctatgaagttagcaagttgtgtgtgtgtgtgtgtgtgtgtgtgtatgtatgtgaatgagctggacttgtttgctccctacccgttcttgaaaatgcagttctacataatatggtcttatgtaaacacaaagcagagaataggattgaaacascaacatccgtttccttggtgtagttcctgctgttttcttgtttgtcagggcggattgtgtgagggtagagttgttttaggaatatcattgttgaattttatacagtcccataaaaatcactttattgtgtatttttactatctttgtatttttgttccaatccaactggcagatactcagttatctgcatagttttattttcgttatccaaagactaataggctgaatttaggtctgttcagcttgattaatggacagtaaagaaaacttgaaaatttgaggatcattttgcaaagatcacataatttaataaacactaatagccaggggaatatccttgttcatttgttatagcgcctgtacatttttgttaagatgaaacactttaatatcgagtgaccactttggggctggttctgtttttattggtttatgacttagtgcctaaacatgtttccctttgtacacccagtctcaggtctctgggtagacagagttgaaatgtgatgagctctgcctctgagcacctctccatcgtcgtccagggaattgggccccagggaagggggctctggggaagcagcctctgggaaaggggggctctgggggrgtgggctgtgggaccttggaggagtcttgaaggagccaagtacgagtttgctgcatcttgagaatggtcagcccagccttggaaagctagtgtcrggttttggggatcgaggcatctgagggtgtgcgttgctgagaggatcatgctgtgttggaaatgccaaaactgcccgggcagtgccccaaggccagtggctgggattgggtgctgtatctgtcatttgcttgcactcatcttgactaagcatcatctgatctgcagttatctgcaacttctgctccagtttcttctctctgctcgcctcccccagggacttctggcgagctccctctttcygtctgtgccggggctcattccttctgtgcctcttccagggatgtggcccactggacggtggtgccctggagatcctggagcggcgcctgcgtgtgggcgtgcacaatggtctgggcttcgtgcagaggccgcaggtcgttgtactggtgcctgagatggatgtggccttgacgcgctcagctagcttcagcaggaaagtggtctcctcttccaagaccaggtattgtctcttgggtccccagggatgggtggggatgtgcaagggatcacgatgaaatgaggtcatttgtgcatgtcaggtgttgactcacccacgtgggagttcttccttgtgtttctttcctcttggaagttgtgcccattaggaacaaactttggagttggaagtttggaaaaagcccccccctttttttttccttttgtgctctgacaatttgggggttagcattatggatgcttccagctgcggctgctgagggtctacggaggccttgcatgctgccttctaggcgtgccctgtgattagtttctcataggacggagagtcagggggcagcaagacctgctgctctgtttaatccagtgcttcccaaatcaggtgtcacagacatcactgcagggcgtcatgcctttcctctctcatggtgccaggcagaggccaggtgtcctctgccgtaggccagccttgaggaaggagcctccatcctctgtggcatttcctggtaacttggccgtatcaggcctgcaggcaagctttggtaatttggaaatgcgttgaaagagcaatgagaggctgaggcgggaggattgcttgagctcaggagtttgagaccagtcatggcagcctagtgagacccccatctcttaaaaagcagygttttggggaatttctgaatcatttggragagcgtgcagtgttacatggtggacttgctgttgcagcagcacccctgtgtcccccagggtgtccccttgactgttctgacagtggtcgacgtggatgcgggaaggatgggagctcgagctctaatgtgtccctggtttgtgtttctgacccagctccgggagccaagctctggttttgagaagccgcctccgcctcccagagatggtcggccaccctgcatttgcggtcatcttccagctggagtacgtgttcagcagccctgcaggagtggacggcaatgtaagaacagcccttttgcactcggtttcctctggtggtgaactctgtgtgtgaggataaatgtagtgggcatgaatgctttttccattaaaaacaggcatgattattataaataataagtaaaaatcactttactgacatttatcagctgattgtaaggaatgttacaaaggatacagatgagatggagagggcaaagaatgtgggaaggacttggagctcccatgccctcctgggcaccgccctctgggcacttccatgggttcagctgtccagagctctctgaagtcagtccttttgggttttgatgaaaactttattacgtaggcataattgattaaacattggccattgatgatcaatgtaaccttcagtcactctcctccccctgccttggtctttctgtgagcagccccatcctgaagccacctaggggctaccagccacagtcatctcattagcacacaaaagatagcacttcggagattccgggggtttcaggagttgtataccaggaaactggaygaagatcaaatacatatttcacaaatcacaggtgcattctgctggctgggagtaatgcataggtcagtaagtttcatgtatcataatagcgttaattcatgattattgaatcgctaattattttgaaaaatgaggccattttaatgtatttttatatgacagtagtgtggtaaagcttgagtttgcacaaatgagagatggtttctcatagggaactttatatatacctatagaacactaagagtaagaatttataggttcagttgaaagaaataaaatatgtggacatcatttatattaatgtagattctttgagaaacccaaatcctgctgttcttaagatttagttttctgtttgaaaaagtcaataatgcagttccgccttttccatggggcgtttgttccaagaccccagtgggggcctgaaacctctgtagtactgacccctacacggtacatactaggttttgtcctgcatatacatacctatgacayagtttataaattaggtacggtaagatatttaacaacaataacaataaaatagaacaattataatatacagtaataaaagtgaacgtagtctctctctctctacctctcaactgcaatgggtgggtggtgtctacagtgtggatatgcgggacggagggatgattcacgccctggggggggacaatgccagatctaatcacactgctcagagtggcacgcaatttaggacttagggattgttttcttctggagttttctgtttaatattttcagaccaaggttgactgagggtcactgaaactgcagatcggggtacttctgtatcattttaacaagtaaatcagaaaccaaaaaacggttgacaagacatcttccatggcgatctggcctgccatcgcgactgggccgctctctcaggaacagcctgtgaaggagcatgaggtgctgaggacggtcttagggtgtgcctcaggccggagagcagggtgtcggggtgtagctgccatttggtgtttctaatctcttctggtagcggcgagttgaccttgccagtgtccatgcctccggtccctatgattccgagtcctaattaggtgcagaaatccagaagtgccaagcgttctgtggactgacacagtcacagtcatttaatgaaactgttccagttctgcttttctttacttatgaccagaaatttcagctaaaatacagctgtttgtgaatacccttgggtgggaggggtcttctggggtgggtgtggctcatggggagggatggggctgcccaggctggggagtgagcggaggagaaatggcctcagggtgtcctggcagcgcctgatggctgatgtgtggttcccaggggctgtggggggaggtggggaggagcaggagggctggcgcctcactctcagtgtcttctagagaatattaattgtaatttacttgtgattatgacatctgtatgctgaaaccaagatgtcttagcgatactttattcttttttaaccctcatctgaaattcctgacaacaggtggtttcgatggtggccgcttcatgggcgtctggggtgcgggtgcgggtgaggctatggagtcactgatttctcttctcttctcttttcgagacagagtctcactctgtcgcccctcagtggcgcgatctcggctcactgcaacctccgcctcctgggttcaagtgactctcctgcctcagtctcctgagtagctgggactataggcacgggccaccatgcccagctaatttttgtatttttaatagagacggggttttcccacgttggccaggcaggtctcagacttctgacctcaagtgatctgccctccttggcctcccaaagtgctcaggttccagacgtgaaccaccgcgcccggccagtcattggtactttccgatgtgctggtcgattgtaactgggaatactggattccactttactgtcatcaagtgcgctttcctgggtgaaatctggaatggaaatgttgcagtgtgtgaaatgaccttccacacaaaaattgcttcctgtgcggaaccattggaagtgggttaagcatccaccgggtgaaactggaattgagcgggacgtgagaggagaaaggcacaatggcggggccgtctgtgacggtggctgtggtagaggagcccagcgcgctccttggaaggcccagggcgggctgtggcagggccctcccacctcagccaccccgtctgcagcagtgtctcccagagcagccttcttcagctgggtggggattttttcagctgggtgtggttgtgccttccggctgcagcgtcctcctcctygtctttggtgaggaccctgcgtggtggaagctgtaagcacagctgaaaacaggctggctggtgcgatgggccccacggagcttccccggctgccagcttcctggacaatctgcttcttctrtgtcctctcccacaacccgttttgaattattctgaaacaaattccaggcatcattttatttcatctgtaaaccttttggcatgaacatttcttttttttttaaaaacttttttattttgggaaatttcaaagctaacagtggagaagcatgtggtgcgctccctgcacccacctccaacccccaatttatcgctcatgtctcatctctttctcccgtcccgttccacctgggctattggagaccgcatcctagacattgcatcctttcatctacagatggctcaccatgtctctccaaaagacagggctctggagtgtcactgtgaacaccatcatcacacctaaccttgactgcatttcttagtatcatcaaacatccagtcagcctgggtgtacattttttaagtattttacttaataagaaacggacaaaccccagcaatgtgcttttccctggaaagtgacttgtgacagccgtcttcctgcatgagctgggcggcctgtctgttgttccctggcagtggcttcctcatgttgcctttgactggaggatctgctctccctgtggccctgctgccttcatcacacattcgtaatgctgggagagccaaaatgcaccaggcttttggcagctgcttcacttggcctcatgcatcagatcaggaggcaaaagctatggtgtctaggggccctttgtggaaggattcatctgtaaatggtatgcacagacgaggaggctacctgggctgatgagaacatggaacaaatactgtgttcagggcacacccaggcactggagtctgcatgtattctttgggtcctgagtattttgtagtcattggaaacaaactaggaacaaaagttttgccaagacacactcactgactttaatctgctgttaatttttttgcattttttagttaaccaaagcatctaaaacctttttcctgtaatttatgtttgggttagctgtgaagaagctaaagaaactaccaaagaagtagtccctcctgtccagaccactttcttcccaggatcctggggacagtgcaacctcatttgactgccacagcactgcctcttttgaaatgtcttatgcatgcaagtgtgggctccagaaatgtttgctgactgaatgagtgatggagcaaactccctgtaacatgagcatgaaatgcaacaggggcaaacctgcaaaaatcaccagatccggtgtcttggctgcgtttcatgtctgaataagcgggcatcctcctgagcctctgggggtgaatacagtccttttctgtgggtcacatgacaaaataaccctctccccaaatctctaaggggtgaagatttgcctgatttattgtttatgtattaactcatattcttggaacaaaatcaatggccyatgttccagggtctgttgaactgatccatgtgtgtccctgatggcctttcctccagtaccgtgtccagttcaggatcatgtcttgtgtctggtttctgtgtctctttgacctccttaattctggaacagttcctcagctttttttttttttttttgtcawttatgattttatttttaatattttagtctcctttttttttttttttttttttgagatggagtctcgctctgtygcccaggctggagtgcagtggcgygacctcggctcactgcaacctccgcctcctgagttcaagcgattctcctgcctcagcctcctgagtagctgggactacaggtgcctgccaccacgcccggctaattttttgtatttttagtagagatggggttttaccatgttagccaggatggtctcgatatcctgaccttgtgatccacccgccttggccttccaaagtgctgggattacaggcatgagccactgtgcatggcctagtctcccttctttaaaaaatttttaatgcgtatgttgcttgggttcatctgatgcttcctcatagttggagtcaggttgtgccttcctggtagtggtccgtgtgagcaaggggcagtccttgggtcccacatccagacgtgcatgtgttcatcctgggcgaggttggttgtggtgatctttgctgatatctccactgtagagttaccttttttcctccatgcagctaataagtgatctgtggggagactctgagaccacgtgggtatctgctcctcatccgattgtcccccttgggttggcgtcgtttatgcttcctgcaggaggaggagccccagcccagctttcccacagacctgcagctggcatggcacctcctgtccccagggccccctgtctcctcactggtgggtagatggttgacttgtccatcaagcgcacatgggtctggactcagggatccctgttttcaaagtcactgcttctgattattttggtacaaattgtcccagatttggccggatggagtccttgaggctggcccctgtgtcctatggcatccttcgtcctgttttgtgtttgagtactttctggcttcagaagatgcttcaggctcatcttcatctctacttattttgcccatttttctgtartttttgcatttttcatcaaatattaaaagttctttgtatgttaaggatatttgctctttatctgtgataaatagtgcagatattttctcctcattttgtcatttatctttttattttttttcctggctgtgtaaacattaaaacatcttttaatgtagtcagatatataagttctttcttttattgtatctggattttgagtcagggaaaaagcctttcttcgttccccagtcatagaggaattcacccatattttctcctcgtgcaatgtttctcctgccctttttttttttttttttttttttttgtctagatctcttgtttgtggtgtgagggatggatctgattttatcttttcccagtggccatctggtcccactaccacttactcagaagtccccctttgccatggtgacttaatgtgctgtctttatcacatactctgtctttatggatagtgcatctgtttttggacttttactctcatgggctgccctgtctgttaatgtaccatggccatactgttttaattttggaggctctgttgtgtgttttagcatttggtaaggcaagttcagctttatggttcttsttttccttgcttttctagcttttcttgcatgtttattttctggattaacttttgtatcaagaggtctagctccaaaaaatgctgattggcattttaaaaattgggattgcagtaaatttatgattgaatttagagagaattttacatctcaaggatgtttagttgccctaaccaagaacaggatgtctttccatttgttcaagtctatttttgtgtctttcaggaatgattttaaaaatggttttaaaatgtagatttttaacaattcttattaaattttttcatgggtatttaattttttgtgctgctgttgtaaatgggatgttttctttcattatattgtctgaattagcactgtgtttttattttgtttttgtagacagtcattattatttaagcaattttactagcattttatgtagctcttattatataccgcatgctgtctttaaaattaagctttgtattttgaggtaattgtagattcatattgcagttatgaagagtaaagcggggagatttgtgtcccctttccctggttgctcctgtctgagtctgttttctgctgctgtaactgaataccacagactgggtcatttatagtgaatagaatttattggctcatgcatggttctggaggatggggagtccaagatcaaggtgccagcatcttgtgagggccttcttgttacgtcactccctagcgaaagggcaaagagagggtgagcaagagaaaggggggctgaactcgtccttgtagaagaggcccattcccgagacaatggcattcatccattcactccaccctcatggcctcaccacctctcatgaggcyccacctcccagccctggtttgttggggattaaatttccaacacatgccttttgggggacatgttaaaattatagcaccccaaatgttacactatcttttgrtgagcggtagttctgattttaagtctagctggcctactttttcttgcacgtgggatgctttctgcctgttccagggcaggcagctcttctctgtccctctgctggccccacctcatcctctgttgtcctcttccctccttctgtgccctggggtcctggtgggggtgtgactgtcaactgcgttgggctaacttttttccctgctggtggcccgtaatgaaagaaagcttcttgctcccaagttccttaaatccaagctcatagacaacgcggtctcacagcaggcctggggccagcctcacgtgagccccttccctggtgtagtcactggcatgggggaatgggatttcctgttgccctactgtgtggctgaggtgggggttgcttcctggagccaggccttgtggaagggcagtgcccactgcagtggatgctgggccctgaatctgaccccagtgttcattggctctgtgagacccagtgagggcagggagggaagtggagctggggtgagaagtagaggccctgcagggcccacgtgccagccaccaggcctcagactaggctcagatgacggagagctgcacacctgcccaacccaggccctgcagtgcccacwtgccagccgctggggcccagacttgctccagagggcggagagctttacaccggcccaacccaggccatggctccaaatgcgtgacagttttgctgttgcttcttttagtcattgtcaagttgatgcttgttttgcagaggaccaaggctttatgaacctattaccctgtgtgaagagtttcaccaggttatggaaatttctttaaaaccataccacagttttttcattattcatgtatatttttaaaaataattactgcactcagtagaataacatgaaaatgttgcctgttagcccttttccagtttgccccgagaatactgggggcacttgtggctgcaatgtttatcctgcggcagctttgccatgaagtatctcacttttattattatttttgcattgctcgagtatattgactttggaaacaaaagacatcattctatttatagcattatgtttttagtagtggtatttccatatacaagatacrgtaattttccgtcaatgaaaatgtcaaattctagaaaatgtaacattcctatgcgtggtgttaacatcgttctctaacagttgttggccgaagattcgtttgatgaatccgatttttccaaaatagccgattctgatgattcagacgattctgatgttctgtttagaaataattccaagaacagtttttacattttattttcacattgaaaatcagtcagatttgcttcagcctcaaagagcacgtttatgtaaaattaaatgagtgctggcagccagctgcgctttgtttttctaaatgggaaaagggttaaatttcactcagcttttaaatgacagcgcacagcctgtgtcatagagggttggaggagatgactttaactgcctgtggttaggattcctttcccccaggaatgtctgggagccactgccgggtttgctgtccgtctcgtttggactcagttctgcatgtactggatccgatttgaggactgagtagcttctggttgatggcatctggcttgtgaacctccgctgttgctggcagtggctgtgcygctgttgtgacctctgggctcctggttcttcctgctgctcagccaggaggtagaggcaccaacgccagcctggctgcctgccacccccagmtcttcacctggtggggctcagtctctctggccttgtgaagttcgcctcaagggccaagagctccgtgtccttcagggagaatgccggccagcgagcgagccatcgggaaggacttgccctcagcccgtgccctgagctctgagttccggagccacccgccgcttgtgtgccccacctgtcatgctgctgggggacaccaggctccacctccaaggatgctcctgggtctgtgccacccgccgtgtgcggctggttgctctgtttcctgcgcctgtatggtggtcatttcacagggtgggagctggtgcacagggtggatggtgcctgcgaggggtcagccctgtccctgctgtggctctcacaccacgtgagtgtgactgcgcgtgttcccagcccagggcctgagctgctttcctcacacttatcttaggcctccctgtctccttcgtctgcataattatagacctacatttctctctcttttttctttatgtcctctgtgatttgtgtgatactaggaacattcagagatgttttgacgcagtagtttgtctttttaaaatttgtcctcagccaagtgccacatgtcacctccatcgaggtggcagttcccctgggcccagctctctatctggataaggccttgagacagtggagcgtgagtgcgctgcttggcggggaccccaccctgtcattacccagagaacggccgccatccccttcactgtgcattcccagttcctggggctggaggtcccagcagaactgggcccagggccagaggctgggtgcctaggcaagagtgaaaaggtctcactgaaaatctaaacaaaatgaagctcgtgaagtaatgtgatgttttcaccttcgtctaagtaagttcaggttgatctgaggacagaagccatcaagggcctgtatgactttccagtggcttctgtaacaaagtgtcacaccctccacagctcaaagcagcggaaatgtgtgctctcacagctctgaggccacaggtccacaatctgctctgctggcaaaccccaggtgtggtagggctaagtttctccccaggaaaccccaggtgtggtggggcccagctcctccccaggaaacccctggtgtgacagagccgagatcctcctcaggcaaagctcaggtgtggcgggccgagctccttccgaggaaaccccaggtgtggcaggactgagttcctccggaggttctgtgggatggggcctccctgcctcttgtgggttttggggctcctagctgtccttggcytgtggccatatcactccgttctccgccccctcrtcatgtggcctcttctctgtgtctccctctgtgtctgtctctctctcccctgctcctacagggatgcttgccattggagttagggccagtctagataatgaaggattatctcatcccacaacactgtaactaatcacatccacagagacccttgtttccaacaaagccacagccacaggttccggggattaggctgagagcatctttttggaggacacattgagcccgccacagggactctggtttgtagcatttccagaggccaagggcctgttttctgtgagcggctttgcgtggtaaatgcaagtgtggcacttctgttccacaacaaaacctgactcataatccaagtgtattcctcatttgtcttttgtgtattgtgtattttgtcttttgtgtatttgtacttgtgtatttggtgctgttatacttaaaaagtctaaatgggagcaattcggtgtatttggggctttttttttcttttcagtttgtgtgaattcaaacccaagttgggcaggaaaaggaatgatgaagtagtggatgtcatctcaagcactaggatccactggctgtaggagcgtgttagactcactgtgactctgcttgtgcttggccttctctgcagagccaggtggttttcgggcagttcctgtctgccggtccctctgtgggctggcagtgagcaagtgtgggcaaatacatggcgactggcttcccaccaggcccccattcgcctgttgaggtctcagaaagaatgatcaataattggctacacagattttttgttgttgttattaaagctgttaaacagaaaagtgaggaaaaatgcatgtttatgtaactgacagatactttgcacagaggagatcatctactgatggagaaccaaaaagaactgtgaaattggaaaattagatattggaatcccctaagtggaaaattagaagttgtatagatagcatgaaaacgtagatacatattttactttattttgtttttgatcctgtaataatacacttctgtattttataatgataactgtttacaaaagtagtctagacattgttgaatccttatagtgacaagttttcctaatacatttatagtaatttgatttttttgttgttgagatggagtctcactctgtcgcccaggctggagtgcagtggtgtgatcttggctccctgcaacctccaccttctaggttcaagcgattctcctgcctcagcctcccgagtagctgggattacaggtgcctacaaccatgcccagctgatttttgtatttttactaaagatggggtttcaccatgtcagccagggtggtcttgaactcctgacctcaggtgatccacccgcctcgacctcccaaagtgctgggattacaggcgtgagccaccgtgcctggctgtaatttgatttttaaaaagcagtggagttataatcaccatgtcgttggtatgctatagttgctcagcactgttttataatctgttgtcagctaactggayggggaacaggaagacattgtttttgtatttggcaaatgttgaaagtgtggcttagagtcatatgcttccatttcttacttttctgattctatgtccttccatggtgtgggtgttttctcattgaattgccagggaccacccaaatccccgctcaccctgtgacgggggcgtgaatgtggcagtaacctggcccatgatctggaatttagctgcagcaaagggctctgcagaagtggatggtttgaagtccgattgtgatgggaaaagagattaatgtgaaacaagatgccgattctaaatttttattaggatataacaggatgggatatcatctggcaggaacagtctggaagaggctaacttggaagaaacaagaactgttttcttttctgtattcacatctgcttgtatatgaagttggctgtggtttagcccagtagagaccatggggccatctgtgtccggattttagaggccttgagagcacgcatgcatgcggggatctgtgtgggacctgagtgcagtctgggcagtgacactrgtgtggctgttccccactggcatgtccagccaaataagcaaagtcccttaggacycctggccaccaccactggagtcttgcctcstccttcgctcccagggcagcgcaaattcctggatcctctgggtgtctctgttcctggtggatgctgtgctccacccatcctaggcagggcatgggcgtccattcgtcaccaagagtgggacgcgtcctccttccgggccacctcctcgctgtgaccatggctgcgcttgcgatgctgcctgggttcatgccctcaggcagcagtgttaagagggatgcccttggctgccttagccaagcccgggactgggagcagtggggagccaccccattttacttttgtcacccctgaagggtgcagctgtctctgttagccagggctggggggaagccrtagcaagtggagcactgtaggaagtggagcactgtgctcatggtccagtcaccacctcctgcttgggggttgtttctcctgcgcatgggacacagaggctggaagtcccaggtggaagtggacagctgctcctccttcctctgggctgttccggtggctctggtctaggcagcgctccgcagcacttactgatcagtgcagctgtgatcttaggagtggaaagagctctaactggggctcctggtcggacccgctgttgcctgtaccccatgggcctctggctaatcggcttcctggtgacttaagtgtgctccacccaccaggggagcctgcaggatctgcaggcagggccttggttcagagctgatcacctctggagtcctcttcaacaaggtggctctgctggactttggggtccaaaaaagaccggggtttagctttagtcctacttctttttaagtaaatggatgaaagttggtaattttaaaactctttactcagtcaagccgtgaaaccgtgtttgtgacaatgactttaatgtggttgtaacccaagggattggttttcacagtgtcctcattccttccatttggccagccagagagaagcagaaagaaggaacaatgcctggaatttgacccgatcgatttcccaatttcctgaaagctacagatacgaaatgtgctattgtaagctggagctttgtggagaaaatgtgtgctaataatgctgarttgaatatacatgtgcattcttcgttattttaccaaatttctgattaggaattcaaagtgctgttcctagtattttcctgacggatttgagttggtgttggcaaggtgcagagtgtttacaaacctatggaaagatccttatgggaacaggggttcataaaacagtgctggtctctaagggggaagccatcactaccttgggccagaaaaggagactcatgggtgggcaggggtcctgactgggtcggtggggtcatgtaactgaagactatctgtgccctactgtctgcactgtggatgccatgtcctcctcctgccctagttccttttataaaatgcaactgatgatccctgccccttgctacactgagctctcgttgaattttacacatgaaagcactgttgatttcccctctccaggtgacttctgtgataactcatacaccgatgtgctttgttttaattctaggcagcttcggtcacctctctgtccaamctggcatgcatgcacatggtccgctgggctgtttggaaccccttgctggaagctgattctggaagggtgaccctgcctctgcagggtgggatccagcccaacccctcgcactgtctggtctacaaggtaccctcagccagcatgagctctgaagaggtaaattattaggtatttcttatgcatctccggtgagcttctagcaagttcattcattttcaaaagcaaaagttcacaaatatgtttgcagatgtttcatttacagaatttttttcatgtcatgggtatgcctttagaaagattagtatgatgtttttatgtaaacctgataagaccagttttatcatgggttttattgctgttcacatactgatttcctgggatgacttggtgaacctccagctgatgtgtacacactttgcagcaagattcacctgtgtggcgtgcacgtttggagcattggagcttgggcctcatgtggcctttaccagtaggttttttggtggatgagtgctgaggtgggagccggttctggtttctagccctggcttatctttgtgacttatcactaatgcttgttggaccttgggtgtgtaccaaggggtaggaccacagcagagattctcaggttttttttttttttttaattctgaaatgaaatgttctctgcaccccaattaagacggcaaaaacaagtagagcgaagtgggttgaagtgtgtatgagggtctcatccccagcctccttggccccattggcggtgttggaggatggttagcggtgacccagggcaccacagacagtgcgaaaccctgctctggcagatggctagagtccgttgggctctccgaggtgtggcagagtttctgctcggctgcagtgtttggtgagattttaaaggtatatagatgtaatatttagaatattacctaaacttagttgataaagcaatggcaaggtttgagaagattgactatgattttgaaagttctgcctatggtaaaatactgtcaaatagcattgcatggtactcttttatgacatgaaaagtcaattgatggagcaaacttgcattgtggtcttgttttatgaaagctctgcaggcatcccaaccttcagcaaccactactctgattaggcagcagccatcaatatcaaggcacaaccctccactagcaaaaagattacaatgttctggaaggcttagatgatccttagcatttttttttttttgagacagggtcttactctgttgccctggctggagtgcgtggcacgatcatagttcactgcagccttgaactcctatgctccagcaatcctcacacctcagtgtcctgagtagctaggactacaggcatgtgccaccatgcctgggtaattttttaatttttgtagagttgaggtcttgctgtgtttcctgggatcatcttgagctcctgggttcaagggatcctcctaccttggcctcccagagtgttgggattataggcgtgagtcaccatacctataatggcacaatggttagcatttttttagcaagaaagttttttkttttttttttttttttttgagatgaagtcctgctctgtaacccaggctggagtgcagtggcgcagtctcagctcactgcaacctccatctcccaggttcacgcgattcttctggctcagcctcccaagtagctgggattataggtgcccaccaccrtgcctggctaatttttatatttttagtagagatggggtttcatcatgttggccaggctggtcttgaactcctgaccttaggtgatctgtgtgcctctcaaagtgctgggattgcagatgtgagtcactgcacccggccagcaataaagtatttttaaattaaggtaggtacagtacttktttttttttttttttagacatatgctattacacacctattgactacagtatagtataaatacaacttttaaatgcactgggaaaccaaaaaattcagtgacttgctttattgtagtggtttggaactgaacctgtagtatctttgaggtatgcctataattacattacgtgtaaatagtgtaaacacaccagtttaaaagatattgtcaggcttaatgaaagacaaagcccaactatatactgtctataagaagtatactttaaataaatataacrtaaattaaaagaatggaaaatattcttttcaaacactaaaagaaaactggagtgggtatattactattgacactatcagacaaactagacttcagaatacaggaaatttccaggaattaagagagatagtacacatgataaaagggtcagttgccaagacataacaatcctaaaattgcttgcatctaacatagagcttcaaaatacatgaagcaaaaactgattgaactgaaaggagaaatggacaaatccacaattagagttggagacttcagcatcctctctaagtaaacaaagaacaactagctattccatcagcaatgatacagaaggactgaacatcgccatcgaccaactggatcggaatgatatttatagagcactctccccaacaacagcaggatacacgttgtttacaagtgcacatggaacattcatcaagatagacaatatccttggtcataaaacaaacttcagttttaagagagttgagattatacaggatgtattctcagattataatggaattgaactagaaatcaataacaaagataataaaaattttcaaccacttggaaattaaacaatatgtaaaaatccataaagtaaagagtaaatctcaagggaaaatagaagatattgtgaacttaacagatatggaaatacaacatgtcaaagttcgtaggatgcagctcaaatatgcttagcgttaggtgcttatattagaacagaaaaaagatcttaattcagtgatctgatctttgtcttcagaaactagaaaaagaagagtraaataaacccaaagctattcagaagtcaataacagcagaaaccaatgaaattgaaaacaaaaacaatagattaaaaattaaaaaatagcaaaaacccagtgaaacaaraacctgtttgaaaatatcagtaaaactgatgaacttctagcaagactgaaaaagaagggaggacacaaatgactaatattaggaatgaaagaaggaatatcagtacagacctcacgggtattaaaaggataataagggaatactacaaacaattctctgcacataaatttgacaatttaggtgaaatggatgaatgaatatgaaactccacattgccaaaactcagccaagatgaagtagatgacctgagtagtcctataactaatatgtaagttgaattcatagtttaaaaacttttgaaaaagaaatattcaggcctaytcactatgaattctattagacatgtgaagaagaaataatgccacttttatayaatctatttcagaaaacagaaaagatgggagcaattcccaactcatgaaatgaagccagcattaccctgatatcaaaaccagaaaaataatattaataataacaagaaaacagaactgtggacccgtatccttcataaacataggtgcaaaatactcaacaaaatattagcagattgagtccagcaatacgcaaaaagaataatacactatagccaagtggagctttatccagagaatgcaagtctgttttctatttggaaatcaataaatgtaattcattatagtaacagcctaaagaaggaaaaccatatgatcctggcaattgatactgaaaaaacatttgacgatattcagcatcagtttatgattaaaaactgagcaaactagcaataaaagaaaacttccttagcataatcagtgatgtytacaaaaactctttagttaacatcatacttaatggtgaaagactgattgctttccccctaagattaggaacaagtaaaggatgtccactgttagcattcaacgtcatgttcagtattgcactggaagttgtagtcagtgctgtaagtcaagaaaacaaaagacctacacattagaaggaagaaacaaaactgtccttatttgcagaaaacgtgattgtctatgccaragattctgaggagtctacaaaaaagtccttttagaatgagtaagtgggtttagtgaggttgcaggataacacaggaagtcarcatgaaaaatcaatcctatttctgtatactagcactgaaaaattgaaagcaaaatacagaaacagtattgtttacaaagcctgccctccatgaactaaatctaacaaaatagttaggggatctgtatgctgaaaacaataaaactgtccttttgctagttgtcattgtggttattcttaggtgaaatcaaagaagacctaaataattggagagacgtaacatgtttatgtcttgggaaactcaacatagtaaagctgtcagttctgcmcaagattgatctagagattttatgcagtttcagtcaaaatctcagcaggatttttttggcgatatagacaagctgattctgaaatttatatggaaagctaaaggaattagaagagtcaaaatagttttgaaaaaagaacagtaaagttggaggaatcatactacacagtttaaacacttactgtacagctacaytgattaatataattagtatcaaggaattcagttaatggaacagactagagagtccagaaataaagtttggaagtgccttatgaaattaaatatgccatatgacccagcagtcctactcttggagaaatgaaacctgtattcacacaaacatatgtgtttgtagcaggtctgtttataatcacccaaaccagaaactacccaaatgtttgtgagtgaatggataaataaactggtacatccgtacaatagaatatcactcagtaataaaaaaagaaacagtttgatgtgtatgtaacaacttggatgaatctcctcagtcttatgctaaatgaaagaagctggtctcaaaagttatacattatgtgattccatgtgttggacatttttttgacattctcaaaaagacgaaatgacagtgctggggaagcagtcatagattgcccgggttaggcatgggctgggtgtggctgcagaggggcagggcagggcaagggagcaccctggggggatggggctggcctgcaccctgggtgtggtgctggttatgtgaatctgtgcatgtgccaaaacccacagagccatacccagaataaagatgtcagtttcacataggtcaatgacaacattcacaactcgagagagattgcgatttctgcttgggtaagggtcattccatgatcatatggtctgcagggcttttaatgccacaccaattgctttttgctcaaactacttgattataatctgagaacatgtggcatcaagaagcctctgatttcacgtagactttgttttagggcagagcctgctgttcctggttggatcgttctgataggcgtgctgatgaagggagtggccatcactgctcttctggtccattgcaggtgaagcaggtggagtcgggtacactccggttccagttctcgctgggctcagaagaacacctggatgcacccacggagcctgtcagtggccccaaagtggagcggcggccttccaggaaaccacccacgtccccttcgagtaagtgtttccrgagagctgactggccaggcacatggcaggcagcacttccatctcttcccggggaaaggtacttagtctagtacggtaatcaccacatttgtaagataatcgtcgtagattgcattaatggaatctgttagttgggtttttgcttaataccaaggtgtagaattggacagtgatgaagtgtggcccagaagcttgtgcttcagcccagagtcagctcagttacttgacagctccccaactaagcatttaaaaggacacgtcacatggatgccctgcaaatgtgggacccgagagttagagggtggtcgagagccgaggaccgccaccttgcgtttgcactgttgaagtagccgtctgtctactcaccttgaagccctgcccgaaagttaggagtgtgtgatctgagtctgtggctttaagaaaaggagtcacaattggctacaagcagcaagggctgccagcagaggtagagtcctggccctgtgggtggcagcaagtccacatggttaggaggttaaagagttcttattggccgtcagcctagctgcttctgctgaggcagtaccctgtgctcagagcctcttggtttagacccatgtcctggttgagaattccacctatactgaagtgaggggcggaaggtacgagggagtgttggagtagtccacctgaatgagtatggggccttggctctaggcgtctggagctctcaccactgaaggttctaggatccctagtcgcaggtgatgacttccttctttctgcctgttccagatggcaagatagggaatgagcaaacgtgcaagcccgggagggagctttgtgttcctctgggctccagctggtgatgcccgggtgtcgagggaggagttgctttctgtgctcggctatggccccaagtcctgctacaaagctgctggtgcttccatcactcaggaggggttttcttcatggattgagattctaatttatgggaactggtcttgttgaatttgattttacagttggtggaagcagcacatgcatttctaagttgatgaatttgatgaagttgatgattttctgagatacctaatacagtgcaaatgctatgtaaattgtactgtttagggagtaatgacaagaaaaaaagagtctgtacgtgttcagtgcagacacatttaaaaaaaaatattttcagcccaagtctggttgaattcatggatgcagaaaccatggacctactctgtactctgatttttgattaagttacttaaaagtacaatagtaatacataataaacatggtgtttcaggattctctgagctatctaagaatattccggtaccaaaacttaatagttgatttctttgggacaaactacatcattaagtattttccttcttttcatagaggtgatgcatttgatggttttaattgttttgttttttcagtgtttgaattttgtgcctaacagcttgttctcaagatttctgtttaccaccagtgtgtacattaataatcccatctttataaayggcactgaaatgtacagtcccccttgtactagaatcccttgtggtggtgggtggtaggcatgcatgcatttcctgtcagagtcggtttagaatgaatttccaatttcatttgataaaattgaatgcattcaaggcataggacacataatttcaaaaaactaaacaaagggtcataataaaggatcatttaaaacaacccattcctggccaggcacggtggctcacgcctgtaatcccagcactttgggaggccgaggcaggtggatcacaaggtcaggagatcgagaccgttctggctaacacggtgaaaccccgtctctactaaaaatacaaaaaattagctggatgtggtggcgggcgcctgtagtcccagttacttgggaggctgaggcaggagaacggcgtgaacccaggaggcagagcttgcagtgagccgagattgtgccactgcactccagcctgggcgacagagcaagactctgtctcaaaaaacaaaacaaaacaaacaaaaaaaaacccattccctgcttacatctgatatctttccttctttgacatacactctttgacatatagttatattttaaaaataaaatacctatcaacctttgagaaacataattatgaaaaacggaggaccttagattataaattgggtatattttgtaattaaatacraacatgattagagttatccctcggtatccgtgggggactggttccacatgctcaagtcccttatataaaatggtgtggtatttgcctgtaatctacgcacatcctcctctgtactttaaatcatctttaggctacttacaatacctaatacagtgcaaatgctatgtaaatcattgtactgtttagggaataatgacaagaaaaaaagagtctgtacgtgttcagtgcagatacaaccatccattttttaaaaaatattttcaatccaaggctggttgaattcatggatgcagaacccatggatccactctgtactctgatttttgattaagttacttagaagtacagtagtaatacataataaacatagtttgcccatgtctgtagaaatgcctgaacagagaatgaacctgtatagctagctttcagraaaaatatgactaccttctctggaaagaaattttcatgtgtttaaattatgatacaggccaggcatggtggctcatgcatgtaatcctagcactttagaaggctgaggcaggaggatcacttgagctcaggagttcaagaccagcctgggcaacatagcaagaccccatttctactaaaaataaaacaaattagctatgcgcggtggtgtgcacctttagtccccgctactcaggaggccaaggcaagaggattggttgagcccgggagatggaggctgcagtgagccgtgattacgccagtgcactccagcctgggcaaaagagtgagaccttgtctcaaaaataaataagtaaataaagatatagttatggcactggaaaagagcagctagttatgttttgaagaccttctaatcaaattaactataaactctgatgggctgatcctgctgtcgggcttttgggctggatcaatttgtggatgccatctgtgggctttggttttacttccctggctgccctgttttcatgaggcgtttggaggagattttaaaaccagtctgccactgcctctgcttgcccagaatgattctttaactgatttttttgccagggttccttgagcttcttagatctctagatttatagttttcatcacatttggaaaaattgtgktcattatttcttcacatatttcttctgtctttctctctcatcctctcattcagaggccccagttacgtgtttatcaggctgccagaaattgcctcacagctcgctgatactctgttcacttttattcataacctccttttgctgtgtgtttcattttagatagtttctgtcttcaagttcacttcaagttcttttcttctggagtgtctgatctgccatttatccttttcagtatacttttcatctcagatattatagttttcatctctagaagttcgtctgggcttgttttattcttccgtgtcttgacttaacatgttcagtgtttcctctggctttttgaacttaagaaatacagttataactactttaatatcctggcttgctaattctaatatctttgtcagttcaggatcagttttgattgatagatttttgtcctgattgggttctgttttcctgcctctttggatgtctgataacttttgatgggctccagatactgagaattttctcttactggatactgaatgtttttgtatctgataaatattcttaagctttgaaaattgttagatccttttgggtcttgctcttaagattggttaggtgagatcagatcagcatttcatctagggctgattattcctcactgagatgacaggtgcccccagagggctctgcccggtgtcccatgaagaatgaggattaccaggtggctggagggaacagcgctatgtctgcctgccctgtgaagaccagsccctattccctgtaatcctctctggtggttctttctcttttggccttaggaagtttcctgatccgcgctctactgaatgctagggtgggaccctctgtaaatggctggcattctctctctgtgctgctcatcctgtctggtgcaaactcactgaacacagtaagctggggkcagggtaggccttccctcttctgtttcccagcccttgggatcactctcctttgttgcctgaagtccactgtcttgaaaaccactgttctacatattttgtgtttaaaagaaaatgtattttagatgggagggtcaatctgatcactgttactcttcttggccagaagtagaagtcctgttaatagtctcttggctgctgaaatcatccccaccggggccgatcatcccggggtttgaaagcgtcttctagctgtgtgtgctacttgtgattyactcaccatgctgcgtgttttccggacttttgagtcttggctcatgctctccgcctggtgtgtctttctcccataygctgcatttattttcttttaggatatattccagggtttttgttttgttttgcttttagagataaattctcacttcgttgctctggctggagtgcgtgccataatcacagctcactgtagccttgaactcctgagctcaagcaatccaccygcctcagcctcctgagtagccaggactacagggagtgccaccgtgcccggctaagccaggactgcaggcagtgccaccgtgcccggctaagccaggactgcaggcagtgccaccgtgcccggctaagccaggactgcaggcagtgccaccgtgcccggctaagccaggactgcaggcagtgccaccgtgcccggctaagccaggactgcagrcagtgccaccgtgcctggctaagttttttgttttgtagagatatggtcttgctgtgttgtacaggctgctcttgaactcctggcctcaagtggtcctcccaccttggcctcccaaaatgctggggttattttttaattaaaaaaaaaaaccatagtcaagaatagccaaggcaattttgaagaaggagggaggcttcacctttcttagttttcagacttactgtaatgttctaatttctagaacaagtatagcattgatacagagagagataaatagataatgggacaaaatataaagtgtgatatgtgacaacttgaagagaaggaatatattagtttctggttgctgttacaacaaattagtgacgttgcaacaggagcttattatcctaaaattctggaggtcagaagtccaaagtgggtcctatagtcttaaatcgagggctcagcggggctgtgctccttctggaggctccaggggaaaatccatttcctctccttttccagctgctagaggccacctgcgtcccttggctccttcttccatcttcaaaggcagccatgtagcactttccagtygtcactgaactctgaccctcctgcctccctgcctttcacttacaaagactattgtgagtacattgggcccacctggataatccagggtcatccccccatctcagggtcagctgatgagcaccttagtcycttggcattgaacatatgtataggttctggggttaggacgtgggtatctctggggtggcagcagttactccgcttaccgcaaggagtagcagtcagtaaatggtgtggcgtgatcccttgcccacrtggaaaatataaaattcagtcctagcttcatgtcatgtacaataataaattccagatggcctaaaaaccaaaacttcagaaatgttagaattagaagatcagaaagaggaaagattatagaaagaagtcctccaaatcaataagaaatagacagcaggaaagaaaaatggacagtgctcagcagttgctgggcgatcgctaacgctgtcgtcatatgaagagggaatttatagagaagaaaccagaataaccaataaccataaacaaatgaaaacatgctcagtattactggtaatcagagaaatgaaaataaaatgacaaaccgttttattcccctcatattggaggaatccagatgtctaatagtgcaaaagttcctgaggatgtggataaagcagaactcttaccaccgtgggaagaatgggatgtgtgcagccgctttgaagagtgattttgtaatatttagttaatatcctacaactcagaagtgccatttccagacgactgttagagagaacaaccggttcatgtgtataaggagacatgggcgggctcagcatcacagcagctgctggtttcccagtcagggaatggataaactgacttacttggacagtgaaatgctgtgtgtcggttaaatgaatgaaatagatctatgcgtatcaggtggataaaccttcacaaaggcatgttgaatgaacacaagttctgaaaggaaatgaacaatgtggtagcatttaagtaactttcaaaacaattgcatgtattgcttatgaatgcatacttattgaatattagagcagttacttaatgtctgtgtccctgtttcctcagctgtaaaatgggatggattaaatacttaaagtatgaaaaacaaacttgagaaatcttagaaaaagacattggagaatatttttatggcctttgggttaggaaggccttcttaagcaagatagacaaagcataaaccaaagagacgattgagaaataagattatattaaaatataaaacttctgtgtgagaaaagactctgtaaacaaagttagaagacagacctcaggctgaaagatatttgcaatacatatgaccattaaaaattaatgaaggaagtaagatgagaagattagaaagaaggattacagaaagacctcctccaaatcaataagaagcagataaacaacagaaaagaaaaatgggcaaaggatagccaaggattggggggaggatgaaatgagtaaagatatgtccaggtgctcggggctgcctggcgtggagcagatgcccagcgattgtcgggcgatcattaacgttgtccccatgccactgccattgtggttcttctggttggcagcgttgagggaagcgaccacatgtacgtaccccttcaactactggttcaattaacacggggccgccagggcaggagcagctggagcacatctctacggagctcctctggaccccagagtctttgatgggtgaaaacagctaaccccggctgggcgcagtggctcatgcctataatcccagcatgttgggaggctgaggtgggaggatggcttgaagccaagagttcgagatcagcctgggtaacatagcaaggccctgactctacaaaaaacttaaggccgggcgcggtggctcatgcctgtaatcccagcactttgggaggttcaggcgggcatatcatgaggttcaggagattgagaccatcctggctaacatggtgaaaccctatctctactaaaaatacaaaaaatcagctggcgtggtggcacgcgcctgtagtcccagctactcgggaggctggggcaagagatctcttgaacctgggagtcagaggttgcagtgagccgagattgcaccactgcactccagcctggacgatagagtgagactctgtctctagatagataggtagatagatagataagtaaataaatgcatgcagtagctgggtgtggtagcatgtgcctgtagtctcagctacttgggaggctgaggcaggagaattgcttgaacccaggaattcgaggctgcagtgaactatgatcacgtcactgtactctagcctgggcatcagagccagactttgcctctaaaaaaaaaaacaaaaaaaacccacaaacaaacaaacacagctggccctgactgcatccacgaaagtaggttccgggtgggcccagaaagctcagtgttggctatgcctctaccattttatcttagccattctgcaaacactttagggcatgctgactcagatggggcttgttcaggtggtcctccttttctcctacccactctccattcagcaaagacttgcggagagtctgtgatgtgccaggcacttggttaggctcctgtcccagtggagctttaaaaacagacaataaacaaactaccaaatacgtgaggtagcaagaagaatcacgtgccatctgctctgggatgttagtgagggtagctgcatgtggggacagggcactgtgggaacaccctgtaccttctgctcagtactgctgagaacctaaaaaactgttcaaaaaaagtattaaaaaagagagaatgacttgtggggagttttacagttatgtccatcttgatgtgattaacttgtatttgggatttctgtttctacaattgaggcccaattatagaagaggtcagcaaactttttctgtaaaggccaaatagtaagtattttaggatttgtgggcaagatggtctctgtcacagctactcatctccgctggtatatataggcgatacgttaatgaatggacgtggctgtgttctaatgagactttgttgatacgcacagattgttagctgaatcgacctgtggaccatagtttgcagacccctgatctgcagctttctcttatgtcataatccagaggaagctgcccatttttttctgggctttaaaatagtttaaacaaaaggcaagacctgtttcttgaaggtctgataaaacttctctgtgaaaccactgaagggatttttgacaaccaattacatttcttttcatggttattggtctatttatgttttccacttcatcttgtgttaacttttgggatacacatcctctaaaaaaaatggccaatttcctctagtttacaaggatgctgtgataaagtttgtaactaatttaaacattcagtatgcgcctgtgattagattccttccttcgctttctatcttgggaggactcttcctttttcggtcaggcttatgagaggtttgtatatttcattagtctcttcaaagaatcagctgttacttttacttactggttctcttgtttttaagttattaattttttctttaatcttaatttaattctatattttatctttattcatcctctttgaaaagcagaattcttagcttatttgctcatygtgtttaataataaaatcatttaagattctgcaattttcttccaagtacatcttttaccccatttcataggttttgatttggaatgttatttcctacattgttgagttccatttttatttcctttttacctacaacttgaaaatgtctttaaatattcccacatttaaaaaggcatatattaaactttccttgccctctcttatggaaacctgtacttatctgtaaagccctgcctaagggtcttgtccatggcagagctttgttttcagcatcccacagccctttgcagacaccaccttttattttatatccttgtgtgttgtctgattccttccttccctgctactgttcttagagggtattagtcgaatttgctatggtaacaaataatctccagatctcggtagcttaaaataaaaaggtttatttctcactctcgctgcgtgcgcattgcagttggtggtggctctgctcgtcctggtcccagagggtgttcgccatcttgaatattgctgggttgcgccagcaggaaggggaggccttggggaggatcttgtaccatcagttacggctctggcccagaaatggcacacgtcacttctccccctcccgggttagaagtagccacgtggcctcccaagtcacaaggggactggggactgactcatcgtatgcctggaaggtaaagaggtgcagatagttggtgcatttatttgctccacactgaagagtcttatcattgaagcagctcacggtggggactgtttcattcatctgtacattgcctgatgagtcctggcccacagtaaaacattcagtacatatttgtagagtgaatgaattaatcaaaacccttttgtatacaagggatagaaacctgactcaaaatagcttcaacaagagagaatgtattggctcatgtgtcagaaaagcctagaggtagagctgatgttaggcatggctggatcccggcactcaaaggatgccattaagactccatctgttcgtctctctccctcatgcccctaccccctcccctcccctttaagctctcctttcttcagtgttggcttctttccgggtagagtttctccacatggtgagcccaggagctcccaggtaatcctgggcttaggaatcccaacagaaaggccctgattgactcagttgttccagtgggagtcctcctgtctttactgtgtaacacctgatggggatgggggtggggacagttggccttggtcacacacccttcttggtgtgggggttggggccacccctgactgtatggttaagggctgggagggtgattccctaaaggaaaaccaccagaagagagtacggattcagggtcggtgaagttgacagatagtggctgcctctgggttggggctcctggtctcccgatcccagtccagggtctttccctgccactgccgctttggctgcactcttgcattccagctttgcccagctattcttgyattttgccgtcagtgaatgcatagacttgagtagttcctgtgactctttcttttgtttgagaaggacgaagacaggtaagaagcagcctgtcctccttctagaagcctgctgtgcttttagtagagatggggtttcgccatgttggccaggctgctcttgaactcctgacctcaggtgatccgcccaccttggccccagaatgctgggattacaggcatgagccactgcacccggcctagcttgacttcttaagatgcagagctgtggggaaccatgctttgagttcctcaccagaagatttactgtcatatccttggcagagaggagtgtgccttggttactggaaggaccaggagttgaacggtggtgcaaatgagctgtagcagcataatctacttctcagtcactgtttggggaccagcaaatctacatggatggaccctgatttcactgagtttatttaatttggatttatggctgcattcatgtcacattaaatgattaccttcagcccaggttccaagcattggaagacattgcctctcaaaacccaatgtaagagacttttaaatacccactagtgtttaacttatgatggaaacttttcatacttcagtatttcaccaacttatatggttcctttggagatcttaatgatatgcggctgtcactttaagtgaggtactttggctctcggttatgaataatcctttttattttctctgtaacattgcaagggagcaaagtttcattcatcacttaccacagaagagtgtgcattgagccgctagagggcactcagtctttatttttttgtaacttggaatttccctgacctatattttgcttttgaatgttcctctggtggtgtcagaattttggtttgtttgcttaatagatttgaaaacagccatgtagaaggggtcattgcaaacatgtaattgtggtgtttcccaggacacgtggagttagattcctgccccgtggtgcctgctgtgctgctagctggtctggaacatcctctccgacagacagcagctcccttgtcctgggtgagggtggttcagtcaatcacatggtggtgggggagagtctaaggccatggagcagctttttggccaccctccaaccacggaatggaagttcgtgtgcaggtggtaagggtgcattttgctggagaattagtgggacagtgggtcagagcaaggctttgacaagggaggtgacacttctgaaactgaccctggaggtgaccccagctcagggctctggcaagtcacggaactccccactcggcttgggcctgctgaaccagctcctgttctgggctgcctgcgatctggactcctgcagycctgggctgcctgggatctggactcctgcagcacagagtcctgtgctcactcatcatccagttgccccttgatctctgcttaggttttgttcattttcccattcctgttttcaaactcttaggaacaatgactttttacctacaaatagttaggaataaaggcctttcaagtgggtttgccatgtgaattcttagtgtctagagtaccactagatactgactcatcctttattttcacggcctgatgaaaggaagctactttttgcaacccttcttcaaaccccagagactgcatctttactagcgatggtccttcctttcccctgccttttggggccatctgtttacccctgtttgtaacagggccacagtctacccccaaggcccaaggcccaaggcccaaggcctggcccgtccctgccttccaccagctgccatgagttgctaagcaacagcctctgcgtgctgccccctctccctcctccctcaggacttctctctcccacggaattgctgaccccataggtaaatgcaggcagctttgctcagctgggcagttgctcagcgaaatgagcattttcctctgttaggacccctcatccagccctctgctgacccctgtttgctcagtggcaggctggcagcacagctaggcccaggaggacaggtgcgtttcagggtgcgggggggaggtctacctggcacctgctggggcagtcgggccacaggggactggtgctgtggggaccgcattcacgaccccgttcacatttccagaaaggacacgttggcctccatgcatgtgtcctgatgttgagaggcccctgctcccttcagcctaggaagacatctcaatgaagaccacagccccgtcctccactgagctgtttccttatcttcatttctttctgtggtcctgtcatagcgcaggcatctgataaaatgtttgttggaaaatgaatctatggacgtgggaaagtaaaggtggtgaaaacatgtccttcctttccccttgcttctattttcactttttaattggcaatgcgcatgcatattgaaaagttatgtggcttgaggcgacagatagctgctcagtgaaaccctaggtcaggacatggacaccgcagcctggcagtgccgggactcccttgtgtagtcagtactttttatttttttgagagaagatctcactctgttgtccaggctggagtgcaatggcgtagtcacggctcactgtggcttccaccttccaggcccaagtgatcttcccacttctgcctcccatgtagctgggaccacaggtgcatgccaccacaccaggcctttttttttttttttttttttttttttttgtatagataagattttgccatgttgcccaggctaatctcgaacttctggactcaaaacagtcctcctgccttggcctcccaaagtgctgggattataggcatgagctaccatgtccagctggtagtcagtacttttaatctgtctggtgaggtgacgctggaagtgagagagggttgttggtggggaggccgcctcctgccccagccctatccctgttcatgtcctggcccgcgtgcgtgatgaagaagcgaagcccagtgtacttactttgcggggagctgcgtgcctggcggccatggggttggctggagagctccttcctctgttctgggctgtgatgttagtggtattattactctgggtaacaatgttcttttctgttctctgcgttatgtatagaatgatctccttcggggtggaggaaggaggaattctggggaatattgtccctgtgagtatatttgagcattatttgttcactgtacaacttctgcagttcaactcacccacagtgctgagagccatgggcttgagggcatgcctgtctctcttgcgtgtggaatgtgtgtgggttgcatcctcttgcagggccccctccaggcgagtgcagaggcagtgtgaagacgttggcagtgaccaggtgggatgcgtggcctcccggggttgggatcagagtgcaggccctgccttgcctcctgaggcctgtgctgtagttgagtgcagggcttttgagtttcttgaagctaaattgacagaaaagtagacatttgagattttgttgactgtggttttcagcaagtggagactgattggagagtgatagagcgtcagggaaaaggaatcttcagagaggtggagaaacctgccgtggtgggaagtctaagtttttctttgtctctagcaatccatgtggaccatttctggatcacagttggttctggtgtcctgggaaaccagtgacttagtctcttcctgctcttctcagatctggctctgggccagaggtgtgtgctggcaaccccatctcagggccccrctggccacgagcttcttggagcagccgtggaagagctgagtctctgtgctttttttttttttttttttgagatggagtctcactctttttgcccaggttggagtgcagtggcgcgatctctgctcattgcaacctccgcctcctgggttcaagcaattcttctgcctcagcctcccgagtagctaggattacaggcgcgtgccaccatgtctggctaatttttgtatttttagtagagacggggcttcaccacgttggccaggctctgtgctcttcttcttaacgccaggttatttccctgaaaccagggtcctgtggtggctcagccagacgctgattcccctcccagtgagggagcccaggcctctgccgcaggggtgagaacggaggggctccgtgttgggagaggcacctggtcatgctgcttgccgtggaggtctcagctttccattctgtgctgactgtgttactacttcaggctccatcagggacctacaggtgtgtcttataatgactgttaaactaacatttaatttactttaagttttatgggcaatgtaggaatacgcgtttcctagcatgtctcatgggtgtggttaccacgagtttgccagcacacccgtatacactgtgggtttctttcatttttcttttttcttttttcttttttttttttttttttgagacggagtctcactgtgttgcccaggctggagtgcagtggcgcgatctcggctcaccgaaagctccgcctcccgggttcacgccattctcctgcctcagcctcctgagtagctgggactacaggtgcccaccaccatacccggctaattttttgtatttttagtagagatggggtttcaccgtgttagccaggatggtctcgatctcctgaccttgtgatccacccgcctmggcctcccaaagtgctgggattacaggcgtgagccaccgtgcccggcctatcgtcactttttaacttgccgcggctgccttcccagttctgcacacaccggctggtctcctcccatcccattgctcccctgccccacgcaggatctgccgggttctgctgaggtagcttccatttgcaggagcaccaggattgtgtctaatgttttgctgttgtcgcagcgctgccccagacagccttgtgctcgtctgtctgctcaccgcagctgctcctacctgtgtcctgtgcacacgcatgctgctcccggttcagttgctggcccaggtgcttgtcagccaagtcctgttatgtggcggaagtcaggcttcccagactccaccgtggtttttggaagactcctggggcctggagtacagcgggtgctccctggcggccgcgctgtcctctgggcaggactatgagtatagtttgggaagcaccttaacccataaccacatcgaacattaaaacaaagagattcgaaactgagttatttcgtggccttggtgtgtctcttcctgctctgcttcaccggttggatctgagttttgggccctgggggtctgggcttcccaccaggtatctttttaaatggccacctttaatggcctttttaaatggccttgtaggtaggtttactctcttggaagaaaaaattgcataagtcatgatataaagagttacttgaaaaaactttccacactgtatgcaaatttgagacgatggggaaataaaatgcatgcgagaagttcagatgtgcttggaaggtttaacttttcatccagcttttcctccccaagaggacgcacacaggcacggagggctggcccccgagtgcccgctgtctctgctgaagataatggagccatttccggcaatttgtcctcattatcaaaatcagcctgcggagttttccgagttcccatttacggaggaacggcgtggagcttcacttaccactctgctgtgtcatctttcaggctttttctgggaggaggtgggcaggggkttgcygtacggagctctgaaatggactgtaagaggcactcagggaatctggggagaggcatcggctttgaggacagctgggcccctgcagaatcctcatctgcattttgcttttagtgagatgatattttcctggggaagcagagcttgctagatcatttgctaactccctccgagcacgtgagctcatttatagaagggcaggttcctctgaccagagtctttgtgctccttggagccacgttactgtggctggttacagaggagctgcgcgggccaaatgggcgctgcccaggaggtagttggactgggagctgtgcccgccaggctgggcagttggatcctctgagggttgggggctccctctggccttgccccaatgccttccacccatccacaggcccttagcagggtttccaccagatcctgcagctggggaagcacctccttggatgggttctggaagctgctgggagaggcacggcggggattggctccgatggtcgtgcagctctggtgttagggcggcactttctggatttggtttctccttggtcgacagcattttccttgttgtttttgtttttttgggattcagagcggaacacgaagtggctgagcagtctctatccagagtgcccagcgtttgacgtcacaggcctctgtgctgtgtgcttggtccgtaggtcccgtaagtgccggcctgtgctctgtgccataggaattcaggataccaggacatataggagattcgtttgcccaaccttcatggcagcagaggccacaggagagggagggaaggcgagctgctgggcccaagatgtgggccacatgggggtgacgggaggtgggacagggccatgggggaagcctgatttctccggaggtctgggttatcctggaagtccgatggggagtggtagtgtctgctgcagtggagagtcctgtcaccgtgaaggaggctgtcatgagccaggtggggacaggacatgggctggagactgggctgtgggcctcagggaagccaggcagatgactcagtgtgcagggctccyaccctggcctctgagtgggcagaggtggccccgtcaggatgggcttggggtctggcttggtggtttcatggtgggcaaaggcaaatggcagtgtatgtgaaatgaccgtaagagacgagtggctatggacgctccagcaccgctgtggcaggagcctggtgggtttcagagactccagcgatgctggggcttcctcctgctgaggtgcaggggctgagagccctgggtctgctgggccatgaggtgtccatgtggcctggggaggggttgcagaagcagcacaaatgccagctgggctgaggcggggctgggcaggtacaggtggccctgkgaggaggctgctggctctttaggcagcccctggatgcttgggaggcagctgtggccttataaagggccaaggcagttctcagtccctggctccagggggaccccatgaagggctggccttgcctcccccaggtgcgcctcccagtgttaccgggcctgcatggagaatcctcagcaggacctggcggacagcttgtgcttagtgggtgttcgtgaggccgcaagccaggttggcagtgtctgctcaggagcttctcggttaacaaaacagccggagtcagggagctgcaagactggggcaacctcagaccccagctcttccgggcagggaagatgcaaagatgactagtgaggagaagcgtgttagggagctccaagcaccccaagctgtgagacctgctggcccaggaagaacagtgaggacgaggccagctgtaccccctctcctggctgctggtgcatgccagggctctagatagacagcgacacttttgggtggcacccttgctgctgttgcccctgaacggtaaccagcggctgcccctgttacagacaaggtggtgaggcctgtggagacctgactgcgtgggggttcaggggcccactgcccccaacacaggctgacacattccctctcctaccccactgtgcttcctcccaggcccgccagcgccagtacctcgagttctcgctgccccgcagaactcacctgtgggaccaggggtaagtccaggccccccacggcctccttcagaattccagagtcaattacttgcaagaaaaccctctgtccccccttaagcacagtggatccctgcgtgcttctgcgtggctggggagggcctgctggcggcggcggggctgtcccctcctaccctgtctgtgcagcctgtccctgatgttctgactcccagtgcgggcttttagtggggctgctgcttgcaacccctatgctgctgtatggggcgtctccacatctccctggcagctgcatctcatggtggcaactctcaggactggacggcctttgctttttctgagagacatcgaggtgtggtcctcaccctctttgctctcccagactaactccaccagtagcggtgcctggcagctattggtgtcccctggccctgtcggccaagcagccgatgctggtggagacagtggcactgctgagaaccacaagctgctggcagttgcacgtccgaccgcacagatccccgtggcgctggaacttcctgagtgggaggagaggcgccttcccgctgggccgttgcccgccagcggtctgagctgagctcctgcttggctgccgttctggagtcccgagacacccgtggcgctcacctgtggctccaaggctggccttagctatgtgatttgcagtgaggtcagatgtggcttgttcctgctgatgactttgtctgccagcatcatcctggaaattgactttctagaaaagttgactaattcagtatccatggctgtctccaaggaagcagctttagtgtgtcatctgcagtgggaaactggatcaggagtgaagaatactggattcacctaaaggcgcaagtctgtggacggcctcccaggcttccctgctggcccaacctggcattttccctggagcagtttccacgtgaccccgagtggtcacgataccgtatagggtctgagggaagctgggtaggccccaaagatctcctctgctccctgaagatgctgccagggtmccctggggatgcttcatgcaccccgccccccattcattcctcagtgcctcttcatacattggggcctctctgccagcacctggtgtgggccagccatcattgctgacagtgaatgtctcaggtgctggctgtgtgtactggagttagagtccgggtttgagatctgtgtcttcagtagtgcgtgggcccccagccctccgcatcagtgttttaagccgcactcatttccaaatatctgcagtatttatagaaggctcaccgtgtgccaggtactatgccaaaccctagccaggattgtcatttaattctcctaacagtcctgcagtttaggtactattattacccccattttacaggtgaggagactgaggcaaaaagaggttagctgacttgcctgaggctacacagtaatgccacattggtgcgggcactccatcacggtaatgccacgttggcacgggcactctatccacagctgtctccagagcccgcgctggccatcaagatggtcattgccttaacagggaggtttgttcgataggaacgcaggcggctagaactggcagggccttggaggtgctcagtccagtgctggcaagggacagagaggcagaggccaggccgcccctgtagcttgagatgctttctcctttcttgcttgttttccttgttaataatattcttattcagatattatgatctgggggagatcatggaatcacctctctgtcattaaataaaggaacttgagaagcggtcccaggttccagagctgccctggccaggaggctgcaggcatcactcccttccgtggctggatcyagggctaccccgttccccggtgtggccagtgcatgttgggagctttgtggacggactggcaagcttctgagcccctcacctgtgctctctttccttccagttgtcaatttcccagctggcggcctccccgcggtccccractcagcactgcttggccaggcctacttcacagctaccccatggctctcaggcctccccggcccaggcagtaagtgccgcccacctgccgccttgccttccaccaaggaatggctccacagctcctcattttgggtttttgcactgtgcctgtccttagttaggtggcagagaccttggcgggttacctgggatgtgggtgggagtggggcattgcttactctgaggcctcagacagttgtcaccattctgtcttggagaccaaagaagaatgtggcccatgagttcttcataccacagcgcttgactcagattgtgctctacccatgaaaacaaagttaagctacccctaggtctctacgtgaaagtaaaaggaaggtgtggctatatctatagacaggctgagacaggcacccagcaccccaggaccctccttgctatcagcagctaaaggaggtgagtggagcccgccatcctggcttcagggtgtgctcctggctaagactggcattgccactggccttggggaattcctatggagtttggtttccaaagtcggctggttcacctgcaaactgcatctttggtcttaactggaattatgttgaggaaaaatagtttcttttaattccttgtttgaaaacactcctagcaccatgagtctctgctgctttatctaaagcatctctggggctcatgtgtttgtgaagagcttgcctagctttttattattggcgcatgagacatggtgtgagggtgacctggtttcctctgggctgaaacagaaagcttgggaatgaagcttgagagagcacattcccaactcccaagccagctcctctctgagaggcctgcctcggccttggaggggagtggaggtggaatacgagtgaatgacaagaagtttcaggggctgtggggacaagagactgtccaaacacgccagccaggggctcggtgccacagtttatcttggagtattgaggaagcttcatctttctgttctataaacatgctttgatatgaatttaccatctcaggtgtcaggtatctcccacggtcctgacctgctcataaaattaggattccctcctcaccgcttctcaactcacacattggattgccrcgtgaaatataggatgcccagttaaatttgaacctcaggtacacaacaaataattttttagtgtaagtatatcccaaatatcgtagggaccatacttatactaaaatcatttgttgtttacctgaaattcaagtgtaattgaaccttttgtatttgctagagctggcaaccctccagaggcaattaatcgatgaatccccttagatctgagcaccgttggttgttacgggttggggtccttggtggcctcacttggaagccctcgttttgttcagcaggagttcccgttggaggscggtatctcccacctggaagccgacctgagccagacctccctggtcctggaaacatccattgccgaacagttacaggagctgccgttcacgcctttgcatgcccctattgttgtgggaacccagaccaggaggtgaggtgtgggtctgggtgggatggaaccagtcacgtgctgtgccgtcagactgttggaccttgtgaaccccagggtttccacagggaggtgcatcaatgggtcccccctttcccgggaggctacctgaggagtctctgtgtctcagctctgcagggcagccctcgagagcctccatggtgctcctgcagtcctccggctttcccgagattctggatgccaataaacagccagccraggctgtcagcgctrcagaacctgtgacgtttaaccctcagaaggaagaatcagattgtctacaaagcaacgaratggtgctacagtttcttgcctttagcaggtaaatccttgaatattctgttactcatctggctttcacatttcctgtgttgaagagaaacttcgctgaggttctgacctggcagaactgtctgtgctgaggtcttagtagattcgggagtgccatctgtttttatcttctcttggctaggacccacccacagcatgctaaaygctgtgaaagctgctttaccccatcttttgtggtccttcattaaaatgtggacggtgggttgtccaggtcttagatcttagtgtagctccaaaggcagcttctctagccgggagtgtccttacactcgagaatgctgctgtctggccggcttgctgagagcacagcaaagcggttgcattggtgaccrcggcagcctctttactgttccccagcgactaaggtgcctggaccatcccctatgcaaacacacattagacccctcaggttctgtgccatggatactcagttaacccagagctgttgttggattcagagtggcccaggactgcygaggaacatcatggccaaagactgtgtatttcaccttccagttctaccgcttcccaccygcaacgacgccaygactgcagctggtccagctggatgaggccggccagcccagctctggcgccctgacccacatcctcgtgcctgtgagcagagatggcacctttgatgctggtgagtactcatgtgcatggcaaaggcaagacattctgtactgagttgtgtgtgtaaattgtcagtgttattaaataagtggtactatgaaaagtttaaaacatatgcaacattagaatcatacggtgaccagtgcagcaaacacttagccccagcagctctcagctgcctcccaacccagcgtcctcccccaagccagggttattttgaagcaaatcccagacattatataatttcatgtatgaatatttccttatgtatatctaaaaaattaggaattctcatttgaaaaacataaacttaaggggtatagcccatctaaaataataactcctaatatcatcaaatatctagccaatgttaaaattttgctagtaacctcataacatttttttaagtttgtccagaaataaggtccatactggtcatggagcagtgtgactcttcagtctctgtctgcagttgctgccaccgtacctgtctctgttgtttcttttttatgtatttattgaagaagccacattgtactgtagagcgtccaccccacagtctggattctktttttgtatcctggtggtaacataaaggtgttgttctgtcccctctttagctgtaaattgggagttagatctagatgcatgattagatgcttttttttgtttttggcaagagttctttgtagcaggtgacgtttgcgccacctcctgcacctccgctgcgcccttggcgtctgcttgcttctctttgtgttgcgtcagcagccattgtgcccaccgctgtgtcatttgtgcagaggtgacgttctgcttctagaacacctcccttgtttgttagctgggatgcttccaaaaccagaaacttcctggcatcaactttttgcttaccttgaggtgcagtttgtataggaaaggctggataatacttgattcttccctttatttgccaatttctgaagtaattacatgattccctggcatccttcaaggatggggactaatgactttttttttcttcgggtatcattgtaaacgaatagattgaagctacattgaatagaaacacacctgacatgttgatatttttattgatggtcagtttccccatcttggtcagtgactcagctcataagggacccagctggggtctgaaacactgccgcctctcgaggtagaaagtggcagatgggaaaagtgatgttaaaatgctgacctcaaatgaagtagcctaacagtggcacctgacagcagagacacaaagcaaatgcagcgctagggatcaaggaggctggtaaacaataaccaagaaagtaattcactaggaaaagaaacagttctgaatccgcgatcttctaacatacgtagcctcaagatagagaggagaacttgatggacttataaggagaaattggcaaacctccacaatcatgggagttctagacatacttctcagtagattgatcaaacagaaacaagttaataaggatattataaaatacagtttaaaaaggtgatctgagaaaacctgtacatcccgtttagagaatatgcattattttaaagcatactttgaaacttagaaaaactgatcatcattcatatatattttttagctcaccaagcaggcatcaccctatactgagagaatcggtatcaaatctaattttataactttctctggccataatgccacaagatcagaagtcagtcactccctcccctacaaccactctgaactgcttttatttttttaattttaaaatgtgcttctaattattccatgagtcaatgaagacctcaaaatagaaatgcgtaattatttaaaactgaatgacaaaataatattgcatatcaaaacttaggagatgcaagtaaaattgtaattacaggggaatttacagttttaaatgcctatgttggtgaagaagaaaggtactctttaagatattgttttaattgttcaacttaagaagttttggggagaaagacagaacaaacccagtaaaagtagaaggaaaaaaatttgataagtgtaaatgcttagaagacaaaacaatagaacgggtcaaccaaacagttgggcaccagggtcaccaggtacaacagggcatgcttcttgtttcttgtccatgggcacagtcggtcaagagaggcagatggcggagatgaaaatatcactttctttatcatgcatttattcatgataaagagggtgtaggacttggttggtctgagagccagctgtgcccactggcgccagcccctgatgtggatggcctttgatgcaggtggaggttggccagacagcagcaggctttgcacctggggtgagccctcgcctctctgcatgcctggaagcacatctcggactgttgcattctctcctgtgggcagatctgaaaagaagagagtggggaggaggagtgagcagcctagttagttagttagctcagttaggctattccccatccccagtcagttgagctgctcttgccctgagaggcatgggggctgggcagagagaggccacaggaagttcctttgcatagaggtgtgaagccagggaaggctgtgctcctacagcatttccagggtttggttttctcaactcactggccttcatcattacgtttatggccaaccaggggtgtggcctttgtctttgkgggagggggctggtcaccaccagggcggttccaaccttcctgaatcacttcaactaagccaaccacctttcctttttcagtcctcctgaggcctttggtagacagtccaactgatgtccccagaaggctgtaaaatggatcagaytaatgcatttgtctcaaggctcctctgtacccactgctgaagactcattccccactctgtttcccattccaaattccatccagtcattttatccagcacagctcatcagaggctctgcaacgaagttaaatgatagcgttgagaccattcaataaaaaaggccaaccacttagagatgctcctgacttgaatataaacccctttccatgatgaatttcccagagaggaattaaagtccccaaattaaatttccttgcaagttgaagtccaaagaaatgaaactccaaaatcaaatttttcttgtcattatgaattaaaattcacagtccaaaattcttaagttgaagtccaaaaaaaccccacccgactgatttcaatttcttacatatctgagtctctgcctgggcaggtctgggcttccttcagcagccgcagcttgtgggagggttctccctggacgggcatggttccctagggccttggtagttgcatcagttcaggactgagcctctcataagcctcacttaaaagatatttgttgttgttgttgaactgtaacatgcgtacggtaaagacagattgccagtgcatggttccattatttttaaaaattagtaattttatttttttagatcagttttaggtttacagaaaaattgagtagctggtacagagagttcccgtaggacctccccccaccccaacagtttcccctattactaacattttgcgttggtgtgacatattcttttttgtttttttttgggttttatttgagacaggatcttactctgtcacccaggctggagtgcagtggcacaattatggctcatggcagcctcgacctcctgrgcccaaacaatcctcccaccttagcccccacatagctgggaccacaggcatgcaccaccatgcccaactaatattttttttgtagtttttgtagagatggggttttgccttgttgcccaggctggtgttgaactccttggctcaagtgatcctcctgcctcagcctcccaaagtgctgagatgacagrcgtgagccaccatgtaacaaatgtaacatttgttacaattgatgaaccagtattaaaaaattattatgaactaaactcatagtttacactaaagttcattctgcattatacagtctgtgatttttgacaaatacatgacatcatggatccaccatgatggatcatacagaatagcttcatggccctacacctcccctgcgctccacctatttagccctcccctcctcccctggcactactgttcttttgactgtttccatgttgcctcttccagaatgtcatacagctggaattatgtagtatgtagcttttcaaaactggtttctyccccccagcactgtgcatttagttcctccatggctttttgtgtctcgctcactcacgtattggattgctgaatgatacttcattgcacgtatgtgccacagcctgtttttccattcacctcttgaagggcatcttggttgtttacagtttttggcaattttgaatgaagctgtcagaaacatttgtgtacagggtgttgtgtgtacataatctttcaactcacaggtaaataccaaggagtgtgattgctggatcacgtggtaagagtatgtttagttttgttaggagtcaccatactgtcttccaaagtggctgggcattttgcattcccaccagcagtgaatgaggattctggttgctccatatcctcaccagcatttggtgttgtcagtggtttggattttagccgctctagcaggcagtgcagtggtgtcttgttgttgtaatttgcagttctctagtgacctatgatgtggagcatcttctcatgtgcttatttgctgtctgtgtatcttcttccctgagatttctgctcagatacctgaacagatgtctttttatattttggatgcaagtcctttatcagatacgtattttgcaaatgttttttccctatctatggcttgtctttttattctcttaccagtatgtttggcagagtgaagtttttcattttagtgaagtccaggtcattagttatttctctcatggattgtgcatgggttgtatctgaaaagccatctctgaggtcacctagattttgttctgtgtcgtctcctaggagttgtatagttttgtggtttacatttaggtctgtgatccattttgagctaatttttataaaaggtataaattttaccaagtgaacacacctgcgtaaccacctcccagcccggaaggggctctggaacaggatgcagaggcctccctcaccgcagtccttcacctcccccaagggaaccacccttctgaattctgccactgtacatcagttttgcccctttttggacttcggtgggatcatgttttatgttctgttttgaatcccacttcttttgctggcctcttgtctgtggggtccctgttctgtctatagcagtagcgtttctgttttcctggctgtagagaagcccagtgtcgggtgattctgtgatgcttctccattcaaacaggcgttggaatgggttctagtttttggctcttctgcatagtgctgctgcgagtgtgcttttggtgcgcacggccgttgtgttagagatatgcctggtagtgaacggctgggttgtggagcagcacctgttgttaggtttagtggatctgccaagcaggtttccctcgtgctgcgccagcttccacatccatcagcaggagacaggcagcccagacagcgccatgtcctcgccagtcacgtggtgatcgctggttttctttgtttctttgaaccatcctgatgtagaggcatctcgtggttggagcttccttgatgataccgagtgcctttcacaggcctgctggccttaggggtatcgtcgttcatgaggcatgtgttcaggtcccctgcccattttctagtgtgttgtctgtgtgtgtgtgtgtgtgcatgtgtgggtttgaattgataggcattctttccgtatcccgtcaccagagttaataggacatgtaagattttaaagcactggccccatacccaccaaatttagacaagccaattcccagccctgaatagttgtcctaaggaaaattatgttctcagaatccaaaatttgacattgccagagactcaggtgtctgagtgaatgcgcgtagatgggagaatgccttggttccagcttcccaggcctttgccatgtcccgatcaggaggaagatccactcagagagcggcatctgaggcgtggctgtctgcccggcagagccgctggggggctcgtgccaaggccctgcacgctggtcctactgaactgaagcttccsgcagccacgcccgtgagcctggaggagccaaggagcccagggctcccgagagtggttttctccgtgtttgggtgtttggagctgtgagtggcctttcttctcatcacctcttcttcctrcactttttggggggctctgccgagggcgtggtctcccctgcgtgtgttggttccctccttggccctgggcttggtgccttcaaccctttttgttttcttcgctcctgtcctggccttttgcttcctaacatgttcctcctggtgtttttgtcttgtgggggccctcctcagtgtgagagctgaagtaattgaattttggatcagccaagagcatctgttcttccaaagaacgcggtccatttcctctccctgggctgtcccagccgagaggcatctccatcagaccagcctccagtcctgctccgggccacctagcacagccttgccgtctcttccttagtggatctcctctttcccgggccttctgcgagagccctaatcccatatgtccccacctgcagaaaccgtgccatgttttggaacattgcttaactgtttatcttgaattatttgaaagtaagttgttgacatgcatggtaacactctacctctaaataagcaacgtgcatctcttaaaaataaggtacccttttatatatgtgcaattctagtatcacatttaagataacacaaatttcatagtaccatttccccatttgtcccccatgtgtatttttttgatctgggatccagcccggtttcctgtattgtatttgtaattatcactttaatctcgtagtcgcytgcattcttttccagtgacactggctttcaggagagaccaagtgagctgtcttgcagaacgtcccgtgttccgggcttacctggttgcttcttcatgttgttgaacttgttgctttatcccccrtagttcttgaaygccgggagcgacggctgaaagctgtttgattctggatctcagcatgaacacttcattgtcagtgctgtgtgcttcacagcccaccacctcaggaggcgcgaatgtcagactatctcattgttacgacgctgattcggttgcttggttaaggtgcccacccccaggtttctcctgtagaaagagagttttttccctttgaactgactgaagaattcttggcgacattttttggcttcatgcaaatatytggtccccagcaaccttccacctcttgttttaacaccctgggctgagctttgcttgcgtcagttatttaattggtgtttttgaaatggtaatttgtctaattctatcatttggtctgctctgcctttattagctcacattctttgttaaaaaagaactttccctaccgataagcgatgaactacatatacatgctccacaaagacaggacaaaggtttaattctttccctttaattgccagttttcagagtgagaagtcggtggaatagttagcccagcagtgggatcccagtgttaggtgtccggctgttttgctttgtctttggagcgtggctgcggtctcctgcatcttcatcgatgcatggggttgcactcattattattccgggagcccttccggcctttcaccggctctgattggactttgagcgcgtcctgctttctggagcagtgccggttccaggctcatcttgtgctctccctgccgccagccagggcccgtttctctgaggagcctggtctgcctgaatggggatgacatttcagagatcaggatatggggtgctttgattctgggtcttcttgcttcaaaacctttcaccaggaagagctgggaaaatgtaaaatgtgagttcatgttgatcttcctaagtcagatttagaatttttctcataaatttccttctattatttgtatgtgtcttacacagaaaatcatggtttctcatcatgtatttacttatttatcttgcctaacaacgtatagaatgcattttcacaatgacactgctgatgttaattgttgacttaatgtcaacagtgcgtgtcctgctgaagtcagattcttcgcagctccttttggcctctgtcccaccgagggttcagaattggtttagtgtgaccaaaagccctcaaaataattcttagctccagtttgatattcagtatgattcatttattttaatttgttttcacttttatgtttgctttcctttttaatttttttggactatttacatggttgaaagttgaacaccgtagcccagtgtgtgctcgggcctccctgctcccctcatccctgtgggctcctccccctgcccagcctcctaacaacagtaaccagacttttcgtttctggctgacccttccagtgtttttactgatttgttttttcaaaaataagcaaacatttacattttattttccctgttttctaattcagtggtaacatacmaaatacactcttctgctccctgcttttttcagttaatgtcatagcccaagtttggctgcgcagacgtcgcctgtgcccgtctctacggtagctgcgtcatgctctgtgggctgcrcagacgtcacctgtgcccgtctctacggtagctgcgtcatgctctgtgggctgcatagatgtcgcctgtgcccgtttctacggtagccgcatcatgctctgtggggtggttatgctgctctttattcagccggtctcctaatagacgtttgygtcatttctagtatttcgctatctcagcaattagtaaccttggttctttctggttctggaaaggggataatggaatcacaggcttcagtggtgttgacagacactgccccacaccctctctcgggtgccgctgcccggggccactggcaatccgtggggctgctggtttcctcctgctcaccgtcaaaatggggcgttaacgggtggtatttttacagtcccatagatgtgaagtccatcttaatgcagtttttttgttgtgttttgttttgtttctgtttgaaacgaagtcttactctgttgcccaagctggagtgcagtkgcgcgatcttggcaaactgcagcctccacctcccgggttcaagtgattctcctgcctcagcctcctgagtagctgggactacaggcacctgccaccatgcccagctaatttttgtatttttttttaattatactttaaattctagggtacacgtgcccaacgtgcaggtttgttacatttgtatacatgtgccatgttggtgtgctgcacccattaactcatcatttaacattaggtatatctcctaatgctatccctccccccttcccccaccccacgacaggccccggtgtgtgatgttccccttcctgtgtccatgtgttctctttgttcagttcccacctatgagtgagaacatgcggtgtttggtttctgtccttgcggtagtttgctgagaatgatggtttccagcttcatccatgtccctacaaaggacatgaactcatccttttttatggctgcatagtaatccatggggtgtatgtgccacatcttcttaatccagtctatcattgatggacatttgggttggttccacgtcttttctattgtgaacagtgccacaagagcgaggagatgacggtccaagacaaggctgcctttccatctgttcatttctactgtgtgtctttctgaagaattttaaagtttatgtcatatgggttttgctattgttttgttttctaattgattaaattttgtgtttatctttaccgtcccctcatttctccttgatttttggtattctttactatcttcctattttttttttgagctgcttaattcatttatcttaattcttttgtttgtgtggatataccaggattcaaggctatgaattttcctgtgattactgccttaagattgttgatactgataagtagtattttcattattattattgtttccagaaaatcttttttgattgtgttttccctttgacagaaagttatttatgagtaagttgcaaatttgtttcttaaaaaattttacctttttttttttttttgagactgggtcttgctctgtagcccaggctggaatgcagtggygtgatctcagcttacttcaacctgcacctcctgggttcaagtgatgggcctcagtctcatgagtagctggggctacaggcatgcaccactatgcctgggcagtttttgtgttttttgtagagatagggtttcaccatgttgctcaggctggcatattaatttctagtttattgcattatgttaagagaatattatttgtagtatttctactttatggagtgcagttttttgtggcctgtgggtggcaagccaaccagrtgctgaggcaagagaacgaggacatgagctgttccagtataataaaatataaaacaagaatagttataccagatatagatcttagatgtgtttatatatgagtatcattaatcattagtttgtagcaattactctgtattccaatattataataatcctcgctctacggtcataacctaggaaaaaccaggccatacagagataggagctgaggggacacagtgagaagtgaccagaagacaagagtgtgagccttctgttatgcccagacagggccaccagagggctccttgatctagaggtaatgccagcgtctgggaagacgcccgttgccaggcggaccatggtctagcggtagcgaaaagtgtcaaggaacaacacccgctacttagcagaccgggaaagggagtctctctttcccygggggagtttagagaagactctgctcctccatctcttgtggagggcctgacatcagtcatgctcgcctgcagttatccggaggcctaaccgtctccctgtgatgctgtgcttcagtggtcacgctcctagtccgccttcatgttccatcctgtccacctggctctgccttctagatagcaggagcaaaattagtgaaagtactaaaagtctctgatatgcagaaataatggtgtaagctgtctttctctttgtctcctctctctctctgcctgggctgccaggcaggraaggkccccctgtccagtggacacgtgacccgcgtgaccttacctatcattggagatgacycacacwctttaccctgccccttttgctttgtatccaataaataacagcgcaaccagacattcggggccactaccggtctctgcgcattggtgrtagtggtcccctgggcccagctgtcttttcttttatctctttgtcttgtgtctttatttctacactctctcgttgccgcacacggggagagacccaccgaccctgtgaggctggtccccacagtggcctaatacatggttcgtttttattaatgttccaaatacacttgaaaagttgttttttctgtcactggggtgctgcgttaaggtcgatccctgcaccccacacccctgccaccgtgggagttggccactctgctcttctagattgtcactcattcatcgttgcctggatctgcctttgaatggagagtggttagtttctaccattactgtgttttctgtttcctcaaccccagaagcagtgaggattccagccgggctggggcgtggtgtttgtgaagggggtgcaggaggtgggcttggggaggacagggccactgcccctgggagtcttcttagttcagttggaggccagcttcctggacttctgagtgggatggaaatgacacagggtggactgtggggagcttggacctcaggggtggccacggaggagccacttgtctcagctggacagggaggggagaggtctgaggctgcagtggggagagtacgcgcgtcccaaacacagctcgacccagtgggaccctctgtcttgtctcctggggagctccttccagtgccccgctggaccggcccccattctgtcaccactataccccagcactgccagggcctttcaatgctaccattaattcacttactcagcaaacaaataactgcgcccccaccatgtgggaggccctgcacagggtagtgctgggagaactggacaagcagggccccacccttaaggagctctgggtttcaaaacagggagacactgatcccagagctgacagcatgctgagagctcctggagtggggggcaggagcatgctaggcacggggccatcctggtctaggctcctctgaccagcctcccaactctcacccactgtccgacaagccccagtgggatgatcccggtacctcagttggaaatgcagaaatcacccatcttctgcgtcgctcatgctgggagctctcactagatgccacagtccaggcaggggtgggggctgtgtggctggtcacctctgaggtgccacactggggacatgcctgcccttgcgtgatgttaatcaccagctcctccttggtcttcctccagattccttatttgcctttctgccccaagatgcccccgtgagctcctgctgtggccagcgccgggcctgagcagtgggtccttgctccacccccttggggcccaccctgggccctgcactcttcgctccccctaggtcccctgtccggacacattgtgcttactccttgtcctctggtcttgagaaacgcagatggaatgtggtctgtggtcatcctgtggggctggagcctgggtggagaggacctgtggccaaatttcagcctggcttggggcctggcactggaggtgctgagtaaaccttcgctccttcctctgctcgttgggggctgtgggaatgttgtcaccattattgatagaaagagaaataatgttgttttgaaatgcttctcaccattgctgttcctcgaattttaactaaggatggtttgaatggcatttttgtcaatttagaattaatgataatgtcacttcaagaagatgaaggcaggggccgcagtccagttcccatctcttagcctgatgaccagggcagaccgcacgggaggagcccrggatacccacggggcaggtgccgtcctgctttagggccaggagaggggctgctgggtgtcccacacatcattctaagcctgatctcggtttgagctctgcctgtgtgtgtgaacatgccagttttgacagcagatgtagactacattttttcttaaattctacacgcccagaataataaactccctagccagcctcataaggacatttgttcccatccatcttaggctgttacaaggacttggtgaaaccataaatcttattttgggaggagtttattgtttctatgcgaaagaaatgtagtcttctgaacatgactcttcattctgttaatttgaatattttatgatgtttttgattaatgtgtttattaactgtagctatgacagaagcagaaattagtaatcatgaccagagctgaaatctcttccaagtgtaaagatgatgaatgactccaattacttttggcctcctttggtgcctctttgacagggtctcctggcttccagctgaggtacatggtgggccctgggttcctgaagccaggtgagcggcgctgctttgcccrctacctggccgtgcagaccctgcagattgacgtctgggacrgagactccctgctgctcatcggatctgctgccgtccagatgaaggtagcggctctctggaaggacaggcacagtgggtgctgcgtccctcatgggacgagtcacgcttccagcgtctgtctgcttggaaggagcgggcgctatcccgcacaggacttgtttgaccttctttgttcactcgttaaaaatagtgctgcattctctgtttcttgaaaggaaaagatttttcactgtctgaattctataatgctagttgtttgctcaagaaactcttaagatcaaactcagttatctatttctcctgcaaactgacctaccaggcagtgtcacttcatctcctcccatgtggtgaatgtggtgagggcaggtgcatccgaggtgggttgaggatgaatgaatggatacgcgaatgactggggtgtgcagtgtgacctgattcctaaggtcagtgacgtgttgttcttttctcattctggtgaaaattagaatctcttttactaattgtccttttccattctccttgtatactaaaacctaaatccatggattctttcactcgtcttccctggaattcttcccaagccttctccattgtatgaaggggaccccatgacaactcttgggccaaggactggggccagtttcacacgctaccatggtgtcctgagacttctctcaggccacgggacggagctgggagaggatgtggcgtcattattgcagcccctgagtctctgagatttccccacttttcttgagtgccgcatagctgctttcctcctggattcctgacacggctgaacccccggggcttcctgtccyctccagcagctgctgacccctgagaagcacggctcctctgctccttcagctgcgctgtgctctcggggtggggggatggggtatgggagtttttccagctgctcttcctctgaggcatggtctgctcttggctccccgtgtgaccgactgatccaggctccatccctgctccctgtgacttctagaggagggggatgccccccagggtggtgggctgtgcacagaacgttcagggtggggtctgcaggtggcagggactccgcagggcttggctgctcttctcatgcctcaccctgggcctctgttcctgttggggtcatggcaagggccccacagggtcatcgtggcccttgcttgtccgtctcccatgctggctttgatgtccccagggcaggactgtgtgtcgacaccacagcatctctagcacaggcctcagccccagcaggctctgcatggtggggaggcgtaaaggaggcaggcggtgtgggaggcagagccrggtcccgctgggcatgtgtggggtggcagtggctcccctgtcgtgcccagccgagccttgtgccccctctttgctgtgccacctggagacggaagccatttgatctccccctacacgaagagccccttaaacaagtgccgttacgcttgttgacatagacttgaataaattaaatttaaagcttcacttttctaaaataaaatcttgtaactttaaaacttaggtagaaaacgtgaaaaactgagatgatcagagagaatcctctggactccagatcctgggagagttaggttgctccggttagcctttggtggacttactttctgcaggcggggccagctttcatcttgtttgagctcttgctgttgcgggtcactacagtggcttttccttctgctaatcactgctgtggacttcttgaagttcaattttacccccatcttctagttgatttcctgggggtgctggccgtaacacgttgctacgacgatgagaagagtttcctctagggacggacggctcctgtgctgccttcagtgtgacccctagcccagccctggggcagttctgtttttatccttgtttctggtggagaaaacagaggcccagggtcacactgatgatcatcagggcrgagtcttagcctaattctgtctccggggcttgtgctatttaccatcctcttctccctaatgacatgttcccrgaagtagaattctgatggtgccaccgtgagggccgcaggcatgcagagccagatgggggtttggcccgaaggctcagccaggcctgcacttcctgaagacagagggcactgtgtcccatgtccttggcttcacagtgtgtcagcctttaaaccagtcgccagtggccattttgataatgatttgggaggaaaatggtgccttgttttcattcgcatttccttgcctcttggagaagctgacatggtttcttgtatttgttggctgttcyctaaaggagacttctcatatcttctcagtctcccagtgactgaggttccggaatcatcgatgtctatgcagtgatcgtatgcagtgtagacgagtgtggcaaagcgaccagggtctgcggcgaccggaagcccccagacccacaagggaagggtcaggtctggcgtctcactcccagagacaggcacttttgttgctgtagaaactggagaattacaaaatccggaacctcatctgctcccacactgcttcttatgtgagaggaagcaccagagcagagagggcacgggggaagagtgtcccagccacgcctggggcacagccgtgaggccgttgtcatcccccacatgcctcacagtgttggcgttcgggcagagtgctgagccgtggaatctgatcagcagaagagcccgtggtcaggaaagtcctgctgaggccctgctgggtctgaggcttcctgctcccaccctgccccgagcagcctcggcctggcatgcagaactgggccaaaccccagcccagggctcccggcgggcctctcgtgccccatggcccctccctgggccccacgggcctctaccccagccatgcttcctggcccagggaaacgggggaggcattgtaccctgtaccctgtgccctgtgcccttggcctggcctgcctccccggccttctctgcctcccctgccctctctgtgcatggcctgtcttcctcctggagtcccattggggtttccgtcctggattcctcgctgtcccagacacgcttggctaagagtcctttgcgttgcttggctgccctctttcctgctcttgcttcctgtggaggggaggatcctccagggcagctgccagacccacttatgccttcccagggcccagtggtatttattcagtgggtaaatccagtcatactttacttaagactttgtgaaaaagaccccagtaataaggagtcctgctttaagacgttggcgcctggctcgccgccccctcaccccccagcgtggtgcagggtcttatcctgcgcacaccccctcccgcccacagtggctttcctgctgggctggggagcagcctccacctgcagggctggtggaagcagcccagggccggctccagcctctgaacgcgcttttctcttctgcagcatctcctccgccaaggccggccggctgtgcaggcctcccacgagcttgaggtcgtggcaactkaatacgagyaggacaacatggtggtgagtggagacatgctggggtttggccgcgtcaagcccatcggcgtccactcggtggtgaagggccggctgcacctgactttggccaacgtgggtaagagtccccagccttgtgccatttctccagcggccgcccaacccctctggtagagtgtgggctccctcgggcaggggccacatcatgggcttcacgggcccaggaggaaaccgggagaattctcaccagcttggccatggagcctgtgtccttggccgctgagtctgtcctggacccagttgtttgcattctgaatttctgattggggttagaggtcatcagtcatctcgggctctcctgcatgttgttgtttgttgctatccctggaggatctccgggacagtcctcaaatacagtgactgggttccaggagagacttccctgtgcctcatgatggaggacagacaagggaagtgttcctaacttccctgcagcccgggaggaggagagtggagaggcgcatttcttctcggcccagcaccatgactttgtagaaaatggtgccccgggattgctcgttagagggcctgagcaaagccctggacttcactccacgtccaggactgtggtgggtgggacaggtgggttgggtggctcaggagggtcccacctgggacgttccaggggcttcgactgaggcctatgctgggataggggctgctgatggggtgtcaagggacacaaggctgggtgcctgcctgtgcgcacctcagggcagaggaccgacatgggaccctgtagggccagtgacaagctcactgaacctcccgagggtcctctggaacgtttgggatttttcagggcagaattgaaaacacaataaaactaagccgtgtgatgtttctgaagctgtgtctgtctgcatgagattcagacttgtctgctattttattagggaattttccactccttagaacccagcctgattgtaaaccccagagccccatgggccacatccacccgacgctggcagcgcagaggttggtggggggcctggcggaggggctcaagtgcacagctcgttaagtcgacttggaggctctgcctgcctgtttacgaatgtacatccgaggcggcctggtaaatagacaatatggacacagcaaaactcaattaggttctggagaaataaatgagccacatgtgaggagcaggcattattcaaaggctcatgcaactaagggagttgcaagaagcgttctgctctgagaccgagttggttgtttttatatttaattctccagccaccaaatgtgcagtgactccaggttttaaaatcttatcttcagaagaaagattgcctccattatatgttatctccaattgtcattttcatactttgcctgcaagagagagataagctcataggaaggggaggctgagatagccagcctgggagactccggcgctgaygggagagggagaggttttcacaaaggtcgaatccacccgcagcactctgcgcatcagtgcagcgagcctggctctcctccgtcagttctgcgttttttggaaaaaaaggtgttatggcttttctttcttcataaaactggctattctgtggtacagtaggcgtctctctgctagcagcgtgggtgctggccatggaagcctgcagggttaccgcacgggacagaacctgagcctcggcctcggcctggattctgctctgggccagctgcattcacagtgcatgttcctgtctgaggccacgcaaggaaacctgtgccatggctggggacatgggtgtctgccagctgggcccagggccctgggactctgatgatggggagaggactgccctcatgcttggtggctgcttcacacagctgatttccttggcagcctcttttgcactgtctttcggtcagcttttgtcgtccagggacagcaagcaccagattgctttctttgatcccagtgatcttggttgtggagtaggatgggttcggctgggagcttgggcagtgatcttggttgcggcgtaggatgggctcggctgggagcttgggcagtgatcttggttgtagagtaggacgggggtttttctgggagcttgggcacttatcttggttgcggagtaggacgggtttggctgggagcttgggcagtgatcttggttgtcragtaggacgggggttcagctgggagcttggacagtgatcttggttgtcgagtaggatgggggttcggctgggagyttgggcagtgatcttggttgtggagtaggacaggggctcggctgggagcttgggcactgatcttggttgtggagtaggacgggggctcggctgggagcttgggcagtgatcttggttgcggcgtaggatgggctcggctgggagcttgggcagtgatcttggttgtggagtaggacgggttcggcwgggagcttgggcagtgatcttggttgtcgagtaggacgggtttggctgggagcttgggcagttatcttggtygtggagtaggacaggggctcggctgggagcttgggcagttatcttggttgtggmgtaggatgggggtttggctgggagcttgggcagtgatcttggttgtggagtaggatgggggtttggcagggagcttgggcagtgatcttggttgtggagtaggacggstgggagcttgggcagtgatcttggttgtggagtaggacgggggctcggctgggagcttgggcagtgatcttggttgtggagtaggacgggggctcggctgggagcttgggcagtgatcttggttgtggagtaggacgggggctcggctgggagcttgggcagtgatcttggttgtggagtaggacgggggctcggctgggagcttgggcagtgatcttggttgtggagtaggacgggggctcggctgggagcttgggcagtgatcttggttgtsgagtaggacgggggytcggctgggagcttgtgtgttacttgtgttctgtgacctttcctgggggaggcaggcgtcaggacagatggccccacaggctaagcgtctgtgttctcacaggacatcctaggagaactgggtggtgatgggttctgacagatggccaggctgtggggtcacacggttggcggtggcgggctttggtccagctgcagggctgcatcgggagccctgtgtgtttggagggaattcctgcccctgcagcaaacgtgttggtgcgggtgtaacctgtttcatggaaggtgaagaaagcctgcactaatttaacatccaagttgtgccctgatgaaatgcagtgcctttgccgcttgtycccttcttgagtgagcatgcaagtgtaaattcagcttacctggtttattttcccatgtgccctaagtagaaatatagtaagaggaaacggtcatgaagcccagcagggttccgtgtcctgctggtcacacccgctgcagccattgtcatcattaggtgtccttcgagtctgagctccaagaatgctggtcgcctgccccaggcccagttggccttgccacactctccttggtctcttagtacttctcagggtggtgcatagtacaggcttaaaatagaccagtgcccacttcagtcagatgtgggtggaccagaggcctcgtctgcgattcagggaaccattcgctatcagatgaaggtggtcgagaaagctatggagcattctgggctgccccgggtataggatgaacccactgcagcccacagtgaagggaggtgccgggtggaggatgaacccactgcagcccacagtgaatggaggtgctgggtgcctgggaggcccctccttcttggagcaggtcctcgggacgtgacagagagcttgccaggactgccagcccgtgagctgctgcccctgctgtgaattcccgtgggaagaaacacacagcaagaagctgggacaactctgagcttgtgagtgggaaactgaggctttggggctggtggcactttctccccatcatgtggagggcagcgtggcccggagcgtgaacatcggtggcactttctcctcgtcatgtggagggcagcgtggcccggagcgtgaacatcggtggcattttctcctcgtcatgtggagggcagcgtggcccggagtgtgaacatcagtgctggtgcccgcagctctggccctggcacaggcaggctgggctggttcaggctgccgtcccttcctcgccccagcctgcttgtttgtctgccattttcccacatgaatctgggaagtctttgaggaccctgatcgtggcttctttgtagtggtgtttgcccttgaacctggcgccgtggtggagagagtgatgaaagcgttgataagaagcctgagtgcccttctcaccgggagccctgttcttcctgggcttcagaagatacagcccatcatggggcatgaacatctgttcgtgtgaaggagcgctgatctgggttcctttcttagggacgaggatcttgatcctgtgaccacgagttgtcagggccaaaaacggattcctggcaggcgagaggagggtgtttgggcagaggctctgcagcctccactgggagggtgcaggctttaacttgaggggaagctggagacccctgcgaagcatgtgggagcagaggtggccatggcgggcaggacaggagggagggtctgagagcaacagggagaggaccgaaatagcccttgtyctaggtgctcgttcccaggaagctggcttggagtgaggactgagtggacgctgcagstgccaggaggcggttggtagcccgaaggcagaagcacagtgtagggcatgtgggcgacatggaggctgcgtctttatggggatgtagcagggacctgggccgagggggaagtcagcacggctgtcctgctgcacagcatggtgctgacgtcgaggtcaaggagaaagaacaagaggcggggggtgtcagctactgggacattggcaagaacgaaattaattcccctggaaagagatggctgggtaagcgcaccactgagagatggctgggtaagcgcgycactgagagatggctgggtaagcgcgccactgagagatggctgggtaagcgcgccactgagagatggctgggtaagcgcgccactgagagatggctgggtaagcgcgccactgagagatggctgggtaagcgcgccactgagagatggctgggtaagcgcgccactgagagatggctgggtaagtgcaccactggcctttctggttgccacctagggcgtgggaggaggcagccagccttcccatccttcgcagtgacggctgtgagcgtggccgtcagaacctggccttgagggccgaattctcagcacaggtgagcaggcggcttgaccctacagctgcccagagtgagctttcaagctgcctccagggatggcgctgagccagggaattctgcatttgtgctcgtgcgcagacagtaggaggcggccaacgtgccagtgcctttgccatagttgcttttggagcttcagttttgaaagagcttacaaagactgaagcagggacagatgaccaagaacagctcgtctgcaggaggtggcaggaaggccagcctggcttggactgagatccggagagagcactcaagatgaccaaaggaacttaagaattaggagaatgtgagttctttgagggcagcagggattgttcgctgctgcgtcaccagctttccatctgtctgtgaagtgaagctcttctagaagttttctagagattgattccaggcagtctgtgatttctaaatctagcctctctctaccaccacatcggggcctttgccctcaacagccctttttgggggctggtctgctgtcccgccaatgtctttggtgtcgccagctgcgattcagtatctggctttcaggtcctttccaaaatccaggcgctgttccctgggatgtagaggggctgaactcaggtagagcagctcggagacctgcctggctcccttggtaggacgggcactccctttccarcctcagctcagacccattctagagagacacctccgtcagccagctctggttttgtcaccaggagaacctgggttggacggaggatatggctcacctccacaggtgcctgcacgtgggcgtgctcccagcactgggctcgtccttgaaaacagcagcttctgacgggcaagaggggaaggaacctggcgcagcaggtggatctgctgcagccaaggagggacctggccagtgtggaagtccctccctcccctrgggctgagggtaggcaggagtgaagggatgcagagaggcaggaagcccaggggaaggggttcccgtttttaacagctcccgggaaaatggtgaggacatcccaggcccgagggcactcaacactgcctcgtcggaattaaggaaattgatggcacaagcattttgtgcgtaccctgggtggttcattttgggacacagcttygttggcggtgctctgcctcgccccttggggaagtaaaggccacaccgaggttgtgggtcccatccttgcaggagagtgtgccgtgggcaagcacggcttcccccaggacactcaggtttgcaagttgcaagtttgyagggtgccacacccaccggccgtgagacacgcttgtcccgaggccacaccacttgcttgccaaagccttctgttatgaacacaactctggtgaaggctccagtttatgggggctctttcaccctgggtgtgtgtggagccagacatttgcacgtgtaaatgcacacaggcctatccttgatcaatgtggccatcgagaggccgaggttagagtttgtgaggcagcccgccttgcgacccagagatccagaagtaagaatccatgtgcagcgaactgtgagtgccacacgctttcattcgtcaccaggaaacggaggctgccactgacacggcaggagaatgaagacctagctgaaagttcgcagcagaacgagctcccacctgtctctcaattgcaaaacattcaaaacagaggcggtggggccttagcgtgtcagggtgtagataggccatttgaaagccacagccgcttatgtggtgggttgatctgtttcatcagattctcatttggggttcatgtcttatgttgggatgtttttcatgtaggtcacccgtgtgaacagaaagtgagaggttgtagcacattgccaccgtccagatctygggtcatctcaaacgatggagccagccgcttctctggaggcagcctcctcacgactggaagctcaaggcgtgagtttacactgttgggcccatgtgtgggtgggtcgtgagtggtgggtgagaggtggaagactgcgtgtgtgtgtgtgtgcatgcgtgtgtgcatgtgtgtgtgtgtgcaccattcgtggtgctgtcagtgcccctctgcgtctaggacgggactgtgctgtccatgtgcaggtgggtcatgaatggcgtgtgagaggtggaaggctgcatgtgtgcacgtgtgcgtgtctgtgtgtgcatgtgtgtgtgcgtgtctgtgtgcgtgtctgtgtgtgtttgcgtgtgtgtgtgtgtttgcgtgtgtgtgtgtgtttgcgtgtgtgtgtgtgtgtgtgcaccattcgtggtgctgttaatgcccatctgcatctagggcaggactgtgctgtccatatgcagctcggtgccctggctagatgcccctgtggacccacaggccccaccgagccaccacattgatcacaccctggtgctctaggctgggctctgcaggcgactgtgctgtttggagaagtgggaaccctgccagtggcatttgtgtctggttggctgctcatctgcaagggaaggagaaatggagagaaggtcaggaggaacatagactgattttcaaaacaagttgaagtcccctatgttgtgaacagaagaaagaagccaattatggagcttgggaaagaaagacctggtttggagaggaagacctgggtttggtgaaaatgtgtttcacagcagggaggctctgaagtttttctatccccttaaaatgtaaggcctcacagacctgagtataaagtacttgtcatttgaattacaagtgggaagtgctctttaaggagcattttccccagaggttgcagatcatctgtgtgaattcacagctgccgtgcgcttttgtgtgttgctgggccttggagctgtggcttgttagaggtgggaggggcagttagaggtgggaggggccgttgggttccctcctgcaaggcttccaggatcccacaaggcccctgaaactctgggtaaacttgtatgttctccctgggagcagacatgaggggctcaaagggattcatgatccaggcagatagagtctgttgttctgggccagcttcctcattgtaattttgaaraaactgagacgaagagaggtcaggtgacttggccagtgccgtggctaaggggtgaacttggcttagaatctggattccctgccctggggtcagtgcccttcatcctcagctggtcccacagaccacctagagtacggtggagagccagctccttagagagaagtccctgagctccaggagccaggctgaggttattgataaaaccctgcctccaggcgcagcaggtcaggagctcagctgtcagggagcaggaacccagaaggccttgctgagacaatcagaggccctgaggtcagtgatcctccagaccctgttttgctcaggaccaggacaggaggtgtcccttaaaagcacatgtctcacccatgaggcaaggctctgcaattagcaagttgcacgaaattttaagaaggttctcagtgcttcgtgccttaccccaagtgcagtttcacggtcactctgtaactttctttctggtttcattgggaccacgagaggtatttgttggggtgatgcaatctgaaaacttgagctcatgataaaccccaacttgcgcaggccccaggtccctccactcacagccgtggctkcaggtagctcagaccaggcctgtgccggagacttgtaagagccacgcggggcatctgcagagcagtttgccggcrttaaaattggatggtggtgagggacctgacagtggcactgtttccttgtgagaaggaggcgggggtcacgttgctgtccactgtgtggaggcttctgcagggggtgcccatgccccatacaagtggaaccaggctgrgagagctcgggctggcattggtttcctgtgggaagtttctgctggtgccagagagtgaggaaggacccaggccctaagctggtaagctggggcgcctctcagctgccctgcctgtgccgggctgagcgattttctgggagcctcatgtgtcagcctttggcgtggcctggtcacccagcacagccccgcccgacaccccaagcccctgctctgtgtcggaaggaagggcctggcccatccagtagtggctgagcctttgcctgccagtgcttgaccctgttcagcttctgttggtttgctaaatgagtcattgtgtgtccctggtttgagtagggccaccccagaggaggcgggctgtcctgggggccaggcagtccagggtcagctgggatggagttgagagcaggagcttgggggccaggcctgctctgagcttcatcgcctgccccccactcactgaaggcctcctgccaaggggacaaccccttacccccattcctgatccgaggggctgaggccagcagccctgggtgaaggcattagtgggccctttaagatcccgagagcatgggcttctagaacgtggccttcttccctagaaaaccccctggtggtgtgttgacagcgttggatctaagggccagagtcagaattgcttttaatttgaaggctgaggaaaggaggggatgctgtggaaaccagggtataaagttatcatctttatctggatctcagaactctgcagattggagctgcaaaaagcatgagccgcactcttgagctccctccctatataggtggtcctgggaggcctgccctggtgtctgckcctggaaggcagacactgcacrtctacctgactcgcgctctgaccctttcgcaggaaaacacgtggtgcaagcacagaagctggcrgacgtggacagtgagctggctgccatgctactgacccatgcccggcagggcaaggggcsccaggacgtcagccgcgagtcggatgccacccgcaggcgtaagctggagcggatgaggtctgtgcgcctgcaggaggccgggggagacttgggccggcgygggacgagcgtgttggtaagggtttgttcagctgtcactgtcctgggatctccatgcagactgagtcactgtgcacrtcctttccctgcctcccacatgattctctcttaccttcctcccaaatcctggggacagaatataagaaaatcggactttttcagccaccgggggaaatctttaagtgagaattatctggagagcttttaataaaagccagttcttgggcgtcacccctggagattctgatactgattggtgtgggcaggacccctggagcctgggtttgaagaaagctttgcaggtgattctgaggctctcccaggtctggggaccagagctgtgaacaactgacatatcctgggttgtcaatgtaatcattctggctagaaaaattcccctttttggctgaaaatctaaatagaacttttaatattttgctactaagaaatgggaggtgagaatggttgtacctcctgggttcatagaagtcgggaaccacaggggccttgagaaagatctcctgagattcccccttgcatgtaggtaggccggggtctgaacagaggtggcccttttcctgacagtaaactcagcagggctgccactcagcctccctgccagcaaggcgttggtgctcaaaggtggatgcagacgcctcggtccctccctaggctcagttcagtctgatggggcgaggaagaggcatggtgagaagacacggggtgaggaggcctggcctgatcccacaggactggtgggctcagtggtcagggaggagggagggactagagggaggccagggcagggccagggcatgactggggcctcctcccaggcctcaggacacccaccccacctccctccctcccttcctccctccctcccagctggcagggcttgaagctgtggcctctggaggcccctagcctggataaccttagctctgtcagcataagcttggaattgaggagccactctcagccctatccctgtttctcatcctaactcatgtctggccccatcgtccagcacagcctgtcagaggttccactcctgaaaagctctgaggatgaaattctgatggaggccccaagtgtgaaaggccagctccaatccccctgcaaaggaacagccagagccttggatgttggaaagtgaatgtccaaagtcatttaagccagaaatcaaattttgtcctcaccttttgagttaaatcctgaaagcactgaagtcagcccatctctctgacgcctcagcctcctctgtgttagacagaaggttcccagcgcccggccgcagcggcttcttggagtagctgcaggctggctgactccccggcatgggggtggccccttccaggcctgagatcttgcaaggcagcctctagtgggccttactttttcttgtaagtcccacaggaaaaacaggccagtctccaacctgtagaacccatgtgtgctggccaagccccttgmgtccctgcggcatcagagcaagsgggtggctgagccttgctgaggcagcgtgctgcttgcctggactctgacccggtgtgaccgagactcagcaggccgggggcatgtcctctcctgtggacgctgggcccaggcagggctcccaaagttgtgttggggacctggctggtgaggcctgtcaccatagttttgaggccattcttttctcttgtttgaaacttctgattctccaccgtgcggggggccagactcgtgtctgtgaagagtctctcaggaataggcagggatgctrtgtggacctccgtgtcagggacacagccagcagatctctgtycagcactgcctgagatccatgcctgggcggggccggccagttccacccagaccacatggtcaaggaagggggtggtggtggcgatgcttgtggagaaatgtcctcttctgagatcgcgggtggtgggcagccagcartagccccttgtggaggagagtgtgcctgggaccctgtccacccatgtcctcttgtctgcwggcrcagcagagcgtccgcacacagcacttgcgggacctacaggtcatcgccgcctaccgggaacgcacgaaggccgagagcatcgccagcctgctgagcctggccatcaccacggagcacacgctccacgccacgctgggggtcgccgagttctytgagtttgtgcttaagaacccccacaacacacagcacacggtgactgtggagatcgacaacccygagctcaggtgaggtctcagtggtgcccgtcctgccccagcccagatctgtgtcrggtgcagccggcacccctgctgagctggctcgaattctgcccgagagccrgggcgatttgacttctctctcccactcctctgagcaccgctctcggtgggtgggaccgcagcctcctgtgggtcctcctgggaagaactgccctgaygcctggacactgcctccyccagcgtcatcgtggacagtcaggagtggagggacttcaagggtgctgctggcctgcacacaccggtggaggaggacatgttccacctgcgtggcagcctggccccccagctctacctgcgcccccacgagaccgcccacgtccccttcaagttccagagcttctctgcagggcagctggccatggtgcaggtgcgggtgtcaggcacacagggaagttgcrtttggctgaygacggtgggaaattgagaatgcttccagtctccaccagtgtccctcccttacctgtgcagacagactagccttggggctgccgcccactccccttggtgctcaacaagagccctggcatgtacactgcaagtggcaaccagccccttctcttttccagcctgatgggtgtcgagctggaccatctcctcctaattttctttactaagttggttggaagggcttcttaaagcccagtgaatctaatggattgacrttttctagcatcttctttccagttaatgttgtttggtcccttccgactgcagcactgtctgctctatgcaagatgcagctttgcaggcatgtgtgcggggagcatgcgtgcagggagcatgtgtgcagggagcgtgcgtgcagcaggtatatgtgcaagaggtatgtgtgcaggatgtatgtgaggtgtgtgtgcaggggcgatatgtgaggtgtgtgtgcaggaggcatgtatgcagggtgtgtgtgaggcacgcgtgcaggagttgtgcgtgtaggggtctgtgagatgtgcagggagtgtgtgaggtgtgtgcagacatgcagttgtgtgtgtgcagggagtatgtgaggtgtgtgtgcaggtgtgcacttgtgtgcagggggtggtgtgtgaggtgtgcctgcagggggtgtgtcatgcccgggtgcgtgaggccggcatggggtgtggagtgtgtgtttcagcttttraccttttggggtcagctctctagggtggtggtcatcgcttaaggtggacttgagatgtccctagaggctcactcacaggatgccatgctggctcttgggatgggctgtgaggactgcaggtgggacctcaggcctttggcttcaggcagagccgggtttccacctgggatctgctgttccctttgttcctggcagcctcagccttctctggcacagtgaggccggttggtgayggttgctgcctggagagtcagtgtgagaggaggctggtggctcccagctgggtggcagtggtgtctctaagcacaggtgctggtcgcctaatggtgttgcttcctgacctgcttgtgctgttyggttcctgcaggcctctcctggsttgagcaacgagaagggcatggacgccgtgtcaccttggaagtccagcgcagtgcccactaaacacgccaaggtaaaggggcaacggaggacaaactgatctcggggcttcctgggtattcccagggcctgacccttgtgtccttctctcccctcctggaggggagggctggggccaggtcagggcaggggtggcgtgggcctgggaatggccttttccgtgtcctcgctgggcagggcagctcygtctgggcgctggcacagcctgcatggtatctggtcggaaatgcctccttggtggccgccttctcacagcccagggctctccgggtgtgaagccgcagttcccgtggtggctgccacagcctgcggccactccttgagcctcacgcagagcattccctggtgtgtgagtgtgtggtgtggttcttcctggaaataagacgtagtccttggttacgtcccttgctaagcgaaggccgtatagtaaggcacctgcttctcaacagctggctgagacattctcaggaggagcttgagacactgctgctttatggcagtttctgaaggttgttttttattcggtagaaacatgccttttgtagtagttgggaagtgaaaaacaaaattaaaaagctttggtctttcttacacattgcctggaggacagaattcagagttcagcgcagtcctgtgaggctgtggcgttcccgtggcccgggtctcactgtggttgcagcctggccctctgtgtccaccgggccccatcaccagtgaaaacttgctttattttatttaagtgtgcagccacagctttgccttgatctaaggaatgtatctgatctttattgagtgctctaggttaacrctttttccttacatgagtgggaagtcccagccatcgcgtcctgttgccaaaaccgttgggaggaaggttttcctctgctagctcaggtctgaatggtaagggctgcaggtggatgaccgtagacagagggacagcagcaaagacgggccttaccgttgtgagcccgtggcagcattgggaagtgagtagcttgccaaatgcccagaggtcgaggtttctgtgccaatgtagcacaaagggggcgagggccagggcctccgtgggaagacggggacattctgttgtctctttatgctgtgagcatggccagtctgtgaccttcctggaatttgcaggatgctttcacttacactttcacataggggtttaatggcagctgcactttcaggtggctgtgcactagtcagataaggaaagttcaggtaagatttcttttcaccttaaaataatctttacgtcagaaatatgatctcttcacatgaatttggagtttgaagggaaatcctagacactgtgttagtttacccataattactgcagtgtgtatctctgactgataaggacttttctttttatcatgactgcatgctgtygtygctgcccccagtcaacgcagacctcggcatcgtctgctggggctgtaaccacgggcctttctaccactggtgcgtttggatcaggacccgctgtcctggggtgctccgcctctggagttgctcagtgggcagaccacgttgtccatgaaggccacccacagaggccatgctggctgtcaccgtgctcaggtgctgatggcctgatgccatcacccgtgtctccctcactcgcatccagctgaggctcctggcccactgcgtgttccatccagggtggaaaatggtgaaattgcagtcctgtcattcttcctgtgatctttctacaaacaaggactttcccgatcagcagtttggttaccctaaaatatactttgtacttgaaagtgaggatgaatgttagaatcattccctttatcaattttcaaataaatgagctgcgtcctagcagcctccagagacagtccatgtttgcggcgtctcatgatggacaccgaggcgttatatttgtatttctcatcccatggaggcaccgctcttagacgctggaactgccctctctcaggccaccgccatccttttcaagttaactcctgtgccttttttaaataacaagtagttattttgaaataatttagaacttagggaagagttacaggaagagtgcagagtccccacatagggttttcccagacttcccggtcactaacctttgccaygtttgcctcgccactctctgtttgtgcatttttcttgaacaatttgagaataaattatcaggtaatgccctttactccatgacacttcgagctgggttatcttgaaaataaggccactgtcctctgtggtcaaaggagagccatgaaaattagggaactgacgctcctcttctgtcatcacaggccccattcacattcacaaatgtcccagcacttgatagatggccygtccagtggcccccaccagccygctgcccatggagtccttctggcgtggctgcrgctgttgtgaagtgcacaggcggttatcctgcagggcgtgcccagtggggctggtctggtgttcgtttcagttagacccaggttatgcacttggggcaggacctccacagacatttgccgtgtcctctacgaacatcatactgtgagggacaccgtgttgctttgtcctgttactggcgatgttactgttttcattcagttaagatgacatctgccatgcttttttcctgtaatatcaggaaatgtctagtaattagaaagtcatgagtaagtatcttgttgggagatactgaggccgttcaaataccctattcttcatcagactttgacgcactaggtgtcagtgtgcactgatgacctggcccgagttggttggtagtgggatgcttgcctgccayggattttccaattccatcattccttctctgttgattactggtattttaagtaaggtagagctgtgccttcaccccattcacctatttactttttatatccttatgaacaatgaatttctattttattcattttgttactatcattatttattttgttgctcatattcgtgccctgactaaccagggcagcctcttcaggccagctcctgcgtcctgttgattcacccctgtcctcctttgagtctttccttactgcccagcacagcaagacgccccaggctcagcttgcatttcaggagtgtcagctatttagctygggttcctttggttggagaatgatatttagaaaccaagatttgagcgttagatgtactcagtactactgggatgtcactgctgctaagtccctctcagcagagacctaagaggtgtatgcctgtgggtgcagatacatacatacacaatatgtgcatatcatgcatatatgatgtatagatatgtgcgtgtatgtgcacagactactgtttctagtgtgctgaagaccatgaatttgcagcagttcttccaacaccaatttaacatcacgggtttcttcctgtttttttccatgtttgtaattctcatttctgctcatgagaaacctagctcgcatttggcttacttatttgcctaatttcctctgtatataaccaatctgctgaccacactggccaaatccctttggctacaataccactggccatctttatgtaygtgtatatttcaaaacatcagtaccaaccagggctagacactatctgtcagtgcaagatttctgaaggtgcatttgtctttaggtcctttgtgtcctgtgatttacatttacttaaagaattcttctctggataattacagcaccaacttgatagaagcttagatttgtttatttttaatacattaacacttctatttattttagttttcaaaattaaaaacaagtaagtcaaaaatcaaactataaagcaagatatatttggaaggatcttgtttccattcttgccctgccccactctctccttctcagtgtgtgcaggtgtgaagtgtgtgcatgtgtgtgtgcatgcatgtgtgtgtgtgcgtgcatgtgtgggtggtgtgtgtgtatgtgcatccatgtttgtatttgtgcatctgtgtacatgtatggatgcatgcatgcatgtgggtgtgcatstgtgtgtgtgtgtstgtkcatgtgggtggatgtgtatgcatgtgggtggatatgtgtgcatgtatgtgtgcattgtgtgcatgtgggtgcgtgtgtgtgcatgtgtgggcggatatgtgtgcattgtgcgtgtgtgcatgtgggtgcatgcatgtgtgcatgtgtgggtgcatgcatgtgggcatgcatgtgtgtgcgtgtgggggcatgtgtgcatgtatgtgtgtgcatgtgtgtgtgtatgggtgcgtgtgtgtscatgtgtgggtggatgtgtgtgcatgtgtgtgtgcattgtgtgtgtgtgcatgtgggtgcatgcatgtgtgtacatgtgtgggtgcatgcatgtgggcgtgcatatgtgtgcgtgtgggggcatgtgtgcatgtatgtgtgtgcatgcgtgtgtgggtgcgtgtgtgcatgtgtgggtggatgtgtgtgcatgtatgtgtgcattgtgtgcgtgtgtgcatgtgggtgcatgcatatgtgtacatgtgtgggtgcatgcatgtgggygtgcatgtgtgtgtgtggggcatgcgtgcatgtatatgtgtacatgcatgtgtgtgcatttgtggctggatgcgtgtgtgcatgcatgggtgcatgtttgcatgtgtgtgcacgtgtgcctgcatgcatgtgggtgtgcatgtatgtgtatgtgtatgggtgcatgtgtgggtgcatgagtgcatgcgtgtgtgtgggtgcgtgtgtgtgagtatgcatgtctctgtggttgtgtgtatcttgaaacaaatatagcctttttatcagttgtcccaattaatacctcttcagacaatatggtttttaatgagtagctcttttgaaaccaggaaagtttctatttctaacccctttggtttaggcacagcctctttttgccatctggaatcaaagagcttgtgctgacgtgcttgaccgcgaacttggccctgccaccacccactccaggacctcctggcctgacttgcgcacatgcacacagggtgtcgggaggtgggatcatggcaggagtagttttgacttgggactgcagaccttctccactggcatttaagaagtgtgctgtactcgcgaggaataatggcagtgtggctgcttgggtgccctgtgtgggtgccggcccagaccttgcttagcggtcccctcctggtggagacctgctgctgcagactcagtccctgcctttgacgatgcccgaccttccccgctcatggcagtggagggtgagggggtcttggcaacagtggagatacgtgtgctgtctaaggagggacaagaagctgctcacaagcctcgtgcccatcccaacactcagcgtggcctcctcacaggtcttgttccgagcgagtggtggcaagcccatcgccgtgctctgcctgactgtggagctgcagccccacgtggtggaccaggtcttccgcttctatcacccggagctctccttcctgaagaaggccatccgcctgccgccctggcacacatttccaggcaggtcctgcactgaccctgcagcccacatgttgcaggctcacctgttggaagtagatacytcttgagggtgacagatggcctcatggcttcatgccstggtgctgtcagagcagcacgtggggcctggggaattctctctcctgcctttatggtttgaaacggtgtccctcttgccacctctgagatgactaggtgcgcatttgccggctgagtctgcccttctaaaaaatcccagctcccgcggcccaggtccaggtgtgcctggaggaacacctacctcctcacctgacggcccgcgtgtttctggtaggtgccccttacagcagagtgcaggcttccctgctccagggagctgtgttttcttttttgtggccccctcgattattccctgtggagatggctgcagccgagccgcagtgggctggatgggcggtgtccatgcagggaacacagtgcttggatgctgtcctgggaaaggtggcggcgtccgtttccccagcaggtgtcttgctgagcacctgtgacgagcctgtcctgtcctatagtgtgtaatgtgtggggccttctccacacaggctggggctgtggagaagactctttttgacatttcccctgctccaggtgctccggtgggaatgcttggtgaggaccccccagtccatgttcgctgcagcgacccgaacgtcatctgtgagacccagaatgtggtaggttgtgttgtggccccagctcaggcagatccttcccagtgagtctgcgcccctgycggcttccccacgggtatcctgggatcctcttcattttaggttttctgctaagtggtttctttcccaaggtactaaagggctattttgacatccttatgagagctttatgagtgtgtttttattttttctactagcagatcagctccttgatcatctgaatttaaattttaaaaaggcacgaagcaaagttaataaagtggatggtaattaaggcacttattaattaccattatgtaaaggataaggcaataattgtgttatgaccagttaggaaaccggataaaatctcctgtagaatctaattgttgagatccatgtaaaatcaggaagctaatgatcttctctttggcagtgaacagaatagtgaattccgattggtatagaacatgaacagatgcgttctgggagggactggccgtcactcgctgcgtgtattagtcacagatttaggggccaggctggggtcggcagagcactgtgtgccctgatgtgctgcacatctggttggcagggccccggggarccacgggacatatttctgaaggtggccagtggtccaagcccggagatcaaagacttctttgtcatcatttactcgtaagtgcacaggctttggggacctggaggcggtggcggaggagaggaggaggcaggcctggggctgctggtggattgaaagtgggcttggccccttcctaaaattgggggagctttcgggccttcgctttgtgaggcgggattctgctgcgagttcagggcccgcaggggtctagggaaggcaccttggaggggcacgtgcagcctgagggacttgggatgcagctcctgccaccaaggagagacaccagtcagcctctgtccccagatagtggcaagggccacccagaagcccctcattacctttttcttgctgagtccctaggctgaacagcatgaatgaagctgtggtccctcctgcggagaggcaggactgtggtggaaatgcccatccctctctcctccaggctaaatgacccggcccctttcccctcccctcctaagtcggatccccaagccctgtgagaatcctttcaarctggtgtgagctcggagatttcctgcagtgcttctgaggatggggcaggggctaacctgcactcagtgcccaccacagaggggccaygtgaccacgtctcagagtggcttcctcgtgagcccatgaagatgcctcacccagccccatttgactrtgaagcagcaggctcttggccctaaaatgctaacaggggcttccgtgctcaggccggcatgacctccagccccaccctgtctcctgcgtggcgctgcccttggcttagcctcagaacccctattgggggtggacacttgtccaggatgtgtgtttggccaaagcgtgccttgtcatttgtttgacatgtggttcctaagcagccctgctgcgccctgagagcctctgctgtgggtgggagatgggcagccaggggtggagccaccaggccctagctctgcctcctggggcctggtcctccggggctttccctgcgtggccccagctctgcctcctgtggcctggtcctctggggctttccctgcacagcctcctgtctgcccacgctcctggcagcccttgttggcctctcgtgggccggtgctgagtcytccgggacaagtgcagatggctcccatcccactgcagggatcgctggctggcgacacccacacagacgtggcaggtctacctccactccctgcagcgcgtggatgtctcctgcgtcgcaggccagctgacccgcctgtcccttgtccttcgggggacacagacagtgaggaaagtgagagctttcacctctcatccccaggagctgaaggtacggcctctctgggggctgttctgagcctctccccaaccccagcctggagacgggcagtgggcattcagctggagcacagtgggtggccctgacagcagcttttccagcgcctccagcgygcagacgctgttaccagaggcctctcggcagttgcctttcgttagatgtgccattgtggggtgagtgacgtacacaccaaccccaaaggccggtgttcagaattcctggcaaggtgaacagtgacaggagctctggtgttagtgaagccacagttagacggggtgggagggcggcccctggtgccaccagctggccggggttttaagcccaagatggcttcagttctgtctgcggaggcagcgcttagggaatagtcgccgtgtgagaggagggacttgcctggtgtggacccragtcgcggccacagtcatgtcagggttggttgtggcctcagatttggccgccccggaaccacccatgaccttgggctcccctggctgattgggctgcaggcgcccaggagccccttgcttgcacatcctgagaggctgtgctctgacccgcctctctcgctcttgaagacagaccccaaaggtgtcttcgtgctgccgcctcrtggggtgcaggacctgcatgttggcgtgaggccccttagggccggcagccgctttgtccatctcaacctggtggacgtggattgccaccagctggtggcctcctggctcgtgtgcctctgctgccgccagccgctcatctccaaggtctgtatgtgtggcaggcacaggctgaggggatgggggctcaataccagggcactgcaggacccccacctcggccctgtgactcggaccactggatacagtgttctgacccagcagggccgggtgcrtgagtgtttgctcctgtgctgtgtctctcccggatggaagctccagagagcgtctgtcttatctctgtgggggtccccgtgcacggtgcacaggagactcagggaatacttggaggaagggccagtggctgttcccgtgagtggccgcagcgtctccctgtcccctccctccacaggcctttgagatcatgttggctgcgggcgaagggaagggtgtcaacaagaggatcacctacaccaacccctacccctcccggaggacattccacctgcacagcgaccacccggagctgctgcggttcagagaggactccttccaggtgtggtggggctgtgcctgggactcctaggggaagacccggggacctgaatggagggcagttagcctgcatttaggagcgagttcctcaaatcaccagcagtcttccaaaagccccagggcggtgacaggtaccatcccatagttgggtgggcccgttgtctctttagtagctggagatttagcaaagtttctcctgagtgtgggaaagggtgttgtgcccagggcttttcatggtaatgttagacagctcagtctcggaaataagtgtgccttcgagtccaagtaacgcgtcacactggctgagcactggttcccatccttgtaccgggcgctgaagtcaaaggcaggccttggatgcacccgcagggctcccctgccttgtcagctccccttggaaataaacacgaccatgcagagaggttgctggtgagagcgtgggacagcccgggggtggatgctgggatttggatgcttatttccaggtcgggggtggagagacctacaccatcggcttgcagttwgcgcctagtcagagagtgggtgaggaggagatcctgatctacatcaatgaccatgaggacaaaaacgaagaggcattttgcgtgaaggtcatctaccagtgagggcttgagggtgacgtccttcctgcggcacccagctggggcctgtctgtgcccctcctgccctgcaggctgtcctccccgcctctctgcagcctttcacttcagtgcccacctggctgacctgtgcacttggctgaggaagcagagaccgagcgctggtcattttgtagtacctgcatccagcttagctgctgctgacacccagcaggcctgggttccgtgagcgcgaactccgtggtggtgggtctggctctggtgctgccatctacgcatgtgggaccctcgttatcgctgttgctcaaaatgtattttatgaatcatcctaaatgagaaaattatgtttttcttactggattttgtacaaacataatctattatttgctatgcaatattttatgctggtattatatctgttttttaaattgttgaacaaaatactaaacttttacacgtcttcccttggcagttttcttgagtgtctgctggcgcaktgtcagaggcttcctgtctacagcacaagcccggtttctccttgaggagacatggtgggggccggtcaggcagcccatgccatgtgtcctcatggagaggccgctcaagcctgccctgggtgggggctgagaccccggctctgagacggcagcagtcgggtagaagtgcgaggggcggagggtcctgtgcccctgagcggagggtgggctgcacccagcggtggttgcagagagcacgtggccccattggtccttgcagtgaggtgcggtcctcgtttgcagagatcagtctcggtgggtggtctctgctgcgtctgcatgctctgatcctgacgcagtccccatccttcagagagaaatttcactggcactgtagttggaccctgaaggtcagagctgtggctttttcctgcgtctgtgccaggggcagagagagagtggagatgcctcctcgggcagtgtgtttgtatcctggtgctgcttctcacgagacagtctgccctcccttcccacggactctccagccggacaggactggctgacacagttttcttttgagggagctggattttctcacaggccccaaggctgagtcctaggcaagggaacaattgtaagatgtccagtccttcagtcctcatggaagaggctccggggagtccaggaagccacatgtgggttccatccagccctgccctgtggggtggagagtcctcgtgggccctgcaggctgggtgggcctacagactgcaagaaagtgcctggcctgtgcttgcaggatgtccatgcagaagcggaaaccacagcagcaaaggagatccatccatgggctagaaaacctcctgtggacgtgtcccttcagcgtttgtaaagctgcactctccctgctttagagtgtctgccttctaggggctgctggagacatccattggaggccatggcggtcgttggtttactccctcactccttcatctggtaccacatgcctgctgtggtctccaccctctcagaggctcaggaacatagggaaggcccatggtacctgggacactcagctgttgccagcccggagtgggaaggaagaggtgcagcctcccacaggaggatggaggttggcgggggcttcccacgagtcgatctgagtgggtgaataggggaggggagacctgggcagagggccatgggagctgaggcccggggccagcggcatggtgtgcccagagtcctaaggaaggccaccaggctgagaagccatccctgatgcaaaacaaggtcctktcaggccatgaggaggacttttatctgtatcaaaaagcgtcaggaagcctttgaaaggttttatgcaaggatgggtgtatttgggtaagatgggggcagtaatgtggagaattaattggagtgggcccagatgtaggcaaatgagaggctgctgcagtagttgggagggagatgatgggagaatggacagaagaggctatattttgttcagctgtgagtgattgaaaatccaaaataacactgtcttaaacaagatggccattaatttctctcacatttaaaaatccaggtagctggtgtagggctggcgtggagctccaccatcactgtgctcccgtctttttctgtcttaccattgtgctgttcttaccacgttgcttccaccttgtatcctgagatggctgctgcagccgctgccatcaccgctccattccagtcagctggaagctggggtgaggcacatagctccttctgaaaagttactgtccggaagctggacccgtttctctgcttgcatccttgtgttcgtttcctatggttgcctaggttggcctctgtccacgccagagctggcttggaaagactgaaggagtgaggtggaggctggactccaggggggaaggagtcacttaaggtgtttctgtgtcttttcaacatgtacctgtgcggagtaatgatatctctctggcttgtccctgttgtcatctgggttgggattctccatgttgctttttcttgaaggcggcctctgaatttgcacgcctgcctcagggcaaacgctgaacagccagggatcccagcttgtccacaccctatgctggctcaaacgtgtgcagtcatgatacggagccgtctcttcgagtcggatgtccaggcctctggtcacagcgtcacctggccagagcctccgagtaacccaggtgcctggtcacttccctggcagctctgtgtggagaaggtgcagctgtgatttactgggtcttgtcactgcaggcaccacctgggcagcccacccatccctgtccactccgtctggctctcgccctgctcctgctgttccccgtcgtaccacgcgagggcaaggcctgccccgttagcctgctgcttccgcagcgccgctgcactctcattaagggtctggggaatgagccactgtgatgggtgctgagtcgtgcgggcaggaggctcagactttctcctaataggtgcctttaaagtaatgttgatggatgtgattatgaagctattatgtcccatttgttcctacagtcttgctggggagggtgaccgggaccattttatccttcccttgcagaaagtctcggtcagatgcattgtactgcaggggaggcagggtctcaactgctcagacatgaggcccaagcctgagatgagccagggaggactccggtgctggagaattaggtgggcgaggcaggagggtctggggctgggtccctttcccaggcctctgggctattgggctgcaggtcagtgcgagggcctgggccgggcaccccgtcatgctacagaagccgccccagcgctctgattgcgggaccccacgtgcctcaggcagggatatgcttagagccattggtcccacggccacatctgtgggcagacagtagggtgggagtgaagggagacctccgtggggacagtcgatgccgtaggtgtccatggtgacttctcgagatcgtggataaggaaacgggtccttctgtgttcctaaaaggtctccacaccccacagatgtgggcatgcgtgggataaaggaggcccctccctaaaggtagcaacaccttgttgtctgccattttcggcgcgggccacatccctcagctcctgcgtctctgctgcgaagctgcaggaggagtttgggattttcagtctgtcagggagggcactgtcgcctctgctttcccaggctgccttcatctcctccactgtggccaagctgaggatgcctcctggactttgccccagctcccgcacctgaggtgctggcgaaccctagacaggaacatcctgctggacgggcagagctctgagaaggcactcacgcagccctgggtgcctcctaatggtgcgggggctctggaggcctcatcagatgccttggggaggggtgtgggacactttcatctccgccccctccatttccagatgcgcccaagagctggctgcctccccggcccctgcagagagatgctgcctgctctgaggggcctgctcttcgtcacgtgggttttccccctggaagaccaggaagcagctgcttttcctggagaggtggatcccccgagtccattcggtccttgcacagcagaggggcccgcggcgctccctgcccgtgtctggtctgtaaagcaaggactcaggcccttcagctgctccgatgccccacaaggcgacagcagagagctggccaagcctccagggctcccgcctgttcgaggtgctttggtaacgtggccaccaccccagcctaccgggctctcacgtctgcgttgtcacccccacggcacaggagggaaccacagcatcagatgcaggaggtgccgcccaggctcgaggagcaggcagcgtgtgccctcctggacgggaccaggctagcctgtgggctggaggacacaggggcatccctcaagcccacgaggagaaagcggcctggcctttggcaagagagacgccatcagccagcgaagctctatttgccacgtgctcctcacgccctcattcaacccgagtgtagacagaggtccccctggccgggggagatggatgctgcccgcccagtacctggctttcttgggggcccagatgatcacatggggacccgtcacggtctgtcgggcggcgctgagggtctgaggggagcagggggatggtgtgaagagggactttagtttggagatcgggcctctctgcgtaggaggcagctgagagagaatggagtggcaggggccctgcaaaggggcagcggggcaggggaggctggcgaggggcctgcagggctgtgccagggcagggggtcgagtgggccaggggaggagctggtgggctggagtggacaggtgccatgtcccgtgagttctccggccctgatcccggccctccgtcagcatggagcccagtcctcgtggggggcggcgatgccgtggctgcctcacccccatcccgcagaccccactctcagtgcttgtggcgcgtgtgcctcttgctggctctgtggggctgggttgaggcctgggacccctccacagctgcccaccccaaagggctccttccgcccagggtggggtggcctgagggcttcggccagccggtcaggaccccatgccttctgctgctggcctccagctgggtgtgttcctgggtgtaccctggccttccacgagaagaggcatctcggggaggggtctcttctgctgggcacaaaccccaggtcaagcctgctgtgtgctctgggttgcaaaacaccagccttgtctcttcctttatgagcccacaatgtcctgtgccgaaacctgaggcgtgggctggcgtattcactcactccccactcccctcttgccagtcgcaggtccagctgggcagagccgggatgcccacgtggaagctgggccctgcagcgcttgcctatggggacggggtacctgggactcccccgatgagggcaccacgctgagctgctgctctctccgtgcaaagccgcatgcctttcaaaggggccgttatcattcccatcacgggcatttctcagctgtgatttcatttctcccgcctgctcctccctcctcctgcccctgttgaaagctacttttcactaaatggagtcaaatgcaagccagatgagctgctttgtatttctcatgtttgataatgatttaatgctatgtttgtctgtatttagaaataagacactttttaaaattgttgcctcaggttctaagagggtggggaaacagccattattgcttccctgatgaccgctttttctcctgtggacggaggcgctgccgctctcaccccagcaacctcgggtagcacttaccgggaggtgcgctgaggccttgacagagaaagagacagagggctcaggagcagctggtggcgtgcccacgggaggtattcaggtgggtcgctgtctcgcacggcccaagcacagtgggtctctctggccctgtgcaggatgccaccctacagacgggaaatgaagaatgtagacccttcctgcctggaggacgctggcgctccacctgccgcactccgctggtgatgccacgtgggccccactggctctcctgaccccaagccaaaaccacgcctgagcgggtccacaggaggctgtgcagcgcccgggagcttctctgcaggttgggcagatccacctcgggccaggcccctgggtttcaacactacccctcacctctccgagggggtcctgggaaaccccttgctggtgggagaatggatgactgaggaacagtcaccccaacttcaggggttgaatactgtccctgcaaaactcacatacactcagaacctcagaatccggctgtttgggaagagggtctttgcagatgaaacgagggcttgagatgaagtcatgttgattggggtgaccctaagcccagggagagtgtccgtatg

SEQ ID NO: 12322 - DNA, 28003 bp, Homo sapiens
acgtaggtccctttctgtttacctccatctcctttgccttgctgtttcctgcctccctgttgggctgtaacctccatgaaggggaggatcatgtctgtcttcatcattatatcctgagtgtccaccatggtacatagcacatgctgaatgaatgaatgaatgttctccaccctcgctctttacccaggtcggacatcctccttaactgactcattgtgagctacctaggcctttagatgttgatatagtttggatgttgtccccgcccaagtttcacgttgaattgtaatcctcagtgttggaggtggggtctgataggaggccactgaatcataagggcaaatttctcatggatgctttagcactatctccttggtaccgtcctcatgacagtggagtgagttctcacgagatcaggtcatttaagtgtgttccacctccccactctctctctttcttgctcctgttctggccatgggacacgcctgctcccacttccccttctgccatgattgtaagtttcctgaggcctctccagaagcctagcagatgccagcaccatgcttcctgtacatgcagaaccgtgagctaattaaaccttcttttttttataaattacccaatctcaactatttttatagcaatgtgtgagtggcctaatacgtatgtcatgaacacacaatagttgtgtcagactttgaagtagaagatagaatatcttgtattcttcatcaaaagagacttttacttaaaatgttcacaggtctgagagccatggcaggatcagggcaaatctgtaggagttcaccatcccctgccccttcttcagctggcaggctgaactcagtgctgtggttttggaaccctggcaagtctgaacctaaagtaaagcgtgctgtttggcactcagctgtcaagacaataccttctacaagttggtcaaaggatttctgaggaatgagatttcccagccctctaaggtccctgcagtagcagcccctaattcctagcatcttggagaaagactagttctcaagaatttgaaacaaagggaaaggtcaggcctttgcaggcatctcagttagcagctctgcctggtgggggtcactgaggtactagggaaagggaagagagaacaggaatatgcatgggagatctgtaaagtaggtgatctaaatttgactgtatgctggtcaatatcatatgacaccataacctctgccttattcattaccggctttcaagcattcagaggtggcttttctgtcacttttgggggaagaatccacataatcctatcacccaaatgttgatccctgttactctgcccccaaccctgcctccctaaaccccttcctctccacgttttaggacgctgtatattccttgttctcttagtccttccaaccacttttcccatattccatgactcttcctcctactccttaaatatgaatactgggttttcctaggatgaagtcttcagtcctcttttctttccccgtctcctcagggaccttactgtaacagtttccatctacaactttatgctgatggctcctcaatggacatctcatccactcactcacattcattcctgacatttcagtagtgattatgggctacatctacaggacttcgatttcaacaggtgcagaacttaattcttcagcttccgcagactggtttccttctaccggtgctcctgtttctatgcaagaattcactgcttatcacatctctgataggtgaccttctagaaacctcctttaagccatccacctccttcccatcctatgtttagtcccaccaagtccgtggatctttctttcctttctctctgggatctgtcctcatgttagaactattcagttgtaagttacaaaaccccaaccaaatctggctcaagtataaaatagattttattggatcacatctcaggaaagttgcatctagccccctaccagacatttttgggaatggcctgtctgtgcttcttggctgtattgtcctctgtgttgttttcactgttcggcaagtgtttcctctgcagtattagatgtggaaggtgaatgctttatgctgtttgcatgactacataaattcctattcattcctattcgttttctaccaataaaattgagttctactgccctgccattttgcttttaatgctaaatcatgaaattccagagcttgaccttaaaaagcagcaagttttcatatttaacataaagagtctcagaaagagataaaggagatgtttgctcatcgggaggctcccccagggagagagacctttctgcattatacaacttgttccaaaaattctgatttcatggggtgttcaattgataacattcattagaatataaaacctgtttttctgtgcactgtagagacttttgtgrctattcctggttattaccaacttgttctgttcactgttttcggaagactaatttgaacaaaggcttctagtaaaactgccaagactttaaaagttgttacaagttgtgaaactgtccttcaaagagcaacttttacctctgactggttgcctttcttgataatgtgttgccctggcaataccgttgaaatggccacctctacatttctgcaaccatatatgcccttgcaaatattttaggttttgtgagtcatgtggtctatgttgcatttattcaactctgcccttgtagcaccaaagcagccagttagcaaatgggcatggctgtgttccaatacaactttatttatgtacactgaaatttgaattttatatagctttcacatgtcataaaatattattattcttttgatttttcaaccatttaaaaatataaaaaccattcttatcttggtttttttttttttgagtactccatctagaaatctctttccccagatatttgtgtggctaacttccttacctccttctaggctttccttacacttcactgtctcaatgaggcccaacctgaccatcttgtctaaaactgcaacacccattatatccccaccgctatttgttrccccccttaccttgttataattttcctatagtacttagaaccttctgaatagtaaataatgtatttatttattattgtactgtttgtcttcccttgcccaatgataagctccctgaggtcagggttgttgtgtttaagctctcagatgactccaaaatgcctacaagattgcctggcatgtaattgacactctaaacactttactgaacaattcaacagatgaattaatagcctgtcaaacctatgatcaaccattagattggagttcaggtcatttgataataaaagttgatttccagatccttccaccaaaaagacacatgcattctcatgttcattgcagcactgttcacaatagcaaagacgtggaatcaacctagatgcccatcagaggctgactggataaagaaaatatggtacatatacccccatggaatactatgcagccataaaaagaacaaatattatgtccaaatttgcagcaatatggatgcagctggaggccgttatcctaagcaaattaacacaggaacagacaaccaaataccacaggttctcacttataagtgggagctaaacactgggtacttatgaaaacacacacacacaaaagttggtttccttttcttgaagtatacagagggcttggtcttcagaaatggaattatgtaagattcacttactgttggacactccattcagaataggtcaaagaactccttcaaattcagagaaaaaaaaagataactgggttttaacataaaaaatggattaatatttattttatacttctttcccaaagtttgctttatcccctgctcaagtatcccctgacactttagcattctgcatcatctgaatcttcctccaacctccccactcctggtggtggccggggctgatgactagggacagtcttaagttgctgacaatggggaccctgaagtggaaagactaggccaggagcaaacaacttcattttttgccttgaaaggtcaatttcagaaaacaaatggtaagagatgtttttccttatttttttaaagaaattcatggtctgcaattgtatttttccccctttttaatttattatttatatgtaagtatttattattttcccttccatgattggttcattttttcattttttggttagtatttcattaattatacaactagcatgcactacaatatgagattatagccatatctttgatcaaattttgttggaaatgagacactcttgaactgattttcttgattcactctataagcaccttaattgaaaaatacagattatcttacagtgcccccttaaaactaaagctgtattctagcctctgtacttctttttattattattatttttgagatggggtcttacatgttgcacaggttggtgtgatcatggctcactgcagcctcaaccttgcaggctcaagtgatcctcccacctcagcctcctgagtagctgggtccacaggcacacacgagcatgccaggctaatttttctttcttcttttttttttttttttagttttaatagagacaaagtctcactatgttgcctaggctggtctcaaactcctgggcttgaactatcctcccacctcagcctcccaaagtgctgggactacaggcatgagcttctgcacctggcctgtacttctttgtagtacattttatatttcttgtaattcacttactctttctaactccagattataagtatttatttacacatctatatttgtcattatacttaaacttcctgaaaatagagactgtrgtttactcatttgtatgctcctcagatcctaagtgtttaattaaaatcttaattaatgaaatgaaatgaaacgtacatagttggcttacccccaagaatttcaatagctccccttagcttgccatgagaggcttttccttatcagagccctgcctttgtctatagtcttatcagctgtcattccctctcaccctccagcccctataagctctagtccctctgggccatgctgttgctcatttcttgcctttatacatcctcttccctcaaactaggttacccttttgactgcatggtgaatgcctcaccatcttcaagccttagtttatacttatctgtttattgtttccctcattagccttttaaactccatgaaaataggggcctggtctgtcttgttcactgctctctctccactgtctgaaaagcaagtagagactggatcaggaaagatcttaaatacaataaggagttttgattatttctagggggtaaccaggaaccactaaaacataagcagagaaagttatgtacaggtttttgctttagaaaaatctctctcatcgctgtatggaggaatggtttggagaacgcaggactggccctaagaaatcaatcagataattagagtaagcaaaagtgatgaggatctgatctgtggctgtatcagtggggtccgaaaggaggtgagggatttgagagttaggagagacagaatggcaggaattggtgacctactggatgctgtgaccgagggtgagggggagtgagggacgatctcggcttcagatttcactctggctgaggatatctggaacgatcgcatcgtattaacaattgtatgtttacctgtggatcactcccaattagtctgaaagcatcttactatagggaccttgctttgtagtctttgtattaccagtgttagaagagcacctgttatgtaggaggagtaataaaatgaatgaatgcactcaaaacactaaacagtaattctgtaatccaacgggaggtacagcgaataccaaaagcctacatatactattctctgcatgctatagcaagaaagaaaggaaagtggcttcccggtggttttctgcctattgtacaaccaggaagctgacaataaagtttatttgagcgtcgacgtgcgccgacgtggccccgcctccccagccggagccgcgattggtgggcatttgccggcggccaccgcttttaagccacgattggcgaaggccgccgtcatttcggagcgactcagcgcctgcccgccctctcgccgcgtcgccggtgcctgcgcctcccgctccacctcgcttcttctctcccggccgaggcccgggggaccagagcgagaagcggggaccatgttccgacgcaagttgacggctctcgactaccacaaccccgccggcttcaactgcaaaggtgaggcggcggcctcagcccggccgcgtgtccctgacctgggcggaggtcccagcctcagtgcccgcaccccacctccccgtcgggaccctcggcggcctggtttccgccggcagcctccgggcccctctcctctgggtcgccacgtacctcggctcttcgccgccccttcccgcctttaaagccctctcacctactcctgtctcggcatgttactttctgcacttgcttaactccaagcatcacgtaactaccttctctgtacataaaagggagagcattcgtctttctcactcactattcaactccatggttccctgggtaattaggcgataccttgagcacctgctaattatgggccagcgcggtgctggattctgaggaaggtgctgagtaacttgaagactagttcactgcctgccaggagctaaagggacgaggggtggaagcaatcagaacccactgagcagtttgagacagtacacaatgaaatcaggaccgatcacagtgggagggtaagcgcgtgtagtaacgggctagttgtgttatgtggtgttgcaaaaaagttaatagcagatgagtgggaaggttgaattgtgaatacaaaggtatttgggattttacagcattagaattttaaaaagtaataacgttgctactcactgtaactaaactgctacccaccactactcgtttcctttgtatagttgtggcctgtgatagactggtaagtttgaaagtgatcaagtataacttgtgatactcagaccactgtgtaattctcaagaccttataatggaagcttgaatttgactcacaaattgaaaataatttctaagcaggatgacagtgttttgttgatcgcctgtagaagcatatcaaattataatctattgtttttctactttaacaaaaaagtatcagtgacaatagagccttgttctggattggaatctttgagtctcaatgttcttatctgtaaaatgggatattacctacctcaaaagaggtatggggaggattaaacgaaacaattatgcacttaatgtgcagttaacattccatgacaacagttgtcacagtgtcttttttgtcatttaatttcttttacttattattttgttgtatattttactttattactttgctataaatttaaccttgccctccttcccctttctgtccgcaaaggaactggaatattaatatgtaacacttaaatagcaaaactatgtgccaggcactgtttttatccgtatttattttatttaagaaacttcttaaataaaacaacttcttttaatcttcataactctatgaggtaagttctattagcaccctcattttgtagctgaagartctgaggcacagaaaatgtgggtgattatcccaagttcacacaaccagtaagtatctggacccaggatttgaacagatcattgttaatctgtactttcaactccagaatctgtactttcaactccctcttttggttcaattaatttagtattttgaagttaagaaaattccacaagaacatatatctgaacatatacctgagaaggaggtattttatgtagtgcttctagttatttatgtgatattttttattgcagatgaaacagaatttagaaacttcatcgtttggcttgaagaccagaaaatcaggcactacaagattgaagacagagggaatttaagaaacatccacagcagcgactggcccaagttctttgaaaaggtaatgaattaggaagtaaagtaaaaatacagagagtttgtctgaaaaatcatgaagatgagcttaaaattactttcttcttttaagaaaaaaatgataatgatcagtgttaggaaagctggatttcagggattttgcttttttcttagatgtgtcttttgcttttagagcaaattattttatgtcttcctaccaagctttcagtattaggtagaaatagttttctctagaaacatgaagtttcttaaataaataatgatgtaaatatttcgctttccctttatggcccaaatcagaatttttgttaaacacagtactatttcttatattaaaagaagacattggctaggtgtgatggctaacacctataatgccagcactttgggaggctgaggtggcagatcatttgagctcaggagttctgacagcagcctgggcaacatgatgaaaccctgtctctacaagaaaatagaaagttatctgggtgtgctggcctgygtctgtagtgtcagctaattgggaggctgaggttctccagcctgggcgacagagtgacaccttgtctcaaaaaaagacattattgagatgcttgaaaaccaagactgtcgtgtttatgcttatatttaatgtaaacagatatcccttgttgtatgctagggaaatagtccttaaatgatctctggtatatcatatttttgtgccttgaatcattttcccattgatttagttttagtaacacttttgcataaaaaagaattctcagattagaataaaaatgcttttagtgtcatttcttacattaaacattttcatcagttatatttgatgagtgagatatttttcttgaaaaaggctaagtttttcatttgcgagagcagtgtgattaggcactttctccctagaatcagtgattttataaattagggattgtataaattacatcattgttattaacctttccgtgtctcaattttttcatcaataagtgagggtaacaatgatacctatctcataagtgtggctttgtttttaatgagtaattgttcacagaagtccctggcgcatagcaagtgtgataagcttattactgccaatgcctctatactactactattaatactactgtattcttttcctttgctcttagaaaatatttttaaaattttcagtggacttcttaaaactttgaaatatatttttaggattttatgtttgtttatattacattwtatggtctattcatgtgtacaagacagtacagaattctgcatgtagaaaggtatctggagaatataaaaaattgtctaggctgggcacggtggctcatgcctataatccaagcagtttgggaagccaagatgggtggatcacctgaggtcaggggttcgagaccagccgggccaacgtggygaaaccccgtctctactaaaaacacaaaattagccaggtgtggtggcgcatgtgtgtaatctcagctgcccagggggctgagccaggagaatcatttgaactcaggaggcggaggttgcagtgagccaagattgtgccattgcactccagcctgggcaacagaacaagactctgtctcaaaaaaaagaaatatgtatgtatgtgtgtgtatatatgtacatatacacacacgtatttctgatgtgaaacacctggaatgacagtaagaataatttcaacatatcagaacctaaacagttattatccttcaagttgattttattataatcttatattacatataattaatgttacatataatactattatatgcaacatttatttgaatatacagcttctgacatttatttaaattacttggttacaccctacatgtatgttacatggctactcttttcagtggcatttccataatatgaaagttaaggtttagatagataatgatttattgtatatcctttttaaagttattctttttagttaattgctctatgtgtattgagactaggaatcagaaagcttagattctagtcccaggtgtaagttgtgtaacccttggcaagtgtcaatctctaggcctcagctttctcatctataaaatgaggaagttgtcgtattctattttttttcttaagatgatacacttaaatgttcccttctgttgggttatataattgcatcaaaagtgtagtaatgttattaaaaaattgttagagatccaaactaaggtctctttcaactctcccattcttttttctgtgactttatggtaataatgaaactggtggttttcttttcttccccctcacagtatctcagagatgttmactgtcctttcaagattcaagatcgacaagaagctattsactggcttcttggtttagctgttagacttgaatatggagataatggtacgttttgtggggaatgtgtattttaaagagagaggaaagatgggaaagggagtgtgaaaatgtagggaactttgcagtttgttttgtctagtactattttacctttggtttattcttatcacaagttaaaagcacttttattgtctttcattggtgtttatatatttctgttagaatttggaaatggtgccctctggagaaggctaattractgtcttctcacagagtaacactactttgataatatggtctgcaccttagcctttcaaattaaattgtttttagtgtcccagaattgatgggactttgaagtgttgttgcagtaggtaatttctcaaaagactgaaacatgtctaatgccaatatacattaatactctataggccagaatatattacttaygtttactgtcttagcacagatacttctatggttggaagcttctgaatgttagyacctatagtaaaaacaatttttctttaaacgggtgttttctcttattagaccatttcattttgaaaggcctgccaacatctaaatgcaagatttgattatcttatctgcatcccctgcattttgtgtttttcggttagytacagycytsttaattatttactttggaagcctttttatatcttggcttatccctttcccttcatcccacctacactgactttttctcatgtttgwtgtatcttcattcccaytggcataatcctaattcaggctcttgtcactttctgccaggagtattataatatctcccattagtgtcaccttctgttcttaactgcatggccaaccaagctaactttctgaaacgttaatctattttaggatgcmacttactccttgtttccaaagaacagttccagttacatattcatattaataaacatacatatccataaacactaatttcccattttctataaaaagaattttaagctcctyagcatggtagttaatgatractgatatccaacctgtattmacatcttgacatcccagctaaattagaataatagtgcttcctgtttatatcccatttccccctctgtttctttgttcacacttttcccttggctaatataccatttcattctatctamacatctaaatcctacccatctttttaagatccatctcatatgcygtcttatgtcttagcagcagtataatttccctctgaacttccatagcttttaaccctatacattttaagtcattaacmactttccattttgcttctatgtcttattcgtcccagtaatttgtaaactgatactcagctttgattcctacatggtacctctcttagcttccaattgatgctgtaacaaattactacaaactcagtgactgaaaacacaatttattattttagaatgagaaggccaacattagcctcactgggttcatgtcaagttgtcagcaaggcaggttccttttgraggctctcgggggaatctgtktctttccttttttaacttctagaggctgcctgaattccttgactctggccccttcttccttcttcaagtctagcagcatagcattttccagtctcttatctgattctgcttccattgtcataactttgtctctggctctgatcctcctgagcccacctggataatccaggataatcccctatctcaagatccttaattttatcatatttgcaaatcttgccatgtaaggtaamacatacacaggttccagggatcaggacatggacatcttggggggtacaggtcaatattgtgtctgtcacagtacctgacatagtttcttgcacacaacaggtgcttatcaatttcagtaatgtgtggcgaatgcagtatatgtgagtgttwacatacactgatttggagcatcagccaatttttkgctgatgcctcagacttaaatttcagaagccttatggcaaaaatcttaaggaaagctcaatttgagacttcgtttacttttccatttaatttaaaaaaaaaaaacttttctttctttagaaaatacatgtattcataagccttatggctttagtgtagtattgattttagggcctttaacaaggtctttttatctaccctgctctggattggtaggaattgtatatgagccaatttgtagcttatcaaaactgtttttcatttattcccaaattcttacatctcagtttatttgttttattctatttgttccatttttataacccgttaaccttcaatggtagatgcatatggtcatgtatacctgcagttgactttagtaagtacatgtatttctcagtaatagcatgttcttttagtgaataaaagaagcttgtgtgtggaatgtaaatttttcaatattgaaaaaggaagtcaacatatacttgaaggtgaatggtatcaaaagtatattaaaagtctaagctagaaaacaagttttgtttattaaaattcagaattgcaaaaacagacttgaaaattggtcaaataatactgtctctaatcggtaggaggcgctgatgttcttttgtggttttacattgatatgttgcctccttgacttttaagttacttattttaaaatttgctgaaaccattgtgagtttttattatttgygctctactattttttgaagccttttggtagcttgtcaacatgatcaataactgaaattttttaaatgtataatttcagatgtatagaaaaattacaaaatagtacaaagattttcatatacctcaagtctacaaatgtagcgtgttacctcatttgcttcatccttctctctacacagaggcacacaccatttttttccaaaccatttgatagtaaattatagatgattcctttttactcttaaacactttraagtgcatttcctaaaaacaactttgtcttatataaccacagtacagtgatcaaaatcaggaagttatctttgatatactattatttattcacattttaccaaaccccccacttctctcgamagaaaaaaataacccagagcaatcctggattatgcaccgcattagttgttacatctgtcttagtatcttaaaatctggaacagttcctgtctttatttgtgcttcatgaccctgacatttattttgtagagtgtccctcaatttggatttatatgatgtttcctcatgattagatttggggtttatacttttgttaggagtaacacagaagtgatgtgttctttttagtgcatcatattaggagatacgtgatagcgatatgtcccattactagttatgttactttgatcactaggttatggtttctccactgtaaagttactattttcctctttgtaataaatatatcttgtggggaggtactttgagactgtatcaattatgtttttgcgcctcaagtttcccccactagttttagcaaccatatgatgattcttgcctcagtcatttattatgttaatcgacaaaaggtgttctctaatttcatcattttttctacatttatttgttggctttctcttgtaagttttcccatctctaatttacttgtttaaatcagtatagatacatggatttttattttattcaatggattataatcctttctgtcatcacrtattttgctgttgatactgttccagatttggccagtggaagcctttttaactctgacttaaattttatgcttttattttttcctcgtttcattaacagatcccataagcactgtatagcctaagatgccattttgaacattaagtttagtgaattattaataagtgtttttatttttgaattcctttkaagtattgtttttcaaatgaaaataataaaatctacctttggaattctgaatttcaagtttccatgaaataagtttgaggtttgtatatgatggtrtatttgatgtattgatttttttggggaaagcaaggtttttggattttatgtacagcattcaaaagaagatggggggaaagcgtactttttaatgagtttgtatttaatcttacgtaacctatacttaaccctcctcccattcttctaccccagatttcagaggaagctgtaaaagcagatttttaccttcctaaaatttacatgtttgaaatgattgcctttagaaatgttaatgaaaagatatttgtgtcacatagtccagtaattgctttagcttaatcaaaaagatagttacattgtctttttacattttctatagcaaaaattaagcttgattgaatgaattgttttatgcttatacaggttaagcatccctaatccgagaatctgaaatcctaaatgctccaaaatccaaaactttttgagcactgacatgaggacacaagtagaaatttccacacataagcacttaacacaaactttatttcatgcacaaaattattaaaaatattatatgaaattaccttcaggctatgtgtataagttgtacattgaacataaaaatgaattttgtgtttagacttcagtcccatccccaaaatatcccattttatatatgcagataatccgaagtctgaaaaaatttaaaatyggaaattattggcatttccagtaagggaaactcaacctgtaatcattttggctcagttaaatttggtaaatagcagtagtcattttaccttgagttgcagttgtacaaattatatttttgcctstttttatagctgaaaaatacaaggatttagtacctgataattcaaaractgcwgacaatgcaactaaaaatgcagaaccattgatcaatttggatggtgagtatataaatgcataacattgaacatcaacatttttggttttttaaatgtttttttctttgaagaatgaagtccaggtttacttggttttagtaaatttagaaggatccatgcagacagcatttatgttaacattttattctctataatgtttttatratgtgctttctccttccccttgcatttgaatatctgaatgttgatttgatttgcttctagtaatttggagttttgatttgtatttaatcatgggggtcattgtttgcctttttgaatgtgtaaatttcttttaatccaatgactctatcagacaagtggtaaaattttccattattttaagtcctggatatcttttagtaatttccctttttaaaaatatgaagaatctaattacctaaattatgatgtgtaaaatatttgttcactggctaattcattgtgacctataatttaggagttaacccttttgaatgagtgagcctcttggacactccagagctgctgcttagagagaaggttttgggaaaactatccatggaggggatctatgtactaaaattaatggccttgggaagaaatgttaattaaaagtgctgtataatttagccttgcagaaaaagttacaggacaaatataatgtgagttaaattagtcatttattggattattcagtttggctgatgaaatacagatactccttgacttaggatgagatcatgtcccaaagtcgaaaatatcataagtcaaaaatgcatttaataccccggaagacccattgtaaagctgaaaaattgtagttggaaccactgtaagttcagattttcctcatcttgcactagggttacatcccactgaactcattgtaaggtcaaaaaattacaagtctaaccatcctaarttggggaccgtctcatacagtaataggaaaaccattttatcttaccaatttatttaattgttgatagtctacagggctttcttttttctcttgtgagtagcagttttaaaaactamgagatttgttgctaccgaaaagttaaaaatgtwtttgtatgttcacaaatatgtttgtaattatacgtttgcagggttgtaagtttttgtttgtttttaatcttttatagtaaataatcctgattttaaggctggtgtgatggctttggctaacctgcttcagattcagcgtcatgatgattacctggtaatgcttaaggtcagcttcatgttcttgattcttgacagaaactgtgcacatagaaaaatgtctttattttctaaatattaactrttgatattaaaattatggttgaatgactaaaatacacagaagaatatgaaacataaagtagatttcatggttttatctgatttggattctgttttctgcctgcactatgctaaatcctttgcaaagatgttctcattcaatcctgccaacaatcctagagacagctgctaatatctttttaaaaatatatatcatatgaagaaactgagactcaatgaggataatgtctaagatgacacagaaaatgacaragccaggattttaagcactataaccctgtggtccattgtttttcccacattaccctacttctgtttagtkagtctttttaatgattcatagtctgcatttgttaagatggtcgaaaatgccaaatgagtaatggtgaatttggtcaaaaatatataaccccaaaatctctttgagaaatgaatctttctgtccccgatgctagataggccactcagttcataactatacttcaggaatcccagtaatctgaaagaggtctcttgtttctgagagaaatcataaacttcagaagatttattcctagtaatcgtgaaagtacagtggtgtggatcaggggagtggtacttaagataccagacttggaaattttataagagattaaaagcttttaactagaccttgtgcatgtaaactactttgtgataaatatcactctacccagaagagattaagccataacttaccatgctttttagatttttattattaaatgtcagttttaacaagactgttgtattcctaagttattaaaattttctatactgaatctgaatgttaacttggattttctcaatccagattrcatgccaaaagacaaaaatgtttttagtgaaatttagctatttcaaaggcttgttctttattccgacaattatgtaaattgccttggaactgttctatagtgatcatgtcagctttaatcataaagtaagtgagaggagagtcagacaatgcatagcgtatttgggatgcttttgttagacttcaaaacccaaggggataaagtataaatcaactacaacaaaatgctataaaattctagtcctgctgcacatttgtcccttttgagttattttaagaggcattcaaacaatarcataatatggaaaacatcttagtacgtttgccaagtacaagcatcagtatattaactgtttggcaaccagactatttaataacatctgcaataactgttaaacattgtttgaattcggtttttcaaagatagcatttggttttttatttaaaaattatagtttaagttttcacacttatttttgagttgtaattgtcatcttcctaattaaaattccatttttttaaaatttgatttttaagtgtgtatggatacttgcatgcatgcctaccataatgaaatgccttggtgattaaaaccaccaacggtgtcctttgaaaggtttgaaaatattttactagagtgaagtgataaaagcaaagtgtaagacagtatgtatgatctgctaccctttgtgtcaaaaatgtgtattcgtgctaagcatgctcgtcatttcgcagttttagtgagggtaaggaatctgtaggggatcgcaaggctcaggtaggaaggagacctactttttaccatgtgtcttgctgtatttaaagttgttttttaccagtcacgtgcattacctattcaaaaaatggttttaattgttgcaagcaccattcaacattattaaaatactagaagtgtgaaaggttacgttatattagtgggttttttttatttttaatttaatggggagtttattaatgaacttaggtaattctgacttcatcaaaatgagcatccttattctctgggctcatagaagaaaggatgacaggtacacagcctataaaaagtaaaaatatttttgggtttcttaggcaattcggattttggttcaggagcgcctgacacaggatgcagttgctaaggcaaatcaaacaaaagaggtacgtttctataaatcctaaataagttgttaatgaacatttcttctggtatggccrtgattttaaactttgcatrtatctgtttaagatatccattctacgttctacaacttagagaaaggatagcttacttcagtgcttcctaaagcaaattgaatgtattcagtggctagggggkcatttttgagtgaaaaacttcatgttcctctcactttgtaccttaaaaaagccacaaatagctcatgcacagtccacaaatcatgcttgtggcccgttgaagtttatttaaaatgagttacccatatgaaacttactggattattttgactcatgctggagaagaaggaacacacctcactacaaattagttttctttttctatctaaattctatccttgctcttatttcttcagagtaaattcttgttttattcaatttcctggcataaaacatgagaaagtaatttggctaaggtcacctagttggtaagtgactgagctcaggcagtctgacttgagagcctgtgctcttacggtaggtggggagaagggtccatgcgtggatgtctgcatgagcttgtcagtctgcccaggtgaagggacagggggttctgttggagtgtaaggttcaaggtacaggtgactgaaatggtatctttcagtcctaccttgtaggctgagaaaagctatatcccatgactaccttccccttaaagagaaaatatggaacatttttagattatatcagaaatccaaagatgcctaaagtttcactggctgtgcagcggtggagagactgtcctcaggtcagcagcagcagtgtctgataacacctgcctcctgcagcaatgatgttgtagtgaatgccttgggcacaactatgttgtttgtcctccctgcgcccttcccccatctcccaatgccttttgtcctccagcccctttaggcaggccaagcagtgttaaaaggttactaatgccagggcagtatctctgaaagacactgttttcttttaaaggttcttactggctcgttgtatatgaatcgagccactggaagttggrttaaagatcagcttatttcacccwcmctatagaacagacagtaaattgttctggtgtaataaagtcawtcattcatwcattcattccttcagcaaaactatgctttggaaggcagtgtaagtwaaggcttagccaaatctctttgctcttgtttgtaaagtaaaatttagttttatttttaatgctccmaattttaattttggtgtcatctcaaaagataccagcctataacaatttagtggagttcttacagtctagtgtacttataagcatttataactactatttgaggcatatggtagttttcaggggtagcttggtggcctgttggcaaaggaaaaaaaagtggagcctctggtactagatgaacatataaagccactcagtacaattctgctctttaattttgctcacttgtgctttcgtacccattggtttcttcagacttacatgtgttagctgttttaaagcagacagagcctacgtagatttacattactagataaggcaagaattgagcagtgactaaagcatttgaatagtaacaggttgtaacattgaaagattgaaagtacgggtastgtgtttttcttggcagtgattttatataatcagcaggaagtacagactgtcctcattttagaatttgtttctgtgaagtttggcatcaccatagtcaccatctttagtatgtccataggtgctgagtggtttagtttttcattttcctagactgtttgtttcaaagtaacttccaagtcaagtcttgaaagttaaattatacataattatacataatcttggcaaacaccatgctggctgaaaggttcgtacaatttgtaaagacaaattaatgtgctcagaaatggaatataaggtactatttttgccgtttatactgttgcttactgtcgccaaaataagacagtaacagcctggctcaacttgccttccatagcagtaatgacaaggcactgctgcaataaggatatattgttttgtatgcctgggctaaaggattggatgagctatagagcttcctggtacatttaaaggttaacttttccccctaaccggttgaaatagggaaaactcgctaatcacaatcatcacaaagcaaatataaacaaaattcctagttcccttgcccatgcagctaaaagagttaagacaccagaatagctaggtgcttttcagtttcagttgaggaaaggatgctattcttaaccataaatactctcrttttgtctttctttttttaaagggcttacctgttgctttagacaaacatattcttggttttgacacaggaggtaagtgattttgtttaaattcaaactattttttttacagactgaatacttgggaggaaataaataaatggccttaaatgtaaaaattatgtattgaagcagtgttcttttctcataaaacagatgcagttcttaatgaagctgctcaaattctgcgattgctgcacatagaggagctcagagagctacagacaaaaatcaacgaagccatagtagctgttcaggcaattattgctgatccaaagacagaccacagactgggaaaagttggaagatgaacacttgaggacttcagcttctcacctacttagtacagttgggaaccatacacttctggcatgtttggaaatcaaaatgtcacattctcgggggaggaagcccagaaaattgggtatgttctagagatttaccaccattgcttattgcttttttytttaataaagtttaggaaagtagaatttttattatgtactgtatgtttgcataaatcacctttctcctttgtggttaaggcatatatgccaacccccagctttgtcctagagacaatatagatccttaagtcataggaaaacttaaaacactttattggagtaatctagaaaattttaaaattgttacatctttggtatttataaatgtgatactttactttctgtgggtacttctatagaggcactacagratcagaaaatgcaaattgaatcattttagcaccttttgatataaatagaaatgcactgatgcagaggtaaaaaatcttagaacttttgttgggaaactataaataattggtcctttcccatcagttctgcattggcttctccaactgtcaaggtttaggattatawtgttatattgatcacatgtgcttwaatttcttggccagaaggaatccatggcaaaaatcaggtttagagtcttaaactctaattcttagttgaatgaatttgatcttttaaatattaatgataaatgttwacaagawgttgctttaataagcaacagttaaaattctgttacctttttaaacttgcaataacaaccttcatttttaaaaatacagtagtaaagattgaggtatcagcttttcacaaaagtctttttgcactacaaaatgttcatcttggatgctcaggaacgtctaatggccaattccttttttactttctttgcctttgcagtcactgttctttagggtccaggttctgattgtaaactccaagtcttcctttacattactgtacttactttcttcctgtgagagaagagcaggggtgggacagggtggtgggtgagtatattgtaaccaagttgcaacagcaagtctttgcattttgtgtataaactaggtagatttaaggtagtaaagactggccctcagggcaggaagaaggcaatggtggcagtgtcacaggcagcaggggtaatcaaataccatatatatcccttctctaccctgctaatttaaaggagcatcctaaagcatactttttacctgttgggcagtaggggtagactgcagttatcccgtagaggtgagatcgttgttctgggagatactcatcagtaaactggccactatgtttatttactgatacaacaccatccctggtaacagaaaggaagagtgaattcagggacagtcatttactagataaagaagtcagtcagccacagaaaatcagttgcaatagaggaaaatttctggcagccttctctgtcccagggctggtgctaaagccatactgaagtttgaagaccattgctctaaatccattgctcatctctagctgcatgttagaatcacatgatgagctatcaaatcagagttgtagggcatggtgtaaagggcttagactttaatgttccacagttcctcatttgagaactagtctaaatagtatttttcggtccctcagacaatatgtccacagtgtcaaaagccaacttaagccctgtaatatagctcatggtatcaagggtagtcttattctctaaagaacatatttagattaatatgctcccttttgagacattatccaatagctttgctactttttaagctatatgtgagcaataccattcgatttctgggtgaagtaaaaggatgatttcaaaaacatgaaaggatgaaaaacatccttgaaggatcttatctgccaatgaggaggtgatgaaacaaaagcctcagagggcttaatgagtcaagtcaggtactgacttttggtaaaacaagtggtgtgtcctctggaacagttggccttttcaggcttgtccagaatttgtggggctcacctcctccagtctgtgtggtagaagtgatctgcatagcttacgatgctgaaggggtacttgaggttgttttgaatgacacgccgtccagttccatcaggtagtgtacactccagttttttggttccttttaaaacaaagggggaaaatgaggtccttcagctgctttgccaaaaatgatagtgacatagtgatagtgacacagtgatagaatggggaaataggatattttacttccattacagtcatagattagcaactgtaaaattacctgtcctattactagtctccagtttttagtagagattcaaactttcaatccttttttggaagacaggattgcatttactgaaatctggtaagtttctgccaaagtagggcattaaacataattatttttataatttgtgtgatttcaagccttagcttataaattataacatctgggtaaatacttgccctttgtaagctatgtctataattactgaggcaaccttttaaccaaaatccttagtatttttaaaatattttctaggtaggaggaaaaaagtgactaaaatggtaacataactcatatttcaatgtaaaggaatcagtcttaaaaatttttacaatagctaaaccattcaagaatttccaagtttcacatttctcatggagccgatttaaatttcaaatccttttaagaaatgtaacttgttttaaacaactgggttataaaagtgacctatgtacattaggcccttttattagattacaaattcaagaacagtctttttcatattctttagtatagaactagacacacagcattttttcagttgtgctgataaaagcaaacaaatgtaggttgctaatacccatgttattactgaaggaagctaccctgctacaatgctttccaaagaatgtccttagcattataacagatgtttataggtaagttatagtgaccctctccccgcataagaataacttcacttaagtttgtcaattcaacaatggctaattcttttaactgttaaaaatatgccaggcactcatggtcaggcaagcagtacaaacttactgcttgatatatccttccctccacccaaaccccagaaagttcattttaagactcatttactagtacttaaatttactagtacttaaaagtttacagaccaaagaaaggagatctaagtgatgggatttcattttgtagtaaaatctgttagtgctcacattcactgtgatgagaggttatctatttgcattccatcagtagtattacctgcatctgcccagcagagcagtttagagaaagggtcaaaggttaagccattgggcaatccaatgtctgtattgatcagaattcttctgttttctccatctaaagatgacgtttcaattttaggagcttctctattccagtctgtccagtacaagttgctgtaagttaaaaatcaagattgtaaaagaatagccatgtagcctgtggtaggcagcatctaagcagcccccagtgatctccatctcctcatgtattatagccttaagcaatccccttgagtttgggctgcattagtagtgtcttgcttcttctagtgcatagagtatagcagaagtgataggctatcactgccgatattcggtctcaaaaaactggtttctgccttaggggctctctcttgctccctttgagggaagctggatgccatgttgcaagctaccctgtaaaggggaacatgtgccaaggaactgatgtccttgagggctgttggccagagacattagtcttgcctgtagcccatgtgagcatgcttgggctgtgtcttccccgagctgagccttgtgatcactgcagtttggccattacctgattgcagccttgtgagagactccatgcctgagggagctcggtgaagacacacttggattcctgactcacagaaactgtgagactaaatgttatcttacactgctgagggtttgggcaatttcttacacagcagtaggtaactaatacacagccatattccacttttacctgtatcacaaggttttctgattattgtcactatgtgggagaagtcattactaagttactatcagaatccctgcctccaagataccccttgactcaactgccccaaaaccctccgtttgttgaagtcttgaattggatcttgggttttagaatagaaacaaatacagctgttaggaatggcttcgatacaaactatggaacttgaagagatgtggaccagggatttgagaaggaaactgttctttcttctgccaaaaatacaatttggtacttgaaggggtacctggcacccagggatggaaacattttaagttaagcactttaccttttaaatgccacgttaaaaatgaaatatattcataacagatactaacgaggaaatatggtcctattaagtggaaataggttataaggaaacaaacaggtttatcgttagagcagaaataatgttgaaagcactttttataaaatactattttataaaagctatagaagctttgaataaatcagttgggctacagagaacctcagtgagaggagaggaagaaaccataggtttcccctgttgcgaatttcatcccttatgcccaacagatgaagcagagagaagctgagagcaaaagctagaaagcagtttccactttgcgctaaggtggaggtggccagagggtacagcatgcatatcattgcttcatcgcttctgatcagtctcctccccaaaatgatttaatatcatcaacaacaataagtctgaaacaagctcacacagatatttggtgtaaattatttggggattgccagaggaagaaagttgtaaaggtgaaatctatagaaagcaaatgagaaatatgcaggaaggcttgacaaccattctgttacgcagttgaaggagatgtaattacatgtgttatattgcaacctggttcaaggtgggttttctttttattaaaaattcaagtcctttagcatttatatttgctgtctggataagaaagttctactttcatatttaaactcatggctgtgatgtggatttcagcttaaaagtatgctttttccccagactccagagacatggccaaagtttcattgcctacaagatggcagctctccccagttttcaggtcaagcaccaagaaggaataaggggccgggcgcagtggctcatacctataatcccagcactttgggaggccaaggcaggtggatcacccagggtcaggagttggagaccaaaatggcgaaaccctgtctcgactaaaaatacaaaaattagctgggcatggtggcacatgcctgtagtcccagctacttgggaggctgaggcaggagaattgcttgaacccgggagatggaggttgtagtcagccgagactgtgccactgcaccccagcctcggcaacaaagcaagaccttgtctcaaaaaaaagaaaaaaaaaagaaaaaaggaccttccaaatgtccaaatgtcagaaaggcaagcctatgcaaagagtttttaagagggctattaattcctgttaagtcaactggaatagagaaggatacaggtacttttcctgtgtgtagaacccaaagtttgaaaccacctttgaggcactgcactaagtatttcatagtcaaaaagcacttacctgaaaattaaagctgaaggttttctttactgatttgaagggcatctgggaatttcatttcgtagaaactccacttaaacatggcaagagtttctcaagatataaaaattctccctgattgtaacaagtactgagacagtgaacaaatcctgtatgtcacatttgatgaccttagcaattatacagacagggaaaatgtttatcttgatttctgctacagcaacactgaagccagaggtgtctgagctttggctaatgtcacttgatgtaggtcagccctactgtgagygtcaaccctggtttctaaatgtgctgctggaggaatcccacttcacttccagtttaagtgtcagctgaggcctcgcctgatcatttgattcagagtagccctagttctcacaacactatctgaattttctacatatcacatcacagactaatattgtttataccagtcttgtttcctcctaataaaatataagtgccatgaaagaacagaccttgtcttttcctagaacaggtcctgacacctcttagatcctcagtaaatctttgttacatgaatgcatttgagctttcactctcttgttctgaccttccccacattgtatttaaaacccaagggcttcacatcaggatctacaggtaagagaagaattagggaagcccagctgaccctcggattggatccacagcgatggcacggggattcaccagatctgtgtagaagaggaccttgcgctcagagccatccagcagggcgctctctatcttatccaggacactgtccgtccagtacattgttctgcggatgtggtctatggcaagtccttcagggcttatcagacctggaaataaagcaaagtcaggactggagtgtttgcaggatatggagggcaaacctgaagccctccaacrgtcgggtgggcaggggggtcagcaggggaaagcaaagcccaagtgtctccaagtccccaagaaccaggttaatagagaaacaagtacttttgttacatattccactacctctagcttctagaccagcagacctaccagtttgatgacaaccggcatccacagtgccagagccaggctgaataaacgaaggcgtcaccctgaattcttaccatgaattcttttaagaagtgcgcacagtaggaatcacctatttcattccgtatgtatgaaggtgtttgcttacagagggggctagtcttatacagctcaataaaatgacttgcct
